United States Patent 12,606,815 (SELF-DIVERSIFYING SYSTEMS AND METHODS OF USE THEREOF) - sequence listing, part 3

SEQ ID NO: 825 - DNA, 4000 bp, Escherichia coli
  misc_feature (1)..(2): n is a, c, g, or t
  misc_feature (4)..(4): n is a, c, g, or t
  misc_feature (7)..(7): n is a, c, g, or t
  misc_feature (9)..(9): n is a, c, g, or t
  misc_feature (11)..(12): n is a, c, g, or t
  misc_feature (18)..(18): n is a, c, g, or t
  misc_feature (22)..(24): n is a, c, g, or t
  misc_feature (27)..(27): n is a, c, g, or t
  misc_feature (29)..(30): n is a, c, g, or t
  misc_feature (32)..(34): n is a, c, g, or t
  misc_feature (36)..(36): n is a, c, g, or t
  misc_feature (38)..(38): n is a, c, g, or t
  misc_feature (40)..(42): n is a, c, g, or t
  misc_feature (49)..(49): n is a, c, g, or t
  misc_feature (51)..(51): n is a, c, g, or t
  misc_feature (55)..(58): n is a, c, g, or t
  misc_feature (60)..(60): n is a, c, g, or t
  misc_feature (62)..(62): n is a, c, g, or t
  misc_feature (64)..(64): n is a, c, g, or t
  misc_feature (66)..(67): n is a, c, g, or t
  misc_feature (70)..(70): n is a, c, g, or t
  misc_feature (74)..(75): n is a, c, g, or t
  misc_feature (77)..(82): n is a, c, g, or t
  misc_feature (84)..(86): n is a, c, g, or t
  misc_feature (88)..(89): n is a, c, g, or t
  misc_feature (92)..(92): n is a, c, g, or t
  misc_feature (94)..(95): n is a, c, g, or t
  misc_feature (99)..(99): n is a, c, g, or t
  misc_feature (103)..(105): n is a, c, g, or t
  misc_feature (107)..(107): n is a, c, g, or t
  misc_feature (109)..(110): n is a, c, g, or t
  misc_feature (113)..(114): n is a, c, g, or t
  misc_feature (116)..(116): n is a, c, g, or t
  misc_feature (119)..(119): n is a, c, g, or t
  misc_feature (127)..(128): n is a, c, g, or t
  misc_feature (131)..(135): n is a, c, g, or t
  misc_feature (140)..(141): n is a, c, g, or t
  misc_feature (143)..(144): n is a, c, g, or t
  misc_feature (146)..(146): n is a, c, g, or t
  misc_feature (149)..(154): n is a, c, g, or t
  misc_feature (160)..(160): n is a, c, g, or t
  misc_feature (162)..(164): n is a, c, g, or t
  misc_feature (166)..(168): n is a, c, g, or t
  misc_feature (171)..(171): n is a, c, g, or t
  misc_feature (176)..(176): n is a, c, g, or t
  misc_feature (178)..(178): n is a, c, g, or t
  misc_feature (180)..(180): n is a, c, g, or t
  misc_feature (182)..(183): n is a, c, g, or t
  misc_feature (185)..(188): n is a, c, g, or t
  misc_feature (190)..(190): n is a, c, g, or t
  misc_feature (192)..(192): n is a, c, g, or t
  misc_feature (194)..(195): n is a, c, g, or t
  misc_feature (197)..(201): n is a, c, g, or t
  misc_feature (203)..(206): n is a, c, g, or t
  misc_feature (209)..(209): n is a, c, g, or t
  misc_feature (213)..(213): n is a, c, g, or t
  misc_feature (215)..(216): n is a, c, g, or t
  misc_feature (218)..(218): n is a, c, g, or t
  misc_feature (220)..(220): n is a, c, g, or t
  misc_feature (223)..(223): n is a, c, g, or t
  misc_feature (227)..(227): n is a, c, g, or t
  misc_feature (232)..(235): n is a, c, g, or t
  misc_feature (239)..(239): n is a, c, g, or t
  misc_feature (241)..(243): n is a, c, g, or t
  misc_feature (245)..(246): n is a, c, g, or t
  misc_feature (250)..(260): n is a, c, g, or t
  misc_feature (264)..(264): n is a, c, g, or t
  misc_feature (266)..(267): n is a, c, g, or t
  misc_feature (269)..(272): n is a, c, g, or t
  misc_feature (274)..(274): n is a, c, g, or t
  misc_feature (276)..(277): n is a, c, g, or t
  misc_feature (279)..(279): n is a, c, g, or t
  misc_feature (281)..(283): n is a, c, g, or t
  misc_feature (285)..(287): n is a, c, g, or t
  misc_feature (289)..(290): n is a, c, g, or t
  misc_feature (292)..(292): n is a, c, g, or t
  misc_feature (294)..(296): n is a, c, g, or t
  misc_feature (298)..(298): n is a, c, g, or t
  misc_feature (301)..(301): n is a, c, g, or t
  misc_feature (305)..(305): n is a, c, g, or t
  misc_feature (311)..(316): n is a, c, g, or t
  misc_feature (318)..(318): n is a, c, g, or t
  misc_feature (321)..(323): n is a, c, g, or t
  misc_feature (325)..(327): n is a, c, g, or t
  misc_feature (329)..(330): n is a, c, g, or t
  misc_feature (332)..(333): n is a, c, g, or t
  misc_feature (337)..(339): n is a, c, g, or t
  misc_feature (341)..(342): n is a, c, g, or t
  misc_feature (344)..(344): n is a, c, g, or t
  misc_feature (346)..(346): n is a, c, g, or t
  misc_feature (349)..(350): n is a, c, g, or t
  misc_feature (352)..(352): n is a, c, g, or t
  misc_feature (354)..(356): n is a, c, g, or t
  misc_feature (358)..(358): n is a, c, g, or t
  misc_feature (360)..(362): n is a, c, g, or t
  misc_feature (365)..(365): n is a, c, g, or t
  misc_feature (367)..(368): n is a, c, g, or t
  misc_feature (370)..(371): n is a, c, g, or t
  misc_feature (373)..(375): n is a, c, g, or t
  misc_feature (377)..(377): n is a, c, g, or t
  misc_feature (384)..(384): n is a, c, g, or t
  misc_feature (388)..(392): n is a, c, g, or t
  misc_feature (394)..(394): n is a, c, g, or t
  misc_feature (396)..(396): n is a, c, g, or t
  misc_feature (400)..(400): n is a, c, g, or t
  misc_feature (402)..(413): n is a, c, g, or t
  misc_feature (415)..(418): n is a, c, g, or t
  misc_feature (420)..(421): n is a, c, g, or t
  misc_feature (423)..(424): n is a, c, g, or t
  misc_feature (426)..(426): n is a, c, g, or t
  misc_feature (428)..(428): n is a, c, g, or t
  misc_feature (430)..(432): n is a, c, g, or t
  misc_feature (435)..(438): n is a, c, g, or t
  misc_feature (440)..(440): n is a, c, g, or t
  misc_feature (443)..(444): n is a, c, g, or t
  misc_feature (448)..(450): n is a, c, g, or t
  misc_feature (453)..(453): n is a, c, g, or t
  misc_feature (455)..(458): n is a, c, g, or t
  misc_feature (460)..(460): n is a, c, g, or t
  misc_feature (462)..(464): n is a, c, g, or t
  misc_feature (468)..(474): n is a, c, g, or t
  misc_feature (477)..(477): n is a, c, g, or t
  misc_feature (479)..(480): n is a, c, g, or t
  misc_feature (482)..(485): n is a, c, g, or t
  misc_feature (488)..(493): n is a, c, g, or t
  misc_feature (495)..(497): n is a, c, g, or t
  misc_feature (499)..(499): n is a, c, g, or t
  misc_feature (501)..(501): n is a, c, g, or t
  misc_feature (503)..(504): n is a, c, g, or t
  misc_feature (506)..(506): n is a, c, g, or t
  misc_feature (509)..(509): n is a, c, g, or t
  misc_feature (511)..(512): n is a, c, g, or t
  misc_feature (518)..(519): n is a, c, g, or t
  misc_feature (521)..(521): n is a, c, g, or t
  misc_feature (523)..(523): n is a, c, g, or t
  misc_feature (527)..(529): n is a, c, g, or t
  misc_feature (532)..(535): n is a, c, g, or t
  misc_feature (537)..(537): n is a, c, g, or t
  misc_feature (539)..(545): n is a, c, g, or t
  misc_feature (547)..(552): n is a, c, g, or t
  misc_feature (554)..(557): n is a, c, g, or t
  misc_feature (559)..(561): n is a, c, g, or t
  misc_feature (563)..(563): n is a, c, g, or t
  misc_feature (566)..(566): n is a, c, g, or t
  misc_feature (570)..(572): n is a, c, g, or t
  misc_feature (574)..(574): n is a, c, g, or t
  misc_feature (576)..(576): n is a, c, g, or t
  misc_feature (578)..(581): n is a, c, g, or t
  misc_feature (590)..(592): n is a, c, g, or t
  misc_feature (594)..(595): n is a, c, g, or t
  misc_feature (598)..(598): n is a, c, g, or t
  misc_feature (600)..(602): n is a, c, g, or t
  misc_feature (604)..(604): n is a, c, g, or t
  misc_feature (607)..(618): n is a, c, g, or t
  misc_feature (621)..(623): n is a, c, g, or t
  misc_feature (625)..(630): n is a, c, g, or t
  misc_feature (633)..(633): n is a, c, g, or t
  misc_feature (635)..(635): n is a, c, g, or t
  misc_feature (638)..(638): n is a, c, g, or t
  misc_feature (641)..(642): n is a, c, g, or t
  misc_feature (646)..(647): n is a, c, g, or t
  misc_feature (650)..(650): n is a, c, g, or t
  misc_feature (652)..(652): n is a, c, g, or t
  misc_feature (655)..(657): n is a, c, g, or t
  misc_feature (660)..(661): n is a, c, g, or t
  misc_feature (663)..(663): n is a, c, g, or t
  misc_feature (665)..(665): n is a, c, g, or t
  misc_feature (667)..(674): n is a, c, g, or t
  misc_feature (676)..(678): n is a, c, g, or t
  misc_feature (681)..(689): n is a, c, g, or t
  misc_feature (691)..(697): n is a, c, g, or t
  misc_feature (699)..(700): n is a, c, g, or t
  misc_feature (702)..(702): n is a, c, g, or t
  misc_feature (704)..(704): n is a, c, g, or t
  misc_feature (707)..(707): n is a, c, g, or t
  misc_feature (709)..(711): n is a, c, g, or t
  misc_feature (717)..(717): n is a, c, g, or t
  misc_feature (719)..(719): n is a, c, g, or t
  misc_feature (722)..(723): n is a, c, g, or t
  misc_feature (725)..(727): n is a, c, g, or t
  misc_feature (730)..(734): n is a, c, g, or t
  misc_feature (737)..(739): n is a, c, g, or t
  misc_feature (741)..(741): n is a, c, g, or t
  misc_feature (743)..(745): n is a, c, g, or t
  misc_feature (747)..(755): n is a, c, g, or t
  misc_feature (757)..(759): n is a, c, g, or t
  misc_feature (762)..(771): n is a, c, g, or t
  misc_feature (773)..(773): n is a, c, g, or t
  misc_feature (777)..(777): n is a, c, g, or t
  misc_feature (780)..(780): n is a, c, g, or t
  misc_feature (782)..(785): n is a, c, g, or t
  misc_feature (787)..(789): n is a, c, g, or t
  misc_feature (791)..(792): n is a, c, g, or t
  misc_feature (794)..(796): n is a, c, g, or t
  misc_feature (799)..(806): n is a, c, g, or t
  misc_feature (808)..(819): n is a, c, g, or t
  misc_feature (822)..(825): n is a, c, g, or t
  misc_feature (827)..(827): n is a, c, g, or t
  misc_feature (854)..(854): n is a, c, g, or t
  misc_feature (866)..(878): n is a, c, g, or t
  misc_feature (881)..(881): n is a, c, g, or t
  misc_feature (883)..(884): n is a, c, g, or t
  misc_feature (887)..(889): n is a, c, g, or t
  misc_feature (892)..(893): n is a, c, g, or t
  misc_feature (932)..(938): n is a, c, g, or t
  misc_feature (940)..(943): n is a, c, g, or t
  misc_feature (945)..(945): n is a, c, g, or t
  misc_feature (947)..(960): n is a, c, g, or t
  misc_feature (997)..(1012): n is a, c, g, or t
  misc_feature (1014)..(1023): n is a, c, g, or t
  misc_feature (1025)..(1026): n is a, c, g, or t
  misc_feature (1063)..(1073): n is a, c, g, or t
  misc_feature (1075)..(1077): n is a, c, g, or t
  misc_feature (1079)..(1086): n is a, c, g, or t
  misc_feature (1088)..(1092): n is a, c, g, or t
  misc_feature (1129)..(1129): n is a, c, g, or t
  misc_feature (1132)..(1136): n is a, c, g, or t
  misc_feature (1138)..(1147): n is a, c, g, or t
  misc_feature (1149)..(1150): n is a, c, g, or t
  misc_feature (1152)..(1152): n is a, c, g, or t
  misc_feature (1154)..(1158): n is a, c, g, or t
  misc_feature (1195)..(1204): n is a, c, g, or t
  misc_feature (1206)..(1211): n is a, c, g, or t
  misc_feature (1215)..(1218): n is a, c, g, or t
  misc_feature (1220)..(1221): n is a, c, g, or t
  misc_feature (1224)..(1224): n is a, c, g, or t
  misc_feature (1261)..(1266): n is a, c, g, or t
  misc_feature (1268)..(1268): n is a, c, g, or t
  misc_feature (1270)..(1278): n is a, c, g, or t
  misc_feature (1280)..(1280): n is a, c, g, or t
  misc_feature (1283)..(1286): n is a, c, g, or t
  misc_feature (1288)..(1290): n is a, c, g, or t
  misc_feature (1327)..(1329): n is a, c, g, or t
  misc_feature (1331)..(1335): n is a, c, g, or t
  misc_feature (1337)..(1339): n is a, c, g, or t
  misc_feature (1341)..(1345): n is a, c, g, or t
  misc_feature (1347)..(1347): n is a, c, g, or t
  misc_feature (1349)..(1351): n is a, c, g, or t
  misc_feature (1354)..(1354): n is a, c, g, or t
  misc_feature (1356)..(1356): n is a, c, g, or t
  misc_feature (1393)..(1400): n is a, c, g, or t
  misc_feature (1402)..(1407): n is a, c, g, or t
  misc_feature (1409)..(1413): n is a, c, g, or t
  misc_feature (1415)..(1415): n is a, c, g, or t
  misc_feature (1417)..(1418): n is a, c, g, or t
  misc_feature (1420)..(1420): n is a, c, g, or t
  misc_feature (1422)..(1422): n is a, c, g, or t
  misc_feature (1460)..(1460): n is a, c, g, or t
  misc_feature (1462)..(1466): n is a, c, g, or t
  misc_feature (1468)..(1472): n is a, c, g, or t
  misc_feature (1474)..(1475): n is a, c, g, or t
  misc_feature (1477)..(1477): n is a, c, g, or t
  misc_feature (1479)..(1488): n is a, c, g, or t
  misc_feature (1525)..(1528): n is a, c, g, or t
  misc_feature (1530)..(1535): n is a, c, g, or t
  misc_feature (1537)..(1539): n is a, c, g, or t
  misc_feature (1541)..(1542): n is a, c, g, or t
  misc_feature (1544)..(1544): n is a, c, g, or t
  misc_feature (1546)..(1546): n is a, c, g, or t
  misc_feature (1548)..(1550): n is a, c, g, or t
  misc_feature (1552)..(1554): n is a, c, g, or t
  misc_feature (1591)..(1591): n is a, c, g, or t
  misc_feature (1593)..(1594): n is a, c, g, or t
  misc_feature (1596)..(1600): n is a, c, g, or t
  misc_feature (1602)..(1602): n is a, c, g, or t
  misc_feature (1604)..(1617): n is a, c, g, or t
  misc_feature (1619)..(1620): n is a, c, g, or t
  misc_feature (1657)..(1661): n is a, c, g, or t
  misc_feature (1663)..(1664): n is a, c, g, or t
  misc_feature (1668)..(1671): n is a, c, g, or t
  misc_feature (1674)..(1677): n is a, c, g, or t
  misc_feature (1679)..(1680): n is a, c, g, or t
  misc_feature (1682)..(1682): n is a, c, g, or t
  misc_feature (1684)..(1686): n is a, c, g, or t
  misc_feature (1723)..(1723): n is a, c, g, or t
  misc_feature (1725)..(1726): n is a, c, g, or t
  misc_feature (1728)..(1728): n is a, c, g, or t
  misc_feature (1730)..(1730): n is a, c, g, or t
  misc_feature (1733)..(1736): n is a, c, g, or t
  misc_feature (1738)..(1743): n is a, c, g, or t
  misc_feature (1745)..(1749): n is a, c, g, or t
  misc_feature (1751)..(1752): n is a, c, g, or t
  misc_feature (1789)..(1792): n is a, c, g, or t
  misc_feature (1795)..(1800): n is a, c, g, or t
  misc_feature (1802)..(1803): n is a, c, g, or t
  misc_feature (1806)..(1808): n is a, c, g, or t
  misc_feature (1810)..(1810): n is a, c, g, or t
  misc_feature (1812)..(1815): n is a, c, g, or t
  misc_feature (1856)..(1857): n is a, c, g, or t
  misc_feature (1859)..(1860): n is a, c, g, or t
  misc_feature (1862)..(1866): n is a, c, g, or t
  misc_feature (1868)..(1868): n is a, c, g, or t
  misc_feature (1870)..(1879): n is a, c, g, or t
  misc_feature (1881)..(1881): n is a, c, g, or t
  misc_feature (1883)..(1884): n is a, c, g, or t
  misc_feature (1922)..(1926): n is a, c, g, or t
  misc_feature (1929)..(1929): n is a, c, g, or t
  misc_feature (1934)..(1938): n is a, c, g, or t
  misc_feature (1940)..(1943): n is a, c, g, or t
  misc_feature (1945)..(1950): n is a, c, g, or t
  misc_feature (1989)..(1992): n is a, c, g, or t
  misc_feature (1994)..(1995): n is a, c, g, or t
  misc_feature (1997)..(1997): n is a, c, g, or t
  misc_feature (2000)..(2008): n is a, c, g, or t
  misc_feature (2011)..(2014): n is a, c, g, or t
  misc_feature (2016)..(2016): n is a, c, g, or t
  misc_feature (2380)..(2381): n is a, c, g, or t
  misc_feature (2633)..(2633): n is a, c, g, or t
nnanacntnanntcaaangaannnaancnntnnntngntnnnctacccntnaaannnncncnananncanactnngnnnnnntnnntnntancnntttnactnnntnannacnntntanaattgcannatnnnnnaactnnannanatnnnnnnatatcntnnngnnngtntgacnancntnnannnntncncnntnnnnnannnngtntatnannancngcngaancatannnntttnannncnntttnnnnnnnnnnnatantnnannnnananncntnnnannngnntntnnnancantttnactacnnnnnnanatnnnannntnntnnaacnnnannancnttnntnannntntnnnaananntnnannncnctttaanattnnnnnanantcanannnnnnnnnnnntnnnntnnanntntnannngtnnnncnacnntttnnnatngnnnnanannnaaannnnnnnaanannannnngannnnnngnnnantntnncnacncnntaaaanngnancatnnncannnnangnnnnnnntnnnnnnannnnannngnagnttgnnnancntnnnnaattgcacnnnanncanannntnaannnnnnnnnnnnagnnnannnnnngtntnacnacnntttnnaantncannntanncnancnnnnnnnntnnnatnnnnnnnnntnnnnnnntnngncnacncnnnaaaatngnacnntnnncannnnnaannnanannnannnnnnnnnannntcnnnnnnnnnncncttnaanannnnannntnntnnnacnnnnnnnntnnnnnnnnnnnnctnnnnanagtttgactaccctttaaaattgcacnatactcaaacgnnnnnnnnnnnnngtntnnttnnngcnnagtttgactaccctttaaaattgcaccatactcaaacannnnnnntnnnntntnnnnnnnnnnnnnngtttgactaccctttaaaattgcaccatactcaaacnnnnnnnnnnnnnnnngnnnnnnnnnntnngtttgactaccctttaaaattgcaccatactcaaacnnnnnnnnnnncnnnannnnnnnntnnnnngtttgactaccctttaaaattgcaccatactcaaacntannnnngnnnnnnnnnnanngnannnnngtttgactaccctttaaaattgcaccatactcaaacnnnnnnnnnngnnnnnnaacnnnncnnaangtttgactaccctttaaaattgcaccatactcaaacnnnnnnantnnnnnnnnngntannnncnnngtttgactaccctttaaaattgcaccatactcaaacnnncnnnnngnnngnnnnncncnnngtntngtttgactaccctttaaaattgcaccatactcaaacnnnnnnnntnnnnnntnnnnnangnntnangtttgactaccctttaaaattgcaccatactcaaacancnnnnntnnnnngnngngnnnnnnnnnngtttgactaccctttaaaattgcaccatactcaaacnnnngnnnnnntnnntnntntngnnntnnngtttgactaccctttaaaattgcaccatactcaaacncnntnnnnnangnnnnnnnnnnnnnntnngtttgactaccctttaaaattgcaccatactcaaacnnnnnanntttnnnnttnnnnanntntnnngtttgactaccctttaaaattgcaccatactcaaacngnncntngannnncnnnnnnannnnnanngtttgactaccctttaaaattgcaccatactcaaacnnnncgnnnnnntnntannncncnnnnatagtttgactaccctttaaaattgcaccatactcaaacgnnannannnnntntnnnnnnnnnntngnngtttgactaccctttaaaattgcaccatactcaaaccnnnnnccnaatcnnnnncnnnnannnnnngtttgactaccctttaaaattgcaccatactcaaactcnnnncnngnctnnnnnnnnnaannnncngtttgactaccctttaaaattgcaccatactcaaacctcaaacctcaaatcagagtatttttacgcaccacacgcatcaattcaaaggacagaatgcaattatttatattatagcataaaatcttattcagacaatgatttcgcacaaatctttgtcaatcaaagtgacaaattcttcgtctgttttatttttcaaagtattttccaaaagaaagagacaaacatcctccagctgcgcctcatagtaaagacttttcaaatccttttcgtttaaaaagttttttagattgaagaaggcaaaacattttatccccaaaatccgcgcattaaaatgaataaaagaaactatagactccaacaaacnntccttttcatccttccagcgcactccgtatgcttttaaaagctgagtcaaactgctttccgtatcaaaatctatcggaaaatccgtttctccgttcagtttttcaaaaaaagcataaatcttctcaacaagttccgaatactcgacggcaaagttgttttcggcaatttgcaccaaacaatttaacaatccgtcccgcgcgcgtttgtctcccaaatcaaaattgaaaaaatcatacagcaattttacgtcnttgactaaggatagtttggtatcgccgtcaaaaagaacaaagtttcccgaattgcctttggattgcagtgcaaattctttgcaaaaatcgaaaaacttgttttcgttttccactacaaggacattgactacggcaggcgtcagctccaacggcttttccaagtcaaaatgagacagaatcacagaaccaccaacctttcggcggtgtctacaaccgtcgattgtttctttccgagaacaaattccatattttcaaattgtctttcggtaacggtaagcatctgaatcagccctttgcccgttttgagttttcttactgtttcttttatcacgtttgcggcggtgttgttcagtattattttggaataaacggattcctgcatcatgaaaaaaccgtttttcaaaagcgcggcgcgaaaccttctgtaatcgcgtcgttcctccgccgtttccgtaggcaaatcaaaaaaaaccactacccgcataaacctaaaactcatattcctttatttttgacgtatccccgtcttccaacgcgttgaaaacgctcttggcatatatagcgattgcatcgtttacaacaaaatatttgtcgtctatctttatttctctgttgagaatatcgcaaaggtatcgtttgaaatccggcgtaagttggcaattatcctttccgaataccgctttgtccacaatcaccctgaaaggctccaccaaatcacagctcagattgaattgattgaactcgcttttgtgcgccaatccgagctgtgtattgaaacccaatcccgcgatttccctgttgaacgcagacagcaaaatggtatatccatagttcaacgccccgttcagaaaggttttgtctcctcttttaaagctcaatccgaacaatgcgtcgaagtatacctttgccgcgtgtccttcacggttggttctgtcattcaattcggtaccgtcgacataacttttcaaaagctcgctctgaggacagcaaagttcggaaagaaattccatctgcttttttattttcatacgtacaatcgccgtccacaccgcgcttttatgttcttctttccaattgagctgccgccgcaaaactccgctgcaatcatgtcttccgtaaagcggcaacagctgtgaaaccggattgtgattttcgtcgcaaaacaaaacgttgactttgttttttattaactcgctcaacaaagctgccgtcaaagaaaccgcggtagactccaccacaagcgaggatatctcgttaagaaacaactttttgacttcttcgccgcgacagacgagatatcccagcttgtattccaacttgcaacgcccccttaccactacaacccgccagctcataggaaccgcttg

SEQ ID NO: 826 - DNA, 4000 bp, Escherichia coli
  misc_feature (344)..(344): n is a, c, g, or t
  misc_feature (366)..(366): n is a, c, g, or t
  misc_feature (381)..(381): n is a, c, g, or t
  misc_feature (390)..(390): n is a, c, g, or t
  misc_feature (393)..(393): n is a, c, g, or t
  misc_feature (402)..(402): n is a, c, g, or t
  misc_feature (408)..(408): n is a, c, g, or t
  misc_feature (417)..(417): n is a, c, g, or t
  misc_feature (435)..(435): n is a, c, g, or t
  misc_feature (477)..(477): n is a, c, g, or t
  misc_feature (483)..(483): n is a, c, g, or t
  misc_feature (1029)..(1029): n is a, c, g, or t
  misc_feature (1404)..(1404): n is a, c, g, or t
  misc_feature (1485)..(1485): n is a, c, g, or t
  misc_feature (1965)..(1965): n is a, c, g, or t
  misc_feature (1988)..(1988): n is a, c, g, or t
  misc_feature (2014)..(2014): n is a, c, g, or t
  misc_feature (2119)..(2119): n is a, c, g, or t
  misc_feature (2134)..(2134): n is a, c, g, or t
  misc_feature (2143)..(2143): n is a, c, g, or t
  misc_feature (2155)..(2155): n is a, c, g, or t
  misc_feature (2176)..(2176): n is a, c, g, or t
  misc_feature (2181)..(2182): n is a, c, g, or t
  misc_feature (2200)..(2200): n is a, c, g, or t
  misc_feature (2224)..(2224): n is a, c, g, or t
  misc_feature (2251)..(2251): n is a, c, g, or t
  misc_feature (2278)..(2278): n is a, c, g, or t
  misc_feature (2293)..(2293): n is a, c, g, or t
  misc_feature (2296)..(2296): n is a, c, g, or t
  misc_feature (2298)..(2298): n is a, c, g, or t
  misc_feature (2309)..(2309): n is a, c, g, or t
  misc_feature (2327)..(2327): n is a, c, g, or t
  misc_feature (2350)..(2350): n is a, c, g, or t
  misc_feature (2400)..(2402): n is a, c, g, or t
  misc_feature (2481)..(2483): n is a, c, g, or t
  misc_feature (2485)..(2485): n is a, c, g, or t
  misc_feature (2488)..(2490): n is a, c, g, or t
  misc_feature (2493)..(2493): n is a, c, g, or t
  misc_feature (2497)..(2500): n is a, c, g, or t
  misc_feature (2502)..(2504): n is a, c, g, or t
  misc_feature (2506)..(2506): n is a, c, g, or t
  misc_feature (2508)..(2511): n is a, c, g, or t
  misc_feature (2515)..(2526): n is a, c, g, or t
  misc_feature (2528)..(2528): n is a, c, g, or t
  misc_feature (2530)..(2531): n is a, c, g, or t
  misc_feature (2533)..(2535): n is a, c, g, or t
  misc_feature (2538)..(2539): n is a, c, g, or t
  misc_feature (2541)..(2545): n is a, c, g, or t
  misc_feature (2548)..(2551): n is a, c, g, or t
  misc_feature (2553)..(2555): n is a, c, g, or t
  misc_feature (2557)..(2560): n is a, c, g, or t
  misc_feature (2562)..(2563): n is a, c, g, or t
  misc_feature (2565)..(2570): n is a, c, g, or t
  misc_feature (2572)..(2578): n is a, c, g, or t
  misc_feature (2580)..(2586): n is a, c, g, or t
  misc_feature (2588)..(2609): n is a, c, g, or t
  misc_feature (2611)..(2618): n is a, c, g, or t
  misc_feature (2620)..(2631): n is a, c, g, or t
  misc_feature (2634)..(2660): n is a, c, g, or t
  misc_feature (2662)..(2665): n is a, c, g, or t
  misc_feature (2667)..(2678): n is a, c, g, or t
  misc_feature (2680)..(2686): n is a, c, g, or t
  misc_feature (2689)..(2701): n is a, c, g, or t
  misc_feature (2703)..(2717): n is a, c, g, or t
  misc_feature (2719)..(2734): n is a, c, g, or t
  misc_feature (2736)..(2736): n is a, c, g, or t
  misc_feature (2738)..(2743): n is a, c, g, or t
  misc_feature (2745)..(2745): n is a, c, g, or t
  misc_feature (2747)..(2752): n is a, c, g, or t
  misc_feature (2754)..(2754): n is a, c, g, or t
  misc_feature (2756)..(2760): n is a, c, g, or t
  misc_feature (2762)..(2780): n is a, c, g, or t
  misc_feature (2782)..(2789): n is a, c, g, or t
  misc_feature (2791)..(2802): n is a, c, g, or t
  misc_feature (2804)..(2829): n is a, c, g, or t
  misc_feature (2831)..(2832): n is a, c, g, or t
  misc_feature (2834)..(2857): n is a, c, g, or t
  misc_feature (2859)..(2863): n is a, c, g, or t
  misc_feature (2865)..(2879): n is a, c, g, or t
  misc_feature (2881)..(2895): n is a, c, g, or t
  misc_feature (2898)..(2900): n is a, c, g, or t
  misc_feature (2902)..(2907): n is a, c, g, or t
  misc_feature (2909)..(2918): n is a, c, g, or t
  misc_feature (2920)..(2926): n is a, c, g, or t
  misc_feature (2928)..(2930): n is a, c, g, or t
  misc_feature (2932)..(2934): n is a, c, g, or t
  misc_feature (2936)..(2936): n is a, c, g, or t
  misc_feature (2938)..(2940): n is a, c, g, or t
  misc_feature (2942)..(2945): n is a, c, g, or t
  misc_feature (2947)..(2949): n is a, c, g, or t
  misc_feature (2951)..(2952): n is a, c, g, or t
  misc_feature (2954)..(2956): n is a, c, g, or t
  misc_feature (2958)..(2966): n is a, c, g, or t
  misc_feature (2968)..(2977): n is a, c, g, or t
  misc_feature (2980)..(2981): n is a, c, g, or t
  misc_feature (2983)..(2983): n is a, c, g, or t
  misc_feature (2985)..(2989): n is a, c, g, or t
  misc_feature (2991)..(2999): n is a, c, g, or t
  misc_feature (3001)..(3003): n is a, c, g, or t
  misc_feature (3005)..(3006): n is a, c, g, or t
  misc_feature (3008)..(3014): n is a, c, g, or t
  misc_feature (3018)..(3021): n is a, c, g, or t
  misc_feature (3023)..(3024): n is a, c, g, or t
  misc_feature (3026)..(3029): n is a, c, g, or t
  misc_feature (3031)..(3038): n is a, c, g, or t
  misc_feature (3041)..(3046): n is a, c, g, or t
  misc_feature (3049)..(3049): n is a, c, g, or t
  misc_feature (3051)..(3057): n is a, c, g, or t
  misc_feature (3059)..(3079): n is a, c, g, or t
  misc_feature (3083)..(3088): n is a, c, g, or t
  misc_feature (3090)..(3092): n is a, c, g, or t
  misc_feature (3094)..(3094): n is a, c, g, or t
  misc_feature (3096)..(3096): n is a, c, g, or t
  misc_feature (3098)..(3112): n is a, c, g, or t
  misc_feature (3115)..(3115): n is a, c, g, or t
  misc_feature (3117)..(3129): n is a, c, g, or t
  misc_feature (3131)..(3137): n is a, c, g, or t
  misc_feature (3139)..(3139): n is a, c, g, or t
  misc_feature (3141)..(3148): n is a, c, g, or t
  misc_feature (3150)..(3163): n is a, c, g, or t
  misc_feature (3165)..(3165): n is a, c, g, or t
  misc_feature (3167)..(3185): n is a, c, g, or t
  misc_feature (3187)..(3196): n is a, c, g, or t
  misc_feature (3199)..(3215): n is a, c, g, or t
  misc_feature (3217)..(3222): n is a, c, g, or t
  misc_feature (3224)..(3232): n is a, c, g, or t
  misc_feature (3234)..(3234): n is a, c, g, or t
  misc_feature (3236)..(3252): n is a, c, g, or t
  misc_feature (3255)..(3269): n is a, c, g, or t
  misc_feature (3272)..(3276): n is a, c, g, or t
  misc_feature (3278)..(3284): n is a, c, g, or t
  misc_feature (3286)..(3292): n is a, c, g, or t
  misc_feature (3294)..(3304): n is a, c, g, or t
  misc_feature (3306)..(3306): n is a, c, g, or t
  misc_feature (3308)..(3311): n is a, c, g, or t
  misc_feature (3314)..(3325): n is a, c, g, or t
  misc_feature (3327)..(3347): n is a, c, g, or t
  misc_feature (3350)..(3350): n is a, c, g, or t
  misc_feature (3352)..(3373): n is a, c, g, or t
  misc_feature (3375)..(3392): n is a, c, g, or t
  misc_feature (3394)..(3399): n is a, c, g, or t
  misc_feature (3401)..(3415): n is a, c, g, or t
  misc_feature (3417)..(3433): n is a, c, g, or t
  misc_feature (3435)..(3444): n is a, c, g, or t
  misc_feature (3446)..(3453): n is a, c, g, or t
  misc_feature (3455)..(3473): n is a, c, g, or t
  misc_feature (3475)..(3500): n is a, c, g, or t
  misc_feature (3502)..(3506): n is a, c, g, or t
  misc_feature (3508)..(3586): n is a, c, g, or t
  misc_feature (3588)..(3616): n is a, c, g, or t
  misc_feature (3618)..(3620): n is a, c, g, or t
  misc_feature (3623)..(3623): n is a, c, g, or t
  misc_feature (3625)..(3626): n is a, c, g, or t
  misc_feature (3628)..(3632): n is a, c, g, or t
  misc_feature (3634)..(3638): n is a, c, g, or t
  misc_feature (3641)..(3670): n is a, c, g, or t
  misc_feature (3672)..(3680): n is a, c, g, or t
  misc_feature (3682)..(3682): n is a, c, g, or t
  misc_feature (3684)..(3698): n is a, c, g, or t
  misc_feature (3700)..(3703): n is a, c, g, or t
  misc_feature (3705)..(3717): n is a, c, g, or t
  misc_feature (3719)..(3756): n is a, c, g, or t
  misc_feature (3758)..(3763): n is a, c, g, or t
  misc_feature (3765)..(3775): n is a, c, g, or t
  misc_feature (3777)..(3788): n is a, c, g, or t
  misc_feature (3790)..(3829): n is a, c, g, or t
  misc_feature (3833)..(3849): n is a, c, g, or t
  misc_feature (3851)..(3874): n is a, c, g, or t
  misc_feature (3877)..(3903): n is a, c, g, or t
  misc_feature (3905)..(3908): n is a, c, g, or t
  misc_feature (3910)..(3912): n is a, c, g, or t
  misc_feature (3914)..(3923): n is a, c, g, or t
  misc_feature (3925)..(3944): n is a, c, g, or t
  misc_feature (3946)..(3952): n is a, c, g, or t
  misc_feature (3954)..(3954): n is a, c, g, or t
  misc_feature (3956)..(3959): n is a, c, g, or t
  misc_feature (3961)..(3973): n is a, c, g, or t
  misc_feature (3975)..(3975): n is a, c, g, or t
  misc_feature (3977)..(4000): n is a, c, g, or t
ttgaactcaactctactaaaagaacccgacatagccggatcaagcgtatgctgttccaatcccatcaaatcctcaaatgttttttgttgtgccgtaaaacagttttcgttcagatatttcagcaaatttcctttttctataattccattgtcatccagaatctttacagacaccgaaaaaagagatgccgtgggaacttcaaccatatctcccggttcaaatgttcgccatccacgacttccaagctgtctaaacaaatattgatattgacttggagatagtacctccaacatatatgctctacgaatcatcatcgcaattgagacatgccatttttcttttantcttaaatattcatttaaaacngttggatattgaagntctttcaanaangcttctttnggcagnaaaaatgcngatgcaaattgatttgcntctgattcattgctccgatactcggcatctgcttgcgatttnacatcngaaacaatatgaccgagtatccagtgtcctagttcgtgagccaacgtaaagttcaatcttgcaggtgttgttttatctgtattatatgttgtgaaatagaacctcttgctttctccattattggcaaggaccggaatgtgactgattgcgtccaaatgccctacgttttccgagaaagaagttaccacaattccaagattttgtaacagatagctcatattacgaatgggcctatccgataagtccaatttttcccgaattttttttgcgattagttccatgtcagaacactctgctacagatttcatacaatcgatcaattgttcggttgatggatattcaatatattctgcaaaaaagtcataaatatatgatttcaatacatcaatgtttgtttgccgtagttttacggctcttgtcgtggttgtagttgctctacaatatgcaactccgggactaaaattatcgctgctaccttcaaagaaaaatttcggtggaaatttcaattcttgcgaaattgctaatactttatcggcacttggtttnattaaaccattttcatactgagagacagtttgctttgtcacccctatcttttctgctagcttaggactggaaatattttggatttcacgagccaatgtcagccgcattccattaaactcggatgtaacaatggcacccattttttacccatctttccgtacaaattttttccgcggtttgaattccggaatactgtcgatttgaacgccatactcattaccagtttcttccttaaacttagtaatttcatcttccggaacagcttctttccaattcatcggaattgcagaatccaaattcatttcatcaacgatgcaaccatttgcattcaaaatttccaatgtacagcttctgatcaattgagctaaatccaancggtacgttaaaattccaaatctcaagacttcaccgtctactgcttgctccaattcatcgaagggcttttcggctttttgntgcacagctttatcttgtccaaacagtgacatctgctcatactggggaaccatttcattcaaatcttgattagccggaagtcccgaaaaaacgtaatgcatctcaccattctgcaatttgacaagtctattgcggaaattttcttggcgaagaatcataatggctgttttgctgtgaggatcatatgccacagcatacttccagcttccagagaccatcaaaaccacacgatatcctgcctttgttaaatgttcatgttcattttgaaagatatgtgcccagccgtgctgtccttttccgttagaatacatcaaatcggcatagacaccttcattttcttccatgccatggtagatgctttcaacaatcagttttgccattgccattgcggaatcttcaaaaaatgcttttttcatgtgaacctccttcacagatgaaattataagcggtggaattttcttatacttcatattttacatnaattttgtaaaaagtcaagtgancgaatgacgttttatgcattcaaatncaaaagcgcagcacctcccaaaaagtactgcgcttttgtataatttgagctaccagttagtcctccaacccacagctcccggtcacattcttcaaatattcctcngggtcaccattcagnatcaaatcngcatagcccagngggtcattgtagatgagatantccanntccgacctctgcgccatngtcacatccaacgcatcctcgacnccggtgcaattgatggaaatttttctnccatcccggagcagcagctccacgcanccggtgtccatgttnaantngcaaactcttncatcgtacttcatgttcntgtcctcctgaaatcatgttgtngcttatgtcggtcaatctatgatttcggatttcatcttccacggacaccnnnattgaattttccgaagaaaacaaataatccgaacccatctcctatcggaaacaagttcggattatttttgtttggtccnnntngcnnnaancgannnnannncntnnnnaacnnnnnnnnnnnncncnncnnnaanngnnnnncannnngnnntnnnntnntnnnnnncnnnnnnngnnnnnnnannnnnnnnnnnnnnnnnnnnnntnnnnnnnntnnnnnnnnnnnnatnnnnnnnnnnnnnnnnnnnnnnnnnnntnnnntnnnnnnnnnnnntnnnnnnntcnnnnnnnnnnnnnannnnnnnnnnnnnnncnnnnnnnnnnnnnnnnantnnnnnncnannnnnncngnnnnntnnnnnnnnnnnnnnnnnnngnnnnnnnngnnnnnnnnnnnntnnnnnnnnnnnnnnnnnnnnnnnnnntnngnnnnnnnnnnnnnnnnnnnnnnnntnnnnncnnnnnnnnnnnnnnntnnnnnnnnnnnnnnnctnnncnnnnnngnnnnnnnnnngnnnnnnncnnngnnnangnnngnnnncnnntnncnnncnnnnnnnnncnnnnnnnnnngtnncngnnnnngnnnnnnnnnannntnncnnnnnnngccnnnncnntnnnngnnnnnnnnctnnnnnncangnnnnnnncnnnnnnnnnnnnnnnnnnnnncaannnnnncnnngngntnnnnnnnnnnnnnnncgngnnnnnnnnnnnnncnnnnnnntncnnnnnnnncnnnnnnnnnnnnnnantnnnnnnnnnnnnnnnnnnngnnnnnnnnnnacnnnnnnnnnnnnnnnnngnnnnnncnnnnnnnnngnannnnnnnnnnnnnnnnncannnnnnnnnnnnnnncgnnnnnannnnnnngnnnnnnncnnnnnnnnnnncncnnnnaannnnnnnnnnnncnnnnnnnnnnnnnnnnnnnnnaanannnnnnnnnnnnnnnnnnnnnngnnnnnnnnnnnnnnnnnncnnnnnnannnnnnnnnnnnnnngnnnnnnnnnnnnnnnnncnnnnnnnnnntnnnnnnnncnnnnnnnnnnnnnnnnnnncnnnnnnnnnnnnnnnnnnnnnnnnnnannnnntnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnngnnngcngnncnnnnncnnnnngtnnnnnnnnnnnnnnnnnnnnnnnnnnnnnngnnnnnnnnnangnnnnnnnnnnnnnnngnnnnannnnnnnnnnnnncnnnnnnnnnnnnnnnnnnnnnnnnnnnnnnnnnnnnnnannnnnnannnnnnnnnnngnnnnnnnnnnnncnnnnnnnnnnnnnnnnnnnnnnnnnnnnnnnnnnnnnnnnggcnnnnnnnnnnnnnnnnncnnnnnnnnnnnnnnnnnnnnnnnngcnnnnnnnnnnnnnnnnnnnnnnnnnnngnnnncnnncnnnnnnnnnncnnnnnnnnnnnnnnnnnnnngnnnnnnncngnnnncnnnnnnnnnnnnncncnnnnnnnnnnnnnnnnnnnnnnnn

SEQ ID NO: 827 - DNA, 4000 bp, Escherichia coli
  misc_feature (1)..(8): n is a, c, g, or t
  misc_feature (10)..(10): n is a, c, g, or t
  misc_feature (12)..(12): n is a, c, g, or t
  misc_feature (15)..(20): n is a, c, g, or t
  misc_feature (22)..(25): n is a, c, g, or t
  misc_feature (27)..(29): n is a, c, g, or t
  misc_feature (31)..(31): n is a, c, g, or t
  misc_feature (33)..(37): n is a, c, g, or t
  misc_feature (39)..(43): n is a, c, g, or t
  misc_feature (45)..(48): n is a, c, g, or t
  misc_feature (50)..(51): n is a, c, g, or t
  misc_feature (53)..(55): n is a, c, g, or t
  misc_feature (59)..(62): n is a, c, g, or t
  misc_feature (64)..(68): n is a, c, g, or t
  misc_feature (70)..(77): n is a, c, g, or t
  misc_feature (79)..(79): n is a, c, g, or t
  misc_feature (81)..(86): n is a, c, g, or t
  misc_feature (88)..(92): n is a, c, g, or t
  misc_feature (94)..(100): n is a, c, g, or t
  misc_feature (102)..(103): n is a, c, g, or t
  misc_feature (106)..(114): n is a, c, g, or t
  misc_feature (117)..(118): n is a, c, g, or t
  misc_feature (120)..(122): n is a, c, g, or t
  misc_feature (125)..(125): n is a, c, g, or t
  misc_feature (127)..(127): n is a, c, g, or t
  misc_feature (129)..(138): n is a, c, g, or t
  misc_feature (140)..(144): n is a, c, g, or t
  misc_feature (146)..(146): n is a, c, g, or t
  misc_feature (148)..(151): n is a, c, g, or t
  misc_feature (153)..(154): n is a, c, g, or t
  misc_feature (156)..(159): n is a, c, g, or t
  misc_feature (161)..(163): n is a, c, g, or t
  misc_feature (165)..(165): n is a, c, g, or t
  misc_feature (167)..(167): n is a, c, g, or t
  misc_feature (169)..(171): n is a, c, g, or t
  misc_feature (173)..(175): n is a, c, g, or t
  misc_feature (177)..(179): n is a, c, g, or t
  misc_feature (181)..(193): n is a, c, g, or t
  misc_feature (197)..(199): n is a, c, g, or t
  misc_feature (201)..(202): n is a, c, g, or t
  misc_feature (204)..(212): n is a, c, g, or t
  misc_feature (214)..(216): n is a, c, g, or t
  misc_feature (219)..(227): n is a, c, g, or t
  misc_feature (229)..(230): n is a, c, g, or t
  misc_feature (232)..(239): n is a, c, g, or t
  misc_feature (241)..(243): n is a, c, g, or t
  misc_feature (248)..(249): n is a, c, g, or t
  misc_feature (251)..(252): n is a, c, g, or t
  misc_feature (254)..(258): n is a, c, g, or t
  misc_feature (260)..(264): n is a, c, g, or t
  misc_feature (269)..(269): n is a, c, g, or t
  misc_feature (271)..(271): n is a, c, g, or t
  misc_feature (273)..(273): n is a, c, g, or t
  misc_feature (275)..(276): n is a, c, g, or t
  misc_feature (278)..(283): n is a, c, g, or t
  misc_feature (285)..(286): n is a, c, g, or t
  misc_feature (288)..(288): n is a, c, g, or t
  misc_feature (290)..(290): n is a, c, g, or t
  misc_feature (292)..(292): n is a, c, g, or t
  misc_feature (297)..(303): n is a, c, g, or t
  misc_feature (305)..(305): n is a, c, g, or t
  misc_feature (307)..(314): n is a, c, g, or t
  misc_feature (316)..(327): n is a, c, g, or t
  misc_feature (330)..(335): n is a, c, g, or t
  misc_feature (337)..(338): n is a, c, g, or t
  misc_feature (340)..(343): n is a, c, g, or t
  misc_feature (345)..(345): n is a, c, g, or t
  misc_feature (349)..(349): n is a, c, g, or t
  misc_feature (351)..(354): n is a, c, g, or t
  misc_feature (356)..(364): n is a, c, g, or t
  misc_feature (366)..(370): n is a, c, g, or t
  misc_feature (372)..(377): n is a, c, g, or t
  misc_feature (379)..(379): n is a, c, g, or t
  misc_feature (382)..(383): n is a, c, g, or t
  misc_feature (386)..(394): n is a, c, g, or t
  misc_feature (396)..(398): n is a, c, g, or t
  misc_feature (400)..(401): n is a, c, g, or t
  misc_feature (403)..(415): n is a, c, g, or t
  misc_feature (417)..(421): n is a, c, g, or t
  misc_feature (425)..(427): n is a, c, g, or t
  misc_feature (429)..(433): n is a, c, g, or t
  misc_feature (435)..(437): n is a, c, g, or t
  misc_feature (440)..(441): n is a, c, g, or t
  misc_feature (443)..(445): n is a, c, g, or t
  misc_feature (448)..(450): n is a, c, g, or t
  misc_feature (452)..(452): n is a, c, g, or t
  misc_feature (455)..(460): n is a, c, g, or t
  misc_feature (462)..(469): n is a, c, g, or t
  misc_feature (471)..(473): n is a, c, g, or t
  misc_feature (478)..(478): n is a, c, g, or t
  misc_feature (480)..(491): n is a, c, g, or t
  misc_feature (493)..(495): n is a, c, g, or t
  misc_feature (498)..(499): n is a, c, g, or t
  misc_feature (501)..(504): n is a, c, g, or t
  misc_feature (506)..(513): n is a, c, g, or t
  misc_feature (515)..(515): n is a, c, g, or t
  misc_feature (517)..(529): n is a, c, g, or t
  misc_feature (531)..(549): n is a, c, g, or t
  misc_feature (551)..(551): n is a, c, g, or t
  misc_feature (553)..(553): n is a, c, g, or t
  misc_feature (556)..(557): n is a, c, g, or t
  misc_feature (560)..(565): n is a, c, g, or t
  misc_feature (567)..(572): n is a, c, g, or t
  misc_feature (574)..(576): n is a, c, g, or t
  misc_feature (578)..(587): n is a, c, g, or t
  misc_feature (589)..(590): n is a, c, g, or t
  misc_feature (592)..(596): n is a, c, g, or t
  misc_feature (598)..(601): n is a, c, g, or t
  misc_feature (603)..(610): n is a, c, g, or t
  misc_feature (612)..(613): n is a, c, g, or t
  misc_feature (615)..(619): n is a, c, g, or t
  misc_feature (621)..(621): n is a, c, g, or t
  misc_feature (623)..(623): n is a, c, g, or t
  misc_feature (628)..(629): n is a, c, g, or t
  misc_feature (631)..(645): n is a, c, g, or t
  misc_feature (648)..(648): n is a, c, g, or t
  misc_feature (650)..(650): n is a, c, g, or t
  misc_feature (652)..(654): n is a, c, g, or t
  misc_feature (656)..(656): n is a, c, g, or t
  misc_feature (658)..(658): n is a, c, g, or t
  misc_feature (660)..(660): n is a, c, g, or t
  misc_feature (662)..(669): n is a, c, g, or t
  misc_feature (671)..(676): n is a, c, g, or t
  misc_feature (679)..(682): n is a, c, g, or t
  misc_feature (684)..(686): n is a, c, g, or t
  misc_feature (688)..(692): n is a, c, g, or t
  misc_feature (695)..(695): n is a, c, g, or t
  misc_feature (698)..(702): n is a, c, g, or t
  misc_feature (704)..(707): n is a, c, g, or t
  misc_feature (709)..(715): n is a, c, g, or t
  misc_feature (718)..(721): n is a, c, g, or t
  misc_feature (723)..(726): n is a, c, g, or t
  misc_feature (728)..(728): n is a, c, g, or t
  misc_feature (730)..(748): n is a, c, g, or t
  misc_feature (750)..(752): n is a, c, g, or t
  misc_feature (755)..(755): n is a, c, g, or t
  misc_feature (758)..(764): n is a, c, g, or t
  misc_feature (766)..(768): n is a, c, g, or t
  misc_feature (770)..(779): n is a, c, g, or t
  misc_feature (782)..(782): n is a, c, g, or t
  misc_feature (784)..(793): n is a, c, g, or t
  misc_feature (795)..(796): n is a, c, g, or t
  misc_feature (800)..(809): n is a, c, g, or t
  misc_feature (813)..(817): n is a, c, g, or t
  misc_feature (819)..(829): n is a, c, g, or t
  misc_feature (831)..(832): n is a, c, g, or t
  misc_feature (834)..(836): n is a, c, g, or t
  misc_feature (839)..(841): n is a, c, g, or t
  misc_feature (843)..(852): n is a, c, g, or t
  misc_feature (854)..(859): n is a, c, g, or t
  misc_feature (861)..(867): n is a, c, g, or t
  misc_feature (870)..(871): n is a, c, g, or t
  misc_feature (874)..(877): n is a, c, g, or t
  misc_feature (880)..(889): n is a, c, g, or t
  misc_feature (892)..(892): n is a, c, g, or t
  misc_feature (894)..(898): n is a, c, g, or t
  misc_feature (900)..(908): n is a, c, g, or t
  misc_feature (910)..(925): n is a, c, g, or t
  misc_feature (927)..(931): n is a, c, g, or t
  misc_feature (933)..(942): n is a, c, g, or t
  misc_feature (944)..(944): n is a, c, g, or t
  misc_feature (946)..(947): n is a, c, g, or t
  misc_feature (949)..(954): n is a, c, g, or t
  misc_feature (956)..(958): n is a, c, g, or t
  misc_feature (961)..(961): n is a, c, g, or t
  misc_feature (963)..(968): n is a, c, g, or t
  misc_feature (970)..(972): n is a, c, g, or t
  misc_feature (974)..(974): n is a, c, g, or t
  misc_feature (976)..(977): n is a, c, g, or t
  misc_feature (981)..(981): n is a, c, g, or t
  misc_feature (983)..(984): n is a, c, g, or t
  misc_feature (986)..(986): n is a, c, g, or t
  misc_feature (989)..(991): n is a, c, g, or t
  misc_feature (993)..(993): n is a, c, g, or t
  misc_feature (995)..(997): n is a, c, g, or t
  misc_feature (999)..(999): n is a, c, g, or t
  misc_feature (1001)..(1009): n is a, c, g, or t
  misc_feature (1011)..(1014): n is a, c, g, or t
  misc_feature (1016)..(1016): n is a, c, g, or t
  misc_feature (1018)..(1022): n is a, c, g, or t
  misc_feature (1025)..(1028): n is a, c, g, or t
  misc_feature (1030)..(1031): n is a, c, g, or t
  misc_feature (1033)..(1034): n is a, c, g, or t
  misc_feature (1036)..(1037): n is a, c, g, or t
  misc_feature (1039)..(1045): n is a, c, g, or t
  misc_feature (1047)..(1051): n is a, c, g, or t
  misc_feature (1055)..(1057): n is a, c, g, or t
  misc_feature (1059)..(1059): n is a, c, g, or t
  misc_feature (1061)..(1066): n is a, c, g, or t
  misc_feature (1069)..(1069): n is a, c, g, or t
  misc_feature (1071)..(1075): n is a, c, g, or t
  misc_feature (1078)..(1079): n is a, c, g, or t
  misc_feature (1081)..(1090): n is a, c, g, or t
  misc_feature (1094)..(1096): n is a, c, g, or t
  misc_feature (1099)..(1107): n is a, c, g, or t
  misc_feature (1109)..(1111): n is a, c, g, or t
  misc_feature (1113)..(1119): n is a, c, g, or t
  misc_feature (1121)..(1121): n is a, c, g, or t
  misc_feature (1125)..(1127): n is a, c, g, or t
  misc_feature (1129)..(1130): n is a, c, g, or t
  misc_feature (1132)..(1135): n is a, c, g, or t
  misc_feature (1137)..(1139): n is a, c, g, or t
  misc_feature (1142)..(1150): n is a, c, g, or t
  misc_feature (1153)..(1156): n is a, c, g, or t
  misc_feature (1158)..(1164): n is a, c, g, or t
  misc_feature (1166)..(1166): n is a, c, g, or t
  misc_feature (1170)..(1170): n is a, c, g, or t
  misc_feature (1172)..(1175): n is a, c, g, or t
  misc_feature (1177)..(1178): n is a, c, g, or t
  misc_feature (1180)..(1180): n is a, c, g, or t
  misc_feature (1182)..(1187): n is a, c, g, or t
  misc_feature (1189)..(1190): n is a, c, g, or t
  misc_feature (1192)..(1193): n is a, c, g, or t
  misc_feature (1196)..(1204): n is a, c, g, or t
  misc_feature (1207)..(1209): n is a, c, g, or t
  misc_feature (1211)..(1212): n is a, c, g, or t
  misc_feature (1215)..(1215): n is a, c, g, or t
  misc_feature (1217)..(1230): n is a, c, g, or t
  misc_feature (1232)..(1240): n is a, c, g, or t
  misc_feature (1242)..(1245): n is a, c, g, or t
  misc_feature (1247)..(1251): n is a, c, g, or t
  misc_feature (1253)..(1253): n is a, c, g, or t
  misc_feature (1255)..(1259): n is a, c, g, or t
  misc_feature (1261)..(1261): n is a, c, g, or t
  misc_feature (1264)..(1266): n is a, c, g, or t
  misc_feature (1268)..(1268): n is a, c, g, or t
  misc_feature (1270)..(1274): n is a, c, g, or t
  misc_feature (1276)..(1276): n is a, c, g, or t
  misc_feature (1278)..(1280): n is a, c, g, or t
  misc_feature (1282)..(1293): n is a, c, g, or t
  misc_feature (1296)..(1298): n is a, c, g, or t
  misc_feature (1300)..(1302): n is a, c, g, or t
  misc_feature (1304)..(1304): n is a, c, g, or t
  misc_feature (1308)..(1310): n is a, c, g, or t
  misc_feature (1312)..(1312): n is a, c, g, or t
  misc_feature (1314)..(1320): n is a, c, g, or t
  misc_feature (1322)..(1322): n is a, c, g, or t
  misc_feature (1324)..(1329): n is a, c, g, or t
  misc_feature (1331)..(1331): n is a, c, g, or t
  misc_feature (1333)..(1333): n is a, c, g, or t
  misc_feature (1335)..(1335): n is a, c, g, or t
  misc_feature (1338)..(1340): n is a, c, g, or t
  misc_feature (1342)..(1345): n is a, c, g, or t
  misc_feature (1347)..(1355): n is a, c, g, or t
  misc_feature (1357)..(1360): n is a, c, g, or t
  misc_feature (1362)..(1365): n is a, c, g, or t
  misc_feature (1367)..(1370): n is a, c, g, or t
  misc_feature (1372)..(1373): n is a, c, g, or t
  misc_feature (1375)..(1378): n is a, c, g, or t
  misc_feature (1380)..(1388): n is a, c, g, or t
  misc_feature (1390)..(1392): n is a, c, g, or t
  misc_feature (1394)..(1394): n is a, c, g, or t
  misc_feature (1396)..(1411): n is a, c, g, or t
  misc_feature (1413)..(1419): n is a, c, g, or t
  misc_feature (1422)..(1424): n is a, c, g, or t
  misc_feature (1426)..(1427): n is a, c, g, or t
  misc_feature (1429)..(1435): n is a, c, g, or t
  misc_feature (1437)..(1438): n is a, c, g, or t
  misc_feature (1441)..(1447): n is a, c, g, or t
  misc_feature (1449)..(1449): n is a, c, g, or t
  misc_feature (1453)..(1455): n is a, c, g, or t
  misc_feature (1459)..(1461): n is a, c, g, or t
  misc_feature (1463)..(1470): n is a, c, g, or t
  misc_feature (1472)..(1473): n is a, c, g, or t
  misc_feature (1475)..(1476): n is a, c, g, or t
  misc_feature (1478)..(1478): n is a, c, g, or t
  misc_feature (1480)..(1484): n is a, c, g, or t
  misc_feature (1487)..(1505): n is a, c, g, or t
  misc_feature (1507)..(1512): n is a, c, g, or t
  misc_feature (1514)..(1517): n is a, c, g, or t
  misc_feature (1985)..(1985): n is a, c, g, or t
  misc_feature (2243)..(2243): n is a, c, g, or t
  misc_feature (2291)..(2291): n is a, c, g, or t
  misc_feature (2645)..(2645): n is a, c, g, or t
  misc_feature (2654)..(2654): n is a, c, g, or t
  misc_feature (2723)..(2723): n is a, c, g, or t
  misc_feature (2729)..(2729): n is a, c, g, or t
  misc_feature (2731)..(2732): n is a, c, g, or t
  misc_feature (2738)..(2738): n is a, c, g, or t
  misc_feature (2741)..(2743): n is a, c, g, or t
  misc_feature (2747)..(2748): n is a, c, g, or t
  misc_feature (2750)..(2752): n is a, c, g, or t
  misc_feature (2761)..(2763): n is a, c, g, or t
  misc_feature (2765)..(2766): n is a, c, g, or t
  misc_feature (2771)..(2771): n is a, c, g, or t
  misc_feature (2773)..(2774): n is a, c, g, or t
  misc_feature (2776)..(2776): n is a, c, g, or t
  misc_feature (2778)..(2778): n is a, c, g, or t
  misc_feature (2781)..(2781): n is a, c, g, or t
  misc_feature (2783)..(2783): n is a, c, g, or t
  misc_feature (2787)..(2787): n is a, c, g, or t
  misc_feature (2791)..(2794): n is a, c, g, or t
  misc_feature (2796)..(2797): n is a, c, g, or t
  misc_feature (2799)..(2802): n is a, c, g, or t
  misc_feature (2804)..(2809): n is a, c, g, or t
  misc_feature (2814)..(2816): n is a, c, g, or t
  misc_feature (2819)..(2819): n is a, c, g, or t
  misc_feature (2821)..(2825): n is a, c, g, or t
  misc_feature (2828)..(2830): n is a, c, g, or t
  misc_feature (2832)..(2832): n is a, c, g, or t
  misc_feature (2837)..(2839): n is a, c, g, or t
  misc_feature (2841)..(2841): n is a, c, g, or t
  misc_feature (2843)..(2843): n is a, c, g, or t
  misc_feature (2846)..(2847): n is a, c, g, or t
  misc_feature (2849)..(2850): n is a, c, g, or t
  misc_feature (2854)..(2854): n is a, c, g, or t
  misc_feature (2860)..(2861): n is a, c, g, or t
  misc_feature (2864)..(2872): n is a, c, g, or t
  misc_feature (2876)..(2881): n is a, c, g, or t
  misc_feature (2883)..(2885): n is a, c, g, or t
  misc_feature (2887)..(2891): n is a, c, g, or t
  misc_feature (2893)..(2894): n is a, c, g, or t
  misc_feature (2896)..(2899): n is a, c, g, or t
  misc_feature (2901)..(2902): n is a, c, g, or t
  misc_feature (2904)..(2906): n is a, c, g, or t
  misc_feature (2910)..(2910): n is a, c, g, or t
  misc_feature (2912)..(2912): n is a, c, g, or t
  misc_feature (2914)..(2916): n is a, c, g, or t
  misc_feature (2919)..(2921): n is a, c, g, or t
  misc_feature (2924)..(2924): n is a, c, g, or t
  misc_feature (2926)..(2928): n is a, c, g, or t
  misc_feature (2930)..(2931): n is a, c, g, or t
  misc_feature (2933)..(2936): n is a, c, g, or t
  misc_feature (2938)..(2938): n is a, c, g, or t
  misc_feature (2940)..(2941): n is a, c, g, or t
  misc_feature (2944)..(2944): n is a, c, g, or t
  misc_feature (2946)..(2946): n is a, c, g, or t
  misc_feature (2949)..(2950): n is a, c, g, or t
  misc_feature (2954)..(2955): n is a, c, g, or t
  misc_feature (2958)..(2963): n is a, c, g, or t
  misc_feature (2965)..(2968): n is a, c, g, or t
  misc_feature (2970)..(2971): n is a, c, g, or t
  misc_feature (2974)..(2984): n is a, c, g, or t
  misc_feature (2986)..(2995): n is a, c, g, or t
  misc_feature (2997)..(2998): n is a, c, g, or t
  misc_feature (3000)..(3003): n is a, c, g, or t
  misc_feature (3009)..(3009): n is a, c, g, or t
  misc_feature (3011)..(3011): n is a, c, g, or t
  misc_feature (3014)..(3014): n is a, c, g, or t
  misc_feature (3016)..(3016): n is a, c, g, or t
  misc_feature (3020)..(3021): n is a, c, g, or t
  misc_feature (3023)..(3024): n is a, c, g, or t
  misc_feature (3026)..(3027): n is a, c, g, or t
  misc_feature (3030)..(3030): n is a, c, g, or t
  misc_feature (3032)..(3032): n is a, c, g, or t
  misc_feature (3034)..(3035): n is a, c, g, or t
  misc_feature (3038)..(3038): n is a, c, g, or t
  misc_feature (3040)..(3040): n is a, c, g, or t
  misc_feature (3042)..(3043): n is a, c, g, or t
  misc_feature (3045)..(3048): n is a, c, g, or t
  misc_feature (3050)..(3051): n is a, c, g, or t
  misc_feature (3054)..(3056): n is a, c, g, or t
  misc_feature (3058)..(3058): n is a, c, g, or t
  misc_feature (3061)..(3066): n is a, c, g, or t
  misc_feature (3068)..(3068): n is a, c, g, or t
  misc_feature (3070)..(3070): n is a, c, g, or t
  misc_feature (3072)..(3073): n is a, c, g, or t
  misc_feature (3075)..(3082): n is a, c, g, or t
  misc_feature (3084)..(3084): n is a, c, g, or t
  misc_feature (3086)..(3086): n is a, c, g, or t
  misc_feature (3088)..(3091): n is a, c, g, or t
  misc_feature (3093)..(3105): n is a, c, g, or t
  misc_feature (3109)..(3109): n is a, c, g, or t
  misc_feature (3111)..(3111): n is a, c, g, or t
  misc_feature (3114)..(3116): n is a, c, g, or t
  misc_feature (3118)..(3119): n is a, c, g, or t
  misc_feature (3123)..(3127): n is a, c, g, or t
  misc_feature (3130)..(3130): n is a, c, g, or t
  misc_feature (3132)..(3135): n is a, c, g, or t
  misc_feature (3137)..(3137): n is a, c, g, or t
  misc_feature (3139)..(3148): n is a, c, g, or t
  misc_feature (3150)..(3152): n is a, c, g, or t
  misc_feature (3156)..(3156): n is a, c, g, or t
  misc_feature (3158)..(3158): n is a, c, g, or t
  misc_feature (3160)..(3161): n is a, c, g, or t
  misc_feature (3163)..(3163): n is a, c, g, or t
  misc_feature (3166)..(3170): n is a, c, g, or t
  misc_feature (3172)..(3172): n is a, c, g, or t
  misc_feature (3176)..(3176): n is a, c, g, or t
  misc_feature (3178)..(3178): n is a, c, g, or t
  misc_feature (3180)..(3184): n is a, c, g, or t
  misc_feature (3187)..(3188): n is a, c, g, or t
  misc_feature (3190)..(3190): n is a, c, g, or t
  misc_feature (3192)..(3194): n is a, c, g, or t
  misc_feature (3196)..(3204): n is a, c, g, or t
  misc_feature (3207)..(3208): n is a, c, g, or t
  misc_feature (3210)..(3210): n is a, c, g, or t
  misc_feature (3212)..(3212): n is a, c, g, or t
  misc_feature (3214)..(3216): n is a, c, g, or t
  misc_feature (3219)..(3220): n is a, c, g, or t
  misc_feature (3224)..(3224): n is a, c, g, or t
  misc_feature (3226)..(3226): n is a, c, g, or t
  misc_feature (3228)..(3228): n is a, c, g, or t
  misc_feature (3230)..(3232): n is a, c, g, or t
  misc_feature (3234)..(3238): n is a, c, g, or t
  misc_feature (3240)..(3249): n is a, c, g, or t
  misc_feature (3252)..(3253): n is a, c, g, or t
  misc_feature (3255)..(3256): n is a, c, g, or t
  misc_feature (3258)..(3259): n is a, c, g, or t
  misc_feature (3261)..(3261): n is a, c, g, or t
  misc_feature (3263)..(3263): n is a, c, g, or t
  misc_feature (3265)..(3268): n is a, c, g, or t
  misc_feature (3271)..(3271): n is a, c, g, or t
  misc_feature (3274)..(3275): n is a, c, g, or t
  misc_feature (3279)..(3282): n is a, c, g, or t
  misc_feature (3284)..(3285): n is a, c, g, or t
  misc_feature (3288)..(3293): n is a, c, g, or t
  misc_feature (3295)..(3295): n is a, c, g, or t
  misc_feature (3297)..(3298): n is a, c, g, or t
  misc_feature (3300)..(3302): n is a, c, g, or t
  misc_feature (3305)..(3306): n is a, c, g, or t
  misc_feature (3308)..(3308): n is a, c, g, or t
  misc_feature (3312)..(3315): n is a, c, g, or t
  misc_feature (3317)..(3318): n is a, c, g, or t
  misc_feature (3320)..(3320): n is a, c, g, or t
  misc_feature (3323)..(3325): n is a, c, g, or t
  misc_feature (3327)..(3327): n is a, c, g, or t
  misc_feature (3329)..(3329): n is a, c, g, or t
  misc_feature (3331)..(3334): n is a, c, g, or t
  misc_feature (3336)..(3338): n is a, c, g, or t
  misc_feature (3340)..(3341): n is a, c, g, or t
  misc_feature (3343)..(3347): n is a, c, g, or t
  misc_feature (3349)..(3356): n is a, c, g, or t
  misc_feature (3358)..(3358): n is a, c, g, or t
  misc_feature (3360)..(3360): n is a, c, g, or t
  misc_feature (3362)..(3362): n is a, c, g, or t
  misc_feature (3365)..(3368): n is a, c, g, or t
  misc_feature (3370)..(3370): n is a, c, g, or t
  misc_feature (3372)..(3372): n is a, c, g, or t
  misc_feature (3374)..(3377): n is a, c, g, or t
  misc_feature (3379)..(3379): n is a, c, g, or t
  misc_feature (3382)..(3383): n is a, c, g, or t
  misc_feature (3386)..(3392): n is a, c, g, or t
  misc_feature (3394)..(3394): n is a, c, g, or t
  misc_feature (3396)..(3397): n is a, c, g, or t
  misc_feature (3400)..(3401): n is a, c, g, or t
  misc_feature (3403)..(3405): n is a, c, g, or t
  misc_feature (3407)..(3407): n is a, c, g, or t
  misc_feature (3410)..(3410): n is a, c, g, or t
  misc_feature (3412)..(3413): n is a, c, g, or t
  misc_feature (3416)..(3417): n is a, c, g, or t
  misc_feature (3419)..(3419): n is a, c, g, or t
  misc_feature (3422)..(3423): n is a, c, g, or t
  misc_feature (3428)..(3428): n is a, c, g, or t
  misc_feature (3430)..(3430): n is a, c, g, or t
  misc_feature (3432)..(3435): n is a, c, g, or t
  misc_feature (3437)..(3438): n is a, c, g, or t
  misc_feature (3441)..(3442): n is a, c, g, or t
  misc_feature (3444)..(3446): n is a, c, g, or t
  misc_feature (3449)..(3452): n is a, c, g, or t
  misc_feature (3455)..(3455): n is a, c, g, or t
  misc_feature (3459)..(3462): n is a, c, g, or t
  misc_feature (3468)..(3469): n is a, c, g, or t
  misc_feature (3471)..(3472): n is a, c, g, or t
  misc_feature (3474)..(3474): n is a, c, g, or t
  misc_feature (3479)..(3481): n is a, c, g, or t
  misc_feature (3483)..(3485): n is a, c, g, or t
  misc_feature (3489)..(3495): n is a, c, g, or t
  misc_feature (3498)..(3498): n is a, c, g, or t
  misc_feature (3501)..(3503): n is a, c, g, or t
  misc_feature (3507)..(3507): n is a, c, g, or t
  misc_feature (3510)..(3513): n is a, c, g, or t
  misc_feature (3517)..(3517): n is a, c, g, or t
  misc_feature (3519)..(3525): n is a, c, g, or t
  misc_feature (3527)..(3530): n is a, c, g, or t
  misc_feature (3534)..(3534): n is a, c, g, or t
  misc_feature (3536)..(3540): n is a, c, g, or t
  misc_feature (3542)..(3545): n is a, c, g, or t
  misc_feature (3547)..(3547): n is a, c, g, or t
  misc_feature (3550)..(3551): n is a, c, g, or t
  misc_feature (3555)..(3558): n is a, c, g, or t
  misc_feature (3560)..(3566): n is a, c, g, or t
  misc_feature (3568)..(3569): n is a, c, g, or t
  misc_feature (3572)..(3577): n is a, c, g, or t
  misc_feature (3580)..(3580): n is a, c, g, or t
  misc_feature (3583)..(3587): n is a, c, g, or t
  misc_feature (3589)..(3590): n is a, c, g, or t
  misc_feature (3592)..(3592): n is a, c, g, or t
  misc_feature (3594)..(3602): n is a, c, g, or t
  misc_feature (3605)..(3605): n is a, c, g, or t
  misc_feature (3608)..(3608): n is a, c, g, or t
  misc_feature (3611)..(3611): n is a, c, g, or t
  misc_feature (3615)..(3615): n is a, c, g, or t
  misc_feature (3617)..(3623): n is a, c, g, or t
  misc_feature (3625)..(3626): n is a, c, g, or t
  misc_feature (3628)..(3628): n is a, c, g, or t
  misc_feature (3630)..(3631): n is a, c, g, or t
  misc_feature (3635)..(3635): n is a, c, g, or t
  misc_feature (3637)..(3640): n is a, c, g, or t
  misc_feature (3642)..(3642): n is a, c, g, or t
  misc_feature (3644)..(3646): n is a, c, g, or t
  misc_feature (3649)..(3650): n is a, c, g, or t
  misc_feature (3653)..(3654): n is a, c, g, or t
  misc_feature (3656)..(3662): n is a, c, g, or t
  misc_feature (3665)..(3665): n is a, c, g, or t
  misc_feature (3667)..(3667): n is a, c, g, or t
  misc_feature (3669)..(3671): n is a, c, g, or t
  misc_feature (3674)..(3681): n is a, c, g, or t
  misc_feature (3683)..(3684): n is a, c, g, or t
  misc_feature (3686)..(3692): n is a, c, g, or t
  misc_feature (3694)..(3695): n is a, c, g, or t
  misc_feature (3697)..(3701): n is a, c, g, or t
  misc_feature (3704)..(3705): n is a, c, g, or t
  misc_feature (3707)..(3707): n is a, c, g, or t
  misc_feature (3711)..(3711): n is a, c, g, or t
  misc_feature (3713)..(3713): n is a, c, g, or t
  misc_feature (3715)..(3717): n is a, c, g, or t
  misc_feature (3720)..(3720): n is a, c, g, or t
  misc_feature (3722)..(3722): n is a, c, g, or t
  misc_feature (3724)..(3725): n is a, c, g, or t
  misc_feature (3727)..(3728): n is a, c, g, or t
  misc_feature (3731)..(3739): n is a, c, g, or t
  misc_feature (3743)..(3748): n is a, c, g, or t
  misc_feature (3750)..(3752): n is a, c, g, or t
  misc_feature (3754)..(3756): n is a, c, g, or t
  misc_feature (3758)..(3758): n is a, c, g, or t
  misc_feature (3760)..(3761): n is a, c, g, or t
  misc_feature (3763)..(3766): n is a, c, g, or t
  misc_feature (3769)..(3769): n is a, c, g, or t
  misc_feature (3772)..(3772): n is a, c, g, or t
  misc_feature (3774)..(3774): n is a, c, g, or t
  misc_feature (3779)..(3780): n is a, c, g, or t
  misc_feature (3783)..(3785): n is a, c, g, or t
  misc_feature (3787)..(3789): n is a, c, g, or t
  misc_feature (3791)..(3792): n is a, c, g, or t
  misc_feature (3794)..(3794): n is a, c, g, or t
  misc_feature (3797)..(3798): n is a, c, g, or t
  misc_feature (3800)..(3801): n is a, c, g, or t
  misc_feature (3804)..(3805): n is a, c, g, or t
  misc_feature (3807)..(3810): n is a, c, g, or t
  misc_feature (3816)..(3819): n is a, c, g, or t
  misc_feature (3823)..(3823): n is a, c, g, or t
  misc_feature (3825)..(3831): n is a, c, g, or t
  misc_feature (3833)..(3842): n is a, c, g, or t
  misc_feature (3844)..(3847): n is a, c, g, or t
  misc_feature (3850)..(3851): n is a, c, g, or t
  misc_feature (3853)..(3854): n is a, c, g, or t
  misc_feature (3856)..(3857): n is a, c, g, or t
  misc_feature (3860)..(3861): n is a, c, g, or t
  misc_feature (3863)..(3864): n is a, c, g, or t
  misc_feature (3867)..(3869): n is a, c, g, or t
  misc_feature (3871)..(3872): n is a, c, g, or t
  misc_feature (3874)..(3876): n is a, c, g, or t
  misc_feature (3878)..(3879): n is a, c, g, or t
  misc_feature (3882)..(3883): n is a, c, g, or t
  misc_feature (3885)..(3887): n is a, c, g, or t
  misc_feature (3889)..(3890): n is a, c, g, or t
  misc_feature (3892)..(3896): n is a, c, g, or t
  misc_feature (3898)..(3902): n is a, c, g, or t
  misc_feature (3905)..(3905): n is a, c, g, or t
  misc_feature (3909)..(3910): n is a, c, g, or t
  misc_feature (3912)..(3915): n is a, c, g, or t
  misc_feature (3917)..(3919): n is a, c, g, or t
  misc_feature (3922)..(3933): n is a, c, g, or t
  misc_feature (3935)..(3935): n is a, c, g, or t
  misc_feature (3937)..(3937): n is a, c, g, or t
  misc_feature (3940)..(3942): n is a, c, g, or t
  misc_feature (3950)..(3950): n is a, c, g, or t
  misc_feature (3954)..(3955): n is a, c, g, or t
  misc_feature (3957)..(3959): n is a, c, g, or t
  misc_feature (3961)..(3961): n is a, c, g, or t
  misc_feature (3963)..(3964): n is a, c, g, or t
  misc_feature (3966)..(3966): n is a, c, g, or t
  misc_feature (3968)..(3968): n is a, c, g, or t
  misc_feature (3971)..(3977): n is a, c, g, or t
  misc_feature (3982)..(3982): n is a, c, g, or t
  misc_feature (3984)..(3985): n is a, c, g, or t
  misc_feature (3987)..(3988): n is a, c, g, or t
  misc_feature (3990)..(3995): n is a, c, g, or t
nnnnnnnncntnggnnnnnnannnngnnncntnnnnngnnnnngnnnngnntnnnaaannnncnnnnnannnnnnnntngnnnnnnannnnntnnnnnnnannttnnnnnnnnnaanngnnnttncngnnnnnnnnnngnnnnnancnnnntnnannnncnnngntncnnncnnntnnnannnnnnnnnnnnnaaannngnngnnnnnnnnncnnnggnnnnnnnnnanngnnnnnnnngnnngaaannannannnnncnnnnnaaaangncngnngnnnnnncnncngncnttttnnnnnnntngnnnnnnnngnnnnnnnnnnnnttnnnnnngnngnnnngncttncnnnnannnnnnnnncnnnnncnnnnnntnggnnaannnnnnnnncnnnanngnnnnnnnnnnnnngnnnnngccnnncnnnnncnnnccnnannnttnnncnggnnnnnncnnnnnnnngnnnttttncnnnnnnnnnnnngnnnaanncnnnncnnnnnnnncngnnnnnnnnnnnnncnnnnnnnnnnnnnnnnnnncntnggnnggnnnnnngnnnnnngnnntnnnnnnnnnnannannnnntnnnncnnnnnnnngnngnnnnngnanggggnngnnnnnnnnnnnnnnnaancngnnncntngntnnnnnnnnannnnnncgnnnncnnnannnnnccnggnnnnncnnnngnnnnnnnggnnnncnnnntngnnnnnnnnnnnnnnnnnnncnnnggnccnnnnnnncnnncnnnnnnnnnnccngnnnnnnnnnngnntttnnnnnnnnnncccnnnnncnnnnnnnnnnncnncnnnccnnncnnnnnnnnnngnnnnnngnnnnnnnccnnccnnnnctnnnnnnnnnnaancnnnnncnnnnnnnnncnnnnnnnnnnnnnnnngnnnnncnnnnnnnnnncntnnannnnnntnnnggnannnnnnannncngnngggntnntnggnnnantnnncnannnnnnnnncnnnntngnnnnnttnnnngnngnngnnannnnnnncnnnnngggnnngnannnnnnctncnnnnnggnngnnnnnnnnnngggnnnggnnnnnnnnncnnngnnnnnnncngggnnngnngnnnnannnggnnnnnnnnnaannnncnnnnnnncngggntnnnngnngncnnnnnngnngnnaannnnnnnnnttnnncnnccngnnnnnnnnnnnnnntnnnnnnnnntnnnngnnnnncngnnnnntnctnnnancnnnnngncnnngnnnnnnnnnnnnccnnngnnncngggnnngncnnnnnnncngnnnnnncngncnaannngnnnngnnnnnnnnntnnnngnnnngnnnngnngnnnngnnnnnnnnntnnncnannnnnnnnnnnnnnnncnnnnnnnccnnntnnannnnnnngnnggnnnnnnngnaaannncccnnncnnnnnnnncnncnncnannnnnccnnnnnnnnnnnnnnnnnnntnnnnnncnnnntctccctcgtaacttgaagacgcaggggcgcagagcatggttgatttgtcaatcaggcttgaccgccagtggcgggtcgggctacgcagacggcatgaagatgatgccactcattatttgctgtattacctgctaagaccttccggcgggcttgctcacatcgttttcttcccgagatttctgtgccatgcccgcgcaatccttgcgtaaggacgcgccatgaccacgatcaagctgcacaacacgaaaacccgcaaacgcgaggatttcaccccgattgatgataaaaacgtgcggatgtatgtctgtgggcccacggtgtacgaccgcgcccatctgggcaatgcgcgccccgtgatcgtgtttgacgtgctcaaccggttgctgcgtcatgtctatggcgacgcccatgtgacctatgtgcgcaacttcacggatgtggatgacaagatcaacgcgcgcgcagcncaaagcgggcggtctatcggagagattaccgccgagacaacccagtggtttctggacgatatggccgccgtcggcgcgcttgagcccgaccacatgccacgcgccaccgcctatattccgcagatggtcgcgatgatcgaagatctgatcgccaagggacacgcctatgccgccgaggggcatgtgctgttctctgtcgaaagctacaaagcctatggcgcgctgtcgggccggtcgatcgacgatatgattgccggngcgcgggtcgaggttgcgccctacaagcgtaacccgatggatttcgtnctgtggaagccgtcggacgacgcgacgccggggtgggacagcccctggggccgtggccgccccggctggcacatcgaatgctccgccatggcggacgagctgctgtggaaagagcccctgcgtcaggaccgtctgtcggacaaggcgaagagcgcacctcacgtctttgacatccacggcggcggtctggatctgcaattcccccaccacgaggacgagatcgcccaaagctgctgcgccaatggcaccgacgagatggcgcgctactggctgcataacgagatgctgcaggtcgagggcaagaagatgtccaaatcgcttggtaacttcttcaccgtacgcgacctgctggancaaggcgtnccgggagaggtgatccgtttcgtcatgctcagcacgcattaccgcaagccgatggactggaccgagaanaagcgngnngaagcngannngacnntnnngaagtggannnanntgacngnngncntanancctngcgnnnntnncnnnnannnnnntgatnnnatngnnnnngannngnatacnnncnangcnntnncgcntctcgnngannnnnnnnncaannnnnngnnngnnnnncnncnnnnanntnnnaatnangnnngannnctngnnngnntnnnngncnnatngnggnnggannatnnnnnngnnnntnncgnnnnnnnnnnnannnnnnnnnncnntnnnnctgagntnaanancganntnncnnaantngnngangngnngnnnnanntgnnnangannnnnnangntnntnnnnnnnncnangnnnncnnnnnnnnnnnnntggnancgnnntnngagnnnnngancnnnnangnnnnnnnnnnannnatancngnncncannnnngncccnancnnnnnggnngngnnnannnnnnnnncgnngngncnnncgnnggcngntngnnngnnnnngnnnnnnnnnngcnngnncnncngnannnncgnagnntatnnnncnngannnnnntnanntnnntgnnangacnnnngnncnccnnnancncnnnnannngnntnnnnncnnnnnnnngnanangcnnnngntncnnnncncgnncgnnnnnnngntnncgnntnnnancgngnncgnnangcnnggcgngnannnnannganngnnnctnnnncgncgcnnnnccgacnncnngngcgannntnnnggcnnnnnnnatnacnnnggcnaannnnacgncnnnnnnnannnncaangnnnnngnnnngncgnngcannnngnnnnnnngnnggnnnnnntgntgnnnnngnncncnnnnnnnnncgnctnggngggnannnnnnntnngntnnacgngnnnncngnnnttnncgnnannnnnnncgngnannnggnnnnnnnngnnannnnnnncnngnnnnnggnngngcangncnnngangngnngnncgnnnnnnnnnattnnnnnnannncnnncncnncnnnnccnatnangcggnnacnnngnnnanngngcnntnnganncnnnngcgggnnnnatgncnnnnnnngnnnnnnnnnncnnnnccnngnncnncgnngnnggnnncnncnnngnnganntnnncnncnnnnncnnnnncgncgcnnannnngnnntcnnnnnnnnnnnngncnccnnnaacgcggncgcnngnnngntnncngncannnnnnngggcncnngnnannnnnngggca

SEQ ID NO: 828 - DNA, 4000 bp, Escherichia coli
  misc_feature (1987)..(1987): n is a, c, g, or t
  misc_feature (1995)..(1995): n is a, c, g, or t
gcaaaagaaaagtggtttgtagttgcaaccattaatccattgacacattctggaacaaaagaacttccaccacaaattctaagtagatttccagtacgaattagattagaatatccaccagaaaatatagaactagatattgtcaaaaaacatgtttcaggaaattatgaatcagaaattattcaagccataaaattagcaaatacattaagacaagctgcagctgttgaagaattattttattcgccaagtttgagagaaacaattgcatttggaaaattattagataaagaagtacctccaaaagaagctgcaaacattgtttttggaaatgtatacacacagtgggggaatatagagtatcaaaaagtaagtgacattattacttcaatgtttggaaattaaatgcatccaattcaacttcaaaatgattcattagtagaaattgccacttttcttgttcgaaggtggtctgaagaagaggacattataattgaaatttcagataaaatagaaactaaaacaagattgaaggaaaaaaaagtaatcctaacacctttagaaaaaagaataggaagtgattttgaaaaatatagacaatttagaatatcatcatggtatgaagcaatgaaaataaaatattgtgaaaaaattctcagtgaagatcatgcttttggttttattcttaacacaatggaaacaaaaagagtagaacagttaggcagaaaaatttggaaagggatggatgaagaaattatttttaattacacatacatgcttgtggcaagaccacaacttcatacagtttatggaaaagcaagaattgtagaagcattttatcaatattttatgtttggagcaattaaaggaaatatacaatcaagccactttgaaaaaattaaaaaagcagcaatatttgcaaaaaaaattgtcaacgaagcaataaaaaataatcaaaaaacaaattggattgaaaaacatgtaactgaaataattaaaattttagaaatcgattcactattaacaattccaatatcagtggcgtttatgaaagctggaatggcattatcagaagaagagttacgaaaagtgctaaaagtaatttctaaaaataaagagggggattttggttcaattgatccttcatcagtagtaaaaggagagaatgtttatgatgaatacaaagtgctaattgatgaaaataaaaaaatggaaaacaaaggattatcatcagaaacaataggaattcaaattccatctacaaaaaatattgatgaaacagcaatctatgacgtgagtttaatcaatggattaaaaatgaaatttaaagaatggaaagcaggttggaaagaacaacatgtaaaatctggagatgaatttgatgaggaaaattacattgaaggaaatgaaccattttttacagatataaaaaaatcaattaaaaccaaaattgtgatattattagaccattcatcaagtatatcttcagatgcaattgaatacaaaaaagcaacaatagcattatgtgaagtactagcatttcttaaagtaaaatttgcagtatatgcatttagtactcaaaatagatcaatgatatgctggtcaattaaagaagagaatgtaaaatggaataatattactgcaaaaaggttagcacaaatagttgcaaatggatcaacgccattagcagaaatatatgataaaatgtttccaactttacaatcaaaaagaccaaatatttttttgacattaactgatggtgaaccttcagattcagatgcagttagaaatatgacaaaatcattaaaaggattaggaattagcatggttgctttaggattaggtccaaatacaattagagctacaaccatagcaaataatctaaaacatttaggatatgacaaaactatggcagtaagtagattaaaagatattccaaacaaagttatcagtattttagatgtatgaataggagaattaaaaattngaaaacantagtaagaatatcagatattttatatgaccttttaaacattaaaaattagaaataaaattggaagaaaatcaagataacaatattgacaaagatctacttgcacgttttgaaaaagaaatttggagtaaagtaccacatttagaaaataatcaagaaggagaaaaggtggtaaatgcaacaccactagtagacattacagcagattttaaagaatgtgccaaagaagtttacaatctagatctctctaattcagaattacaaatttatggaaaattagattccacattacttacaggttcaataaaaataagaccagcagcgaatataatttacaatgcaattacaacaggaaaaataaaaagtggacaaaccgtaattgaggcaacatcaggtaattttggaattgcattaggaatgttatcaaaattaggattacaagtagtcacaattgtttcaagaaaattacaagaaggagtatttcacgaattaagaaatatgaatatcaaaattatggatttagagatggatatttgtcctgcaccaggaatggaaggtaagaaagatgaattagttgcaaaagcaacagcaggtaacattcgttctcaattatctcagatgggatttgatccaagtatttttgataattcatctaatgaaatagaatcattattagcaaaacaagatattattaatttagcaaaattactctcaaaaatatacaattgtttctgtccagaacaatatgataatgatttgaatgtgaatgcacataaaaccataacaggggcagaaatagatcagcaattacataaagatgggaattcacttgaagaatttaacatcctatgtacatttggtacaggaggaacttcaggaggattaagtaaatacatctctgaaaaatataacaaaaagggagttcatgttatatttccaccaagtggacaagatgttgcagggattagaactcacaataatgcggatggcttaaaatattatcaaccagacaaatatgcgggagaatatgaagtagattttgaaaaagcaaaaccactcctaaaatttttcgtagaaaaaggtcacgacattggagagagtagtgcattagaactttatgcaactttacaactagccagcacaaataaaggaaataaatttgtagtaatgatttgtgatggaatagagaaatatagaaagaacttggaaaaaattggaaaaatacagcctccaggacaagtatcaccacaagatgtagcatcaaatgcagatgattatgacaaagttatttggattcatacacaatatacccctcaagaaggaggaatagaattacttgcaaaatctttaggtattgataaaagtaaaataattataccaaatgcaagaacagcacaacaactattatcaggacaagggattccagatgaaattaataattcacttcaagaatcaaaaggtaaatcattgatggtttgtatggctggaagaacatcattaatggctgcaaatgtattagcagaaaaaggaattgttacagatagtttgataggaggaattacagagcttcccgaagcaagaaacagtgaactttcagaattagttaaacaagcttcacagttttaatttacataaaaattctaccattataattatgaaatgtctttcaatttgtcaaccatttgcagaattaattattcagaatagaaaaacaatagaattaagaacgtggaatacaaattttcgtggagaatttttgatacatgcaccaattaaaattagaaaagaagaatgtaaaaaattgaaaatggagcaaaaatttacaacaagtgcaataataggaaaagcagagttgtgtgatgtaaaaaaatatgaatcattaaaagaaattcaaatagataaaaataaacatttttcatcaaaaacttttcatgaaaaaacatttggatttattttaaaaaatgccaaatcatttagaattcctattccatggaaaggtcaattagg

SEQ ID NO: 829 - DNA, 4000 bp, Escherichia coli
  misc_feature (168)..(168): n is a, c, g, or t
  misc_feature (828)..(828): n is a, c, g, or t
  misc_feature (1302)..(1302): n is a, c, g, or t
  misc_feature (1304)..(1304): n is a, c, g, or t
  misc_feature (1337)..(1337): n is a, c, g, or t
  misc_feature (1349)..(1349): n is a, c, g, or t
  misc_feature (1358)..(1358): n is a, c, g, or t
  misc_feature (1467)..(1467): n is a, c, g, or t
  misc_feature (1480)..(1480): n is a, c, g, or t
  misc_feature (1763)..(1763): n is a, c, g, or t
gtatctgcgaacagatctggaccccaatgataccccgcccgctgcgcctgccaatctgatcgcctatgccgtatcggccagtgaaatccaattgaactgggatgatctctcaaataatgaacgaggatttcacatacgacgctccgtgaacggaatcgatttcaccgncatcgacaccgcccccgtggatgccatcagctacctggaccgaacagcctctcctgacaccacctatacctatcaagtcgaagcctacaccgccagcttcacagtcgcatccaatacggcgacggccaccacgccggatgccatggttctttccgccaacggatacaaaaggaaagggaaagcgcaggtcgacttgacttggtcgggaggttcggaagtgacaagcgtaggcatctggaggagtgtggatggtgggagtttcgtcaacattgcaagcgtcagccacaatccaggcggaacgagctatacagacgtcacaaatcttaagggcagcttcttcgtagactacgaggtacgtagctcgaccggtgagctgagctcaaacacggtgaccgtggtcttttaaaccccggcaccttattcaaggcaattccaccacctgagtccaatgggcgtcgcccagttcggcgacaaaagcctcggcggcctgttcggcggcagatcggctcgggaaaagggcgaaggtggtggagccgcttccggacatcaaactcacttcggccccaagtttgcggagggttgtctggaaaatctcgaggagaggatacttctcgagaaccggaccttccagactgttgaaaaacagatcggaagctgagncaagatcagaaccttgcaaggcttcgaccaatcgtttgcctttgccgggttggccgttcaacaaatcggggaaccgctgcagactttgatatgcccatccggtggatactccaaatccaggtttcaccagaaacaatcctttgtttttcaaggctggaaagggtggaagcgagacgaccttttccccccttccatccgcaagggcaggattgttttggaggaagaacggcacatctgacccgagagtagctgcgatttcctggagcgtttcagcgttgaggggttttcctgtcatctcattcaaggcgttcaaggtgacaccggcattgccgctgccgccccccaatcccgcctccattggaatccgcttgtcgaggtgaatggatacggtcggttccagatcggctttttcataaaagcccctcgccgcccgggtgatcaggttgtcggatcccggactgagatccgctccgncnatcgtcaaatgaatgcccctttccccggaaggntcaaacgtcagnaaatcacanaggggcactgggaacatcaccgtttccagttcatggaaaccatcctcacgcttgcccagaatgttgagcagtagattgactttgcagggtgattgtttttggagcatgnaaaaagtggggtnattcaacaaaaaaggcgccaacattcaagctggcgcctttcgatgaaagtaaatggttgatcaatagtcgaaaacacggaaacgacttccaacgatcgggagcatgtcaccaccgctgaagccgagatcgctgtcagctgcgtatgtggagtccgacaccaggctgggagtgtagttttccgggtaaatgacttcgtccttcactccgacgggatcgtagcttgggattgggaaagtgacgatttcgtaaatccccacagccgtgcgcttcacggactggttnaaaccacggatgaacccggtggtataggattgctcgggaccttcccagagagcggtttgctccatggagtgacgcatttccccaagacgggcaaattcggtcacgtttctcatgccacggccgagcttctgctcaggaccggcacatccggttgccaaaaccacagcagctacacctgccaacaaaatggactttgaaatacgcatcataattaagactttggttgcggagagactaatcatcactccaagcttgtaaaggttttttcgtttattttggacttttatccgtcggttttcgttcgaaatttcaaatatatgagcaggaactatgcctcctcggcctgttttcgctcatccctgcgcgcccaaacacgcgaaatcaacacactcaactcataaagcaagtgcaacggtaatgccatcaaaatcagggtaaacggatcacctgtcggcgtcaaaaacgcacaaatggtcaaattggcgatcacccaatagggtcggaaggtattgagtttcttataatccaggaatccgattttaaccaaggtcaataacaccaccggcaactgaaaactcaaacccatggccaacatgaatttgatcacaaaggtcatgtagtcgcgggcattccattcgtctgcagaaaatccaagccagtttgaaaattgtaccagtgcaagaatggcaattttcatcatgacaaagtagcagaaaagtattcccagaataaacaaaccgacaccgaatccggtcgtctggtaaaggaatttcttctcgtggatcctgagcgcagggaggatgaactgtcccagaaaaaagaagacaaatggagccgaaatcaccaatcctccataaagcatcaaatggaatgcaaccagaaatccatcgacgggcttgtagtttttcagacgatcgcgcagagcgttgagagggttctccgtgctgggctccagactgaggagtattcgatcatcttcctgaataggaacaagcttcaagctgtgcacttcatccaggttttcgatttgaatggtattggtgagtgaaagaatggaaatattcgctatccgggtatcccctaaagtcaatcctacaagatgattgctgttcaacttttggatttcagcttgttccagcggtgctttgaggatcgcgatgatgttgtccagcatggaaaaacacaccaccatgctgacaatgacggcgaccatgcacttgatcagagtccatcgtagatcttcgagatgttccaggaaggttttaaccgggccgccaccttctgcctcatcccattcctgatccacgacgagctcatcgttgggacgaggctcttcttcgctcatgtggggtcaatcgggtacgagaaccgcggcttcaggccttggacgtatcggcggcttcttccttaccgggagctgcgctgccttcgcctgtttcagattcctggggaataggtgccggttcggcagccttgcgaggaggcgccgaagcaacggaatcctcttccatggcctggtggaggtcttgttggacgtccttggtggcctttttgaattctttaattccctgaccaagccccttggccagctctggcaattttttggcgccgaagaaaatgagaatgacgacgagcagaaggatcacttcaggaccctgaagaccgccaatcaacgcaaattgagaatgaagatacaacatatgaaacaattcgttaaatcatcccgattgaaaatgagcaaagcaagatcaaagtaacatgatcaaaccagcaatcaaccggcttttgggtacgacatttgtaagttactgaagcaggacgaattcgccgcgtcggtttttcgaataagctgactcggtatcaccatcgacagcaggcttgtcttcaccccagctttcagtcgtgattctggaggaagcaatgccttccttgaccagaacatcccgcacggacaaggcccggcgctcgcccaaggtgcgattgtactcctcggtgccacgctcatcacaatgtccttcgatgcgaagcttcgcggcgggtgtgtccttgaggatgttcgccacggtgatgattttaggcaactcgctggcgttgacgttgtaacgatcgaaatcgaaatagacggtcgaagtttcaagtcgtgtttccgctttgtccgcgaaatcactcagattctccggaagggtatgaccatctccgtcctcaaactcagtgccttgactgaaattattattatc

SEQ ID NO: 830 - DNA, 4000 bp, Escherichia coli
  misc_feature (2)..(2): n is a, c, g, or t
  misc_feature (4)..(5): n is a, c, g, or t
  misc_feature (8)..(10): n is a, c, g, or t
  misc_feature (13)..(14): n is a, c, g, or t
  misc_feature (18)..(18): n is a, c, g, or t
  misc_feature (20)..(21): n is a, c, g, or t
  misc_feature (23)..(23): n is a, c, g, or t
  misc_feature (26)..(26): n is a, c, g, or t
  misc_feature (30)..(31): n is a, c, g, or t
  misc_feature (34)..(34): n is a, c, g, or t
  misc_feature (36)..(37): n is a, c, g, or t
  misc_feature (41)..(41): n is a, c, g, or t
  misc_feature (43)..(43): n is a, c, g, or t
  misc_feature (50)..(50): n is a, c, g, or t
  misc_feature (52)..(52): n is a, c, g, or t
  misc_feature (56)..(57): n is a, c, g, or t
  misc_feature (59)..(61): n is a, c, g, or t
  misc_feature (63)..(63): n is a, c, g, or t
  misc_feature (68)..(68): n is a, c, g, or t
  misc_feature (71)..(73): n is a, c, g, or t
  misc_feature (76)..(77): n is a, c, g, or t
  misc_feature (83)..(83): n is a, c, g, or t
  misc_feature (86)..(86): n is a, c, g, or t
  misc_feature (90)..(90): n is a, c, g, or t
  misc_feature (95)..(95): n is a, c, g, or t
  misc_feature (99)..(101): n is a, c, g, or t
  misc_feature (105)..(106): n is a, c, g, or t
  misc_feature (109)..(109): n is a, c, g, or t
  misc_feature (122)..(123): n is a, c, g, or t
  misc_feature (127)..(128): n is a, c, g, or t
  misc_feature (130)..(130): n is a, c, g, or t
  misc_feature (133)..(134): n is a, c, g, or t
  misc_feature (139)..(139): n is a, c, g, or t
  misc_feature (141)..(143): n is a, c, g, or t
  misc_feature (145)..(145): n is a, c, g, or t
  misc_feature (151)..(151): n is a, c, g, or t
  misc_feature (156)..(158): n is a, c, g, or t
  misc_feature (160)..(160): n is a, c, g, or t
  misc_feature (162)..(162): n is a, c, g, or t
  misc_feature (168)..(169): n is a, c, g, or t
  misc_feature (171)..(172): n is a, c, g, or t
  misc_feature (174)..(174): n is a, c, g, or t
  misc_feature (189)..(190): n is a, c, g, or t
  misc_feature (197)..(198): n is a, c, g, or t
  misc_feature (204)..(207): n is a, c, g, or t
  misc_feature (209)..(210): n is a, c, g, or t
  misc_feature (212)..(212): n is a, c, g, or t
  misc_feature (215)..(216): n is a, c, g, or t
  misc_feature (219)..(225): n is a, c, g, or t
  misc_feature (227)..(227): n is a, c, g, or t
  misc_feature (229)..(229): n is a, c, g, or t
  misc_feature (233)..(233): n is a, c, g, or t
  misc_feature (237)..(238): n is a, c, g, or t
  misc_feature (241)..(241): n is a, c, g, or t
  misc_feature (247)..(247): n is a, c, g, or t
  misc_feature (249)..(249): n is a, c, g, or t
  misc_feature (251)..(251): n is a, c, g, or t
  misc_feature (253)..(258): n is a, c, g, or t
  misc_feature (261)..(261): n is a, c, g, or t
  misc_feature (264)..(265): n is a, c, g, or t
  misc_feature (267)..(268): n is a, c, g, or t
  misc_feature (270)..(271): n is a, c, g, or t
  misc_feature (273)..(273): n is a, c, g, or t
  misc_feature (277)..(278): n is a, c, g, or t
  misc_feature (280)..(280): n is a, c, g, or t
  misc_feature (283)..(286): n is a, c, g, or t
  misc_feature (291)..(294): n is a, c, g, or t
  misc_feature (296)..(299): n is a, c, g, or t
  misc_feature (301)..(302): n is a, c, g, or t
  misc_feature (304)..(304): n is a, c, g, or t
  misc_feature (306)..(307): n is a, c, g, or t
  misc_feature (310)..(310): n is a, c, g, or t
  misc_feature (312)..(314): n is a, c, g, or t
  misc_feature (316)..(319): n is a, c, g, or t
  misc_feature (321)..(321): n is a, c, g, or t
  misc_feature (323)..(324): n is a, c, g, or t
  misc_feature (327)..(327): n is a, c, g, or t
  misc_feature (329)..(332): n is a, c, g, or t
  misc_feature (336)..(341): n is a, c, g, or t
  misc_feature (345)..(349): n is a, c, g, or t
  misc_feature (351)..(351): n is a, c, g, or t
  misc_feature (353)..(354): n is a, c, g, or t
  misc_feature (356)..(356): n is a, c, g, or t
  misc_feature (360)..(364): n is a, c, g, or t
  misc_feature (367)..(367): n is a, c, g, or t
  misc_feature (369)..(376): n is a, c, g, or t
  misc_feature (378)..(384): n is a, c, g, or t
  misc_feature (386)..(389): n is a, c, g, or t
  misc_feature (392)..(392): n is a, c, g, or t
  misc_feature (395)..(402): n is a, c, g, or t
  misc_feature (404)..(406): n is a, c, g, or t
  misc_feature (408)..(409): n is a, c, g, or t
  misc_feature (414)..(416): n is a, c, g, or t
  misc_feature (419)..(419): n is a, c, g, or t
  misc_feature (421)..(423): n is a, c, g, or t
  misc_feature (425)..(426): n is a, c, g, or t
  misc_feature (429)..(430): n is a, c, g, or t
  misc_feature (432)..(435): n is a, c, g, or t
  misc_feature (440)..(450): n is a, c, g, or t
  misc_feature (452)..(453): n is a, c, g, or t
  misc_feature (455)..(456): n is a, c, g, or t
  misc_feature (458)..(460): n is a, c, g, or t
  misc_feature (462)..(462): n is a, c, g, or t
  misc_feature (464)..(464): n is a, c, g, or t
  misc_feature (466)..(468): n is a, c, g, or t
  misc_feature (470)..(470): n is a, c, g, or t
  misc_feature (472)..(473): n is a, c, g, or t
  misc_feature (476)..(477): n is a, c, g, or t
  misc_feature (481)..(482): n is a, c, g, or t
  misc_feature (484)..(484): n is a, c, g, or t
  misc_feature (486)..(489): n is a, c, g, or t
  misc_feature (491)..(492): n is a, c, g, or t
  misc_feature (495)..(497): n is a, c, g, or t
  misc_feature (499)..(501): n is a, c, g, or t
  misc_feature (504)..(505): n is a, c, g, or t
  misc_feature (508)..(509): n is a, c, g, or t
  misc_feature (511)..(511): n is a, c, g, or t
  misc_feature (513)..(513): n is a, c, g, or t
  misc_feature (515)..(515): n is a, c, g, or t
  misc_feature (517)..(517): n is a, c, g, or t
  misc_feature (519)..(519): n is a, c, g, or t
  misc_feature (522)..(527): n is a, c, g, or t
  misc_feature (529)..(529): n is a, c, g, or t
  misc_feature (533)..(536): n is a, c, g, or t
  misc_feature (541)..(543): n is a, c, g, or t
  misc_feature (545)..(550): n is a, c, g, or t
  misc_feature (553)..(554): n is a, c, g, or t
  misc_feature (556)..(556): n is a, c, g, or t
  misc_feature (559)..(561): n is a, c, g, or t
  misc_feature (565)..(568): n is a, c, g, or t
  misc_feature (570)..(572): n is a, c, g, or t
  misc_feature (574)..(575): n is a, c, g, or t
  misc_feature (577)..(577): n is a, c, g, or t
  misc_feature (581)..(582): n is a, c, g, or t
  misc_feature (587)..(588): n is a, c, g, or t
  misc_feature (591)..(592): n is a, c, g, or t
  misc_feature (595)..(597): n is a, c, g, or t
  misc_feature (599)..(599): n is a, c, g, or t
  misc_feature (601)..(601): n is a, c, g, or t
  misc_feature (604)..(604): n is a, c, g, or t
  misc_feature (607)..(607): n is a, c, g, or t
  misc_feature (610)..(610): n is a, c, g, or t
  misc_feature (616)..(616): n is a, c, g, or t
  misc_feature (620)..(621): n is a, c, g, or t
  misc_feature (624)..(624): n is a, c, g, or t
  misc_feature (626)..(626): n is a, c, g, or t
  misc_feature (630)..(632): n is a, c, g, or t
  misc_feature (638)..(640): n is a, c, g, or t
  misc_feature (643)..(643): n is a, c, g, or t
  misc_feature (647)..(650): n is a, c, g, or t
  misc_feature (652)..(652): n is a, c, g, or t
  misc_feature (656)..(656): n is a, c, g, or t
  misc_feature (658)..(658): n is a, c, g, or t
  misc_feature (660)..(662): n is a, c, g, or t
  misc_feature (665)..(666): n is a, c, g, or t
  misc_feature (669)..(669): n is a, c, g, or t
  misc_feature (671)..(671): n is a, c, g, or t
  misc_feature (673)..(676): n is a, c, g, or t
  misc_feature (680)..(682): n is a, c, g, or t
  misc_feature (684)..(684): n is a, c, g, or t
  misc_feature (687)..(688): n is a, c, g, or t
  misc_feature (691)..(691): n is a, c, g, or t
  misc_feature (694)..(694): n is a, c, g, or t
  misc_feature (698)..(698): n is a, c, g, or t
  misc_feature (700)..(701): n is a, c, g, or t
  misc_feature (703)..(703): n is a, c, g, or t
  misc_feature (705)..(705): n is a, c, g, or t
  misc_feature (707)..(710): n is a, c, g, or t
  misc_feature (713)..(715): n is a, c, g, or t
  misc_feature (717)..(719): n is a, c, g, or t
  misc_feature (722)..(726): n is a, c, g, or t
  misc_feature (730)..(730): n is a, c, g, or t
  misc_feature (733)..(736): n is a, c, g, or t
  misc_feature (738)..(738): n is a, c, g, or t
  misc_feature (740)..(741): n is a, c, g, or t
  misc_feature (743)..(743): n is a, c, g, or t
  misc_feature (746)..(746): n is a, c, g, or t
  misc_feature (748)..(750): n is a, c, g, or t
  misc_feature (753)..(753): n is a, c, g, or t
  misc_feature (756)..(758): n is a, c, g, or t
  misc_feature (760)..(764): n is a, c, g, or t
  misc_feature (766)..(767): n is a, c, g, or t
  misc_feature (769)..(769): n is a, c, g, or t
  misc_feature (771)..(771): n is a, c, g, or t
  misc_feature (773)..(773): n is a, c, g, or t
  misc_feature (776)..(778): n is a, c, g, or t
  misc_feature (781)..(783): n is a, c, g, or t
  misc_feature (785)..(785): n is a, c, g, or t
  misc_feature (787)..(789): n is a, c, g, or t
  misc_feature (791)..(792): n is a, c, g, or t
  misc_feature (795)..(796): n is a, c, g, or t
  misc_feature (803)..(807): n is a, c, g, or t
  misc_feature (811)..(811): n is a, c, g, or t
  misc_feature (814)..(814): n is a, c, g, or t
  misc_feature (816)..(818): n is a, c, g, or t
  misc_feature (821)..(821): n is a, c, g, or t
  misc_feature (824)..(825): n is a, c, g, or t
  misc_feature (827)..(827): n is a, c, g, or t
  misc_feature (829)..(830): n is a, c, g, or t
  misc_feature (833)..(833): n is a, c, g, or t
  misc_feature (835)..(836): n is a, c, g, or t
  misc_feature (838)..(838): n is a, c, g, or t
  misc_feature (840)..(840): n is a, c, g, or t
  misc_feature (842)..(842): n is a, c, g, or t
  misc_feature (844)..(845): n is a, c, g, or t
  misc_feature (847)..(847): n is a, c, g, or t
  misc_feature (849)..(849): n is a, c, g, or t
  misc_feature (851)..(851): n is a, c, g, or t
  misc_feature (853)..(853): n is a, c, g, or t
  misc_feature (856)..(857): n is a, c, g, or t
  misc_feature (862)..(862): n is a, c, g, or t
  misc_feature (864)..(864): n is a, c, g, or t
  misc_feature (866)..(866): n is a, c, g, or t
  misc_feature (868)..(868): n is a, c, g, or t
  misc_feature (871)..(873): n is a, c, g, or t
  misc_feature (876)..(876): n is a, c, g, or t
  misc_feature (878)..(879): n is a, c, g, or t
  misc_feature (881)..(881): n is a, c, g, or t
  misc_feature (884)..(885): n is a, c, g, or t
  misc_feature (888)..(888): n is a, c, g, or t
  misc_feature (890)..(890): n is a, c, g, or t
  misc_feature (892)..(892): n is a, c, g, or t
  misc_feature (894)..(895): n is a, c, g, or t
  misc_feature (898)..(898): n is a, c, g, or t
  misc_feature (900)..(902): n is a, c, g, or t
  misc_feature (904)..(917): n is a, c, g, or t
  misc_feature (921)..(924): n is a, c, g, or t
  misc_feature (926)..(928): n is a, c, g, or t
  misc_feature (930)..(931): n is a, c, g, or t
  misc_feature (934)..(936): n is a, c, g, or t
  misc_feature (938)..(940): n is a, c, g, or t
  misc_feature (942)..(948): n is a, c, g, or t
  misc_feature (950)..(950): n is a, c, g, or t
  misc_feature (954)..(954): n is a, c, g, or t
  misc_feature (957)..(957): n is a, c, g, or t
  misc_feature (960)..(962): n is a, c, g, or t
  misc_feature (964)..(969): n is a, c, g, or t
  misc_feature (972)..(979): n is a, c, g, or t
  misc_feature (981)..(981): n is a, c, g, or t
  misc_feature (983)..(988): n is a, c, g, or t
  misc_feature (990)..(993): n is a, c, g, or t
  misc_feature (995)..(996): n is a, c, g, or t
  misc_feature (998)..(1001): n is a, c, g, or t
  misc_feature (1004)..(1004): n is a, c, g, or t
  misc_feature (1007)..(1009): n is a, c, g, or t
  misc_feature (1011)..(1012): n is a, c, g, or t
  misc_feature (1014)..(1016): n is a, c, g, or t
  misc_feature (1019)..(1019): n is a, c, g, or t
  misc_feature (1021)..(1021): n is a, c, g, or t
  misc_feature (1024)..(1024): n is a, c, g, or t
  misc_feature (1026)..(1029): n is a, c, g, or t
  misc_feature (1032)..(1033): n is a, c, g, or t
  misc_feature (1036)..(1036): n is a, c, g, or t
  misc_feature (1038)..(1038): n is a, c, g, or t
  misc_feature (1040)..(1040): n is a, c, g, or t
  misc_feature (1043)..(1045): n is a, c, g, or t
  misc_feature (1047)..(1049): n is a, c, g, or t
  misc_feature (1051)..(1051): n is a, c, g, or t
  misc_feature (1053)..(1054): n is a, c, g, or t
  misc_feature (1061)..(1061): n is a, c, g, or t
  misc_feature (1063)..(1063): n is a, c, g, or t
  misc_feature (1070)..(1071): n is a, c, g, or t
  misc_feature (1083)..(1084): n is a, c, g, or t
  misc_feature (1091)..(1091): n is a, c, g, or t
  misc_feature (1097)..(1097): n is a, c, g, or t
  misc_feature (1104)..(1104): n is a, c, g, or t
  misc_feature (1110)..(1112): n is a, c, g, or t
  misc_feature (1119)..(1119): n is a, c, g, or t
  misc_feature (1126)..(1127): n is a, c, g, or t
  misc_feature (1130)..(1130): n is a, c, g, or t
  misc_feature (1132)..(1132): n is a, c, g, or t
  misc_feature (1136)..(1136): n is a, c, g, or t
  misc_feature (1144)..(1144): n is a, c, g, or t
  misc_feature (1148)..(1148): n is a, c, g, or t
  misc_feature (1151)..(1152): n is a, c, g, or t
  misc_feature (1154)..(1155): n is a, c, g, or t
  misc_feature (1158)..(1158): n is a, c, g, or t
  misc_feature (1160)..(1161): n is a, c, g, or t
  misc_feature (1165)..(1165): n is a, c, g, or t
  misc_feature (1176)..(1177): n is a, c, g, or t
cnanncgnnngcnntttncnncngtnctanncantnnatgngngcagcgngncggnncnnngnaagcncgnnnggnncgctcnctnttcntcgcngctnnnaaannccntgcgtgcaggagnncganngngtnnggaangnnntncgcagntgtcnnncnanatcctnntnntncgcctgttgtaatannaggcacnnttcatnnnngnngngcnnggnnnnnnntncngtgnacanntgncgggcngnancnnnnnnttngtnngnntnntncacnncnagnnnntgatnnnngnnnngnngnannggncnnncnnnnantnngtncnnnncgtnnnnnngcannnnntngnnantgcnnnnntgnannnnnnnntnnnnnnnannnngcngannnnnnnngnnncnncaatnnnagngnnnanngcnntnnnncgggnnnnnnnnnnncnnannannncngnannngncnnacnngganngntnnnngnnatnnncnnngtnnaanntntncncngnaannnnnngnctgnnnntctgnnntnnnnnnctnngntgnnncagnnnngnnntnncngcanngcggnnatnncannnanancgntcnttncccttncggnnaangnctgnnntgggtnnngtnatgnnnncntcgncnannnagnnagngnannnntcgnnnanatnntcngtnaggntnncntncnnnnagnnnannntgnnnnngganatnnnnananncngtntnnnccnttnnngnnnnntnntntncnaannnatnnngncnnngnngtnngccagcnnnnngccngtncnnncgnctnntncnnacngnnanantncnntntnananaanntatcnanancntcnnngcnanncncgnnttntncntnncgnannncnnnnnnnnnnnnnngtannnncnnncnnaannncnnntnnnnnnngnggtnggnttnnncnnnnnncgnnnnnnnngntnnnnnntnnnncnncnnnnttncannncnntnnnagnanaangnnnngcnncangngnttnnngnnntncnncccacgntntgccctnnacggcaaaagtnnatagttnagaaantgtgccncatttnnngcccgcncccctgnnacngngaanacaacagncagnccnntnncantnnccgntcactgacttnnccggagtcttactgcttacaactccggctcggtcaccccctctgacgcgggaggctgcaggtgtatcattatagccttttccttggcaacatatggttttgccaaaccgcccatcgggtctgccggaaaaggaacgtacctgttatgctgggtattcagttgtcaaggtgctggggaacggactatatccgctaaagagaaaagcgtcggagaatggagtgtgccgccatacgatcttcttctgtttctgcctcattgtacttcctgcgaagccactcaatttctatcggttttaagtatgctgtatgagaattgggtctgcggtctataagagaaattcctccatgcggaccgggcttcgtgtcaatttcgtaaaagtccataaggtaaacaatatcataattgattgtgcggcgagaaacgccgaaccgtttcgcaaaatcatcgatgctatattttttatatgtatataaaagctcaataatttcattgcggcgtatttcgacgtcagacactccatcacctcctctcatttctctaaaccccatcttaaatgtaattagtgcaaaaaccttgcactaattatttgaactttttgtgaatttttgaagttaaaaaaacaccgccgatttcagtaaaggaatcagcggtgttttgcattagaagttttttattccgactatatgccaatagcggaaaagttcctgtctcatacagaaagattcagtgtaagttcttcaatgaaatatctctgtactagtttttctgctgtttgcaatgtatcaggtacagcataaaatttatagcaataccgcacaattcccgcctgacggcttaagcaccgttccggcggctgccgcaccttgctcgccgtatcggtacttagaattatgcggtattgccttatattacttcacctattattatgtgtatccttaccatcttgcttttataaacttttttcatctgttttgcttgcgtatccagcacagattgatttctaagttgcggtgtttttctatcccgatgttcgctgccaagcgaatagtcttacttcacacccttgtcaccaaggtctgacaggtaccgcgcacggcatagctgccgctgcctgcgggcaggaagaagctgtcgcctttcttgacgaccacggtctcaccaccgcaggtcagctcaccctcgccgtctgtgacgagcagcgaaacaaagctcttctcgtccgctgtgtcctcaaacgcgccgttcttggcatccacggtgaaatattcaccctgcgccagatggctgccgaagtcatgcttgacaggcggggtgcgcagggtcacgtccaacgccttctccacgtgcagggcgcggggcttgccgtccgcccccacacggccgtaatcgtacacacggtaggtcacgttggagttctgctgtacctcggcaatgacaatgcccttgcaaatggcgtgcagcgtgccggccggaataaagaagcagtcacccttgtgcaccggcacggcgttcaacacctcggtcagggtgttattcttgatgcgctcctcaaactccgccttggagatttcatggtcaaagccatagtacaggaaggcacccggctcacagtccagcacataccacatttcggtcttgccgtactgatgctcgtttttcagcgcgtactcgttggaggggtgtacctgaatggacagattgttctttgcgtcaatgaactttgtcaggattgggaactgttcaaacttctcgcagtcggtgccaaggcagcccgggtgggcggtcacatagtccgccagcgttgtgccgtccgccagatagctgggaccgtccgggtggcaggaaagcacccacgcctcggccagcgggttcagatcgctcttgatgccaaagtcactgcgcaggcggctgccgccccacaggtaatccttgcagctgggagtcaatttcagtatattcatatggatctcctttacctcaaaatttcattttttactcaggcatcttctgtttcctgttctcgcaaaaaatagcacacaataaacgctgactgtgtcatgcccagccagagtagaaacaccgcattccagcctcggctatgccgccgatgccccgtgcggtcgcagctgcaccaaaataggttatggcgctcagcacagggcgctaaaatcttcactttaagcaaaccacttctcggcgtctttcacaatttcacattcgaccttttcagcagcttctctgttttcggcactgacagaaatgtaaattttcagtttcggctccgtgccggagggacgcacgacaatagagcagttatcttccagcaggaacttcagcacttcagacttgggcagcccgtccaggccataagcataatccagcagctttacaaccttcttaccgccaaacgctttgatattgccgcggaatgcctgcataatgctctgcatcttggcaaaaccggcgctgccgtcgaactcgtagctgtgcagggtgttcaggcagtagccataggtcttgtacagctcgtccagcttatccagcaggctgatgcccttggtggcgtagtagctgaacatctcgcagatcatgtaagcaccgtccacgccgtccttatcgcggacgtaggagccggtcaggtagccgtagctttcctcaaagccgaacacatagctgtctgccctgccctgcttttccagcttgccaatctgctcaccgataaacttgaatcccgtcagcacattgattgtccgcaaaccataatgggtggcaatctgttcccccatatccatcgtcacgatggtcttaaccatgaccgggtcg

SEQ ID NO: 831 - DNA, 4000 bp, Escherichia coli
  misc_feature (6)..(7): n is a, c, g, or t
  misc_feature (11)..(11): n is a, c, g, or t
  misc_feature (13)..(13): n is a, c, g, or t
  misc_feature (15)..(15): n is a, c, g, or t
  misc_feature (19)..(20): n is a, c, g, or t
  misc_feature (28)..(29): n is a, c, g, or t
  misc_feature (35)..(36): n is a, c, g, or t
  misc_feature (38)..(38): n is a, c, g, or t
  misc_feature (40)..(40): n is a, c, g, or t
  misc_feature (43)..(45): n is a, c, g, or t
  misc_feature (49)..(49): n is a, c, g, or t
  misc_feature (51)..(51): n is a, c, g, or t
  misc_feature (53)..(58): n is a, c, g, or t
  misc_feature (62)..(62): n is a, c, g, or t
  misc_feature (65)..(65): n is a, c, g, or t
  misc_feature (67)..(67): n is a, c, g, or t
  misc_feature (71)..(71): n is a, c, g, or t
  misc_feature (73)..(73): n is a, c, g, or t
  misc_feature (75)..(77): n is a, c, g, or t
  misc_feature (79)..(79): n is a, c, g, or t
  misc_feature (82)..(82): n is a, c, g, or t
  misc_feature (85)..(85): n is a, c, g, or t
  misc_feature (87)..(87): n is a, c, g, or t
  misc_feature (90)..(90): n is a, c, g, or t
  misc_feature (93)..(93): n is a, c, g, or t
  misc_feature (95)..(95): n is a, c, g, or t
  misc_feature (99)..(100): n is a, c, g, or t
  misc_feature (108)..(110): n is a, c, g, or t
  misc_feature (112)..(118): n is a, c, g, or t
  misc_feature (120)..(120): n is a, c, g, or t
  misc_feature (122)..(123): n is a, c, g, or t
  misc_feature (125)..(126): n is a, c, g, or t
  misc_feature (128)..(128): n is a, c, g, or t
  misc_feature (130)..(130): n is a, c, g, or t
  misc_feature (132)..(132): n is a, c, g, or t
  misc_feature (135)..(135): n is a, c, g, or t
  misc_feature (137)..(137): n is a, c, g, or t
  misc_feature (139)..(141): n is a, c, g, or t
  misc_feature (144)..(144): n is a, c, g, or t
  misc_feature (154)..(154): n is a, c, g, or t
  misc_feature (157)..(159): n is a, c, g, or t
  misc_feature (163)..(165): n is a, c, g, or t
  misc_feature (167)..(167): n is a, c, g, or t
  misc_feature (169)..(169): n is a, c, g, or t
  misc_feature (171)..(172): n is a, c, g, or t
  misc_feature (174)..(174): n is a, c, g, or t
  misc_feature (180)..(181): n is a, c, g, or t
  misc_feature (183)..(183): n is a, c, g, or t
  misc_feature (189)..(190): n is a, c, g, or t
  misc_feature (192)..(192): n is a, c, g, or t
  misc_feature (195)..(197): n is a, c, g, or t
  misc_feature (200)..(201): n is a, c, g, or t
  misc_feature (205)..(205): n is a, c, g, or t
  misc_feature (208)..(210): n is a, c, g, or t
  misc_feature (212)..(214): n is a, c, g, or t
  misc_feature (216)..(216): n is a, c, g, or t
  misc_feature (218)..(218): n is a, c, g, or t
  misc_feature (220)..(224): n is a, c, g, or t
  misc_feature (226)..(227): n is a, c, g, or t
  misc_feature (229)..(229): n is a, c, g, or t
  misc_feature (231)..(233): n is a, c, g, or t
  misc_feature (238)..(239): n is a, c, g, or t
  misc_feature (241)..(243): n is a, c, g, or t
  misc_feature (249)..(249): n is a, c, g, or t
  misc_feature (254)..(254): n is a, c, g, or t
  misc_feature (267)..(267): n is a, c, g, or t
  misc_feature (275)..(275): n is a, c, g, or t
  misc_feature (277)..(277): n is a, c, g, or t
  misc_feature (281)..(281): n is a, c, g, or t
  misc_feature (283)..(284): n is a, c, g, or t
  misc_feature (290)..(290): n is a, c, g, or t
  misc_feature (292)..(293): n is a, c, g, or t
  misc_feature (308)..(308): n is a, c, g, or t
  misc_feature (312)..(312): n is a, c, g, or t
  misc_feature (319)..(319): n is a, c, g, or t
  misc_feature (321)..(321): n is a, c, g, or t
  misc_feature (325)..(325): n is a, c, g, or t
  misc_feature (332)..(332): n is a, c, g, or t
  misc_feature (348)..(348): n is a, c, g, or t
  misc_feature (355)..(355): n is a, c, g, or t
  misc_feature (360)..(360): n is a, c, g, or t
  misc_feature (366)..(366): n is a, c, g, or t
  misc_feature (370)..(370): n is a, c, g, or t
  misc_feature (377)..(377): n is a, c, g, or t
  misc_feature (389)..(389): n is a, c, g, or t
  misc_feature (402)..(402): n is a, c, g, or t
  misc_feature (405)..(405): n is a, c, g, or t
  misc_feature (407)..(407): n is a, c, g, or t
  misc_feature (410)..(410): n is a, c, g, or t
  misc_feature (418)..(418): n is a, c, g, or t
  misc_feature (428)..(429): n is a, c, g, or t
  misc_feature (431)..(432): n is a, c, g, or t
  misc_feature (437)..(439): n is a, c, g, or t
  misc_feature (447)..(447): n is a, c, g, or t
  misc_feature (453)..(453): n is a, c, g, or t
  misc_feature (456)..(456): n is a, c, g, or t
  misc_feature (459)..(459): n is a, c, g, or t
  misc_feature (465)..(465): n is a, c, g, or t
  misc_feature (467)..(469): n is a, c, g, or t
  misc_feature (472)..(472): n is a, c, g, or t
  misc_feature (474)..(474): n is a, c, g, or t
  misc_feature (482)..(482): n is a, c, g, or t
  misc_feature (484)..(485): n is a, c, g, or t
  misc_feature (487)..(487): n is a, c, g, or t
  misc_feature (492)..(492): n is a, c, g, or t
  misc_feature (495)..(495): n is a, c, g, or t
  misc_feature (498)..(498): n is a, c, g, or t
  misc_feature (500)..(501): n is a, c, g, or t
  misc_feature (504)..(504): n is a, c, g, or t
  misc_feature (507)..(507): n is a, c, g, or t
  misc_feature (512)..(512): n is a, c, g, or t
  misc_feature (515)..(515): n is a, c, g, or t
  misc_feature (517)..(517): n is a, c, g, or t
  misc_feature (521)..(521): n is a, c, g, or t
  misc_feature (527)..(528): n is a, c, g, or t
  misc_feature (530)..(530): n is a, c, g, or t
  misc_feature (532)..(532): n is a, c, g, or t
  misc_feature (535)..(535): n is a, c, g, or t
  misc_feature (537)..(537): n is a, c, g, or t
  misc_feature (539)..(540): n is a, c, g, or t
  misc_feature (544)..(544): n is a, c, g, or t
  misc_feature (546)..(546): n is a, c, g, or t
  misc_feature (549)..(549): n is a, c, g, or t
  misc_feature (551)..(551): n is a, c, g, or t
  misc_feature (553)..(553): n is a, c, g, or t
  misc_feature (557)..(557): n is a, c, g, or t
  misc_feature (559)..(559): n is a, c, g, or t
  misc_feature (563)..(564): n is a, c, g, or t
  misc_feature (567)..(567): n is a, c, g, or t
  misc_feature (569)..(569): n is a, c, g, or t
  misc_feature (573)..(573): n is a, c, g, or t
  misc_feature (575)..(578): n is a, c, g, or t
  misc_feature (581)..(583): n is a, c, g, or t
  misc_feature (588)..(588): n is a, c, g, or t
  misc_feature (590)..(591): n is a, c, g, or t
  misc_feature (593)..(593): n is a, c, g, or t
  misc_feature (597)..(597): n is a, c, g, or t
  misc_feature (599)..(600): n is a, c, g, or t
  misc_feature (603)..(605): n is a, c, g, or t
  misc_feature (607)..(607): n is a, c, g, or t
  misc_feature (611)..(611): n is a, c, g, or t
  misc_feature (616)..(616): n is a, c, g, or t
  misc_feature (618)..(619): n is a, c, g, or t
  misc_feature (621)..(623): n is a, c, g, or t
  misc_feature (625)..(625): n is a, c, g, or t
  misc_feature (634)..(634): n is a, c, g, or t
  misc_feature (636)..(638): n is a, c, g, or t
  misc_feature (640)..(641): n is a, c, g, or t
  misc_feature (643)..(643): n is a, c, g, or t
  misc_feature (646)..(646): n is a, c, g, or t
  misc_feature (649)..(651): n is a, c, g, or t
  misc_feature (656)..(656): n is a, c, g, or t
  misc_feature (659)..(659): n is a, c, g, or t
  misc_feature (662)..(663): n is a, c, g, or t
  misc_feature (666)..(667): n is a, c, g, or t
  misc_feature (679)..(679): n is a, c, g, or t
  misc_feature (681)..(683): n is a, c, g, or t
  misc_feature (686)..(686): n is a, c, g, or t
  misc_feature (689)..(690): n is a, c, g, or t
  misc_feature (693)..(695): n is a, c, g, or t
  misc_feature (698)..(698): n is a, c, g, or t
  misc_feature (701)..(701): n is a, c, g, or t
  misc_feature (739)..(739): n is a, c, g, or t
  misc_feature (760)..(760): n is a, c, g, or t
  misc_feature (1986)..(1986): n is a, c, g, or t
  misc_feature (2017)..(2017): n is a, c, g, or t
  misc_feature (2397)..(2397): n is a, c, g, or t
  misc_feature (2921)..(2921): n is a, c, g, or t
  misc_feature (3200)..(3200): n is a, c, g, or t
  misc_feature (3512)..(3512): n is a, c, g, or t
  misc_feature (3539)..(3539): n is a, c, g, or t
  misc_feature (3557)..(3557): n is a, c, g, or t
  misc_feature (3674)..(3674): n is a, c, g, or t
  misc_feature (3680)..(3680): n is a, c, g, or t
  misc_feature (3728)..(3728): n is a, c, g, or t
  misc_feature (3734)..(3734): n is a, c, g, or t
gcgggnngcantngncggnncctccggnnccggcnngncnacnnngctncngnnnnnnggcngtntngacngncnnncngcnggngnggngcncntcgnnggccgcgnnntnnnnnnncncnncnngngngngcncngnnngcngcgcaaccangcnnncggnnncntntnncngtttcnncncctgcnncnggnnntcnnggcnctnnngnnngngncnnnnncnntncnnntgcgnngnnngagggncgccngcgcgcgcaccgnggcccgcngnctcntnnagcgcntnnggctcggcgagcggntgcngcaccgncngcancagctcnccggcggggagcggcngcgcgcngcggncgcgcncgcnctggtgncgcagccgcggntcgtgctggccgntgngncgnccggcaanctggacggcnncnncgccnnnggcgtgcnggcgcngangcnggagcncnnncgngngcgcggcncnngnctggnggnggngnntcntgncctgnggntngccncgcgcnngnancgngncnncgancncgngngnggcncnctcnncgngngcgngnnnnaannngcggngnngngcgngnncgnnngngggngcttncnngnnngngcgcgccangnnngnngngcncgnnnccccnagngannggnncacggcgtcccngnnnggnccnncannngcncgngcccgccaccgaagtgtcaggccgccagggtgtcgtgncgggtgcggtagcggctggtnacctgccagcgccacaacaggtcgagcgacagccagccgacgatgccgacgagcagcgcgcaggtgacgcagccggcgatgaacggctgccacaccggcgccaggctgtggcctaaccagtgccagctggggacgaacctgaaatgctgccgcggcacgtgcagcagcgctgcgcccacccggtaggcgaggtagtacacgggtaccgcggtgaagggattgagcagcaaggtggtgccgcagatcaccgcaatgttgaggcgccagatgaccgcaacggtggttgccaggagcaggtgcaccggcaggggtacgaagcagatcgcaagtccggccccgaaggcgggcgtcacgccgcgccgatgcagcgtccacagcagcgggtcggtgagccgggcgccgaacggccgcaggaaccagcgttcgcgcagcgtgtgcgggtcggggaagagtcttttcagcagccggcgtggcatcgagccgcggactctaccagaaggccggcggcgggtatgtgcggcgtgccgcagcagcggcgctgccttgagcggccgcgcccctccggtatgatgccgcctttgcagccttaagctgccaggggtcgcgtaggatgtgggaaattgtgcgggccggcggcccgctgatgtggccgatcattctgtgctcgatcaccggggcggccatcgttctggagcgcctgtggaccctgcaggacaagcgcgtgctgccgcaggagctgccggagcgcgtgtggcagctgatcgaagcgaaccaggtcaatgacaaggtgatcgcgacgctcgagcagaactcgcccctcggcagactcctggccacggggctcgccaaccgccaccggtcgcgcgagatgctgatggagcgtctggaggacaccgggcgccacgtggtccacgagctcgagcgctttctcaacacgctcggcacgatcgccggcgtgtccccgctgctgggcctgctcggcaccgtgaccggcatcatccgctccttcaacgtcatccaggcgggcggcatgggcgacccgcgcgcactctccggcggcatcgccgaggcgctgatctgcaccgtcgccggcctgtgcgtcgccattcccgccctcatcttctatcgttacctgcgcggcagggtcgatggcatcgtggtgcagatggagaagcacgcgatccgcatggcggacgcgctggaagcggcgcggctgcgcgaacggncctcaccggcggccgccgcctagcgggcatnccgtgaacctcaagccgcgccgccacgaggagccggagatcaacgtcgtgtcgctgatcgacgtggtgctgctgctggtggtgttcttcatcctgtcgagccggttcagcgacgaggggcgcctgcgcgtgcacctgccgcatgcgagcgcggtgccggccgagaaggtgagcggcgagccgctggtggtgagcgtaacccagcagggcggttatctcgtcaacgggcacgagctcatcaactcgagccccgagacgctgcgcgccgcgctgctcaaggaagccggcaccaaccgcggtatccgggtcacgatgcgcgcggacgcccgcgcgactcaccagtccgtcatcaccgccatggacgtgctcgggcgcctcggnttctccgaggtcaatatcgccaccgtcaaggaagaggcggcgggcaagccttgaacgacgcacaccgcgcaggtgtcggaacgaggagcgcaccgcccctcgcgggcggggcgctgcgggcctaccggcgcctgctcggctacctgcgcccccatcggggacgtttcctgctcgggatcctcggcggggtgttgttttccgccaccatggcgagcttcgcgctgctcgccaagaaattcggcgacggcaccttcacccaccaggacccgcgcaccatcgtgtgggtgccgctcgcgctgatcggcctgttcatcctgcgcggcctgggcgacttcacccagacctacttcatgggctatgtcggccgccgcatcgtgagccagctgcggcgcgaggtgttccggcacatcctgcacctgccgatcggttacttcgatcgcagctcttccgccgcgctgctgtcgcgcctcacctacaacaccgagcagatcggccaggcgaccaccgactcggtgatcatcgtngtgcgcaccgcgctcaccatcatcgcctcggtcggctttctgctgtggctcaacgtgcgcctcacgctcatcgcgctcgtcatgggtccgctggtgggctggctggtgtcggtcatcaaccgccgtttccgccgctacagccgccgcatccaggactcgatgggcgacgtcacgcgcgtcgccaaggagggcttcgaagccccgcgcctgatcaaggtctacaacgccgaggagcatctcggccgccagttcgacgccgtgaacgatcgcaacctgcgntcgaacatgaagctcgtgctgaccaagggagtctcgaatccgaccgtgcagctggtgaccgtcgtgggtctcgcgttcgtgctgtcgatcgcgatagccgacgccgtgcacgcgcgcatgagcatgggcgacctgctgggcttcctcaccgcgctggtgagcatcgcgcagccgctgcgcgaactggtcggggtggccggccccctgcagcaggggatcgccgcggggcagagcctgttcgagctgctcgatgagccgcaagagccgcagggcggcagctggcgtgtggcgcgcgtgcacggggccgtgcanttcgaccacgtgtcgttctcgtacgcnggcgccgcgacgctggcngctgagccccgctctcgcgagcgcgccgcggcgctcactgacgtgtcgctgcaggtcgccgccggggagagtctggcgatcgtggggcgctccggcagcggcaagtcgacgctggtnaatctnctgccgcgcttctacgacgccggcgcgggcagcgtgcgcatcgacggncgcgangtgcgcgattacgcgctgcggaacctgcgcgaccagatcgcggtcgtcagccaggacgtggtgctgttcgatgacaccatccgcaacaacatcgccttcggccgcgagctgccggccgcggccctcgagcgcgcggcggaggccgcacacgtgctcgagttcgcgcgcgcccagcccgacgggctcgataccctggtgggcgaccgcggcgtcttgctctcgggcggccagcgccagcgcatcgccatcgcgcgggcgctgctgaa

SEQ ID NO: 832 - DNA, 4000 bp, Escherichia coli
catcagcgcttgtgcgtggatggtcagtctatctgtttgtatctctctcgtgaaggtgtgagcccgtgaaaaccctgtggaattggcttccaagcgccactgaccgtcgtgtgcgcattgccgcctgggcttctctcatcagccagatcctcatcattggcaccggtggggccgtccgactcaccgcctcaggtttggggtgccccacttggcctcggtgcaccgaagactccttcgttaccacggcggagatgggctttcacggaatcatcgagtttggcaatcggctcctgactttcgtgctcatcatcatcgccatcgtgatgttcgctttcgttctgcgaatgcgcaaagaacggcccgagctctttcgcctgtcgttaggccttggtctaggaattcctggtcaggcggttattggcggtgtcacggtcctaacagacctcaatccttatgttgtgggtctccattacctcctttcggcaattctcgtgggattcgcggcagtgcttctctaccgcgttcgcagcggaccgcgtcggagcggatggggcgtgccgggtgctgtgcgagccttgagcgccactctcctcgctgtactgggactctctgttgtcatggggattctcaccaccggatccggaccgcatgcaggagacgcgggcgcggcgagaaacggcttggactcctggttgcttcaacatttccacgcctggccctcctatattgtcctggggctggtcgtgacactcactgcgcttgcgtggtttgcaggtgtggggtcgcagggcttccgcagggtaataaccggctcgctggtcgtcaccagcgttcaaatagctgtgggcctctaccaggcgaattacggtctacctgttcttgccgtgggaatccacatggtcttggctgcggtacttgtcgcgttcgtcgtgaccgcacttctcgctcagcgcgaaccgcttacagcggaagaagcgggtcaatcccgaccgcgaggaagagtagcgtcaagtagctaatgctggagtgaaacaccttcatgggggcaagttcgccacctcggagggaacgctgatataggcggtgagactcgaagacgaaccaccctcctgctcctagcgcgacgacggagtagagcagtcccatcggagcggcgggaatcagcaacagcgatgccgcgacggtagcccatgcgtacaagatgacctgcagtcccacgacaggtgcctcacggaccacagcaagcatgggcacgtcaacccgcgcgtagtcctctcgatacttcatcgagagaggccagtagtggggcggcgtccacaggaacaccacgaggaacagaatccaagcttctaagctcagtgaaccggtgacagccgcccaaccaatgagtactggaaaacatccggcgattcctccccagatgatgttctgctcactccgcctcttgagccagagtgtatagacgaagacatagaagagaattgcagccagcgagagcccagcggcaagaggagtcgtgaaaacccagagccacgcgacagacagcactcccaggacactggcaaaaacgagagccgatcgtccagaaatatcccccgtcaccagaggtcttgcgctggtgcgacccatgtgaacatcaatgtcgcgatcgatgaacatgttgtaggcattggcgctgcccgcactgagggcgcctccgacaacagtggcgaccactagccagaggctcggtatgccacgttccgccagcaccataacggggatggtggtcaccaagagcagttcgatgacccggggcttcgtgagcgcaacgtaggcgcgaaccacggtccgaagactccgtggacgcacgggagcaccgagagaagaagtcatgacgggaagaatccttagggtaacgcgacagcctcagtctagggagaaaagcctctaaagagctgagtgcgtcacggcccaggtggagaattgcccctgggtatactgggttgtgtagggcctcaatcggtgccccagatagcggaatgtccaaaggatggccctcccacatgggatcagtgtttagcgaagttgacagagaagccgtagatatcgcgagagtgttggccgctgacgctgtggagaaagccggccatggacaccctggcaccgcaataagcctcgcgccagtggcctacctgctctatcaaaaagtgatgaagctcgacccgacggaccctcactggataggccgcgaccggttcatcctgtccgcggggcactcttctttgacgcagtatgttcagctcttcctgggcggcatggggctcgagctcgatgacatcaaggctctccggacctgggggtcactgacgccaggccaccccgaatttggtcacaccgaccatgtggagattacgacaggccccttggggcaaggcattgcttccgccaccggatttgcctacgcgcaacgttttgagcgggggctgtttgaccccgatgcggctcccggagagtccccctttgaccaccacgtgtttgtcattgctggtgacggtgacctgcaagagggggtctccgcggaggcggcgtccttagctggacatcaagagttgggaaatttagtcgttctctacgacgccaaccaaatctctatcgaggatgacgtcgacatcgcgttcagtgaggacgtggctctccgctacgagtcctatgggtggcacgtccagacggtggatttcggcgaagcggatggttacacggaggacgtggacgccttgttgggagccatctcgtccgccaaagctgagacgggtcgaccctcgttgatcgtgatcaagaccatcatcgggtggccctcccccaccaaaaaaaacaccggcaagattcacggctccgcactgggagcggacgaactaaaggcactcaaaacagaactgggggtggatccggacgccacatttgtcgtcccaccccatgttctcgagcacactcgatccttgcgtgagcgggctcacattgtgcggcacgcgtgggacgaaaaattcgactcctggggtagcgccaaccccgacaagaaagcgctgttggatcgtctcctgagcaagtcattgcctgacctggaagggctgcttccgacctttgaaggtgcagagactatggcaacgagagcggcctcgggacaggtcattaatgctcttgccgccgccctgccagaactctggggaggatcggctgaccttgcggattcgaacctcacgacaatcaaaggacggccttcttttgcgccggagcgtcgctccaccaaggaatggtcggcaaacccctacggctctgtcctgcactttggcatccgggaacacgcgatgggggcgatcctgaatgggattgcgctgcatggcccaactcggcccttcggcggtaccttcctgatcttcagcgactacatgcgccctgcagtgcgcctcgctgccctgatgggtgtgcctgtcatctacgtctggacacacgattcgattggtttgggagaggatggccccacccaccagcccgtggaacagttggcaacgctgcgggccattcccgggttggacatcgttcgacctgcggatgcgcatgaaactgcctgggcctggaagacgatgattgagcgcactagcaaccctgcgggtatcgctctcacgcgccaaggcatacccgttcttgcgcgcggagaggacgaagcgaccccgtcaacacttgcccatgcgcgccacaccgcccgtggtggatacgtcttagccgaagcagacggtgagctctccgtgatcctcatcgctacaggctccgaggtggcaattgcgctgaaagcgcgagagtctctccaagcggagggcgttggcactcgcgtcgtctcgatgccctgcgtggagtggtttgacgagcaagaacagggctaccgagagaccgtgttgcctgcttcggtgcgggcgcgcgtatccatcgaagctggaatttctcaatgttggcatcgctttgtcgg

SEQ ID NO: 833 - DNA, 4000 bp, Escherichia coli
  misc_feature (1175)..(1175): n is a, c, g, or t
  misc_feature (1618)..(1618): n is a, c, g, or t
  misc_feature (1659)..(1659): n is a, c, g, or t
  misc_feature (1995)..(1995): n is a, c, g, or t
  misc_feature (2926)..(2926): n is a, c, g, or t
  misc_feature (2962)..(2962): n is a, c, g, or t
  misc_feature (3944)..(3944): n is a, c, g, or t
agttggagcagcttagaattctatatgcaggttacaagattggtgttgttcaatcaaatgacacgccctcggctggagttgatacccccgaagatcttgaaagggtaagaaagtttttttctaattaaatagcagattcacccgtttcactagttctaatcctcactacctcttcaatattacttacaaaaattttcccatcgccaatttttccggtatgtgctgctgtagatattgcttcaatgacttttttaaccattttgtctgaaacaataatgtctaatttaattttgggtaaaaagtcaattacatactctgcacccctatagagttcagtgtggcctttttgtcttccaaaccctttaacttccgtcgctgtaatcccatttataccaatttcagaaagagcctctcttacttcgtctaatttaaatggtttaattactgcctcaatttttttcatctaatttccttcttcatatacattaatgtttaaaggttatggggtatcttctgtctttaccaaacgccctatgcgtaattttcggccctatgggactttgagctcttttaaattcgttattattgattaactttacaacgcgattcacatttttactagaaaaaccttcttttacaatcgacgctatatctagatctttttcaatataaagctcaattatcttatcaagaatttcatatttagggaggctattctgatcaagctggtcatgccttaattcagctgtaggtggtcttttaatgatttcatttggaatgatctttgatattgaatttctataatgtgctaatttataaacccatgtttttgggacgtctttaagaagtgcaaaacctcctaccatatctccataaagggttgtataacctacagcagtttcacttttattacttgttgatattacaagcccactaaatttattagacaaagccattaataaaacacccctgatgcgagcctgtaaattttcttcagttgtatcaaaaggcttatttttaaattcgcttgataatgtttttctaaaaagtttaaaaatagattgaatatctatttctttgtaattgacacctgtatttttaatcattttgcgagattcaataatgcttatttttgcggtaaattctgaaggcatcatgacagcagtaatatctcntttgtcaaatacgtcatttgctagcgctagaaccaaagcagaatctataccaccagatagacctataaatatgcttttaaagttattcttaactacataatctctaagtcctaatttaagcgcctcatataaatgtgcttccttgttataaaaagtattattaatgtttgcttttaaaaaaacatcaataatcgctgtttcttctttaaaaaatgataactgatgagtaagcttcgcttgtttgttaacaacaaaagagccaccatcaaatatgagctcatcttgacctccaattgcattgaggtagatcacagtagattttgtttccttagctagcttagttatgatttttactcgagcatcatatttttctatttcataaggggacgcattaactacaataatgacatcaactaattttttcttaagtaatttgcttgggnaaagactccaagcatcttcgcaaataagaagaccaatcttnaaactcttatgtttaaaaataaattctttttcacccggctcaaaatatctattttcatcaaatacgccataatttggcagaatttttttaaaataggtaccttgaatttttccattaaaaagtaatgatgctgcattgtatattttgccgcctttttttaatgggtgcccaacaattacttttatagaaggtaaggcttgcgcaatcctcgtcagtgattttgaacatgctttaagaaaatcttctcttaagacaagatcttcaggggggtagccgcacaaagagagttcaggagtaataactaattcagccccgttttcagcagcttctgtggcncgcttaataataagaatgctgttattttcaatatcaccaacaaacgaatttatttgtgctagagctattttcatagttttagtaactgccacccgcatttttaataaggtcaacaatttctgtatttttagctttgagcgcatatacaagagctgttaatccgtagcgatcttttgcttttaaattaacttttgattcaataaaaagttgaatcatttccttagatttatttgctacagcatagtgaattataggcgtgccatccgagtcttttcggtcaatattagcgccatttactataagaagttttgaaactgccaaatgattttttttcgtggcccaagtgagtgctgtccaattaaactgatcttcataatcaatttttacaccacgctttataaaaagacttaccgcatctgcattaccctctcttgaagcatacataagaggactgcatttgtatttgtctacgatatttggatcagcaccatggtcaagtagtgtttgaattgtttttatatcaccgtttttggaggcatacattaaaacagtttgaccagcatcgttagtgttattgggatcaatgccgcgtttgattaatagatctacgatattatgaaatcctgatatcgcagctagcccataagcgctccatccatcattgtctcttatttttggatctgctccattatctaaaagtaactgagctgatcgtatataatttttctttgcagcaaacattaatgcagtccagccgttactttcagttgcattcactgatgcgccttttttaattaagagtgccacaatcttatccatatcttttcttgctgcatacataagagctgtgacgccatcttcatctttactgtttggatttccaccgctttccaaaatagcgcttactgtctcaaggtcgccttttgatgcngctgttaaaaggtaatttactgactcttccgcattngctataaaagcaaaaaaagaagtgattagaaaaaagatgataagagtttttttatacaatttttatttttttaataatgcttgcatagtaagccccatgtccgcaggagacttagacatgttcacaccggctttttctagcgctttaattttatctattgcaagaccagagccttgagaaatgatagcgcccgcatgacccattctttttccttcaggggctgtaatgccagcaatataacctgcaataggtttttttatgtgttgtttgatatattcagcagccaattcttcatctgaaccaccaatttcaccaactaatataatgccctgagtatttttatcttcttcaaacatttgtaagcattcaataaaattgagtcctttgatgggatcgccaccaatgccaacacacgtgctttgacctaacccaagcactgttgtttgttgaacagcttcgtaagttaacgtgcctgattttgaaataatgccaatggatccaggcaagtgaatacttccaggcataatcccaatcttacattcgcctggtgttataacgccaggacaattagggccaatcagtttagattggttagcgcgaatagccgccttcacattaatcatatcttgtattggaataccttctgtaatacatacaataatttcaataccttcttcagaggcttcgataattgaatctgcagcgaaagcgggaggaacgtagatgactgatgcattggctccagttgttttaatagcatctctcactgtattaaatacaggtaaattaagatgtaatgtcccacctttgccaggcgtaaccccgccgactaattttgtaccataggtaattgcttgctctgagtgaaaagtaccttgtttgccagtaaagccttggcaaataagcctggtagatttattaatgagaatagacattttattttttgatgagactagttgcgatcgttgccgcttcggtaagngtgtttgcggccttaatatttaaaccgcttgtttgtaaaagttttttacctaaatc

SEQ ID NO: 834 - DNA, 4000 bp, Escherichia coli
  misc_feature (471)..(471): n is a, c, g, or t
  misc_feature (504)..(504): n is a, c, g, or t
  misc_feature (903)..(903): n is a, c, g, or t
  misc_feature (1016)..(1016): n is a, c, g, or t
  misc_feature (1434)..(1434): n is a, c, g, or t
  misc_feature (2290)..(2290): n is a, c, g, or t
  misc_feature (2374)..(2374): n is a, c, g, or t
  misc_feature (2377)..(2377): n is a, c, g, or t
  misc_feature (2380)..(2380): n is a, c, g, or t
  misc_feature (2767)..(2767): n is a, c, g, or t
  misc_feature (2791)..(2791): n is a, c, g, or t
  misc_feature (2809)..(2809): n is a, c, g, or t
  misc_feature (2881)..(2881): n is a, c, g, or t
caaattgttgacttggtagagaacactaaaatgaacaagagcaaaatcgtttgcaccatcgataaaattattccttattttgtttggacaacgttgttattagcgactcttacttttgtttattggtacccaaaagattttgatttggcgttgctcagtgccaccagcgtactaattatcacttgtccttgtgcatttggtttagccacaccaatgagcattgcagtggccagcggtgctgcagcaaaaaagaaaatactgattaaaaatggcgatgcattagaagtgttgagcaaggttaagcacgtggtatttgataaaaccggcacacttactttgggcgaatttaaagtaagtgggttggaatcaaagattgatcgagctgaatttttgagtattatggcgagtattgaaaagcattcagagcaccctttggctaaagccattgttgattacgccggcgctaaaaanaccttagcagttaaaaactttaatgcaataccnggtgaaggcgtggttgcaaaaattggctcaaagcagtatcggttgggcaatttaaactaccttgtgagccatggcgcgagcgaagacagtgacttgtctgataatgcgaacgcactagaaaaacaaggccatacttgtatctggtgcgctgacgagaacaaggtcttaggttttatttcgctcagcgatgaagtgaaatcggatgccaaagcagtggttaacgaactgcatcgaatgggtaaaaccgttaccatgctcagtggcgatagtaagcaggtcgcccaaacagtggctaagcatttgggcattaaaaatgttattgcacaggtattgccaagtgacaaagccaaccacattaaaactttgcaaaaaaatggcttagtgctgatggtgggtganggtattaatgatgcaccggctttggtacaggccgacagtagtattgccattggttctggcgccgatgtgagtgttggtagtgctgatgtggtggttttaaaaaatacactaanccctattattgaggcaattaaattgtcaaaaaatacacaaaataccattaagcaaaatattgctttcgccttattttacaatgccctgatggttccattggcgatgatggcaaaggtgacaccgctgtttgccgccattgtgatgccaataagttcactcattgtgattggcaatgctgctcgattaagggctaaaaagtgaagatattacaagtgaaatagtatataatccctcctctttgagaaatacataaaagttacagacatgaaaacagacattcatcctaattatgacaccgtaaaagtagtgtgttcgtgtggcaattcttttgaaacacgttctaccataggcaaagaaaatttaaatctagacgtgtgttctagttgccaccctttttacacgggcaagcaaaaaatnatggatactgcaggtcgcgttgagaagtttaaatcacgctacgcttcgtttaaaagataaagcattgaaaatccttaaaaagccacgagagtggctttttttatgcctgatgattactcaaatgccgatataattattacattcatttttagataggaaaattatgtcatttgattacattaacgccttattaaaaaaaccagtatcacgcacgcccatttgggtgatgcgacaagcagggcgttatttgcctgagtatcgtgccacacgcaaaaaagcaggtgactttatgagcttgtgtaaaaacccagaacttgcttgtgaagtgactatgcagccaatggatagatttgatctagacgcggccattttatttagtgacattttgaccattcctgatgccatgggtttagggctttattttagcgaaggcgaggggccgaaatttgaacgccctatccaaactttggcagatatcgaagccattccttcagaagttaataacgatttaacttatgtatttgacgcagtttctaccattaagtcagcattgggcgctcgtgcaccactcattggatttagtggcagtccttggactttggccacttatatgattgaaggtggcagtagcaagacattcgctaaaaccaaagccatgttatttaatgaccctaaaatgttgcacttgcttttagataaattagcagacagtgttattgcttatttagaccaacaagtacaaagtggtgtggacagtctaatggtgtttgatacttggggcggtgttctgtctaaatctaattatttggatttttcattaagctatatgcaaaaaattgtaaacggcgtcaaggcnaaacatccaaatacaccgattactttgtttagtaaaaacggcggcaagcatttgagcgaaattgcggatactggttgtgatggngtnggnattgattggacagtggaactcagcgaagttgagcaacaaattggcagtaaagtggccattcaaggtaacttagatcctgctgttatgtatgccacacctgaagttgttcgagtggaggttaaaaaagtattgagccaatttaaaggcgacacaggacatgtgtttaatttaggccatggcattactccagacgttgatccagagaacatgaaagtactggttgatagtgttcacgaatttagtaccaaataatttatgtcacgcttaaaaacggtttttagtcaattaccttctggtaataaagcttttatcccttttattactgcgggagacagcggtattgacaatacttacgagctaatgcaggtcttggttgagaatggcgcngacgtgattgagcttggtgtgccnttttctgatccgatggcngatggcccggtcattgctaagtcacacgaacgagcagtggaaggcggtgtaagtttgcatgacgtactaganttggtaaaaaaattcagacaaaccaacgatacaacggccattgtacttatgggctatctgaatccaattgaagtatttggttatcaagaattttctgatgctgcaagcaatagtggcgtggacggtgtgctggtagtggatatgccacccgaagaggcgcaggacttaaagcggtgtttagataaaaaggacattgactttattttcttagtagcacccaccacaaccgatcaacgcctagattctttggccgatattgcttctggatttgtttacttcgtctcgttaaaaggcgtgactggtgcgggtcatttagacgtagattctgttaatgacaacatagcaagaattcgtaagtatgttaatttgccaatcggtgttggttttggtatcaaggatgctaaaacagccaaagctgtgtcggcatcagccgatgccgttattgttggttcatctttagtatcatttgttgaacaatatgctcatgatagggataaaatgttagcaagcgttggtagattatcggctgaaatatcagccgctataaaataaaggatcgattatgagttggttagaaaaaatattaccctcaattagcagtggggtaaaaaagaacataccagaagggctttggagtaagtgccctaagtgttcctcaacattgtatgaggaagaattaaaaaaattagtctacgtgtgtccaaattgcgaccaccacatgagaatatctgccagagttcgacttgaaagttttttggatgtggatgggcaagaggagatagcgcctaatctagtagccgttgatccgctgaagtttaaagatcaaaagaaatacaaggatcgctattctcaagcacagaaaaatacaggtgaaaaagatgctttagtggttaaaaaaggcacactaaatggcatgccagttgtggtggctgcgtttgattttaaattcatgggcggctcgatgggatctgtggttggtgaaaaatttgtccgtgcagcgcaagaaagcatggcaagcaattcacccttgatttgtttttcagcatctggcggtgcgcgtatgcaagagggcttattttcactcatgcaaatgtctaaaacatcgttgattttaaagtt

SEQ ID NO: 835 - DNA, 4000 bp, Escherichia coli
  misc_feature (1)..(1): n is a, c, g, or t
  misc_feature (3)..(3): n is a, c, g, or t
  misc_feature (5)..(7): n is a, c, g, or t
  misc_feature (9)..(13): n is a, c, g, or t
  misc_feature (17)..(18): n is a, c, g, or t
  misc_feature (21)..(22): n is a, c, g, or t
  misc_feature (24)..(24): n is a, c, g, or t
  misc_feature (28)..(32): n is a, c, g, or t
  misc_feature (34)..(34): n is a, c, g, or t
  misc_feature (41)..(41): n is a, c, g, or t
  misc_feature (45)..(45): n is a, c, g, or t
  misc_feature (47)..(51): n is a, c, g, or t
  misc_feature (56)..(57): n is a, c, g, or t
  misc_feature (59)..(61): n is a, c, g, or t
  misc_feature (63)..(64): n is a, c, g, or t
  misc_feature (66)..(67): n is a, c, g, or t
  misc_feature (70)..(70): n is a, c, g, or t
  misc_feature (74)..(75): n is a, c, g, or t
  misc_feature (80)..(80): n is a, c, g, or t
  misc_feature (82)..(83): n is a, c, g, or t
  misc_feature (87)..(87): n is a, c, g, or t
  misc_feature (89)..(92): n is a, c, g, or t
  misc_feature (94)..(99): n is a, c, g, or t
  misc_feature (102)..(102): n is a, c, g, or t
  misc_feature (105)..(105): n is a, c, g, or t
  misc_feature (108)..(112): n is a, c, g, or t
  misc_feature (114)..(119): n is a, c, g, or t
  misc_feature (123)..(123): n is a, c, g, or t
  misc_feature (128)..(128): n is a, c, g, or t
  misc_feature (131)..(135): n is a, c, g, or t
  misc_feature (138)..(138): n is a, c, g, or t
  misc_feature (140)..(141): n is a, c, g, or t
  misc_feature (143)..(143): n is a, c, g, or t
  misc_feature (145)..(146): n is a, c, g, or t
  misc_feature (148)..(150): n is a, c, g, or t
  misc_feature (152)..(152): n is a, c, g, or t
  misc_feature (154)..(154): n is a, c, g, or t
  misc_feature (158)..(158): n is a, c, g, or t
  misc_feature (160)..(164): n is a, c, g, or t
  misc_feature (166)..(166): n is a, c, g, or t
  misc_feature (172)..(173): n is a, c, g, or t
  misc_feature (176)..(179): n is a, c, g, or t
  misc_feature (181)..(182): n is a, c, g, or t
  misc_feature (185)..(186): n is a, c, g, or t
  misc_feature (188)..(192): n is a, c, g, or t
  misc_feature (194)..(194): n is a, c, g, or t
  misc_feature (197)..(198): n is a, c, g, or t
  misc_feature (201)..(203): n is a, c, g, or t
  misc_feature (207)..(209): n is a, c, g, or t
  misc_feature (211)..(211): n is a, c, g, or t
  misc_feature (213)..(213): n is a, c, g, or t
  misc_feature (216)..(226): n is a, c, g, or t
  misc_feature (228)..(233): n is a, c, g, or t
  misc_feature (237)..(238): n is a, c, g, or t
  misc_feature (242)..(243): n is a, c, g, or t
  misc_feature (248)..(248): n is a, c, g, or t
  misc_feature (250)..(250): n is a, c, g, or t
  misc_feature (252)..(252): n is a, c, g, or t
  misc_feature (257)..(263): n is a, c, g, or t
  misc_feature (265)..(265): n is a, c, g, or t
  misc_feature (267)..(268): n is a, c, g, or t
  misc_feature (270)..(272): n is a, c, g, or t
  misc_feature (275)..(278): n is a, c, g, or t
  misc_feature (281)..(281): n is a, c, g, or t
  misc_feature (285)..(285): n is a, c, g, or t
  misc_feature (291)..(291): n is a, c, g, or t
  misc_feature (293)..(293): n is a, c, g, or t
  misc_feature (296)..(297): n is a, c, g, or t
  misc_feature (300)..(300): n is a, c, g, or t
  misc_feature (302)..(303): n is a, c, g, or t
  misc_feature (305)..(306): n is a, c, g, or t
  misc_feature (308)..(311): n is a, c, g, or t
  misc_feature (313)..(313): n is a, c, g, or t
  misc_feature (315)..(316): n is a, c, g, or t
  misc_feature (318)..(320): n is a, c, g, or t
  misc_feature (324)..(324): n is a, c, g, or t
  misc_feature (328)..(328): n is a, c, g, or t
  misc_feature (333)..(333): n is a, c, g, or t
  misc_feature (335)..(340): n is a, c, g, or t
  misc_feature (349)..(349): n is a, c, g, or t
  misc_feature (351)..(351): n is a, c, g, or t
  misc_feature (353)..(359): n is a, c, g, or t
  misc_feature (362)..(362): n is a, c, g, or t
  misc_feature (364)..(368): n is a, c, g, or t
  misc_feature (370)..(371): n is a, c, g, or t
  misc_feature (373)..(376): n is a, c, g, or t
  misc_feature (381)..(381): n is a, c, g, or t
  misc_feature (385)..(385): n is a, c, g, or t
  misc_feature (388)..(388): n is a, c, g, or t
  misc_feature (390)..(390): n is a, c, g, or t
  misc_feature (393)..(393): n is a, c, g, or t
  misc_feature (395)..(395): n is a, c, g, or t
  misc_feature (398)..(398): n is a, c, g, or t
  misc_feature (402)..(402): n is a, c, g, or t
  misc_feature (404)..(410): n is a, c, g, or t
  misc_feature (412)..(414): n is a, c, g, or t
  misc_feature (423)..(424): n is a, c, g, or t
  misc_feature (439)..(439): n is a, c, g, or t
  misc_feature (464)..(464): n is a, c, g, or t
  misc_feature (537)..(537): n is a, c, g, or t
  misc_feature (580)..(582): n is a, c, g, or t
  misc_feature (586)..(586): n is a, c, g, or t
  misc_feature (830)..(830): n is a, c, g, or t
  misc_feature (1950)..(1950): n is a, c, g, or t
  misc_feature (1987)..(1987): n is a, c, g, or t
  misc_feature (2389)..(2389): n is a, c, g, or t
  misc_feature (3856)..(3856): n is a, c, g, or t
nancnnnannnnntttnngcnntngaannnnntnttttttnctgnannnnngcttnncnnntnntnnttnaggnntaaancnnttancnnnnannnnnnaanganttnnnnntnnnnnnggcnatacnatnnnnnttnannancnntnnnantntccnannnnntntttttnnatnnnntnnaanntnnnnnanggnnaannnaaannntngntgnnnnnnnnnnnannnnnngaanncatnnaaaananantttgnnnnnnntnannannnaannnnggntgcngttttnanaanncantnnannannnnancnncnnnaaanaacnaaccnannnnnnaaaacaaangntnnnnnnnttngnnnnntnngnnnnaaatntttnagnanttncnccnacanannnnnnntnnncccccttcnnaaccaaaattaggtncagccttctaaaccttcttttcagnaacttttacacgttagtagcctataatgataagcgtaaaatgcttacattaagaaaggcgaaaactgctatgngcaaattagatatctataacgaacgtttcagatatctgtcgtnnncgtntcagatatctgtcgcaatcgtttcagatatctgtttttttcgtattgctcgaaacaggaataaacaaaaaatattcatcgtttcgttgatatctattaacaatattaaatttgcttgtttcagagctatttgctatctttgcaacaaagagaaaattaaaaacaaacatattgcaggcgttttactaacactattaaagcataccaatatattgctcggaaatatactggaacagacgcacaanaaacgtgatgcaatgttttacgagtattgaaaagaaacaataatagcgaagtatttaaaaagttgtagaacgctgctatattgaaatttagaaccttatacaacaaaacagcttacaaagcatctgtttttttgaaatacagaagaatatacatttatgacaaatatagatactacaaatatgtgctctcaccttaaaaagaagctgtttgaggctgatggcatataccattctgtttgggaagcaatacaaaaagacgaagaacttagtgccgttgttcgctctcggcagttgcacatttaccgaaatggtaagaaaataatggtgttagctggtaaggcagcacctaaacttatatgcaatgataggcttaaccagctaatagaaaggggtggtaaatgaaaagggctattgttatgggtgccagtagtggcattgggcacgaagtggcacaactgcttattgccgatgggtggactgtaggtgtggctgcacggcatatcgacaaattagccgacttacaaaatgttgctcccgaacgtgtggttgttgctaaaattgatgttactgacaacaacgccgaaacaaactttcgccaacttattgagcgcataggagggttaaatctttactttcactcagcaggaatagggtggcaaaacacaactttagaccccgacaaagaaattaaaacaatggaaaccaacgccacagcatttacacgaatggtgggtgcagcatatcgatactttactgagaatggtggcggacatattgcctgtatcacttcaattgcaggaacaaagggacttggtgtggctccagcatatagcgcaacaaaggctttgcagaatgtttatattcaggctctggaacaattggctattacaaagcatcagaatatatgctttacagatatccgaccaggctttgttgatactcccctactcgctggtgctgctcattttcctatgctaatgacaaccaaatatgttgcacaccgcattatgaaagccattaaaaaacataaacacatttgtgttatagacacccgttggcacattcttaccttcttttggcaatacattcccaactgcatttggaggcatattccacttgntcgcacataaagaatatgcaatataaatggttacgcngtagggttgtttattgttttgtatgggcttaatgaccacattggattaaacaatacacaaaaaaccgccactgcaattaaatgcaatggcggaagagatgaaaaagattaattaccagagagttatcacaacccccttgcctttagcaaaccagacgcatctggtgccttaaggcccgtaaaattggagaatatctccattaagtccattgtatttccacgactcagcactttattcctaaagtcatcgcccacttttctggtcaatgcgccgtgctttgcaaagtagtcagcaatattaacagctaatacttcagaccacaaatagctataatatcctgctgcgtaaccgcctccccaaacatggttgaaatacgatgtagaatatcgtggaggaatttgnttgttaagcaatccaacatcgtttagagcctttacttcgaagtttttagcttcggtagcagtaggaacattcttagtatcgagcatgtgccaagccatatctacgcacgttgcgccaagattttcgcctaaggcgtatgcagcctgatagtttatagatttcaacatacggtcgcacaagtcggcaggcataggctggttggttttgtaatgttttgcataatgattgaacacctctggtatgcttgcaaaactctcgttaaattgtgatggcatctccacgaaatcgcgtgccacagctgtaccacttagtgtgttgtagtagcagttcgacaacattccgtgcagcgcatgaccaaactcatggaacatagtagacacctcatcccatgttaaaagagtaggctgtccgtctggtgcctttgcataattgcacacattatatataagaggtatctgctggcgcattttgctttgctttgcaaaagcactcatccacgctccgccacgctttgaaggacgacggaaataatcgcaatagaatagtgccaactgtttaccattattgtctattacatcgaacaccttcatatctgggtgataagtaggtatgtctttgcgttccttaaaagttaaaccatataccttatttgcagcataaaaaataccattaataagaacagaatcgatattgaagtatggtttcacttcatcgtcagcaaagttaaagtgttctttcttcatctttgcagagtaatagaatctatcgtaaggttgcaaactaaagtcggctccttgtgttttgcgcgcatacgcctctatatctgccgtttctgcagcagccttaggttggtattcctttataagttggttaagaaaagcatacacattatcggtattcttcgccattacattcgataaggcatacgatgcataattcttatagcccataagttgagccttttcggcacgtaacttagcaatctccacaattataggaaaggtgttgtattctcctgttccatcggtgcgatgaatagaagcattgtaaacacgttcacgaagttggcggttttcgagattagcaagtataggctgttgtgtggtattagtaataacaatgcaataaggggctttcccgccacgactttcagcgtctttcttacattgtgcaatagcgccttcgctaagtccagcaagttctttcacatcgtttacccatacagttgatgctacagaggctttaggaagcatatttccaaagtcttgctgcaactgtgctaacttagtgtttatttctttcatacgagccattttatcttttggcaacaatgcgcctgagcgtacaaagttcttgtatatttcttccagtagcactttgtcttcgcccttcaagctgttccgctcatggtcgtacacatattttacacgttcaaaaaacttctgattaaagcttatttcgttctcnaagtttgtaagtaatggtgttacttccttttctgctgcttctatctcgggtgttttattagcttcggtaacacagaaaaatatgtttttcactctatcgagtagtaatccactcttttcgtaagccaatattgtattcttaaaa

SEQ ID NO: 836 - DNA, 4000 bp, Escherichia coli
  misc_feature (921)..(921): n is a, c, g, or t
  misc_feature (1547)..(1547): n is a, c, g, or t
  misc_feature (1989)..(1989): n is a, c, g, or t
  misc_feature (2965)..(2965): n is a, c, g, or t
gaacatggcagtgcgtgatcattatgccaatcagaagatagatgttgatgaactgatcaagacacatagtgatttggtccggaaaattgcttggcaaattcacggccgcacgcgccatacaactgaaatcgaagatgtcatgcaggttggctttaccggtctggtcaacgccgcccagcaatatacgcgcaaagaaggtgccagctttggcacctatgccagcatccgtattaagggtgcgattatcgattatcttcgcaaaagctcaaatctttgccgcacaacgattcagatgaaaaagcgctataatgtggtgcaaagccagcttcaaagtaaattgatgcgcaagccaactgttaccgaactcagcgttgccatgaacatgtctgaaactgagcttcaagaatgggaacatgcttttcaggcaaatgcacatgaatcgcttgatagcgtttatgatcaatattcgatctggtatgcctcaagtgaagattcacccgaagaaaagctgaaccaagatcaactcaaagggttgctgaaattagcgctccttgaacttagcgaaaaagaagcgctggtaatccagctctattatgtcgaagaattgaacgtttttgagattgctgctgtgctagaagtttcgactggtcgcgtctcgcagatcaaaaaatcagcgattgccaatctgcgttcctgtatttccaaatcacagcatattgattgatcatggccgaatctggatttaatgaaatcaccgaaattcagatgtcattgcagcttgccgaacatcagctgcagcataacccttttcaagaacagctgcatctatcattatctttgatatcgattgcgcgcgggtcatgcaaaatgatcatccgccccgatcggcaaagcgcgccatcgtttgttggcgccctgcanattcccgctgatcgcgcaattatgcaggcaaccatcgcgctgccacaaagcccatttgatgatttgtcacaaaagctgcgccggtcagcgccacgcccaattaatttatttgcgactttagacaaaccgctaacggttgactatgaagggattttattcattgatccgccagttgatgcggccatcacaaatctagtctggacaattccacttaaataaatgactaatggtcacttacaggaatttacgcaccatttcggtctcagattggagcagacgtgatgttccggaaaaggcctgttgtgcgcggatcagcttggccaattcgccagtcatgtcgatattcgacatttccaaagcgcctgaatggattttaccacggccatcttttaccgcctgcccaagatttcccggccccgattttgcattttcgcgaaacatattattgccaatcgcggttagacggttcgcatcagcaaatgttgcaaggccaattttcccaacagcaacaatgtttgtgccaccataagttgcctcaacagttccatctgactggataccaacactggttaacgcaaccgagccaagctgttcgacaccattttcggtaacaataccggcggcangcatcggaaccgtaattgccataccatttgccgacatgactttatggccctcgcttgtcgcaatctcaccatttaaatcaatcgagaaagacccatcgcgtgtatatagaacatcttgcaaattactgccattgcgaagcgcgaacatcccctcgccttcgacagccaaatcaagaaccgtgccggtttgccgtaattcaccctgcgaccgcataatccgcatttcagaggttgtcacgcccgacccaaccttgtttccaacacccatggtaaccgtatcggcataaacatccacaaagctggtttcccgctttttgtagccagtggttcccgcattggcgatattatttgacgtaacatcaaggtcactcaaggctgccgacatgccgctgcgaattaccgaaatcatgattatcagacctaacgtagtttgcttcgcacngtatcagcaaattttgtgccaaagcatcatcatggccaagtttggttcatttttgcaagccagcaagcaagccatccttgggtaaatcgtttcgcttaaaattcaacttgtttagccgttgctaatgcagcatattaccagattgttaagcgaaggcagaaaatggcaaaacaacaaaacacatcgctggttcccatggcaaaacgattgcccgcaacccgccccgccaaaacgggcacgcaatcattttcactctatgatggggagcgacatttcaccagccgtgaagatgtgcgtgaatttttgccggatattcttggtaaggcacttgcccgcacatggattgatgctgattttcggactgcgtttgataacgatccctgcggcgcgcttgaaagccacggtgtgtttctgcctgaaaatatgttgattgagttccaaagccaaaattccgatcgcccgcggattgttgtgtatgaacagcggccaaactcaaaattcaaagcacgcgttctgtacttgcagttggtgatgatggcagggcggtgatggttcgttccgcccctatcaaacgcgtttttcccagtctttttgtgctttctgtttgtcttttgggcatgcctgccaacgccagcgacccacaaacccagatggaaaacaaagccttcaaagaagcggtcgaggcggtcaaggacaagaattatgcacacgccataaccttgttcgaagctcaggccaagatgacacgccatgacgcgcagcataatcttgcggttttgctgaatgccggcaagggccgcccacgcaattatgttgaggcgctgttctggtcatggcaggcccagctcggcggtattgaagatgccgaagatttggcaaatgatattgtagattttctgccgccaaaggtagcagatgaagtgcggagccgcgttggtgaggcattacaagcgcgcatcgacgccaatgacctaancgcaattccgcaatttgccaattatcacttaaccattcttgccgaacctgattatgccaatgcctatatctggtattcaatcgccgctgcgatcaatctgcccaagacaagcgatgcgcgcgacgatgccgaatctcaaatcgacagcaaagatcttgttgaattgcagatgaaaacccaaaccctttttgacaaatataaattcaaaccattgccagccactggcaaaggagggaaaaatgcaagttaaggttcaatggattattgatggtcttatcgaaattgacgccgaatcaaatgaagcagccgaagcaattgctgatgaaaagcttcgcagctttatcgcagcaaaccctgaattgactgaagtgttgggcgctgttgccattcaaggccatgccgtcattgaaaccgattaaccgaaactgttcagcagctcagcaatggtcttttctagatcgtcgttatcagtttcgatctcggtaatttcctgacgcaattcttcaatacgctgtttgcgcttttccatgacatcacggatttcttcgagaaccgtggcaagacgaccgcttaaatcggcttcgttcatctcatcttcggccatttcacccatcctttttcaaatctgataatgcaacctgctaacctgtaaaacaccagcgctagatcattacattatcttttgctaaacttagcaacttcaatctgtgagacaacccttgcagataccatgccaacaacaaaagtgatgtatcagcatgttttcacgcgatctagccagcttatgccaacgcgcgaccataatgattgctttattggcgatagctggtgtttttattatgtttacagcggccaatagcccactttttgctggcagtcaccgcaaagtggaaatcgtgccttgcgacatcaaactggtatttggggctgacgatagcggcatgtcgcttgtgtcctatgatctggaaatgcaaatcagcaaccaccatggccagacagtcaccggcatttcggttcattggcttgatcgcagtg

SEQ ID NO: 837 - DNA, 4000 bp, Escherichia coli
  misc_feature (1)..(1): n is a, c, g, or t
  misc_feature (8)..(8): n is a, c, g, or t
  misc_feature (11)..(11): n is a, c, g, or t
  misc_feature (20)..(20): n is a, c, g, or t
  misc_feature (27)..(27): n is a, c, g, or t
  misc_feature (29)..(30): n is a, c, g, or t
  misc_feature (37)..(37): n is a, c, g, or t
  misc_feature (40)..(40): n is a, c, g, or t
  misc_feature (43)..(43): n is a, c, g, or t
  misc_feature (45)..(45): n is a, c, g, or t
  misc_feature (49)..(49): n is a, c, g, or t
  misc_feature (51)..(51): n is a, c, g, or t
  misc_feature (56)..(56): n is a, c, g, or t
  misc_feature (58)..(59): n is a, c, g, or t
  misc_feature (65)..(65): n is a, c, g, or t
  misc_feature (72)..(72): n is a, c, g, or t
  misc_feature (74)..(74): n is a, c, g, or t
  misc_feature (76)..(77): n is a, c, g, or t
  misc_feature (85)..(85): n is a, c, g, or t
  misc_feature (87)..(87): n is a, c, g, or t
  misc_feature (89)..(89): n is a, c, g, or t
  misc_feature (96)..(96): n is a, c, g, or t
  misc_feature (100)..(101): n is a, c, g, or t
  misc_feature (104)..(104): n is a, c, g, or t
  misc_feature (108)..(108): n is a, c, g, or t
  misc_feature (118)..(121): n is a, c, g, or t
  misc_feature (129)..(129): n is a, c, g, or t
  misc_feature (131)..(131): n is a, c, g, or t
  misc_feature (140)..(140): n is a, c, g, or t
  misc_feature (143)..(143): n is a, c, g, or t
  misc_feature (152)..(152): n is a, c, g, or t
  misc_feature (154)..(154): n is a, c, g, or t
  misc_feature (166)..(166): n is a, c, g, or t
  misc_feature (171)..(171): n is a, c, g, or t
  misc_feature (179)..(179): n is a, c, g, or t
  misc_feature (181)..(182): n is a, c, g, or t
  misc_feature (194)..(194): n is a, c, g, or t
  misc_feature (199)..(199): n is a, c, g, or t
  misc_feature (205)..(205): n is a, c, g, or t
  misc_feature (210)..(210): n is a, c, g, or t
  misc_feature (213)..(214): n is a, c, g, or t
  misc_feature (221)..(221): n is a, c, g, or t
  misc_feature (229)..(229): n is a, c, g, or t
  misc_feature (233)..(233): n is a, c, g, or t
  misc_feature (238)..(238): n is a, c, g, or t
  misc_feature (240)..(241): n is a, c, g, or t
  misc_feature (248)..(248): n is a, c, g, or t
  misc_feature (260)..(260): n is a, c, g, or t
  misc_feature (269)..(270): n is a, c, g, or t
  misc_feature (272)..(272): n is a, c, g, or t
  misc_feature (281)..(281): n is a, c, g, or t
  misc_feature (286)..(287): n is a, c, g, or t
  misc_feature (289)..(289): n is a, c, g, or t
  misc_feature (299)..(299): n is a, c, g, or t
  misc_feature (303)..(303): n is a, c, g, or t
  misc_feature (317)..(317): n is a, c, g, or t
  misc_feature (324)..(324): n is a, c, g, or t
  misc_feature (330)..(330): n is a, c, g, or t
  misc_feature (335)..(335): n is a, c, g, or t
  misc_feature (342)..(343): n is a, c, g, or t
  misc_feature (349)..(350): n is a, c, g, or t
  misc_feature (359)..(360): n is a, c, g, or t
  misc_feature (362)..(362): n is a, c, g, or t
  misc_feature (374)..(374): n is a, c, g, or t
  misc_feature (379)..(380): n is a, c, g, or t
  misc_feature (385)..(385): n is a, c, g, or t
  misc_feature (388)..(388): n is a, c, g, or t
  misc_feature (391)..(391): n is a, c, g, or t
  misc_feature (394)..(394): n is a, c, g, or t
  misc_feature (398)..(398): n is a, c, g, or t
  misc_feature (400)..(401): n is a, c, g, or t
  misc_feature (404)..(405): n is a, c, g, or t
  misc_feature (411)..(412): n is a, c, g, or t
  misc_feature (415)..(416): n is a, c, g, or t
  misc_feature (424)..(424): n is a, c, g, or t
  misc_feature (426)..(426): n is a, c, g, or t
  misc_feature (431)..(431): n is a, c, g, or t
  misc_feature (433)..(433): n is a, c, g, or t
  misc_feature (435)..(435): n is a, c, g, or t
  misc_feature (437)..(437): n is a, c, g, or t
  misc_feature (443)..(443): n is a, c, g, or t
  misc_feature (445)..(445): n is a, c, g, or t
  misc_feature (447)..(447): n is a, c, g, or t
  misc_feature (452)..(452): n is a, c, g, or t
  misc_feature (458)..(458): n is a, c, g, or t
  misc_feature (469)..(469): n is a, c, g, or t
  misc_feature (472)..(473): n is a, c, g, or t
  misc_feature (483)..(485): n is a, c, g, or t
  misc_feature (496)..(496): n is a, c, g, or t
  misc_feature (498)..(498): n is a, c, g, or t
  misc_feature (504)..(504): n is a, c, g, or t
  misc_feature (507)..(507): n is a, c, g, or t
  misc_feature (512)..(512): n is a, c, g, or t
  misc_feature (514)..(514): n is a, c, g, or t
  misc_feature (518)..(518): n is a, c, g, or t
  misc_feature (520)..(520): n is a, c, g, or t
  misc_feature (533)..(534): n is a, c, g, or t
  misc_feature (543)..(543): n is a, c, g, or t
  misc_feature (548)..(548): n is a, c, g, or t
  misc_feature (553)..(555): n is a, c, g, or t
  misc_feature (557)..(557): n is a, c, g, or t
  misc_feature (564)..(564): n is a, c, g, or t
  misc_feature (568)..(569): n is a, c, g, or t
  misc_feature (574)..(575): n is a, c, g, or t
  misc_feature (580)..(580): n is a, c, g, or t
  misc_feature (582)..(582): n is a, c, g, or t
  misc_feature (586)..(586): n is a, c, g, or t
  misc_feature (591)..(592): n is a, c, g, or t
  misc_feature (596)..(596): n is a, c, g, or t
  misc_feature (600)..(601): n is a, c, g, or t
  misc_feature (606)..(606): n is a, c, g, or t
  misc_feature (615)..(616): n is a, c, g, or t
  misc_feature (620)..(621): n is a, c, g, or t
  misc_feature (625)..(626): n is a, c, g, or t
  misc_feature (640)..(640): n is a, c, g, or t
  misc_feature (646)..(646): n is a, c, g, or t
  misc_feature (648)..(648): n is a, c, g, or t
  misc_feature (654)..(654): n is a, c, g, or t
  misc_feature (661)..(661): n is a, c, g, or t
  misc_feature (664)..(664): n is a, c, g, or t
  misc_feature (671)..(671): n is a, c, g, or t
  misc_feature (676)..(679): n is a, c, g, or t
  misc_feature (683)..(683): n is a, c, g, or t
  misc_feature (686)..(686): n is a, c, g, or t
  misc_feature (691)..(691): n is a, c, g, or t
  misc_feature (693)..(693): n is a, c, g, or t
  misc_feature (697)..(697): n is a, c, g, or t
  misc_feature (699)..(699): n is a, c, g, or t
  misc_feature (703)..(704): n is a, c, g, or t
  misc_feature (708)..(708): n is a, c, g, or t
  misc_feature (713)..(713): n is a, c, g, or t
  misc_feature (717)..(717): n is a, c, g, or t
  misc_feature (719)..(719): n is a, c, g, or t
  misc_feature (723)..(723): n is a, c, g, or t
  misc_feature (729)..(729): n is a, c, g, or t
  misc_feature (742)..(742): n is a, c, g, or t
  misc_feature (745)..(746): n is a, c, g, or t
  misc_feature (750)..(750): n is a, c, g, or t
  misc_feature (753)..(753): n is a, c, g, or t
  misc_feature (755)..(755): n is a, c, g, or t
  misc_feature (768)..(770): n is a, c, g, or t
  misc_feature (773)..(773): n is a, c, g, or t
  misc_feature (789)..(789): n is a, c, g, or t
  misc_feature (795)..(796): n is a, c, g, or t
  misc_feature (800)..(800): n is a, c, g, or t
  misc_feature (805)..(805): n is a, c, g, or t
  misc_feature (812)..(812): n is a, c, g, or t
  misc_feature (819)..(819): n is a, c, g, or t
  misc_feature (828)..(828): n is a, c, g, or t
  misc_feature (837)..(839): n is a, c, g, or t
  misc_feature (843)..(843): n is a, c, g, or t
  misc_feature (846)..(847): n is a, c, g, or t
  misc_feature (850)..(850): n is a, c, g, or t
  misc_feature (856)..(857): n is a, c, g, or t
  misc_feature (859)..(859): n is a, c, g, or t
  misc_feature (863)..(863): n is a, c, g, or t
  misc_feature (879)..(879): n is a, c, g, or t
  misc_feature (882)..(882): n is a, c, g, or t
  misc_feature (885)..(885): n is a, c, g, or t
  misc_feature (889)..(890): n is a, c, g, or t
  misc_feature (913)..(913): n is a, c, g, or t
  misc_feature (915)..(915): n is a, c, g, or t
  misc_feature (918)..(918): n is a, c, g, or t
  misc_feature (924)..(924): n is a, c, g, or t
  misc_feature (926)..(928): n is a, c, g, or t
  misc_feature (934)..(935): n is a, c, g, or t
  misc_feature (940)..(940): n is a, c, g, or t
  misc_feature (943)..(944): n is a, c, g, or t
  misc_feature (958)..(959): n is a, c, g, or t
  misc_feature (968)..(968): n is a, c, g, or t
  misc_feature (971)..(973): n is a, c, g, or t
  misc_feature (979)..(979): n is a, c, g, or t
  misc_feature (985)..(985): n is a, c, g, or t
  misc_feature (991)..(991): n is a, c, g, or t
  misc_feature (995)..(995): n is a, c, g, or t
  misc_feature (1001)..(1001): n is a, c, g, or t
  misc_feature (1004)..(1004): n is a, c, g, or t
  misc_feature (1006)..(1006): n is a, c, g, or t
  misc_feature (1010)..(1010): n is a, c, g, or t
  misc_feature (1015)..(1015): n is a, c, g, or t
  misc_feature (1017)..(1017): n is a, c, g, or t
  misc_feature (1021)..(1021): n is a, c, g, or t
  misc_feature (1025)..(1025): n is a, c, g, or t
  misc_feature (1028)..(1028): n is a, c, g, or t
  misc_feature (1034)..(1034): n is a, c, g, or t
  misc_feature (1036)..(1036): n is a, c, g, or t
  misc_feature (1038)..(1039): n is a, c, g, or t
  misc_feature (1053)..(1053): n is a, c, g, or t
  misc_feature (1066)..(1067): n is a, c, g, or t
  misc_feature (1070)..(1070): n is a, c, g, or t
  misc_feature (1073)..(1073): n is a, c, g, or t
  misc_feature (1077)..(1077): n is a, c, g, or t
  misc_feature (1081)..(1082): n is a, c, g, or t
  misc_feature (1088)..(1088): n is a, c, g, or t
  misc_feature (1094)..(1096): n is a, c, g, or t
  misc_feature (1104)..(1104): n is a, c, g, or t
  misc_feature (1118)..(1118): n is a, c, g, or t
  misc_feature (1126)..(1127): n is a, c, g, or t
  misc_feature (1132)..(1132): n is a, c, g, or t
  misc_feature (1134)..(1135): n is a, c, g, or t
  misc_feature (1138)..(1139): n is a, c, g, or t
  misc_feature (1141)..(1141): n is a, c, g, or t
  misc_feature (1151)..(1151): n is a, c, g, or t
  misc_feature (1157)..(1157): n is a, c, g, or t
  misc_feature (1187)..(1187): n is a, c, g, or t
  misc_feature (1653)..(1653): n is a, c, g, or t
  misc_feature (2534)..(2534): n is a, c, g, or t
  misc_feature (2669)..(2669): n is a, c, g, or t
  misc_feature (2714)..(2714): n is a, c, g, or t
  misc_feature (2762)..(2762): n is a, c, g, or t
  misc_feature (2850)..(2850): n is a, c, g, or t
  misc_feature (2891)..(2891): n is a, c, g, or t
  misc_feature (2957)..(2957): n is a, c, g, or t
  misc_feature (3756)..(3756): n is a, c, g, or t
nctctttnttnggggagcancagagcngnntttccancgnagngnaggntngtatntnntttgtngctctcncncnnaaaacaancnanaaagaanaaannaanaaantttttaaagnnnngactgccncntcccaaaanctnatggctggngnagttgtgggtgntgtcnccacttangnngccccgccgaangacangggagnagccnacnntctttcngccgcgcntctnactcncnnctttggnctcggccggtcnttctttgtnnanaaggataanaaagnncnttttgggttnaaanacaagctgcctgcngcgctcntcaatntcccnaaaatgnncggtgnngcccttgannanaaacgcagcggnggggnnctgtncantcnggngtgngnngannacccannggnngccttccncnccatncntnanttaatncntnttgcngcgggncgggccgtggngcnntggagccagnnngggtttgggcncnccgcancgncttcnangagncnggtgacggcacgnnaccttttcngtttnaaagnnngnacgaacnaccnnaaaanncaagngncggngctgnngaanaaanntgtgngggcttccnncgannactnngagggaaaccccgnctggangnacggcngcacctnccncgcagcncgccnnnnccgnatnattantnaaangngggnncggncccgnctgnangagnaagaanatattattgggcncannaaantancnggcgcgccgctcnnnggnggagaggaatttaccnccccanntttnaatangaagggnaaaaacngccctatcnttcccgatnnntcgnatnngcngctcanncncccnaaccaaaataatggtnttnagntgcnncgccgcgggtttaactacacggntngcnccgacngnnntggacnnctggntgnngggctgttctttanngcgttcgtntgnnncccgcncacccncttcancccncttctnganancatnacccngnccgntgcnctnagtgantntnntaaacacaccggcngcgccgtttttgnngtnccncccngtannaaagangagaannnttttatcncttctgggttgttntaaaccgnngagtntnnttnngntgggcgcccngtaccnagacggtatccgggcgcttaggggtcagcngtgtttcgataaccgtggtctgaactattgggttcttcaggactttatcgggcatgggaaaggggagaaacttcgtactaaggcattttaaaacagtgatgtggtatgccttggcggcgcggtttattgtgatgttcggctgaaaaccttcggcggtgcgcgtctaatttgactgccacaccgccaacggtactattgagttaaaaatcacatacatatgggagacaatgatgactgctcaacccccctcgtacgacccgcagaattttaggagcgacgccgttccttctgatacgcaagccatttatattcaagaaggcggagactctgcaagcaacctttttaatctgccttctaaacatcctaaaattcttcgtctacaagaaattatgattgtgtcggcgattatctgttttattcatgggctcatctcggcatttgcgccgggtaacgctaaacctcttgngggactgcctgaattcggggttgctggcggcattgggttgcttgttgtttcggctgccgtttacctcaccgtctatttcatggtgcaaaacggtaaccggctgggcctgacaattgggcttatcttcgcaattttgggcgggctgatcgctattatgtcccttctaggtaacattcttgatactcaacgctacggttttgtgccgctctatgctggctggtttattgccaatgttctgtggattcgcgccgctttcgacccggcagtgaaagctgctctcaagtaggtttccgtaacttttcggctgcaccgtgaaagtagcctgcaaaaccggccgcaccccgccaactgggatgcggccggttcctatatgtactcttcgtgctgcaaagcagaaacgtgagaggggcaaacggtgaaagagccctccgactgcactaaaatagtaaggatgggcaggcccctcaaaattgtagggtgcgcccctaacctcaggaagaacgcagagaagagtagcaatgaccgatcccgtgcaggagaccgagaacgtgcctgaatcggcgcaaaccctcgccagcatcgcacagattctcaatgaaaaccccgaaagtgggcttgagattgtgcgcgccgcctttgacgctgagcgcgagcgcgcactgaccgccctccgcgaacgtgccaaagattttgaatcgcttaaaacggtgcgcctaggctttttcggcgataaggggagcatgagcttggcaaacaagcaaatgcgtgaccttcagaatcagcacaagggacccgtggggaaactgctggggcaggcacgtgcggcgctcaccgaggctattgaggcgcgtactgctgaactggaggccgagcgcgaggcncgcatcctagaggaagaagcagttgatgtgacagcggcttcagcgcggcgttcgctgggtgggcggcatcctgtggcgctcatgcaggaaaaactcaccgatatcttcgtaggtatgggctgggaagtcgctgangggccggagctggaatctgagtggtacaactttgatgccctgaanattaagcctgaccacccggcacgcgatatgcaagacaccttctacgtngagccgcgagaggcacatttggtactgcgcacccacacctccccggtgcagatgcgcgccatgcttacccgtgagctgccgttatacnttgtgtgccccggtcaggtgtaccgtacagatgagctggangccacacacacccccgtattccatcagattgaggggcttgcggttgataaaggcctgacgatggcngatatgaaaggcaccctggagtatatggcccgcgccatgtttggtgaggaagctaggattcgtttgcgcccgaacttcttccccttcaccgagccttccgctgagctagatttgtggcacccgaacgccaagggtggtccgcaatggattgaatggggcggttgcggcatggtaaaccccaatgtgttgcgtgcggccgggatcgaccccgaaatatattcggggttcgccttcggcatgggtattgaacgtacccttatgttccgtaataacgtccccgatatgcatgacatgattgagggcgacattcgtttctctgagcagttcgggatggagatttaaaacaatgcgagtacccctatcatggttgcgtgagttcgcgcctgttcctgaggacgcgacggctgaagacgtactggacaccctcgtgaaggttgggctggaagaggaggctgtgcaccgtccggccgatgagatctctggccctattgtggtcggtcaggtgctctcgatagaacctgagacgcattctaacggtaagactgtgaactggtgccaggtgcgtgttgttcctgaggggcagcagcagactctcaccggtaaaggtatcgaagaatccggtgtgcagggcattatctgcggcgcccacaacttcaaggtcggcgacaaagttgtggtgaccctccccggtgccgtcctacccggaaatttcgctattaccgcccgtaaaacctatgggcacaagtctgccggtatgattgcctccacccgcgagctgggtattggtgaggaccacggnggtattttggtgctctccaccctgggactcgatccggaacttgggtcagatgcgctggagcttttgggtctgtatgacgaagcagccgaggttaatgtgactcctgatcgcggatatgcgttttcgattcgcggtattgcccgtgaatacgcgcatgcgaccggaacttctttcaacgattttgttctggaatacggcgctcgcgcccccaaagcgaactccgaaggcattccggtacgcctgg

SEQ ID NO: 838 - DNA, 4000 bp, Escherichia coli
  misc_feature (99)..(99): n is a, c, g, or t
  misc_feature (1954)..(1954): n is a, c, g, or t
  misc_feature (1996)..(1996): n is a, c, g, or t
  misc_feature (2145)..(2145): n is a, c, g, or t
cctttgtcacctttgtcacctttgtcgccagtaattcccttgtctccagaaagtcccttgtcgccagaaagtcccttgtctccttgtgaacctttgtcnccagtggcacctttgtctccagtggcaccagggggaccaagtggacccttgcctccaagtggaccttgttgtccaggttgaccaggttgacctttgtcgccaggttgaccaggcggaccagcaatacctttgtcgccaggttgacctcgctctccagatgcaccagtggtgcctttagaattaaaattagaagtattttttgaagtaggtttagattttacattatttttagatgtttcatttttttctttttgaatagaagacttagcagatggttcagatgattttcgcaaccggacatcaaaaacggaatatactgaagagaataaatcatttacaacaacccaaacaacatccacatcattgatagatttaggaagagggttttcagagtctcccactacttcagaaaaaataccatctttgaccctaagatgaaaatttcccttccataaaggagaaaaacttttttcgcgaatttgatcatcagatggtttaacatcaattagcgatatctgagcctcataaacgccagattgcttaaatggcgactgaccctggatttcaattcgtggctgagatgacacagtggttggttaatgtatgaagtatttcaggatttggatcgcaaaatccaactaaaatgccaaattatcaagaataatcacaattaaaatggtatttatctagatgaagataaaaaattgacaagttgtttggtaaaaaaaataaaaaagtagaggcaaaagtagagaaaaaaggatcagaaagcacagttaccaaagaaaccagcttagtagatccaagttacaatattaaaaaattatttaaaaaaggcatcaacttaatggcagatgaaaaactagacgacgccatagaagtatttgagcaagcattacgaattgaaccagacaatattgaaatcttaatgaaattaggatatgcaagatttcatctagaggattacaatgatgcactaaaagtatatgataaaattttagaaatagatgtaacgaatccagaagcatggaatcttaaaggattagttcattatgaacagagaaaatattcgcaagcattagatgcagtcaacaaagcaatagagtcagacaagacatatggaatggcatggtacaacaaagcatgtttcctatcattgctaaatcaagtaccagaatcactacaagcactaaaacacgcaatagaaatagatgttaaaaatgctagaaagtcaattagagataaagactttgtcaacgtaagaattgaagaaggattcaaaagaattgaagaagttgtggttctagaatcagttaaacaaggataccatacaataggagcaattgtttggacaacattcttagataaaattgatgcagaaaaagctttaagaaaactactagaaaaaggactaatcgtacagaatgaaaaacgtgacggtctaagtaaaataccaatttatgatctttcagataactttgcagaaaaagtaggtaaagaaaaaataggattatttggaattacaagaaagaaacttccaaagccagttaaaaatttgaagataatgagtcaagcaattcaatcggcaaaagaggcaattgaggaggcaaacatagagaaagcagtagaggcttttgatcaattcattgatccagcaaaatcaggggagcaaatgatagagaatttctttgaagctcacagagaaataagattatggaaaataagactaagcgatagaggtgcagattacatgatagataacaaagacaagatgatagaggttttagaggacgtggaagttacaataactaaaaaacttagagacgaaatagcctaatcaatcatacagagaaantccggcagataacatagtttaatttttgggcatgaatatttncagattattccgcagacaaatcccaataattggcatcttgttgtttgtcagtaggtttctccaaatttttccattccttaaaggatctaacatacaattttgtattagatagtcctgcagatttaagagcatagtatgccaatcccganaaagttcccacactgccacagtaagtgattatctcagagtcaccagaaatatccctattatcaaataatcttttcatgtcttcttttgaacgaagaattccatcactgcttgccagtgtacgataaggaagactaacagcaccaggaatatgttgttcgagatagttcaagcgttccctgttgtcaattaaaatcacatcgtcacgtgattttacagattccaggtattcagaagttgccaaaatattagattgtaaattcatagaatgttccttgttagatatttcgggagttagtgaatcagtttccaatcccaatgatttccaattaccataagttgtttcaagtaaagtgacatcggagtgtccaatccattctaacgtccaagctactctggatgccaaagcgccaaaagtatcatcgtaaacaacgacaggagtttcatcgtcgatacctagagaatttacaagtttcaaaacacgttcaggactatcatcagacaacaaagtggctaaaggtaaatttacagaatttggaatatgatcttgcttgtaatcaccttcacgtctaacgtcaattactctaacgctattgtctcgaatttcagaacgtagtgaatcaatatcagtagtaactttaacagattcagtcaagcagcacattcacccttaccggtttttgtatgatagctagtgtcactgccataatcaagatagaaatcaggatcgtcctctttcgtcggaggagcaacaagaggttccaatacttttttgatatcaccaatagatttaatgtcagaatcctcactatcatttacaattctatgaatccaagatttcaaagtgtcatcagattgcttatttgctttaaacagttcaattatttttagaataacaggaattactctcttagctggtaccctaagacatgtttgacctaatgtagtgtcagcatcaaaacgaccgccaagagacatttgataatttggatacatgtcttttcccaaacgaccgccaccaccaaagaaaccaattgttgcaataccatgctgtgcacatgagtttggacatccgctaatcttaattgaagaatcagcgagatcatcatcctcgtcaagttttaattcaagaaattttctttgaatttcttttgcaagtctatgagaattagtcaatgccaaattacaagaagttgttccagagcaaccgacaggggcagtcatagttaaaccgccagattttgccaatccagtttcaagaagtcgagaatacaatttgactaaatcatcttcatgcacatatcgtagtgccacattctgaacaaatccagatctagccttgccttcagaagagaactcacgaataagagcagccatagaatttaattgatttgaagtaatgtcaccagcttctaaagtaataaagacagaacgatagtcagactgtttttgttttattgtgtttgatttaagccatctagcatatccgtcaggaaccgagcttccgccctcgtcactaatttttagtgggcgagtgattttatcaggagtggtgtcaacttttagtttagtaactacagattgagtagctctgacaattgcccgttctttcaatacgagattttggaatttttcccaacccatgtcattaacaagataacgcattctatttcttgcaagattttttctatcacctaatctatcaaatattctcatgacagcaatagaagtgtaaagtaaatcttcctcaggagtgaaatcttccaactgatgtccaacaaaggatcgattgcccaaaccaccaccaaggaaaattttgaaacctttttgtttagagccgttgatttgttgaatttc

SEQ ID NO: 839 - DNA, 4000 bp, Escherichia coli
  misc_feature (44)..(45): n is a, c, g, or t
  misc_feature (47)..(47): n is a, c, g, or t
  misc_feature (49)..(49): n is a, c, g, or t
  misc_feature (51)..(56): n is a, c, g, or t
  misc_feature (59)..(65): n is a, c, g, or t
  misc_feature (67)..(67): n is a, c, g, or t
  misc_feature (69)..(74): n is a, c, g, or t
  misc_feature (76)..(76): n is a, c, g, or t
  misc_feature (79)..(83): n is a, c, g, or t
  misc_feature (89)..(91): n is a, c, g, or t
  misc_feature (93)..(94): n is a, c, g, or t
  misc_feature (96)..(97): n is a, c, g, or t
  misc_feature (99)..(101): n is a, c, g, or t
  misc_feature (103)..(106): n is a, c, g, or t
  misc_feature (108)..(118): n is a, c, g, or t
  misc_feature (120)..(120): n is a, c, g, or t
  misc_feature (122)..(129): n is a, c, g, or t
  misc_feature (131)..(140): n is a, c, g, or t
  misc_feature (142)..(142): n is a, c, g, or t
  misc_feature (144)..(146): n is a, c, g, or t
  misc_feature (148)..(150): n is a, c, g, or t
  misc_feature (152)..(154): n is a, c, g, or t
  misc_feature (156)..(161): n is a, c, g, or t
  misc_feature (163)..(174): n is a, c, g, or t
  misc_feature (177)..(179): n is a, c, g, or t
  misc_feature (182)..(184): n is a, c, g, or t
  misc_feature (186)..(187): n is a, c, g, or t
  misc_feature (189)..(189): n is a, c, g, or t
  misc_feature (191)..(194): n is a, c, g, or t
  misc_feature (197)..(199): n is a, c, g, or t
  misc_feature (201)..(201): n is a, c, g, or t
  misc_feature (203)..(204): n is a, c, g, or t
  misc_feature (207)..(209): n is a, c, g, or t
  misc_feature (211)..(214): n is a, c, g, or t
  misc_feature (216)..(218): n is a, c, g, or t
  misc_feature (220)..(222): n is a, c, g, or t
  misc_feature (224)..(226): n is a, c, g, or t
  misc_feature (228)..(229): n is a, c, g, or t
  misc_feature (231)..(237): n is a, c, g, or t
  misc_feature (239)..(244): n is a, c, g, or t
  misc_feature (247)..(250): n is a, c, g, or t
  misc_feature (252)..(253): n is a, c, g, or t
  misc_feature (257)..(267): n is a, c, g, or t
  misc_feature (269)..(273): n is a, c, g, or t
  misc_feature (275)..(275): n is a, c, g, or t
  misc_feature (277)..(285): n is a, c, g, or t
  misc_feature (287)..(288): n is a, c, g, or t
  misc_feature (290)..(300): n is a, c, g, or t
  misc_feature (302)..(302): n is a, c, g, or t
  misc_feature (304)..(313): n is a, c, g, or t
  misc_feature (315)..(323): n is a, c, g, or t
  misc_feature (325)..(325): n is a, c, g, or t
  misc_feature (327)..(327): n is a, c, g, or t
  misc_feature (329)..(329): n is a, c, g, or t
  misc_feature (332)..(337): n is a, c, g, or t
  misc_feature (339)..(340): n is a, c, g, or t
  misc_feature (342)..(348): n is a, c, g, or t
  misc_feature (351)..(358): n is a, c, g, or t
  misc_feature (360)..(364): n is a, c, g, or t
  misc_feature (366)..(368): n is a, c, g, or t
  misc_feature (371)..(374): n is a, c, g, or t
  misc_feature (377)..(379): n is a, c, g, or t
  misc_feature (381)..(382): n is a, c, g, or t
  misc_feature (384)..(385): n is a, c, g, or t
  misc_feature (387)..(387): n is a, c, g, or t
  misc_feature (389)..(400): n is a, c, g, or t
  misc_feature (402)..(403): n is a, c, g, or t
  misc_feature (405)..(409): n is a, c, g, or t
  misc_feature (411)..(418): n is a, c, g, or t
  misc_feature (420)..(432): n is a, c, g, or t
  misc_feature (434)..(435): n is a, c, g, or t
  misc_feature (438)..(440): n is a, c, g, or t
  misc_feature (442)..(442): n is a, c, g, or t
  misc_feature (444)..(445): n is a, c, g, or t
  misc_feature (447)..(454): n is a, c, g, or t
  misc_feature (456)..(457): n is a, c, g, or t
  misc_feature (461)..(463): n is a, c, g, or t
  misc_feature (468)..(474): n is a, c, g, or t
  misc_feature (476)..(478): n is a, c, g, or t
  misc_feature (480)..(480): n is a, c, g, or t
  misc_feature (482)..(484): n is a, c, g, or t
  misc_feature (488)..(492): n is a, c, g, or t
  misc_feature (494)..(496): n is a, c, g, or t
  misc_feature (499)..(502): n is a, c, g, or t
  misc_feature (504)..(506): n is a, c, g, or t
  misc_feature (509)..(512): n is a, c, g, or t
  misc_feature (514)..(516): n is a, c, g, or t
  misc_feature (519)..(520): n is a, c, g, or t
  misc_feature (522)..(526): n is a, c, g, or t
  misc_feature (529)..(536): n is a, c, g, or t
  misc_feature (538)..(548): n is a, c, g, or t
  misc_feature (550)..(555): n is a, c, g, or t
  misc_feature (557)..(560): n is a, c, g, or t
  misc_feature (563)..(564): n is a, c, g, or t
  misc_feature (566)..(577): n is a, c, g, or t
  misc_feature (579)..(585): n is a, c, g, or t
  misc_feature (587)..(587): n is a, c, g, or t
  misc_feature (591)..(598): n is a, c, g, or t
  misc_feature (600)..(602): n is a, c, g, or t
  misc_feature (604)..(610): n is a, c, g, or t
  misc_feature (612)..(616): n is a, c, g, or t
  misc_feature (618)..(622): n is a, c, g, or t
  misc_feature (624)..(633): n is a, c, g, or t
  misc_feature (635)..(636): n is a, c, g, or t
  misc_feature (638)..(647): n is a, c, g, or t
  misc_feature (649)..(655): n is a, c, g, or t
  misc_feature (657)..(658): n is a, c, g, or t
  misc_feature (661)..(661): n is a, c, g, or t
  misc_feature (664)..(664): n is a, c, g, or t
  misc_feature (666)..(667): n is a, c, g, or t
  misc_feature (671)..(675): n is a, c, g, or t
  misc_feature (677)..(682): n is a, c, g, or t
  misc_feature (684)..(686): n is a, c, g, or t
  misc_feature (688)..(694): n is a, c, g, or t
  misc_feature (698)..(700): n is a, c, g, or t
  misc_feature (702)..(702): n is a, c, g, or t
  misc_feature (704)..(704): n is a, c, g, or t
  misc_feature (706)..(708): n is a, c, g, or t
  misc_feature (711)..(713): n is a, c, g, or t
  misc_feature (715)..(723): n is a, c, g, or t
  misc_feature (725)..(726): n is a, c, g, or t
  misc_feature (728)..(730): n is a, c, g, or t
  misc_feature (732)..(734): n is a, c, g, or t
  misc_feature (736)..(745): n is a, c, g, or t
  misc_feature (748)..(750): n is a, c, g, or t
  misc_feature (752)..(754): n is a, c, g, or t
  misc_feature (756)..(756): n is a, c, g, or t
  misc_feature (759)..(759): n is a, c, g, or t
  misc_feature (761)..(763): n is a, c, g, or t
  misc_feature (766)..(772): n is a, c, g, or t
  misc_feature (774)..(776): n is a, c, g, or t
  misc_feature (778)..(793): n is a, c, g, or t
  misc_feature (795)..(796): n is a, c, g, or t
  misc_feature (798)..(802): n is a, c, g, or t
  misc_feature (804)..(806): n is a, c, g, or t
  misc_feature (808)..(808): n is a, c, g, or t
  misc_feature (811)..(814): n is a, c, g, or t
  misc_feature (817)..(821): n is a, c, g, or t
  misc_feature (824)..(827): n is a, c, g, or t
  misc_feature (830)..(831): n is a, c, g, or t
  misc_feature (834)..(834): n is a, c, g, or t
  misc_feature (836)..(847): n is a, c, g, or t
  misc_feature (849)..(851): n is a, c, g, or t
  misc_feature (853)..(853): n is a, c, g, or t
  misc_feature (855)..(863): n is a, c, g, or t
  misc_feature (865)..(866): n is a, c, g, or t
  misc_feature (869)..(871): n is a, c, g, or t
  misc_feature (873)..(875): n is a, c, g, or t
  misc_feature (877)..(886): n is a, c, g, or t
  misc_feature (888)..(902): n is a, c, g, or t
  misc_feature (904)..(904): n is a, c, g, or t
  misc_feature (906)..(916): n is a, c, g, or t
  misc_feature (918)..(918): n is a, c, g, or t
  misc_feature (920)..(925): n is a, c, g, or t
  misc_feature (927)..(935): n is a, c, g, or t
  misc_feature (939)..(939): n is a, c, g, or t
  misc_feature (941)..(950): n is a, c, g, or t
  misc_feature (952)..(952): n is a, c, g, or t
  misc_feature (954)..(959): n is a, c, g, or t
  misc_feature (961)..(970): n is a, c, g, or t
  misc_feature (972)..(974): n is a, c, g, or t
  misc_feature (976)..(982): n is a, c, g, or t
  misc_feature (984)..(985): n is a, c, g, or t
  misc_feature (987)..(991): n is a, c, g, or t
  misc_feature (993)..(998): n is a, c, g, or t
  misc_feature (1000)..(1004): n is a, c, g, or t
  misc_feature (1006)..(1022): n is a, c, g, or t
  misc_feature (1024)..(1026): n is a, c, g, or t
  misc_feature (1028)..(1034): n is a, c, g, or t
  misc_feature (1036)..(1049): n is a, c, g, or t
  misc_feature (1051)..(1062): n is a, c, g, or t
  misc_feature (1065)..(1067): n is a, c, g, or t
  misc_feature (1069)..(1070): n is a, c, g, or t
  misc_feature (1072)..(1085): n is a, c, g, or t
  misc_feature (1087)..(1089): n is a, c, g, or t
  misc_feature (1091)..(1097): n is a, c, g, or t
  misc_feature (1100)..(1114): n is a, c, g, or t
  misc_feature (1116)..(1122): n is a, c, g, or t
  misc_feature (1125)..(1128): n is a, c, g, or t
  misc_feature (1131)..(1134): n is a, c, g, or t
  misc_feature (1136)..(1138): n is a, c, g, or t
  misc_feature (1140)..(1151): n is a, c, g, or t
  misc_feature (1153)..(1159): n is a, c, g, or t
  misc_feature (1161)..(1163): n is a, c, g, or t
  misc_feature (1165)..(1166): n is a, c, g, or t
  misc_feature (1168)..(1185): n is a, c, g, or t
  misc_feature (1188)..(1189): n is a, c, g, or t
  misc_feature (1191)..(1191): n is a, c, g, or t
  misc_feature (1195)..(1195): n is a, c, g, or t
  misc_feature (1197)..(1208): n is a, c, g, or t
  misc_feature (1210)..(1214): n is a, c, g, or t
  misc_feature (1216)..(1219): n is a, c, g, or t
  misc_feature (1221)..(1221): n is a, c, g, or t
  misc_feature (1224)..(1231): n is a, c, g, or t
  misc_feature (1233)..(1233): n is a, c, g, or t
  misc_feature (1235)..(1237): n is a, c, g, or t
  misc_feature (1239)..(1248): n is a, c, g, or t
  misc_feature (1250)..(1250): n is a, c, g, or t
  misc_feature (1252)..(1252): n is a, c, g, or t
  misc_feature (1254)..(1259): n is a, c, g, or t
  misc_feature (1261)..(1262): n is a, c, g, or t
  misc_feature (1265)..(1270): n is a, c, g, or t
  misc_feature (1272)..(1276): n is a, c, g, or t
  misc_feature (1278)..(1280): n is a, c, g, or t
  misc_feature (1284)..(1288): n is a, c, g, or t
  misc_feature (1290)..(1298): n is a, c, g, or t
  misc_feature (1300)..(1300): n is a, c, g, or t
  misc_feature (1303)..(1304): n is a, c, g, or t
  misc_feature (1307)..(1309): n is a, c, g, or t
  misc_feature (1311)..(1312): n is a, c, g, or t
  misc_feature (1314)..(1314): n is a, c, g, or t
  misc_feature (1316)..(1317): n is a, c, g, or t
  misc_feature (1321)..(1323): n is a, c, g, or t
  misc_feature (1325)..(1325): n is a, c, g, or t
  misc_feature (1327)..(1327): n is a, c, g, or t
  misc_feature (1330)..(1330): n is a, c, g, or t
  misc_feature (1332)..(1335): n is a, c, g, or t
  misc_feature (1338)..(1343): n is a, c, g, or t
  misc_feature (1345)..(1346): n is a, c, g, or t
  misc_feature (1348)..(1349): n is a, c, g, or t
  misc_feature (1351)..(1351): n is a, c, g, or t
  misc_feature (1354)..(1357): n is a, c, g, or t
  misc_feature (1360)..(1361): n is a, c, g, or t
  misc_feature (1363)..(1363): n is a, c, g, or t
  misc_feature (1366)..(1367): n is a, c, g, or t
  misc_feature (1369)..(1374): n is a, c, g, or t
  misc_feature (1376)..(1377): n is a, c, g, or t
  misc_feature (1379)..(1384): n is a, c, g, or t
  misc_feature (1387)..(1397): n is a, c, g, or t
  misc_feature (1399)..(1410): n is a, c, g, or t
  misc_feature (1412)..(1431): n is a, c, g, or t
  misc_feature (1433)..(1439): n is a, c, g, or t
  misc_feature (1441)..(1447): n is a, c, g, or t
  misc_feature (1449)..(1450): n is a, c, g, or t
  misc_feature (1452)..(1452): n is a, c, g, or t
  misc_feature (1457)..(1460): n is a, c, g, or t
  misc_feature (1462)..(1463): n is a, c, g, or t
  misc_feature (1466)..(1468): n is a, c, g, or t
  misc_feature (1470)..(1471): n is a, c, g, or t
  misc_feature (1475)..(1480): n is a, c, g, or t
  misc_feature (1483)..(1485): n is a, c, g, or t
  misc_feature (1487)..(1487): n is a, c, g, or t
  misc_feature (1489)..(1491): n is a, c, g, or t
  misc_feature (1493)..(1493): n is a, c, g, or t
  misc_feature (1495)..(1499): n is a, c, g, or t
  misc_feature (1501)..(1503): n is a, c, g, or t
  misc_feature (1505)..(1513): n is a, c, g, or t
  misc_feature (1515)..(1518): n is a, c, g, or t
  misc_feature (1520)..(1523): n is a, c, g, or t
  misc_feature (1525)..(1529): n is a, c, g, or t
  misc_feature (1531)..(1531): n is a, c, g, or t
  misc_feature (1534)..(1541): n is a, c, g, or t
  misc_feature (1543)..(1553): n is a, c, g, or t
  misc_feature (1557)..(1557): n is a, c, g, or t
  misc_feature (1561)..(1561): n is a, c, g, or t
  misc_feature (1563)..(1563): n is a, c, g, or t
  misc_feature (1565)..(1565): n is a, c, g, or t
  misc_feature (1567)..(1570): n is a, c, g, or t
  misc_feature (1573)..(1573): n is a, c, g, or t
  misc_feature (1575)..(1575): n is a, c, g, or t
  misc_feature (1577)..(1580): n is a, c, g, or t
  misc_feature (1583)..(1583): n is a, c, g, or t
  misc_feature (1585)..(1588): n is a, c, g, or t
  misc_feature (1593)..(1593): n is a, c, g, or t
  misc_feature (1597)..(1597): n is a, c, g, or t
  misc_feature (1601)..(1602): n is a, c, g, or t
  misc_feature (1610)..(1611): n is a, c, g, or t
  misc_feature (1616)..(1619): n is a, c, g, or t
  misc_feature (1622)..(1622): n is a, c, g, or t
  misc_feature (1630)..(1631): n is a, c, g, or t
  misc_feature (1633)..(1634): n is a, c, g, or t
  misc_feature (1637)..(1637): n is a, c, g, or t
  misc_feature (1639)..(1639): n is a, c, g, or t
  misc_feature (1642)..(1643): n is a, c, g, or t
  misc_feature (1653)..(1653): n is a, c, g, or t
  misc_feature (1675)..(1675): n is a, c, g, or t
  misc_feature (1677)..(1677): n is a, c, g, or t
  misc_feature (1683)..(1683): n is a, c, g, or t
  misc_feature (1702)..(1702): n is a, c, g, or t
  misc_feature (1706)..(1706): n is a, c, g, or t
  misc_feature (1712)..(1712): n is a, c, g, or t
  misc_feature (1724)..(1724): n is a, c, g, or t
  misc_feature (1727)..(1727): n is a, c, g, or t
  misc_feature (1737)..(1737): n is a, c, g, or t
  misc_feature (1786)..(1786): n is a, c, g, or t
cgccgaacacattcgtcaggaaacccacactttgccatgatatnngntngnnnnnntgnnnnnnntngnnnnnncngcnnnnntcgccnnngnncnnannncnnnntnnnnnnnnnnncncnnnnnnnncnnnnnnnnnngntnnnannngnnnannnnnngnnnnnnnnnnnntgnnnacnnngnntngnnnnagnnncncnnccnnntnnnnannngnnncnnngnnannnnnnntnnnnnngannnncnnttcnnnnnnnnnnncnnnnncnannnnnnnnncnncnnnnnnnnnnncntnnnnnnnnnngnnnnnnnnnancntnacnnnnnnanntnnnnnnncgnnnnnnnngnnnnncnnntcnnnngcnnncnncnnancnnnnnnnnnnnncnncnnnnnannnnnnnncnnnnnnnnnnnnngnngcnnntngnncnnnnnnnngnnagcnnngctcnnnnnnnannngncnnnaccnnnnngnnnaannnncnnnaannnnannntcnncnnnnncgnnnnnnnncnnnnnnnnnnngnnnnnntnnnnaanngnnnnnnnnnnnntnnnnnnnancccnnnnnnnnannnannnnnnncnnnnntnnnnngnnnnnnnnnnanngnnnnnnnnnngnnnnnnngnnccnggngnnggcnnnnngnnnnnncnnncnnnnnnngggnnngngnannnttnnnannnnnnnnnanngnnngnnngnnnnnnnnnncgnnnannncncgncnnncannnnnnngnnngnnnnnnnnnnnnnnnncnncnnnnngnnntngtnnnnggnnnnnggnnnngcnnccntnnnnnnnnnnnngnnnangnnnnnnnnngnnggnnngnnnannnnnnnnnncnnnnnnnnnnnnnnnangnnnnnnnnnnncntnnnnnncnnnnnnnnngggnannnnnnnnnngngnnnnnngnnnnnnnnnncnnnannnnnnnanncnnnnngnnnnnnannnnnannnnnnnnnnnnnnnnntnnncnnnnnnngnnnnnnnnnnnnnnannnnnnnnnnnncgnnnannannnnnnnnnnnnnngnnncnnnnnnnaannnnnnnnnnnnnnngnnnnnnnggnnnnaannnngnnntnnnnnnnnnnnngnnnnnnngnnnannannnnnnnnnnnnnnnnnnggnnangggngnnnnnnnnnnnngnnnnntnnnngntcnnnnnnnntngnnngnnnnnnnnnnancntnnnnnngnntcnnnnnngnnnnntnnnccannnnnannnnnnnnncngtnnggnnncnntngnncgannncncnacntnnnngcnnnnnncnnanncntcnnnnaanncnacnngnnnnnngnnannnnnncgnnnnnnnnnnncnnnnnnnnnnnncnnnnnnnnnnnnnnnnnnnncnnnnnnngnnnnnnncnncngccgnnnngnncannnanngccnnnnnnagnnncngnnncncnnnnncnnnannnnnnnnntnnnngnnnngnnnnngnatnnnnnnnncnnnnnnnnnnntccngcgntngncnnnnggncncnnnncgngnnnnagggngaanccgnnaaacaccnngccgnnnncgncggggaanngnnatncngcnngcgcttgagntgtcatccggccgccaaaggantngccacnggccaatagagcaagctcngganccaggngtgatgcttcgngcnccgccgcgcngaagatcgtcgtgatccaccagactgaggtggagcgttttcattccggntttcgcaggcaaaaggaagccgaaacgattggtggtgcgattcggaagtcattcaaggcgtttgatcctgtgcggaattatcggaagccctctggttgattggcagggttgaggcaatgaagggagtcgcctggcacagttcccgttttcaacggtgagaaggaacaggtcgtgctttactaattccacctggacacgaatactgagctttttgtcgaagtcgaacgcggcgtgactgacttttcaaattggtcgcgcgcgatggtctattggtttggcgagccaattcgtccgcatttggaacgcatgcggcggtctcgcggccgcggcgcgctgtggggggcagggttcgttttggcagtcttgctcctggtggcaggcattggcgtttcgcgacgttccggggaacagcttcaggaagccacgcgcgcccttacccacacacgcgaagtcttggaaagcctggcagacatttccgccagaatgagtgaagtggaaagctccgcgcgcagcttcgccatttccggaaaacagtcacatctgaaccctttttatacagcggctaaatccgtgccgcctcaagtggatgaactcaagcacctcctccgaagtgacccaggatcactggagtctctcacacaaatcgagcccgtgatcactcagcatctgaaggtgatgaaggacatggtggaactgggcaatcgcaatctgtttcgaggttttggacaacgtggtttgacagacgagggcagcaagctgatggaacaaattcggggcgctttgagttcgatggagaaggagcaacgtgcgcgattggctcagcaacaagcgaagctcgcggcaaagacagatcacgtcgcattgatcagtttcgcaggaagcgctctggccggagtacttgtgctcgcgtgcgccatggccacattcggtgccgtgcaccgacgaaggaaagcggacgagaaactggatcgcttgctgggttcgatgcctgacggattgttcatcgtcaacgcggaaggaaaaattgtcagcagcaatgctcaagcggaaaagttgttcggctacagcgaccgggaactccagggcgagagcatggccctgctggttccggaacgttttcggcagacccaaaggcaatactacgccggatacttctcccagcgttccggccggatgccgacaacgactttggagctttgtggtttgcacaaggacggtcgggaattcccaatcgagatgagcacaaagccgctggcattggacaatggatcggtcgtcacaagcgcaattcgcgatatcactggacgcaaacaggtggaaaagcaaatttccaagttgaacaaggaactggaacttcgcgccgtcgaattggaaacagcctacaaggagctcgaagccttcagttattcggtttcgcatgacctgcgttcgccgctccagaacattgatagcttcagccagatcctgatagaggattatgccaatcggcttgattccgatggccgggattacgttcaacgactgcgcgccagttgccaacacatggaggagatcattgatgctctgttggcgttgtcgaatatgatgcgaagcgagttgcagatagaagccttcgatcttagcgctttggccaataccgtggctgcggacttgaagctaaagaatccggaccgcctcgtggactgggtcatcgccgagggactgagcgtcgagggcgacccgcaactgttgcgagtggtgctggagaatctgtttggcaacgcgtggaagttcacggcgaatcggccgcgcgcgcggattgaattcggagcgcttccacaatccaacggcgcccgcacttatttcgtgcgcgacgacggtgcgggtttcgatatggcgcgggcagccagtttgttcacgccgttcaagcgtctgcacgaccaaagcgaatttcgcggcacgggcatcgggctggcaaccgtgcagcgcgttatccaacgccatcgaggaaaaatctgggcggaaggtgttgtcgatcgcggcgcgactttttgcttcaccctgacggatgacgggggcgcacctaatggacgaaatcatgattccaccccaccaaagtgacttgtccgaagcagagctcccaagcaaacccttgcgggtcctgttcgccgatgactcggaaaatgacgttctgatgctgttacgcgtcttacgcaaggccggctatgagcctgt

SEQ ID NO: 840 - DNA, 4000 bp, Escherichia coli
  misc_feature (2)..(2): n is a, c, g, or t
  misc_feature (62)..(62): n is a, c, g, or t
  misc_feature (80)..(80): n is a, c, g, or t
  misc_feature (83)..(83): n is a, c, g, or t
  misc_feature (137)..(137): n is a, c, g, or t
  misc_feature (149)..(149): n is a, c, g, or t
  misc_feature (197)..(197): n is a, c, g, or t
  misc_feature (215)..(215): n is a, c, g, or t
  misc_feature (228)..(228): n is a, c, g, or t
  misc_feature (233)..(233): n is a, c, g, or t
  misc_feature (242)..(242): n is a, c, g, or t
  misc_feature (257)..(257): n is a, c, g, or t
  misc_feature (272)..(272): n is a, c, g, or t
  misc_feature (329)..(329): n is a, c, g, or t
  misc_feature (356)..(356): n is a, c, g, or t
  misc_feature (386)..(386): n is a, c, g, or t
  misc_feature (392)..(392): n is a, c, g, or t
  misc_feature (416)..(416): n is a, c, g, or t
  misc_feature (431)..(431): n is a, c, g, or t
  misc_feature (479)..(479): n is a, c, g, or t
  misc_feature (503)..(503): n is a, c, g, or t
  misc_feature (533)..(533): n is a, c, g, or t
  misc_feature (697)..(697): n is a, c, g, or t
  misc_feature (788)..(788): n is a, c, g, or t
  misc_feature (824)..(824): n is a, c, g, or t
  misc_feature (827)..(827): n is a, c, g, or t
  misc_feature (837)..(837): n is a, c, g, or t
  misc_feature (976)..(976): n is a, c, g, or t
  misc_feature (1007)..(1008): n is a, c, g, or t
  misc_feature (1012)..(1012): n is a, c, g, or t
  misc_feature (1017)..(1018): n is a, c, g, or t
  misc_feature (1030)..(1030): n is a, c, g, or t
  misc_feature (1040)..(1040): n is a, c, g, or t
  misc_feature (1078)..(1078): n is a, c, g, or t
  misc_feature (1085)..(1085): n is a, c, g, or t
  misc_feature (1087)..(1087): n is a, c, g, or t
  misc_feature (1096)..(1096): n is a, c, g, or t
  misc_feature (1103)..(1103): n is a, c, g, or t
  misc_feature (1105)..(1105): n is a, c, g, or t
  misc_feature (1162)..(1162): n is a, c, g, or t
  misc_feature (1177)..(1177): n is a, c, g, or t
  misc_feature (1196)..(1196): n is a, c, g, or t
  misc_feature (1198)..(1198): n is a, c, g, or t
  misc_feature (1213)..(1213): n is a, c, g, or t
  misc_feature (1216)..(1217): n is a, c, g, or t
  misc_feature (1243)..(1243): n is a, c, g, or t
  misc_feature (1245)..(1245): n is a, c, g, or t
  misc_feature (1268)..(1268): n is a, c, g, or t
  misc_feature (1304)..(1304): n is a, c, g, or t
  misc_feature (1362)..(1362): n is a, c, g, or t
  misc_feature (1542)..(1542): n is a, c, g, or t
  misc_feature (1558)..(1558): n is a, c, g, or t
  misc_feature (1569)..(1569): n is a, c, g, or t
  misc_feature (1605)..(1605): n is a, c, g, or t
  misc_feature (1761)..(1761): n is a, c, g, or t
  misc_feature (1824)..(1824): n is a, c, g, or t
  misc_feature (1864)..(1864): n is a, c, g, or t
  misc_feature (1968)..(1968): n is a, c, g, or t
  misc_feature (1970)..(1970): n is a, c, g, or t
  misc_feature (1980)..(1980): n is a, c, g, or t
  misc_feature (1985)..(1986): n is a, c, g, or t
  misc_feature (1992)..(1993): n is a, c, g, or t
  misc_feature (1996)..(1996): n is a, c, g, or t
  misc_feature (1998)..(1998): n is a, c, g, or t
  misc_feature (2000)..(2000): n is a, c, g, or t
  misc_feature (2009)..(2009): n is a, c, g, or t
  misc_feature (2507)..(2507): n is a, c, g, or t
  misc_feature (2598)..(2598): n is a, c, g, or t
  misc_feature (3183)..(3184): n is a, c, g, or t
  misc_feature (3205)..(3205): n is a, c, g, or t
  misc_feature (3218)..(3218): n is a, c, g, or t
  misc_feature (3252)..(3252): n is a, c, g, or t
  misc_feature (3255)..(3255): n is a, c, g, or t
  misc_feature (3285)..(3285): n is a, c, g, or t
  misc_feature (3361)..(3361): n is a, c, g, or t
  misc_feature (3367)..(3367): n is a, c, g, or t
  misc_feature (3378)..(3379): n is a, c, g, or t
  misc_feature (3381)..(3382): n is a, c, g, or t
  misc_feature (3385)..(3385): n is a, c, g, or t
  misc_feature (3389)..(3395): n is a, c, g, or t
  misc_feature (3397)..(3400): n is a, c, g, or t
  misc_feature (3403)..(3403): n is a, c, g, or t
  misc_feature (3405)..(3405): n is a, c, g, or t
  misc_feature (3411)..(3411): n is a, c, g, or t
  misc_feature (3438)..(3438): n is a, c, g, or t
  misc_feature (3440)..(3440): n is a, c, g, or t
  misc_feature (3443)..(3443): n is a, c, g, or t
  misc_feature (3446)..(3446): n is a, c, g, or t
  misc_feature (3452)..(3452): n is a, c, g, or t
  misc_feature (3455)..(3455): n is a, c, g, or t
  misc_feature (3457)..(3458): n is a, c, g, or t
  misc_feature (3462)..(3463): n is a, c, g, or t
  misc_feature (3471)..(3471): n is a, c, g, or t
  misc_feature (3474)..(3474): n is a, c, g, or t
  misc_feature (3476)..(3476): n is a, c, g, or t
  misc_feature (3481)..(3482): n is a, c, g, or t
  misc_feature (3484)..(3484): n is a, c, g, or t
  misc_feature (3488)..(3489): n is a, c, g, or t
  misc_feature (3491)..(3491): n is a, c, g, or t
  misc_feature (3495)..(3495): n is a, c, g, or t
  misc_feature (3501)..(3502): n is a, c, g, or t
  misc_feature (3505)..(3505): n is a, c, g, or t
  misc_feature (3507)..(3508): n is a, c, g, or t
  misc_feature (3510)..(3513): n is a, c, g, or t
  misc_feature (3516)..(3516): n is a, c, g, or t
  misc_feature (3518)..(3518): n is a, c, g, or t
  misc_feature (3521)..(3521): n is a, c, g, or t
  misc_feature (3525)..(3525): n is a, c, g, or t
  misc_feature (3527)..(3527): n is a, c, g, or t
  misc_feature (3532)..(3532): n is a, c, g, or t
  misc_feature (3534)..(3535): n is a, c, g, or t
  misc_feature (3540)..(3544): n is a, c, g, or t
  misc_feature (3547)..(3548): n is a, c, g, or t
  misc_feature (3551)..(3551): n is a, c, g, or t
  misc_feature (3553)..(3554): n is a, c, g, or t
  misc_feature (3556)..(3556): n is a, c, g, or t
  misc_feature (3558)..(3560): n is a, c, g, or t
  misc_feature (3563)..(3563): n is a, c, g, or t
  misc_feature (3568)..(3568): n is a, c, g, or t
  misc_feature (3572)..(3574): n is a, c, g, or t
  misc_feature (3577)..(3577): n is a, c, g, or t
  misc_feature (3580)..(3580): n is a, c, g, or t
  misc_feature (3583)..(3590): n is a, c, g, or t
  misc_feature (3593)..(3594): n is a, c, g, or t
  misc_feature (3596)..(3598): n is a, c, g, or t
  misc_feature (3602)..(3602): n is a, c, g, or t
  misc_feature (3604)..(3605): n is a, c, g, or t
  misc_feature (3608)..(3608): n is a, c, g, or t
  misc_feature (3610)..(3610): n is a, c, g, or t
  misc_feature (3612)..(3612): n is a, c, g, or t
  misc_feature (3614)..(3614): n is a, c, g, or t
  misc_feature (3616)..(3618): n is a, c, g, or t
  misc_feature (3620)..(3621): n is a, c, g, or t
  misc_feature (3624)..(3624): n is a, c, g, or t
  misc_feature (3626)..(3627): n is a, c, g, or t
  misc_feature (3632)..(3632): n is a, c, g, or t
  misc_feature (3634)..(3634): n is a, c, g, or t
  misc_feature (3638)..(3638): n is a, c, g, or t
  misc_feature (3642)..(3648): n is a, c, g, or t
  misc_feature (3651)..(3651): n is a, c, g, or t
  misc_feature (3653)..(3653): n is a, c, g, or t
  misc_feature (3656)..(3656): n is a, c, g, or t
  misc_feature (3666)..(3668): n is a, c, g, or t
  misc_feature (3672)..(3676): n is a, c, g, or t
  misc_feature (3678)..(3678): n is a, c, g, or t
  misc_feature (3680)..(3684): n is a, c, g, or t
  misc_feature (3688)..(3688): n is a, c, g, or t
  misc_feature (3690)..(3691): n is a, c, g, or t
  misc_feature (3693)..(3696): n is a, c, g, or t
  misc_feature (3698)..(3699): n is a, c, g, or t
  misc_feature (3701)..(3701): n is a, c, g, or t
  misc_feature (3703)..(3707): n is a, c, g, or t
  misc_feature (3709)..(3710): n is a, c, g, or t
  misc_feature (3716)..(3717): n is a, c, g, or t
  misc_feature (3720)..(3722): n is a, c, g, or t
  misc_feature (3728)..(3731): n is a, c, g, or t
  misc_feature (3733)..(3734): n is a, c, g, or t
  misc_feature (3736)..(3738): n is a, c, g, or t
  misc_feature (3741)..(3742): n is a, c, g, or t
  misc_feature (3745)..(3745): n is a, c, g, or t
  misc_feature (3747)..(3750): n is a, c, g, or t
  misc_feature (3754)..(3758): n is a, c, g, or t
  misc_feature (3760)..(3760): n is a, c, g, or t
  misc_feature (3762)..(3769): n is a, c, g, or t
  misc_feature (3772)..(3772): n is a, c, g, or t
  misc_feature (3775)..(3780): n is a, c, g, or t
  misc_feature (3782)..(3785): n is a, c, g, or t
  misc_feature (3788)..(3791): n is a, c, g, or t
  misc_feature (3793)..(3796): n is a, c, g, or t
  misc_feature (3798)..(3798): n is a, c, g, or t
  misc_feature (3801)..(3802): n is a, c, g, or t
  misc_feature (3804)..(3805): n is a, c, g, or t
  misc_feature (3808)..(3809): n is a, c, g, or t
  misc_feature (3812)..(3812): n is a, c, g, or t
  misc_feature (3814)..(3815): n is a, c, g, or t
  misc_feature (3817)..(3821): n is a, c, g, or t
  misc_feature (3824)..(3825): n is a, c, g, or t
  misc_feature (3828)..(3828): n is a, c, g, or t
  misc_feature (3830)..(3832): n is a, c, g, or t
  misc_feature (3835)..(3836): n is a, c, g, or t
  misc_feature (3839)..(3843): n is a, c, g, or t
  misc_feature (3845)..(3845): n is a, c, g, or t
  misc_feature (3847)..(3847): n is a, c, g, or t
  misc_feature (3850)..(3850): n is a, c, g, or t
  misc_feature (3854)..(3854): n is a, c, g, or t
  misc_feature (3856)..(3856): n is a, c, g, or t
  misc_feature (3859)..(3859): n is a, c, g, or t
  misc_feature (3862)..(3862): n is a, c, g, or t
  misc_feature (3866)..(3868): n is a, c, g, or t
  misc_feature (3870)..(3870): n is a, c, g, or t
  misc_feature (3872)..(3874): n is a, c, g, or t
  misc_feature (3877)..(3878): n is a, c, g, or t
  misc_feature (3881)..(3881): n is a, c, g, or t
  misc_feature (3883)..(3885): n is a, c, g, or t
  misc_feature (3887)..(3889): n is a, c, g, or t
  misc_feature (3891)..(3891): n is a, c, g, or t
  misc_feature (3895)..(3896): n is a, c, g, or t
  misc_feature (3900)..(3901): n is a, c, g, or t
  misc_feature (3903)..(3910): n is a, c, g, or t
  misc_feature (3914)..(3915): n is a, c, g, or t
  misc_feature (3917)..(3921): n is a, c, g, or t
  misc_feature (3923)..(3923): n is a, c, g, or t
  misc_feature (3925)..(3930): n is a, c, g, or t
  misc_feature (3932)..(3934): n is a, c, g, or t
  misc_feature (3936)..(3936): n is a, c, g, or t
  misc_feature (3939)..(3939): n is a, c, g, or t
  misc_feature (3941)..(3942): n is a, c, g, or t
  misc_feature (3947)..(3948): n is a, c, g, or t
  misc_feature (3950)..(3950): n is a, c, g, or t
  misc_feature (3952)..(3952): n is a, c, g, or t
  misc_feature (3954)..(3954): n is a, c, g, or t
  misc_feature (3957)..(3957): n is a, c, g, or t
  misc_feature (3959)..(3959): n is a, c, g, or t
  misc_feature (3961)..(3964): n is a, c, g, or t
  misc_feature (3967)..(3973): n is a, c, g, or t
  misc_feature (3978)..(3980): n is a, c, g, or t
  misc_feature (3982)..(3983): n is a, c, g, or t
  misc_feature (3985)..(3985): n is a, c, g, or t
  misc_feature (3987)..(3988): n is a, c, g, or t
  misc_feature (3990)..(3990): n is a, c, g, or t
  misc_feature (3994)..(3995): n is a, c, g, or t
  misc_feature (3998)..(4000): n is a, c, g, or t
gngtgtctgcggatattcaacgggcgatttggaaggagacggggatttactcgacggttggnatgtcgaatgcgaatccnctnttggccaaattagcgctcgataatgaggcgaagaagattccgcatatgcgagcnaactggtcgtangaagatgtcgaggagaaggtctggggaattccagagatgacagacttntggggaattggctcgcgnatggagaagcgantgaangcactaggnatttattcgattcgngaattggcaaatgcnaatcccgaccgattgaaacaagcgcttggcgtcgtaggcttggatttatggtttcangcgaatggcatcgatgagagtaatgtncatgtgccgtaccgtccgaaatcaagaggnctcggnaactcgcaggtgcttccgcgcaantatgttcgccagcgngatattgaaatcgtgctacgcgagatggcggagcaggtggcgattcgnatgagacgaattaagaagaaggcnacggttgtttcgattcatgtaggctactcnaaggacgaaggcttgtcgtcgatacaggcgcagcgcaaaattgacccgacgaatcgcacttcggtgttatcggaagtggtgttggaactctttcgtaagaaatacaaaggaggtgcggtgcgtaatgtggcggtgcggtattccggatttgtcgaagaaagctntggactcatttcactattcgaagatattgaagcagttgagaaagaagaaaggctccagacggcgattgatacggtccgcgaccaatacggnttcacctcgcttttaaaagggaacgcgctggaaggnggntcgcgcgtgntggctagaagtaagttagtcggaggacattccgctggaggattagacggtttgaaataatggaaagagcgtatttgccgtatcgctcggcaagagagcacaaggatcgcggcatggcgaagtggatgggatttttcctntctgaacatacgacgtccctaaaggatgaanngaancgcgnngaccagacgagnatgctgacgntggaagagaaatggatgctgctatcgcaattgtatgtngggaagntncaagccagnattacgntnccgtatcggatgatgcgacaaacgctcattggcgaagtgagtgaattatacgagagngaaatctcgctgaanacagaagaaggctaccgcngnattgcagtggaaganatnntgcaaattcagttggtggaaggtttntnaaatgtgttgcaattgtatcgcnaatgtgttgttttctagtgttgtttcttttataatnatggtactagaataacagaggtgagactatggcgaatatgaaaaccgcaagtgtgaangtaagaatacaagaagatatcaaaaagcaagcagaggaaattttagatcaattaggacttccaagagcagtagcgatagatatgttttatagacagattatcctaaacaaaggtattccttttgagttagttattccaactgcaccgaaatcacgtgaagaactcacaaaagaagaattngacaagatgatgaaantagctgttgancaagtagaaaaaggacaaacaacaccggtagaagangtttttgaggaactatatcgaggtatgtaaatggaacattataggatagagatttctgatttagctaaggcacagttagttgaaattagagattatatagctaaagagttatattctccagcaactgccagaaagacgctacatttattggaaaanaatatcctttctctttctaaattaccccatcgacatgaaaaagtggaggataaggaatggggnaataaagggattaggaagtatcaggtgaagaactttctcntttattattctattcatgaagaaagtcgagttgttgcgattctgggtattatgtatgctaaaaggaatccagcttatttattgaaaaagttacagtaaatgaanantcaaaacacngtttnngagtgnncantnantgaacgtcncccgttattcactagagttgacgggggcgttcttttttgctaaaatagtcgtgttgtaattgtgaagcaccacagctacaaccgctcggattagagtacaaaagaccggaatcggcactttaaactggcgagtcttagtctaaaatataggaggtgcaatatgtacgcaatcgtaaaaactggtggaaaacaagttaaagttgaagttggtcaagcaatctacgttgaaaaattaaacgcagaagctggcgacaaagtaactttcgaagaagtagtatttgtaggtggagatgacgttaaagttggtgctccattcgtagcaggtgcaactgttgaaggaactgttgaaaaacaaggccgtcaaaagaaagttgtaactttcaaatacaaacgtcgtaaagactcacaccgtaaacaaggtcaccgtcaaccttatacaaaagttgttattgacgcaatcaacgcttaatcacgatgattcaagtgactgtacacaanaagaaccaacgtatcgtttcctttgaaatgactggtcatgcaaactttagtgaacatggttcggatatcgtttgcgcaggggtatcggctntagccattacaactgtgaacagcattgagaagttagcaggataccaaccgattgtcgaagtcgacgaggttgagggtggttacttatatatggaagttgtagaagacttgacgaaagagcaagaacatacaactcaaattttattaaatagtctattactagggttagaagatattcaatcggaatatcaagactttctagctgtaactgttgcataatcaatcaaggaggtgcacaactatgttaaaagtgaatttacaattattcgcccataaaaaagggggcggttctacatcaaacggacgtgactcacaagcgaaacgtctaggtgctaaacgtgctgacggacaattcgtttcaggtggttcaattttataccgtcaacgtggaacaaaaatccatccaggtgaaaacgtaggtagaggtggagacgatactttatttgctaaagtagacggaattgtacgtttcgaacgtaaaggccgtgacaaaaaacaagtatctgtatatccagtaatcgctgctgaataatattgagtaggatgtgacattcagtcacatccttttttttaagaaaaatgagannttaacaaaactacttcaaacntttcagattactntataatagctatactagctgtaccggaggaagcnttncgtcttccttcctctcaagcttcaaactgnctctaggaaatgaatttccagagtcagtaattcacattgagtacaatcgctagtattgctattatagaatctgaangttctncgtagttttgnnannaanaaannnnnnngnnnntantncatatnattcaaagctcaaaaactcttaaaaananaanganggattnttntnnaagnnggtaaagnaantnaagcnntngaannantggnaaaagnngtngnngnnnntcnanaanaaancngttantnnaatgnnnnngcnnttngnnanannntanaaaanattnnnaanaanaannnnnnnnaannannngaangnntgncnantnannnanncgntnnaaaantnaacnaagnnnnnnnacnantanatttaacaannnattnnnnngnannnnntcgncnnannnntnnantnnnnntnntaaaanncgnnnaagaannnngnntnnnaannaancnnnnaatnnnnncngnnnnnnnnggnttnnnnnngnnnnatnnnntnnnncnaannannaannaanannannnnntgnnaantnnngannttnnnnnangnagngggnanttnctnagcnnnantnnnttnntcntnnnannngntggnnaaanngnnnnnnnnacanncnnnnntnannnnnnannncntgntnncttanncntncnagntntnnnnttnnnnnnnttggnnntnnananntncttnnaannn

SEQ ID NO: 841 - DNA, 4000 bp, Escherichia coli
  misc_feature (441)..(441): n is a, c, g, or t
  misc_feature (911)..(911): n is a, c, g, or t
  misc_feature (1068)..(1068): n is a, c, g, or t
  misc_feature (1887)..(1887): n is a, c, g, or t
  misc_feature (1992)..(1992): n is a, c, g, or t
  misc_feature (3777)..(3777): n is a, c, g, or t
cttctgcgccgaaaatgtagggggctaagctcgcaaccgaagcctcggatccgaaaagccagatcttttcggatggtaggggagcgttcctgttgggccgaagtcgcatcgtgaggtgcggtggactgacaggaagtgagaatgccggcatgagtagcgttaaagcaagtgaaagacttgctcaccggaagcccaagggttcctggggaagggaatccgcccagggttaggcgggacctaaggtgtagccgaagggcgaagccgatggacagccggtagacattccggccccaccttggtgacgtttgtaccgaaggggtgacgcagggagctaggcacgctgggcgatggaatgcccagtccaagggagtagggggagccttcaggcaaatccgagggctcgaaaccccgagacctgatggggagccttaattataaggngaaggtgttgacgctgcactgccgagaaaagcctctagggaggagccaaggtgcccgtaccctaaaccgacacaggtgggctggttgagcagactgaaggtgtacgggataactctcgctaaggaactcggcaagttgaccccgtaacttagggagaaggggtgcccgcgttaggtgaactcttttacaggggtagccgaggcgggttgcagaaaccaggtccaggcgactgtttaataaaaacacagggctctgctaaaggcgaaagccgatgtatagggcctgacacctgcccggtgccggaaggttaaggggaggggttagccaaagcaatttggcgaagctccaaaccgaagccccggtaaacggcggccgtaactataacggtcctaaggtagcgaaattccttgtcgggtaagttccgacctgcacgaaaggtgtaacgatctggacgctgtctcagcgagagncccggtgaaattgtgggaccggtaaagacgccggttacccgtggttggacgggaagaccccgtggagctttactgtagcctgatattggactttggtacgtcatgtacaggataggtgggaggctgtgaagctagggcgccagccttagtggagccncccttgggataccacccttgatgtgctggggttctaaccgcgaaagcggaacagtgtcaggtgggcagtttgactggggcggtcgcctcctaaagagtaacggaggcgcgcgaaggtcacctcaaggcgtatggaaatcgcctgaagagcgtaagggcataaggtggcctgactgcgagagcgacagctcgagcaggcacgaaagtgggtcctagtgatccggcggttccgagtggaagggccgtcgctcaacggataaaagctaccccggggataacaggctgatcccgcccgagagttcctatcgacggcggggattggcacctcgatgtcggctcatcgcatcctggggctgtagcaggtcccaagggttggtctgttcgcccattaaagcggtacgtgagctgggtttagaacgtcgtgagacagttcggtccctatccaccacgggcgtagggggtttgagaggagctgctcctagtacgagaggaccggagtggacgaacctctggtgtaccggttgtggcgccagctgcaggagccgggtagccacgttcggaaaggataaccgctgaaggcatctaagcgggaagcctacctcaagatgagaccccccactgggaaagccaggtaaggtgtcctggagatgacagggtagataggccggaggtggaagccctgtaaagggtgtagctgaccggtactaatacaccgaggccttgtccttaaaagttttttcctcttttccttgtggtttttgagtcgagtttaaagcaggcatatggtgaccatggcggaggggaaacacccggatccatnccgaacccggcagttaagccctcaagcgccgatggtactgcgggggggacccgtgggagagtaggtcgttgccatgtgcctgctttgttgttatttgcgacattnatgcccctcaaagaaatgttataaatttcaaggtattatgatacactctttatgtaaaatttgtaatgactttttgtccgatcatccctgtaaggggatgtagggaaggggggcacgttgcggtgaaggttttgctttttgggtgtggtagagttggaagggctttttgcgaattactgggtaggaagcgagatgttgtagaaagtgcctcaatttcccttgtgggagttgccactcgaagtcgaggatgtgtttttaactcccatggtatcgatgtagataggctgcttcaatgggaagctttaacgggaaggattgatgctctggagagcgagggcactttggttataagtgacgcaaatgagatgttggaagacctggattatgatattttagttgaatgtactccatctgattttgaaatcggggaacctgccagatctatcatgaaaaaggctattaaaagaggcaagcatgtagttaccgctaatacaggcgctatgagcttgcattttgatgaattaacacgagagtcattggagataggcgtaaaattactttatgaggctaccgttttatcgggtactccacttttttccttggtacgtcatggtttgccgggatgttgcattagaaggtttgaggggatactcaatggtacctgtaattttgtacttactgtaatgggaatgggaagtacttttgatgaagccttgctggaagcccaaaggcgtggcctttcggagcaaaatccatgggttgacatagatggactggaggctgcggctaaaaccgcaatagttgcaaggagtttaatgtcggcgaatgtcgatctcaaacaagcttccataaaggggattagaaatataacggcgcaaaatatcgaagaagccaaaagaaggggaggtaaattaaagctcctttccaggattgaagcaaattctaacgagatacatattagtgtgagtccagaaattctttccttaaaccatcctttggctcacttagaaggtttttccataggtgcgctgcttttgaccgatgtcataggcgaaatatgtattagtggttccggctccggacccaaggagacttcgtattcacttttaaaggacgtgttatccttgagggaaggatgaggttttatatgtctataaagatagcagttatttcagatacacatggaagcttaaaggcttggagggaagcagagcgcctttggcgaggatcaaaccttattattcatcttggtgatgtcttgtaccatggccctcgtaatcctcttcccgaggaatatgcgccaagggaattggcagaagaaatcaatctctctaaaatccctgtcataattattcgaggcaattgcgatgccgatatagatgctgctatactgaagtggcctatatcagatccttattccgtcttatggtgggatggtaggttaatacttgccttgcatggtacggatcttggagagccagggaatctagcgtcgacgttcaatgccgatttagtgcttacgggacacacgcacgttagctctattacctgtgaaggaaaaacgatttttttaaatcccggttcggctagtctgccaaagggcaaaaatcccgcttcgttcgctctattagatgttgatggaattcgaattttaactttaatgggagatataatttgctttgagccttggaatcttatttaaaggggagatattcaaagatggaagttattgagagcatatcaacgagtagagatatgtcccaggaggcaaaaggaagcaaagangctacgttgttggtttttaatctgtttgaagaacattatgctattgaagtatcacaagtaagagagatcgtgcggataccggaaaatataaccagggttccaaacgcaccgccatacgtatgcggagtaatcaatctgagggggacagtaattcccgtaatggatattgccgtaaaaatgagccgaggagagattgagcgtcgcaacgaatcaaggatagtgg

SEQ ID NO: 842 - DNA, 4000 bp, Escherichia coli
  misc_feature (796)..(796): n is a, c, g, or t
  misc_feature (884)..(884): n is a, c, g, or t
  misc_feature (1304)..(1304): n is a, c, g, or t
  misc_feature (1337)..(1337): n is a, c, g, or t
  misc_feature (1992)..(1992): n is a, c, g, or t
  misc_feature (2861)..(2861): n is a, c, g, or t
  misc_feature (3902)..(3903): n is a, c, g, or t
cgccgtggcctttctcgtttagcgaatgggcatcgtcacctggcagcgctgccatgaggcgttgcggctgcccgtcggaagctgtgggaggcgatagcggctggggcgcccagggcggcaatgccgacgtctggtcctcgccgggcctcggcccgtaccatctcggcttcgaagtgtcgttgctgtcgcccgcatcacctgcagatgcggccattgcggccatggcctgatctggtggaggcctggcatcgccttgcctgtccggcggagggctgcttggcgcaagcggcagcggagcctgggcagccggcgctgcattaagggcattcaatcgttggttgatctgctcgagctcggccgtgagcgcgccgatttgcgtctcgagcgcactgacgcgggtgccgagatcgcgctggcttaagggcggttcgggaacgccgccgtttgtatcctctgccggcatcggggcgggattggcgtgggtgaaggactggagtgctccgaccaaagcttgcagctcggcgagtttttgctcgacccgcgacagccgcgcattgatcgaatcccccccttcctcggcgaagctcagacaagaccccaggctcagagcgaggagtactgcggaaaacatcaatgctaggcgcaatcgcttgcgccctgtggaaaccatgagagtcacggtgagaccttgccgctatggccggcaccgacgccttcaagcggagaggcgcccgacgcgaggaaccataacgcatttgtccggccctttggggccaaactgtgatggaaatcctangcttggctcagtagcgggccacagccggattgttcaacacggtctgggcccggcgattctgggtccagcaggagggctcgtcacacancgcgatcgggcgctccttgccataggagatcgtcttgatgcgcgcggcgttgaccccttggcttgccaggaacgtcctgactgccatggcacgccgggccccgagcgcgaggttgtactcgcgcgtgccgcgctcatcggcgtggccctcgatggtcactctgtattgcgggtattggttaagccagctcgcctgatggccgaggatgctgcgggcttctccgctaagcgccgagctgtcctgctcgaaatggacgaggtcgcccacgttaaccgcgaactcctgcggcgaccctggagctgccaccgacccggtggtgccgattccgtattctctcggctctccatggcgcgcgcaggccgccatcagcaaagcaattgcaacgacgcccgcaactttgcaggcgtggccgaccccacngctcgaacgcattactggttactcccgctagcnaaattttagggaaatcgtagagggcaactccttaacgatcccctagtcccgacggtcgggatggctgatggcgagaggatggagaagagatggaagtgctgagaaaaagtatgagaagcgctaaaaaaggaagagatgcctagaacgccgccgcatctcgctacggcgtcccggcatccatattcccctctcgcggaagctgatgcgcttccgcgacgaaatcctggccgcgcctagacgcggacaacctgctcgaccacgacatccgcggacccgagctttagtggctgggtggccacggccttctcgtggtggccgaagcagccaccgagcgcaatggtggcggccacgatcgtggcgacgatgacaacgcccttcaaaccctgcatggtcttctctcctttggtttaacggcagtagccgtctttgcatgtaccggcgcggcgttttgagatcaagaacggatcgatgttcctggaccgttttcccggtcattgatgctaaaatgcaacgccgaatctcaacctccagccagtcgaagctagctcccaaggagaccccgatcaagcatggttaacaccctggaggaggatgattaaaaaagggtaagactagagttgcttttgggacacagggccgcaaatgccgctgcaantcccggccgaaatcggcgctctttggcgctaattgatgagcggcgaccaggctgggtctgagccgaacgcgggcgttgccacctggcgctcgttatagccggtgaggtcgatggtatagagcttggggccgccagcagcgcccggcgattccctgaagaacatcagcacacggccattaggcgcccaggtcgggccctcattgtggaagccctcagtcaggatgcgctcgccgctgccgtcgggcttcatcaccccgatcagaaactcgccgccgaggcgcttggtgaaagcgataaggtcgccgcgcggcgaccacaccggagtggaatagctcccgttcccctggctgatgcgatgctggtcactgccgtcagcgttcatgacgtagatctgctgcgagccgtcgcgatcgctctcgaaaacgatatggcgcccgtcaggcgagtagcagggccccgtatcgatcgcgttgctgttggtgagctgaaatgtgcgccggctgcgcaagtccatcgcaaaaaggtcggcgttgccctcacgctcaaggctcatgacgatgcgctgcccgtcaggcgaaaaacgcggcgcgaaggtcatgcccgggaaggcgcccacgatctccttctgcccggtctcgatgttgaggagatagaccttcggcgtctcgccctcgaaggacatgtaggtgatgtcctgcgtcgaaggactgaagcgcggcgtcagtaccaggttctggccagtggtgagcaacctaacgttgaagccgtcctgatccatgatggcgagccgcttggtgcgcttgtccttaggacctgactcatcgacgaacacgatgcgcgtgtcgaagtagcccttctcgccggtgatncgctcgtagattgcgtcggcgatgatgtggccaacgcgcctcgcatccttcgctcgcgcgaagaactgctcgccggcgagctgcttgccggagaacacgtcccataacctgaactcggctttgagcttttcgtcgctcgcgccgatccgcccaacaaccaatgcctgcgcattcacgacctgccagtcgtcgaagcgcggaacgccgtcgaagttcgtcaccttctcgatgaaggccgcctggtcgatcggattgaacaggccagaggaggcgaggtcagccgccaccacagcggagattgcgcgagctgtttgcgggtcgatcgatccgtcgccggtaaagtcgggaatggcgatcggcagaggctgaatcttgccttgggtgatgttgagctcgaccactgccttcgcctgcggagagcccgcaaccaaggcgagcgcaatcagagcgagcattaggctcagtcggaagagatgaggcgtgagcggaggcatgggtctaaccgctgcgatacatgtcgcttggatcgaagttgaggatcatgtcgcgccacagcgcgtatttggctttgggcaactcgtaaggctggcactggtaaacggctctgactgcgctgtcggcggcggcctggaagaacggcgacgagccgctattggcgaccgtggggtagccgacgagagttccgtcctcattgagcttcagtcttagcttcaccacgatctgatcggcgccgagccctcccggaggcggcgtccagcaatcggctatgcgggctctcagcgcgtcgatctcgttcaccgacatgcttatctccgtgccattcgactgccccttcaccttcttcttgggctcatccgaaggttggaccggctttgggtcgtcggccgcatcggggatcttgttcaggagcgcagcaattttgtcgggattgaaggcgcgcttcttcgcctgcggcttgggcttcttgggggaatcggcggcagcatccttcgctggctttgctgtcttgtcgtcctgcttctgaaggtctggcttctgatnntcaggcttcgccgcagctgcgtcctttggctccttcttgtcgtcgggctttgcctgactcttgtcatccaaagatgccgtctgctcgcgcggcttcg

SEQ ID NO: 843 - DNA, 4000 bp, Escherichia coli
  misc_feature (58)..(58): n is a, c, g, or t
  misc_feature (82)..(82): n is a, c, g, or t
  misc_feature (133)..(133): n is a, c, g, or t
  misc_feature (169)..(169): n is a, c, g, or t
  misc_feature (184)..(184): n is a, c, g, or t
  misc_feature (382)..(382): n is a, c, g, or t
  misc_feature (607)..(607): n is a, c, g, or t
  misc_feature (609)..(609): n is a, c, g, or t
  misc_feature (661)..(661): n is a, c, g, or t
  misc_feature (886)..(886): n is a, c, g, or t
  misc_feature (1002)..(1002): n is a, c, g, or t
  misc_feature (1006)..(1006): n is a, c, g, or t
  misc_feature (1270)..(1270): n is a, c, g, or t
  misc_feature (1429)..(1429): n is a, c, g, or t
  misc_feature (1457)..(1457): n is a, c, g, or t
  misc_feature (1529)..(1529): n is a, c, g, or t
  misc_feature (1580)..(1580): n is a, c, g, or t
  misc_feature (1604)..(1604): n is a, c, g, or t
  misc_feature (1607)..(1607): n is a, c, g, or t
  misc_feature (1631)..(1631): n is a, c, g, or t
  misc_feature (1646)..(1646): n is a, c, g, or t
  misc_feature (1649)..(1649): n is a, c, g, or t
  misc_feature (1673)..(1673): n is a, c, g, or t
  misc_feature (1772)..(1772): n is a, c, g, or t
  misc_feature (1881)..(1881): n is a, c, g, or t
  misc_feature (1973)..(1975): n is a, c, g, or t
  misc_feature (1985)..(1985): n is a, c, g, or t
  misc_feature (1992)..(1992): n is a, c, g, or t
  misc_feature (2001)..(2001): n is a, c, g, or t
  misc_feature (2006)..(2006): n is a, c, g, or t
  misc_feature (2030)..(2030): n is a, c, g, or t
  misc_feature (2372)..(2373): n is a, c, g, or t
  misc_feature (2375)..(2375): n is a, c, g, or t
  misc_feature (2377)..(2384): n is a, c, g, or t
  misc_feature (2386)..(2389): n is a, c, g, or t
  misc_feature (2395)..(2395): n is a, c, g, or t
  misc_feature (2399)..(2399): n is a, c, g, or t
  misc_feature (2401)..(2402): n is a, c, g, or t
  misc_feature (2407)..(2407): n is a, c, g, or t
  misc_feature (2409)..(2411): n is a, c, g, or t
  misc_feature (2414)..(2414): n is a, c, g, or t
  misc_feature (2423)..(2424): n is a, c, g, or t
  misc_feature (2426)..(2426): n is a, c, g, or t
  misc_feature (2428)..(2428): n is a, c, g, or t
  misc_feature (2452)..(2454): n is a, c, g, or t
  misc_feature (2486)..(2486): n is a, c, g, or t
  misc_feature (2495)..(2495): n is a, c, g, or t
  misc_feature (2502)..(2502): n is a, c, g, or t
  misc_feature (2505)..(2505): n is a, c, g, or t
  misc_feature (2531)..(2531): n is a, c, g, or t
  misc_feature (2543)..(2543): n is a, c, g, or t
  misc_feature (2552)..(2554): n is a, c, g, or t
  misc_feature (2556)..(2557): n is a, c, g, or t
  misc_feature (2562)..(2562): n is a, c, g, or t
  misc_feature (2564)..(2564): n is a, c, g, or t
  misc_feature (2571)..(2574): n is a, c, g, or t
  misc_feature (2576)..(2576): n is a, c, g, or t
  misc_feature (2579)..(2580): n is a, c, g, or t
  misc_feature (2582)..(2582): n is a, c, g, or t
  misc_feature (2584)..(2585): n is a, c, g, or t
  misc_feature (2588)..(2589): n is a, c, g, or t
  misc_feature (2591)..(2592): n is a, c, g, or t
  misc_feature (2595)..(2595): n is a, c, g, or t
  misc_feature (2597)..(2602): n is a, c, g, or t
  misc_feature (2604)..(2604): n is a, c, g, or t
  misc_feature (2606)..(2608): n is a, c, g, or t
  misc_feature (2611)..(2612): n is a, c, g, or t
  misc_feature (2616)..(2616): n is a, c, g, or t
  misc_feature (2619)..(2632): n is a, c, g, or t
  misc_feature (2636)..(2638): n is a, c, g, or t
  misc_feature (2640)..(2642): n is a, c, g, or t
  misc_feature (2644)..(2644): n is a, c, g, or t
  misc_feature (2646)..(2649): n is a, c, g, or t
  misc_feature (2651)..(2657): n is a, c, g, or t
  misc_feature (2661)..(2662): n is a, c, g, or t
  misc_feature (2664)..(2664): n is a, c, g, or t
  misc_feature (2666)..(2670): n is a, c, g, or t
  misc_feature (2673)..(2675): n is a, c, g, or t
  misc_feature (2677)..(2679): n is a, c, g, or t
  misc_feature (2681)..(2685): n is a, c, g, or t
  misc_feature (2688)..(2690): n is a, c, g, or t
  misc_feature (2692)..(2705): n is a, c, g, or t
  misc_feature (2707)..(2712): n is a, c, g, or t
  misc_feature (2716)..(2717): n is a, c, g, or t
  misc_feature (2719)..(2724): n is a, c, g, or t
  misc_feature (2726)..(2733): n is a, c, g, or t
  misc_feature (2735)..(2767): n is a, c, g, or t
  misc_feature (2769)..(2772): n is a, c, g, or t
  misc_feature (2774)..(2775): n is a, c, g, or t
  misc_feature (2778)..(2782): n is a, c, g, or t
  misc_feature (2784)..(2787): n is a, c, g, or t
  misc_feature (2789)..(2808): n is a, c, g, or t
  misc_feature (2810)..(2810): n is a, c, g, or t
  misc_feature (2812)..(2818): n is a, c, g, or t
  misc_feature (2820)..(2823): n is a, c, g, or t
  misc_feature (2826)..(2838): n is a, c, g, or t
  misc_feature (2841)..(2851): n is a, c, g, or t
  misc_feature (2853)..(2893): n is a, c, g, or t
  misc_feature (2896)..(2897): n is a, c, g, or t
  misc_feature (2899)..(2905): n is a, c, g, or t
  misc_feature (2907)..(2913): n is a, c, g, or t
  misc_feature (2915)..(2915): n is a, c, g, or t
  misc_feature (2918)..(2923): n is a, c, g, or t
  misc_feature (2925)..(2941): n is a, c, g, or t
  misc_feature (2943)..(2950): n is a, c, g, or t
  misc_feature (2952)..(2993): n is a, c, g, or t
  misc_feature (2996)..(3063): n is a, c, g, or t
  misc_feature (3065)..(3075): n is a, c, g, or t
  misc_feature (3077)..(3096): n is a, c, g, or t
  misc_feature (3099)..(3114): n is a, c, g, or t
  misc_feature (3116)..(3151): n is a, c, g, or t
  misc_feature (3153)..(3169): n is a, c, g, or t
  misc_feature (3171)..(3173): n is a, c, g, or t
  misc_feature (3175)..(3192): n is a, c, g, or t
  misc_feature (3194)..(3291): n is a, c, g, or t
  misc_feature (3293)..(3311): n is a, c, g, or t
  misc_feature (3313)..(3404): n is a, c, g, or t
  misc_feature (3406)..(3428): n is a, c, g, or t
  misc_feature (3430)..(3522): n is a, c, g, or t
  misc_feature (3524)..(3583): n is a, c, g, or t
  misc_feature (3586)..(3639): n is a, c, g, or t
  misc_feature (3642)..(3671): n is a, c, g, or t
  misc_feature (3673)..(3718): n is a, c, g, or t
  misc_feature (3720)..(3765): n is a, c, g, or t
  misc_feature (3767)..(3778): n is a, c, g, or t
  misc_feature (3780)..(3781): n is a, c, g, or t
  misc_feature (3783)..(3801): n is a, c, g, or t
  misc_feature (3803)..(3886): n is a, c, g, or t
  misc_feature (3888)..(3895): n is a, c, g, or t
  misc_feature (3897)..(3914): n is a, c, g, or t
  misc_feature (3917)..(3933): n is a, c, g, or t
  misc_feature (3935)..(4000): n is a, c, g, or t
catgaagtcgtctgttttgatttcaacgccatcaatgtttgtatcacgaacagcgttngtaatttgaccacttgatacaagngccatttgttcgctcattgcagcttggttctcttctaagcttgcttctggnttgaaggctaataatgaagctaacccttctgaaatngtacgagttgcaacnacggcaactgcagcatcttctgatacttcagccgcttggtttgcagccatttgaatgtttttgttgtttggtaatacgataactttttcagcatgcgcttcttttaccgcttgaagaatatcttctgtacttgggttcattgtttgaccaccgttgatgattgtcgttacacccatgctcttgaataattcttgaatnccttcacctgcagcaactgctacgattccgtattccgctttttgtttttgcgctgcttctttaacttttgcagtgtagtctgtttttaacacttcttcgtgttgcaagcgcatgttgtccactttcactttcattaatgaaccgaagcgttgtccgtagttcatgacttcacctggacgttctgtatgcacgtgtactttgatgatttcatcgtcagctactacnantaaagaatctccaagttcgtttaaatagttacggaaagtatcgtagtcgaangtatctacgactgtttcgccttcaccgattttcaccatgatttcagtacagtaaccgaatttgatgtcgcctgttgatacgtgttcgtagtcaacgcctgcttcgtggtgagccactgaagttaaatcgattttattgctttgtaatgattgaacaggaactgcttcccctgttaatgcttcgaagaatccgttgtaaatgaatacaagaccttgaccacctgantccactacgccaacttcttttaatactggtaataaatctggagttttcgctaatgctttttcagcaccacgtaaaacagatcccattacttcgatgatgtcgtttgaagtttctantttncgaacaccacgtttagctgattcacgagcaacagtaaggattgtaccttctacaggtttcataaccgctttataagcagtttccacaccgttcgtaaatgcttgcgctaattcttcaccagtgatttcttctttaccgacaacggctttagagaaaccacggaataattgagataagataacccctgagttcccacgagcacccattaataatccttttgctaaatcttgtgctaaatcacctacagttgttgctgtagagttngcaacacgttccgcaccagatttgaatgagagcatcatgtttgtccctgtgtctccatctggtactgggaatacgtttaatgagtttacgaattctgcattttcagataaacgcatttcaccgatttccaccattgcgcggaaatcttgagccgtaatngttttcatagttgccatattattcttanttcctcctgactagaatcaacaagcattacgcttcgatgattttaactccttgaacatagacattcactgtntttgcagcaaatcctaacattgtttctaagttatatttcacttgttcttgnacgtttctacaaatcgcagaaatnttngtaccataacctacaataatgtanacatccactgcaacnccntcgtcttcttgacgaatcacaacnccacgagtgaagttttctttcttcaagatttcattaaagttgtcgcggatttgattgcggcttgccataccaacaacaccatagttatctgtagcggcnccaccaacaaccgttgcaatcacttcattgctaagttcaatttgtccattttctgtttgaatttttactgtcatacaaatacctcccttaaatgtataaaggtgtctgnctaatttttagacagattgacacattatttctatactataatatcatattccaagcggtttacctagccttttaccaatttttaaccctctnnnaaactcattnaccagcncgcttgcantctanggtcaactatgctaaattatttangtatatgatttagttcaaaattatatcagctgataatgaattaaataaaggaggagaataacaatggctaaagtatgttatttcactggacgtcgtgctgaaacaggtaacactcgttctcacgctatgaacgctaaccgtcgtacttggaaaccaaacttacaaaaagttcgcgttttaatcgatggcaagcctaaaaaagtatgggtttcaactcgtgcattaaaatcaggtaaagtagaacgtgtttaatacagagcactattaaaaagagcttaggcgatatccctaagctctttttgtttttctaaaaataaataagccgaaggcttaaaaaaatanntnannnnnnnnannnncattcnaagntnnttgangnnntgnatagcgganntnantgtaatggtaccggcaggagcctnnngtctccttgcctaccaagcttcaaaccaaggntaagcgacnagtcgcnaanccttggtaattcacattggttacttnttcattacactnaccgctatnnncnnaaatntntttttcnnnntntannantnntcnntnnttncnnnnnncntnnnaannaaanagnnnnnnnnnnnnnntctnnntnnntntnnnntnnnnnnnattnntncnnnnnaannnannnannnnnggnnntnnnnnnnnnnnnnntnnnnnntttnntnnnnnnannnnnnnntnnnnnnnnnnnnnnnnnnnnnnnnnnnnnnnnntnnnnannaannnnnannnnannnnnnnnnnnnnnnnnnnntnannnnnnntnnnnttnnnnnnnnnnnnnaannnnnnnnnnnannnnnnnnnnnnnnnnnnnnnnnnnnnnnnnnnnnnnnnnnaannannnnnnnannnnnnnanaannnnnntnnnnnnnnnnnnnnnnntnnnnnnnnannnnnnnnnnnnnnnnnnnnnnnnnnnnnnnnnnnnnnnnnnttnnnnnnnnnnnnnnnnnnnnnnnnnnnnnnnnnnnnnnnnnnnnnnnnnnnnnnnnnnnnnnnnnnnntnnnnnnnnnnntnnnnnnnnnnnnnnnnnnnnttnnnnnnnnnnnnnnnntnnnnnnnnnnnnnnnnnnnnnnnnnnnnnnnnnnnnannnnnnnnnnnnnnnnnannnannnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnttnnnnnnnnnnnnnnnnnnnnnnnnnnnnnnnnnnnnnnnnnnnnnnnnnnnnnnttnnnnnnnnnnnnnnnnnnnnnnnnnnnnnntnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnntnnnnnnnnnnnnanntnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnntnnnnnnnnnnnnnnnnnnttnnnnnnnnnnnnnnnnntnnnnnnnnnnnnnnnnnnnnnnnnnnnnnnnnnnnnnnnnnnnnnnnnnnnnnnnnnnnnnnnnnn

SEQ ID NO: 844 - DNA, 4000 bp, Escherichia coli
  misc_feature (123)..(123): n is a, c, g, or t
  misc_feature (141)..(141): n is a, c, g, or t
  misc_feature (144)..(144): n is a, c, g, or t
  misc_feature (165)..(165): n is a, c, g, or t
  misc_feature (206)..(206): n is a, c, g, or t
  misc_feature (243)..(243): n is a, c, g, or t
  misc_feature (363)..(363): n is a, c, g, or t
  misc_feature (375)..(375): n is a, c, g, or t
  misc_feature (741)..(741): n is a, c, g, or t
  misc_feature (747)..(747): n is a, c, g, or t
  misc_feature (2079)..(2079): n is a, c, g, or t
  misc_feature (2139)..(2139): n is a, c, g, or t
  misc_feature (2157)..(2157): n is a, c, g, or t
  misc_feature (2252)..(2252): n is a, c, g, or t
  misc_feature (2258)..(2258): n is a, c, g, or t
  misc_feature (2264)..(2264): n is a, c, g, or t
  misc_feature (2270)..(2270): n is a, c, g, or t
  misc_feature (2276)..(2276): n is a, c, g, or t
  misc_feature (2279)..(2279): n is a, c, g, or t
  misc_feature (2285)..(2285): n is a, c, g, or t
  misc_feature (2291)..(2291): n is a, c, g, or t
  misc_feature (2294)..(2294): n is a, c, g, or t
  misc_feature (2315)..(2315): n is a, c, g, or t
  misc_feature (2327)..(2327): n is a, c, g, or t
  misc_feature (2330)..(2330): n is a, c, g, or t
  misc_feature (2333)..(2333): n is a, c, g, or t
  misc_feature (2339)..(2339): n is a, c, g, or t
  misc_feature (2342)..(2342): n is a, c, g, or t
  misc_feature (2411)..(2411): n is a, c, g, or t
  misc_feature (2414)..(2414): n is a, c, g, or t
  misc_feature (2423)..(2423): n is a, c, g, or t
  misc_feature (2441)..(2441): n is a, c, g, or t
  misc_feature (2446)..(2447): n is a, c, g, or t
  misc_feature (2453)..(2453): n is a, c, g, or t
  misc_feature (2456)..(2456): n is a, c, g, or t
  misc_feature (2465)..(2465): n is a, c, g, or t
  misc_feature (2474)..(2474): n is a, c, g, or t
  misc_feature (2483)..(2483): n is a, c, g, or t
  misc_feature (2486)..(2486): n is a, c, g, or t
  misc_feature (2489)..(2489): n is a, c, g, or t
  misc_feature (2498)..(2498): n is a, c, g, or t
  misc_feature (2525)..(2525): n is a, c, g, or t
  misc_feature (2534)..(2534): n is a, c, g, or t
  misc_feature (2726)..(2726): n is a, c, g, or t
  misc_feature (2744)..(2744): n is a, c, g, or t
  misc_feature (3029)..(3029): n is a, c, g, or t
  misc_feature (3077)..(3077): n is a, c, g, or t
  misc_feature (3101)..(3101): n is a, c, g, or t
  misc_feature (3104)..(3104): n is a, c, g, or t
  misc_feature (3173)..(3173): n is a, c, g, or t
  misc_feature (3188)..(3188): n is a, c, g, or t
  misc_feature (3230)..(3230): n is a, c, g, or t
  misc_feature (3299)..(3299): n is a, c, g, or t
  misc_feature (3314)..(3314): n is a, c, g, or t
  misc_feature (3431)..(3431): n is a, c, g, or t
  misc_feature (3452)..(3452): n is a, c, g, or t
  misc_feature (3612)..(3612): n is a, c, g, or t
  misc_feature (3623)..(3623): n is a, c, g, or t
  misc_feature (3701)..(3701): n is a, c, g, or t
  misc_feature (3722)..(3722): n is a, c, g, or t
  misc_feature (3767)..(3767): n is a, c, g, or t
  misc_feature (3770)..(3770): n is a, c, g, or t
  misc_feature (3776)..(3776): n is a, c, g, or t
  misc_feature (3779)..(3779): n is a, c, g, or t
  misc_feature (3818)..(3818): n is a, c, g, or t
  misc_feature (3830)..(3830): n is a, c, g, or t
  misc_feature (3886)..(3886): n is a, c, g, or t
  misc_feature (3897)..(3897): n is a, c, g, or t
  misc_feature (3909)..(3909): n is a, c, g, or t
  misc_feature (3912)..(3912): n is a, c, g, or t
  misc_feature (3915)..(3915): n is a, c, g, or t
  misc_feature (3921)..(3921): n is a, c, g, or t
  misc_feature (3942)..(3943): n is a, c, g, or t
  misc_feature (3984)..(3984): n is a, c, g, or t
  misc_feature (4000)..(4000): n is a, c, g, or t
ttttcggaaagttcttgagcaacagctttacgagcttcgctaagcttgtttccggctgatatcaaagcttcgtagctctttgatagtgaagcttcaaggtttaacttctcatcgtcaaagttntctatggtcaagagctcnccntcaatattatcgcagtaagcnagaatatcctctatggtactaccgtatttctttttaagagnctttatgagctctagacgctcaattgcttcatctagntctgatggatcaaatgtcatttcgtcgacagtatctcttagaacagatacggcttcttcaagtctatagtatgcatcattgcatgattctaaaagctcattcagctttcctgagtactcngcaagtgattcnatgtatgaaagggcagaacctaaagtgctatatgcaccacgttcaccatctataagatcataggcgtggcttgcatcacttgtaatcttctctgagtttttgagcatgtcaaggcgttcctctagctcggtgtcttctcctgggacaagctttgcggatttaatctcgctgatttcaaacttgtaaaaatcaagttttcttgcattctcagaagagagtgagagaagtttgtttagcttcgctttcttttctatatagctttgatattcattagaataagaactcttaagcttgtttatttgttcaaaaccataggtgtcgacaagtgtcaggtgattttcggtgtttagtagtgattgattgtcntactgnccgtgaatatctgcaagcttttggcaggtgagctgaagctctgataatgtaactagtctgccattcagtttgcaaaggttttttccgttagaatttatttctctagaaataattacttcttcgccgtcaatttcacccgaaagttcaataattgctttgtctgtcccaaaacgaacaaacgacgaatcagccctgcttccaagtgcaaggcttatcgccgttactactattgattttccgcttccggtttctccggtaatgatattcagtcctgagtaaaagtcaacatcggtgtttttgataatagcaaaatctctgatactgatgtggtttatcattacttgtgattccttaaaataagcatgttgttaaaaatggataggatttcttctacatgatcttcgtggtcgatgatgagtagaagggtattgtctcctgcaatggagccgacaacatgaggcaagccaatgttgtcaatagcctcgccggctgcagcgccgcaacctgaaagagttttaatgattattaagttgtgtgcagatgcaaatgaagtaatcgtttctctaaagatttttacaaatcgatctgagataggtgcattctgctgcgtgcttactgcatatttatacttgcctgttgatgacagtaccttgattagctgtagctctttgatgtcgcgagatatagtcgcctgtgtaacatcaaagccttcgctctttagcatagccgctagtttctcttgagtttcaatttcgttgtttgagataatctcaagtatcttgttttgtctcgagtaacgcataataataacctctcctggcaaagatgcctccctattttgataattataacacatgtatagttataattaaagataatttgaatggggatttacaaatattgacatataagctctctggttagacaaacatctgttcatatgttataatatcaagcgaaaattaggagagataaagtatgagaattataggtatagaccctggttatgccattatgggctggggaattttagacctaaagggaaataaattcagtgttgttgattacggttcgattacaactgatgcaggcgtagaggcacctaagagacttcagcatatatatgccgagcttggagctattattgcaaaatatcagcctgaggaagctgcgatagaggaactgttttttaataacaatgcaaagacggtaattcttgtaggagaagcaagaggtatcgcagttttagcatgtgcaaatgcaggactagagatatcagaatatacacctttacagataaagcaggctcttgtcggatacggaagagctganaagaagcaggttcaggcaatggttaaggcaatcctaaacctaaaggaagttcctaagccngatgataccgcagatgcngttgcagcagcgatttgccacggacacagtcgtggtaggagggtaattaagtgataagatacattaagggaactatatatcatcaaatggatggntctatnatagtngagaanagctcnggnatgggntttcanatnatgatttccgcaggatctagnttttataagctngtnganggagangangtcaaagttcatacttcaatgatagttaaggaggatgacataagcctctatggcttttctgatagggangancttgaactntttgagcttttgataacngtaannggtatnggngcaaagggngctatgtcnataatgagngtnctnagtcctaangcgctaaagtttgcgattgcatcaggngatagcaantccatagcaaaggcgaatggtgtcggaaagaagacagcagagagaatcatcatagatcttaaggataaagtgggaagctttgatgaagcagagctagatggtcctatagatgataagatatttgttaatgacgatactcgctcggaggctaagatagctttgataagccttggttattcacagcaggaggcngagaatgccataagcaanattaagggtgagaatttgacgatagaggattatatcaagcttgcactcaagcagatgtaggtaataggaatggaagatagaattacaaaaacaagtgccaatgaatttgaggagagacaggaggtcggtcttagaccgcagcgtcttgatgattttattgggcaaagtcatgttaaggaaaatctaaagatatttatagaggcggcaaagctaagaggtgagccactagaccatgttttgttctacggccctccaggacttggtaagacgacacttgcgggaatnattgcaaatgagcttggtgttgatattaagattacttctggccctgcnattggaagagctgcagatcttgcngcnattttgactaatctaaacgaaaacgatgttctttttatagatgagatacatagacttaatagatctgtngaggaagtcctttantctgcgatggaggactatgctcttgatatagttataggaaanggaccgtctgcaaggtcgataagactcgatatagcaaggtttactttgataggtgcaactacgagggcnggtagcctttctgcncctctaagagatagatttggcgtcatagacaagttcgaagtatatggaagcgatgagcttatcaatattattggtagatctgcatccttgcttggggtgacgacagatgaagatgcnctttatgagatggcaagatgntcaagaggaactcctcgtgttgcaaataggatacttaagcgcgtaagggactttgctcaggttagcggaaaatcacatattgactttgaaacggctcagcagtcacttgctgctcttggtgttgatgcacttggtcttgagaaactagatagagagattntagatgcgatnataacaaggtttaacggtggtccagtgggtatagatacaattgctgcatcgattggtgaggagagaattaccatcgangacgcctacgagccatatttnatacagcaaggattgctttatagaacgcagaagggcaggatggcnacngagctngcntataagcaccttggaatcgcctatagcggtgacaaaaanatcgatgcacangaagatagtgcagagtaatttggagaaatagatgcatataaacgattttgattatnagcttccagangagctgattgcncanaanccacanaaggacagggacaaatgtcgnntgatggttttgagacgaagcgacaatagcatagagcatagncatttctttgatatan

SEQ ID NO: 845 - DNA, 4000 bp, Escherichia coli
  misc_feature (2)..(7): n is a, c, g, or t
  misc_feature (9)..(9): n is a, c, g, or t
  misc_feature (11)..(11): n is a, c, g, or t
  misc_feature (14)..(15): n is a, c, g, or t
  misc_feature (17)..(18): n is a, c, g, or t
  misc_feature (20)..(21): n is a, c, g, or t
  misc_feature (23)..(25): n is a, c, g, or t
  misc_feature (27)..(34): n is a, c, g, or t
  misc_feature (37)..(41): n is a, c, g, or t
  misc_feature (45)..(45): n is a, c, g, or t
  misc_feature (47)..(49): n is a, c, g, or t
  misc_feature (52)..(52): n is a, c, g, or t
  misc_feature (55)..(61): n is a, c, g, or t
  misc_feature (63)..(78): n is a, c, g, or t
  misc_feature (80)..(85): n is a, c, g, or t
  misc_feature (87)..(89): n is a, c, g, or t
  misc_feature (91)..(91): n is a, c, g, or t
  misc_feature (93)..(97): n is a, c, g, or t
  misc_feature (99)..(101): n is a, c, g, or t
  misc_feature (103)..(104): n is a, c, g, or t
  misc_feature (106)..(106): n is a, c, g, or t
  misc_feature (108)..(111): n is a, c, g, or t
  misc_feature (114)..(116): n is a, c, g, or t
  misc_feature (120)..(120): n is a, c, g, or t
  misc_feature (122)..(126): n is a, c, g, or t
  misc_feature (128)..(128): n is a, c, g, or t
  misc_feature (131)..(132): n is a, c, g, or t
  misc_feature (134)..(136): n is a, c, g, or t
  misc_feature (139)..(140): n is a, c, g, or t
  misc_feature (144)..(146): n is a, c, g, or t
  misc_feature (148)..(149): n is a, c, g, or t
  misc_feature (151)..(152): n is a, c, g, or t
  misc_feature (154)..(154): n is a, c, g, or t
  misc_feature (156)..(157): n is a, c, g, or t
  misc_feature (159)..(162): n is a, c, g, or t
  misc_feature (165)..(166): n is a, c, g, or t
  misc_feature (168)..(171): n is a, c, g, or t
  misc_feature (173)..(183): n is a, c, g, or t
  misc_feature (186)..(187): n is a, c, g, or t
  misc_feature (189)..(198): n is a, c, g, or t
  misc_feature (200)..(201): n is a, c, g, or t
  misc_feature (204)..(204): n is a, c, g, or t
  misc_feature (206)..(206): n is a, c, g, or t
  misc_feature (209)..(209): n is a, c, g, or t
  misc_feature (215)..(215): n is a, c, g, or t
  misc_feature (218)..(219): n is a, c, g, or t
  misc_feature (222)..(222): n is a, c, g, or t
  misc_feature (224)..(232): n is a, c, g, or t
  misc_feature (235)..(235): n is a, c, g, or t
  misc_feature (237)..(242): n is a, c, g, or t
  misc_feature (244)..(245): n is a, c, g, or t
  misc_feature (248)..(248): n is a, c, g, or t
  misc_feature (253)..(254): n is a, c, g, or t
  misc_feature (256)..(257): n is a, c, g, or t
  misc_feature (260)..(270): n is a, c, g, or t
  misc_feature (272)..(272): n is a, c, g, or t
  misc_feature (274)..(274): n is a, c, g, or t
  misc_feature (276)..(276): n is a, c, g, or t
  misc_feature (278)..(278): n is a, c, g, or t
  misc_feature (280)..(284): n is a, c, g, or t
  misc_feature (286)..(286): n is a, c, g, or t
  misc_feature (288)..(291): n is a, c, g, or t
  misc_feature (293)..(295): n is a, c, g, or t
  misc_feature (297)..(298): n is a, c, g, or t
  misc_feature (300)..(301): n is a, c, g, or t
  misc_feature (304)..(304): n is a, c, g, or t
  misc_feature (311)..(311): n is a, c, g, or t
  misc_feature (313)..(313): n is a, c, g, or t
  misc_feature (315)..(315): n is a, c, g, or t
  misc_feature (322)..(322): n is a, c, g, or t
  misc_feature (325)..(325): n is a, c, g, or t
  misc_feature (327)..(330): n is a, c, g, or t
  misc_feature (336)..(338): n is a, c, g, or t
  misc_feature (340)..(340): n is a, c, g, or t
  misc_feature (343)..(345): n is a, c, g, or t
  misc_feature (351)..(351): n is a, c, g, or t
  misc_feature (353)..(357): n is a, c, g, or t
  misc_feature (359)..(359): n is a, c, g, or t
  misc_feature (362)..(367): n is a, c, g, or t
  misc_feature (369)..(370): n is a, c, g, or t
  misc_feature (378)..(378): n is a, c, g, or t
  misc_feature (380)..(381): n is a, c, g, or t
  misc_feature (386)..(386): n is a, c, g, or t
  misc_feature (391)..(392): n is a, c, g, or t
  misc_feature (397)..(397): n is a, c, g, or t
  misc_feature (399)..(399): n is a, c, g, or t
  misc_feature (401)..(401): n is a, c, g, or t
  misc_feature (403)..(403): n is a, c, g, or t
  misc_feature (406)..(406): n is a, c, g, or t
  misc_feature (409)..(409): n is a, c, g, or t
  misc_feature (412)..(412): n is a, c, g, or t
  misc_feature (414)..(415): n is a, c, g, or t
  misc_feature (417)..(422): n is a, c, g, or t
  misc_feature (424)..(426): n is a, c, g, or t
  misc_feature (429)..(431): n is a, c, g, or t
  misc_feature (434)..(435): n is a, c, g, or t
  misc_feature (437)..(437): n is a, c, g, or t
  misc_feature (445)..(445): n is a, c, g, or t
  misc_feature (742)..(742): n is a, c, g, or t
  misc_feature (1648)..(1648): n is a, c, g, or t
  misc_feature (1789)..(1789): n is a, c, g, or t
  misc_feature (1965)..(1966): n is a, c, g, or t
  misc_feature (1968)..(1971): n is a, c, g, or t
  misc_feature (1973)..(1973): n is a, c, g, or t
  misc_feature (1992)..(1993): n is a, c, g, or t
  misc_feature (2014)..(2014): n is a, c, g, or t
  misc_feature (2140)..(2140): n is a, c, g, or t
  misc_feature (2200)..(2200): n is a, c, g, or t
  misc_feature (2237)..(2237): n is a, c, g, or t
  misc_feature (2417)..(2417): n is a, c, g, or t
  misc_feature (2810)..(2810): n is a, c, g, or t
gnnnnnngnangannannannannnannnnnnnncannnnncagnannncgncgnnnnnnncnnnnnnnnnnnnnnnngnnnnnncnnngntnnnnngnnntnntntnnnnagnnnttcntnnnnngncgnngnnnacnncgcnnngnngnngncnncnnnngannannnntnnnnnnnnnnngannannnnnnnnnngnngangncgncgacgncgnngangnnnnnnnnncgncnnnnnngnnggnggagnngnngcnnnnnnnnnnngntncntngnnnnncncnnnngnnncnncnncgncgacganangngacgagncgngnnnngaggtnnngntgnnngaaaanannnnncngcnnnnnnannaaacgaancnnacgangaagnngacgngngngncgncgncgngnngnnnnnncnnnaannncgnntncttactcncgaagactggccacgtgaagtcgatatcaaagcgtaaggcgaaaacaaccacggtgtcgcagaagaaaccgtcgaacgaggtggcgctggtggaaatgccgcgcgcatcgcgcgcgctgacgactgcaaacgacaagcgctcgaccgcacacacgtggaagtcgtgtccgtttgctattgcgcaaggatccgagccggcgcccgccggatcgcaacagtgcggtaactgcagagcgttggatttgttttatcttgattcgtcgtggaatcaatgaccgacgccagagacgcattttngcctaacgacgtatatgtatgcacacgcttattgattttatcgcgcgatcgattgaaatattgaatattgaaatagtaatcgtcgccgcggcgcggcgacgtcgcgcgatcggtttctctcgcttctactacgcgaggcgtcaatttaacgtacaatcatatcgctgtgctgagaattaaaagctgcgtctaagacgcacaagtgaacgagacagaagtatgaaactagcagcaagagctcttcgcgttgacgctgcgaccttcgcccggtcgcacggtgtttcctcgcggacccgcgttcatttgcggttggctcgccatgcggttcttaatttcgttcgccatggtcatgaaagcttgctcaacgttcgtcgcattcttcgccgacgtctctatgaacgggatcccaatctcatccgcgaacgccttcgccgtcgcgtaatccaccaccttttgactcgtcaagtcgctcttattccccaccagcaacttgttcacattttcgttcgcgtagcgatcgatctcgttcaaccatcccttcaccgcctcaaaactctccatgtcggtcacatcgtacacgacgatgatgccgtgcgcgccgcggtagtacgacgacgtgatcgtccgaaatcgttcctgccccgcggtgtcccaaatttgaagcttgatcgtcttaccctccagctccacagtgcgaatcttaaaatcaaccccgatcgtcgagatatacgtccccgtgtacgtatcgtccgcgaagcgaagcaacagacacgacttaccgacgcccgagtcgccgatgagctgcgcgcgcgcgtcgatagatccgccctcgtcagtcctcgcgtctccctcgcctccgttcgcgcctcccgcgcccgcgcgtcgatcccgtcctcgtccgcgtcnccttcgctcgcgtccgcgcgcgcccgtccctcgatccctcgcgtcaccgcgcgtcgcggtcgagcgttcgcgtcgcgacgatcgcccgtctcaacggcacgcggcgcgttcgcgcgcgcgtcgcgttcgcgcgcgcgcgcncgcgtcgcgcgcgcgcgcgccgaggcgtcggtcgtcgcggcgactcgttcgacgcaccaggagcttgaacaggtaatcgtactcgggattcatcgtcgcgcgcgcgagattctggcgcgcgcgggcgtcgcgcgcgcgcgatggcgcgcgatttagcgccccgaaccctagtgcgnngnnnngnatagaaggacggtgtgagnncatcacgaagtcaactgtttnggcggcggcgcgacgcgcgcgcgcgcgcgcgcggccgcacacgacgacgcgcctcgcgccgtcgacgcgcgcaaacgtcgctcgcacgccgcgcgcgcgtcgcgccgccgcgcccgcgacgcgcgncgcgcgggagcgcgcgaaaacgacgcgcgaacgcctcgcgaggcggcgccgacatgacgnacgcgccgatggacgccgacggcgcgggcgcgagggncgacggggacgcgcgcacggcgaatctggtggtgacgaaaccgaaggacatcggcgacgcggatttcgcgaattatttttgcacgtacgggtacctgtatcaccagaaggacatgctggaggatcagaatcgaatgacggcgtacagcgacgcggtgcgattgaatccggattcgttcanggggaaggtggtgctggacgtggggacgggatctggtgtgctcgcgatgtgggcggcgcaagcgggggcgaagaaggtgtacgcggtggaggcgacgcacatggctgtgcaagcgaggaaaatcgtcgcggcgaacgggctgagcgacgtcgtggaggtgatacaaggatcgatggaggaggtggaactgccggagaaggtggacgtgatcatcagtgaatggatggggtactttttattgcgcgagtcgatgtttgattcggtgctgtgcgcgagggataagtggatgaagccgggaggggcgatgtttccgtcgcacgcgaagatgtatctgagcgcgattaagtcgaacaagagtgggcaaaaatatcaagagcttcaagagagcttgancgtgtgggaggatttcgtgcggaacacgcacgaaaattatggcatagacttgtcgtgcatgaacggcgaatacgaagatgagcaaaaagagcactatttgaacaccgcggcgtgggtggacattcacccgtcgcaagtcatggctaagccgtttacgttggcgagctttgacttgaacacgtgcacgatggacgacatcaaagttcttcgcgacgtcgacttcaagctgcgcctgttcgatggactcgcagggccttcgggggagacgcgcgtcggcgcgttcgcgggctggttcgacgtcacgttcgcgggatccaaggagaacccgtgcgagaacccggtcgagctcacgacagcaccggacgcgaacggcgccacgcactggggtcaacaagcgttctacatgtttcctgaggtatacgccagcgatggtcacttcatttctggtaagtttgacatggttcgtcgcaaggaaaaccaacgcctgtacagcgttcggatgaactggacgcagtccgacacggacgctgggccgccgaacgagtccatcggcacgcgtgggatcgtttggcagattgagtgagcgctcaaccctatcactaatactagtacggtttaaccaaagctcacgcacatttttccgcacgtctcgtccgtctctagtccgcgttgactgtttgactccccaacgcgcgacgacctcactcgcacgcgcgcggcgatcgcgctccatgtccgccgcgagcgcccttgcgagcgcgcgcgacgcgttcgacgacgaggactacgacgaatcgctgcaaatatgcgacgacgctctgggaaccggcgacgaaggtgaaaaagtggcgctgctgtgtcaccgctccaagacatttctagcggtcgggctcgcgcaagaggcgttcgcggacgccgtagacgcggtggcgctcgagggcgacaactccgaggcgctgctcaggctcgggatcgcggcgtacgagatcggggcgtatgcaaaggcacgggaagcgctcgagcgcggcgtcggcgccgagccgagcgggacgagccgacgcgcgacaacgatgaagtggctcgaaaaggcgaaaacggcggaaatgaaggcgagagatggcggcgaagatgcatcgccacacgcgaacgacgagcgtttcaagcgggcgtggtatcagtcgcagacgcac

SEQ ID NO: 846 - DNA, 4000 bp, Escherichia coli
  misc_feature (1986)..(1986): n is a, c, g, or t
  misc_feature (1988)..(1988): n is a, c, g, or t
ttacaaaaaaaccagagcctgagcttgaaatctttacgtctataagtttatcctcttcattttctttgtcgtttttagcggcggtgcgataccattcggctgcttttttatagttctttttcgcattggtgtctttatcgccataatagtacatagaggctaaggccatttgagattttttgtagttttggttaattgctttgacgtaccactcttttgctttttttagatccttttgtactactataccaaactcataaaaaatacccatttgatgctgtgatgcagcattgcccaaatcggctgcttttttaaataatttgaacgccttgggcttgtccttcttaacgcctaggccggccaagtaatgcttagcaagattagttattgctttaacattgcccaaatcggctgctttgttgtaatattcaaaagctttctctgcattgatttcaactacgtcttttccagtaatgtacaaatatgctagtgtgttataagcttgcgctacgccttggtctgcagccttgttggcccaatataatgattttttataatcacgttttacatatatggctcttagatagtatttggctaatttgtcttgagcttcggcataaccaagctcagcagctttgataaataattcaacagctttatctgtatttttatcaaaaccctctccatttttatgcatttctgcaagatcaaataatgattctttatcgccttgatctactgctttttgataccaataaattgcttcatgataatttttactagtgccttttcctagataatgttgtaaggcaatatccttcattgaatttacattgccctgaagtgcggcttgggtgtcccagtataaagatttagccttatcaatatcaacccctaatccaagatagtatcgatctgataaggctgtctgtgcgtaaatgttacccaactctgctgctcttttatagtactcggtttcaagcttttcttgcttagttggtgatgtaagtccaattacaaagccaatgttatacaaagaggttgcgtcgcctttatcggcagatttttggtaatactcaattgctttatcaaaatccacttgaacggtaaatccgtatgtgtaatcaagcgctttttcaaaatctacattgcgatcctgactagctatcttgccagataggacgtcggccttatattgggcatctgtatcacctttttgagtggctttttcataataagccagagccctgggaatgtttatggatgtgccttttccatattcgtacatatgtccaagctcaaattgagagttcgcactgtcaattgcatcagctctttcaaaataatcttttgctatatcaaagtcttgctcgataccatacccatgtaggtgaatttttcctaaaagccataaggcacttatactctctttatacttaattgatttttcaaggtactgtcttgcctgaacataatcttgcttaacgccacgtccgacataatgcatatctccaagtcttaacataacaccagaatcaaacttttcagaagctgccaaatagtgtttaaaggctagtttataatcatcatctataccttctggtgcataataataagccattgctaaatatcttgttagcataggtttaaaagattccatatcctcttcttcaagtgcttgcttaaaattaaaaatagatgttttataatcacctttttgcattgcatctagaccttccgagaatccagcatgtgacacagatattgttagtgttataaaaagtgagattaataatttcattgctctccaaatggttggttaatcttactcaagttaagtgtttaattgatacataatttgttgctatttttcaatctttgttgtttttgttaagttaagtattaatacaaaaaacattaggacgtatagtgttacaaaggtattagatattggctctttcatccagccctcaattgggtagaatngngcagaaagttctggaatccagatgcatgcaaatagaacgattaatgtaattgtatttttcatgataatgcctgttgttaaaaaccaccattatcaaaaataaatgctaactaaaaatgaagattgaatgttttattactgaagtttgttgaaagctaaatgtgtgtcaatccaccgattaacccaccaaacataacaaataacagccataaaatgataattgctggaatagaggcaattgcccacttaaccataaaccacaccattgataaaaatggcattttaatgtctgtaacctctacttttgaaacctctgaatccatcattcacccctgcctaaatcaacataaaatatagccaacataataacgataatctggctaaatatcaagccaggccatgttatgatttttgcactaagtttgcagtcaccacatatctaagcgaccctcctgcaactactgcgttaaacggataacaagttactaatttgagctctgcttggttgctgctaatatttatatctactttgtcagaatcaattatttttatggtgcttacttggtattggtagttttgtttggtatagattgaatccacttcaaattgatcacctattgcaacatcttctaaaaaatcaaagtgcgtatctcgatgagctgatatgattgttgtacccgctctccccggatgtcttgattcaatattgcgcccagggccaaaggcaagcacgttgcccgtgtctccctcaagcacgattaaatcttgattgtgcttggctgatttaagccttatgacagggtgtgaatccatccagttccagggttttacttgatagcctgttttgttagcaacattccaggctgattgaatcatatattgggcagcttcagctttaatcggcatgtaggcgccgtaagcaaaagtactaatgccgataattgccagtagtattgatttattcatgatgttttcctagagcgagtaacaactgacaatagaataagagcaagccctagcatcatccatagctgtgcattggtcgctgttttagcggctttaaccttattagcaaccacttgggtggttgtggcttgattgctcggttttgacggtgttatgtccactgcaactaatgaggtaaattttgagaccagatgatgctcaagcgcaatattggtgatatcggcttgcaccttgtctcgatcaatgcgtctattttgcgctcggtattgatgcatcatttgctcgattttacgtctagcccaaagcacatcaatgccagttgtgttgttattggcgctaatatcaatatctttggtgaatacaccgttagcggtatcgccactaatactgagcttgctagggatggcgttgagtttgtaaactgctgtgatcacctcacctttgtataaatcagagatggatcctaatgcttgctcagcattaatatccatcgggaagttgatattaatatttgtcattgctggagattcaagcttgtcaaatagctccagcattttagtttctacttcatcgatattaccaatgaaagtataagtgcctttaccgtattcagacaaagtagtcattagatgagagtttggtgcagatccgataccaattgtaaacagacggtcttcatcaatattttgacgaacgacacggaatatctcatcttcattgcccacctgtccatcagttaaaaagatgatttggcgtaggtagttatcagcactagattctcttgaatcaaaagcatatttaatcgcctcaagtggctctgtgccaccatcagcacttaaagcattagcaaaacgaacaccatgcttcttgttcatattaatggcgggcatggcgctatcaaagagtgggtcaaagcctgagtcaaaatcaataatattaaatcgatcagttgggttaagtctattgattgcctgaaccaatgctttagatgcttgtagcatagatgatccaagcatagagcctgatgaatcaataacaaagataagc

SEQ ID NO: 847 - DNA, 4000 bp, Escherichia coli
  misc_feature (502)..(502): n is a, c, g, or t
  misc_feature (733)..(733): n is a, c, g, or t
  misc_feature (943)..(943): n is a, c, g, or t
  misc_feature (1381)..(1381): n is a, c, g, or t
  misc_feature (1500)..(1500): n is a, c, g, or t
  misc_feature (1638)..(1638): n is a, c, g, or t
  misc_feature (1642)..(1642): n is a, c, g, or t
  misc_feature (1979)..(1979): n is a, c, g, or t
  misc_feature (1988)..(1988): n is a, c, g, or t
  misc_feature (2319)..(2319): n is a, c, g, or t
  misc_feature (3005)..(3005): n is a, c, g, or t
acatattacgggtaatcctactgatttggtcgttttattgttgatattaaatgtataatcggcattcagggttaaccctttgataatagttgcttttaagaaggcacctatacgagtataagagtcattagtcttgtcatctcctgcttgtttaaggtatgcgatatcatttttcatatcgattccctgataagtaccataaggaccgaagaaacttccccagcgccacatatacgtataagtattacggcgggtattaggggtggtgtatgccttgtcactataactgaagcggccaccgatttgtaaccaatttgttatgtcggaagtgacattcatattagcgttgtatttattcaacttatccgggttgaatgtcatcactccttcctcgtgattatagccaacggacaaaaaataggatgtttttccactggttccctgtattgatatattgtgactttgtgcgggtttccagtctcgaaacataattccgaccacntcccaatctgcataatatagtgcgctgccatcttctcccaaatcaaaatcatcacccggaatcatttcgcgatatccggcttttttacctccgtgtctttgtttccaagcttcagcttttgctatgaaattgtcatccatgtacataccgaacaattcattctcgagattggcacgagtgttggccgcacgcaaagctctggcctgtgtagctacatccggatagttcggnagtatggttggtgtatcccaggagaaattattggtataattgattgtgactttatctgttttctttgcagattttgttgttactaatataacaccaaatgctgctcttgtaccatagatagaagtggaggctgcatctttcaaaacagatatattatcgatatcctgtgtatttaaatatgagatatcgtccattggcacaccatctacnacaataagcgggttactggttgcactgttactcagtgttccggtaccacggatagtcatggttggtttgctgtttagttttccactggtattagtgatggtcaatcccggtactacaccttgcagagctttggacacatcggattgtggacgggcttccaaagtcttgctgacatctacagtggatactgctccggtaaggtttgcctttttctgggttccataacctaccactaccacttcatctagtaattcgttgtcctctttcaggacaactttcatgcttttagttgctttcacatcttgtggttggtatcctacaaatgtgatttgcagagtggtacctacttttacatttagtgaaaatttgccatccatgtcggttacaatcccattggttgtccctttctctacgacactggcaccaataatcggttcnccgtttgcatctactactacacccgtcacggtttgtatttgcatttgttcagtcaccttgtaactactgccggaagcagtttgattagccattgcattgctgctacctataattaaggnagtaatagccatggctataaggaggttgctgttcgctaatcctcgtttcttgcgatcttcattcataaaagatagatgatttaattgttttgtttttcatttgatttctcaggaaaatgcaggtaaaggtaaaatagnaggntaggctaagctatccttggtttggataattatttatcataggcatttcatttaaaggttttaatttttatgttatctctatttgtttttaataagtcctgttaatccttgtttttggccagtttaattaatatcaattggctttgttgattcttttaagagataaattgtttattattaacaaaggtttagaaactctttggagttctactatggcaaagatatattttattttaatatcaagaacaaatattttatataatttagatttatatttgtatattcacattatgacgcttctctgttttataaaaatgatctgtgaatacatttataancgatggttnttaaggtttagaaacattttttagatattgtgcgcgcttttaggactcttcgatgttcatggagtgaaactcgattaaaccattcataggtgtttcttctataacatctatctctactccgaattcctgtgctacttcttgtaaaatatctggatacgcataagctagtgagcctacaaagcggatgggatagtttatataatcgtattggcatacgttgcggttaaagaaactacggagattgttagttaataggttatatacatattcattatccatataatctcctaagaaatacgcaatggttcctaaaaaacgattagggaaaggnagattatatacagattccatgacatcattgaccgagatacgaaacttctcatgaaattcatttgccaattctttgggagctagtcctttaagaaggtcggctaaaaaaagttttccaagaacggctccactgccttcatctcctaaaatatatccggcagctttcacatttttgactataattttaccatcgtaaaaacaggaatttgatccggtacccaagatacaggcaattccggcttcacatttaaataaaccacgagctgctgccagcaaatcgctttcaacctgaatgggagttttgaattgtgccactaaagaggcacctaagatatttttcttttcatatgaactgcatccggcaccatagtaatatacttgatccagtttttttttgaagaatgattccggtagtcccaacctgacgcttctgctaatttctcttctagtctggaagaaagggtttagcccttcggtaaacacacgttgtacgagatgattgtcttcaaccaatgcccattccgttcttgtagaaccactttccgcaataagtttcatttcgcagcctttttgatttggatacaaatatataatattttttgtaatttgatttgttttgatcggaaagttttttcatatcaaataaatgcattcggaaatgtagttccctctttgaatgcttgtgcngaacaatcttttgtttttatccttgtgtcggacctgatcaaatcattcttatttaatagattgtatgaagtttataaaaagaaaatctcagccggattgactacctggctgagatgaattgaaatattaaatcttataatggttatctgcggttaaatccggattttaatttatccgatatttccttctttaatcagatattcggcaatctggacagcattcagtgcggctccttttttgatttgatcacctacaatccagaaggttaatccacagtcattggtcaggtctttacggatacgacctacataaacgggatctttgcctgccaggaacaagggcatcggatattctttctcggcaggattgtcttgcaataccaatccttcacctttggcaaaagcttcacgagcttcttctatcgaaataggacgttctgtttccacccaaatactttcagagtgagcacgaagtgccggaacacgtacacaagtagcacttactttcacgtcagagtgcatgattttgcgtgtttcgttatacattttcatttcctctttcgtatatccgttttctgtgaatacatcaatttgaggaatcaggttgaaggccagctgatacgcaaacttttcaacagtgacaggttcattggctaaaacctgacgatactgttcgtagagttcgtccatagctgctgcaccggcaccgctcgctgcctggtaagtagatacatgcacagtttttatatgagaaagctcttcgatggctttcagtgcgacaaccatctgaatggttgtgcaattcgggttggcaatcacaccacgtggacgatctttagcatcagctgcatttacttcgggcactaccaagggtacatcggcatccatacggaaagcgctggagttatcgatcattaccgcaccatactgggtaatagtcttctcaaactctttagacgtgcctgcaccggccgaagtgaaagcaatgtccacccc

SEQ ID NO: 848 - DNA, 4000 bp, Escherichia coli
  misc_feature (1)..(1): n is a, c, g, or t
  misc_feature (8)..(8): n is a, c, g, or t
  misc_feature (13)..(13): n is a, c, g, or t
  misc_feature (17)..(17): n is a, c, g, or t
  misc_feature (19)..(20): n is a, c, g, or t
  misc_feature (25)..(25): n is a, c, g, or t
  misc_feature (31)..(32): n is a, c, g, or t
  misc_feature (43)..(46): n is a, c, g, or t
  misc_feature (49)..(49): n is a, c, g, or t
  misc_feature (52)..(53): n is a, c, g, or t
  misc_feature (55)..(55): n is a, c, g, or t
  misc_feature (59)..(61): n is a, c, g, or t
  misc_feature (64)..(64): n is a, c, g, or t
  misc_feature (70)..(70): n is a, c, g, or t
  misc_feature (73)..(74): n is a, c, g, or t
  misc_feature (76)..(77): n is a, c, g, or t
  misc_feature (79)..(82): n is a, c, g, or t
  misc_feature (85)..(85): n is a, c, g, or t
  misc_feature (87)..(89): n is a, c, g, or t
  misc_feature (91)..(92): n is a, c, g, or t
  misc_feature (98)..(101): n is a, c, g, or t
  misc_feature (110)..(110): n is a, c, g, or t
  misc_feature (112)..(114): n is a, c, g, or t
  misc_feature (121)..(121): n is a, c, g, or t
  misc_feature (123)..(123): n is a, c, g, or t
  misc_feature (125)..(125): n is a, c, g, or t
  misc_feature (130)..(131): n is a, c, g, or t
  misc_feature (133)..(133): n is a, c, g, or t
  misc_feature (142)..(142): n is a, c, g, or t
  misc_feature (145)..(145): n is a, c, g, or t
  misc_feature (147)..(148): n is a, c, g, or t
  misc_feature (151)..(151): n is a, c, g, or t
  misc_feature (154)..(154): n is a, c, g, or t
  misc_feature (157)..(160): n is a, c, g, or t
  misc_feature (166)..(166): n is a, c, g, or t
  misc_feature (168)..(168): n is a, c, g, or t
  misc_feature (171)..(175): n is a, c, g, or t
  misc_feature (181)..(183): n is a, c, g, or t
  misc_feature (185)..(185): n is a, c, g, or t
  misc_feature (192)..(192): n is a, c, g, or t
  misc_feature (194)..(194): n is a, c, g, or t
  misc_feature (198)..(198): n is a, c, g, or t
  misc_feature (204)..(204): n is a, c, g, or t
  misc_feature (206)..(206): n is a, c, g, or t
  misc_feature (210)..(210): n is a, c, g, or t
  misc_feature (217)..(217): n is a, c, g, or t
  misc_feature (220)..(221): n is a, c, g, or t
  misc_feature (224)..(225): n is a, c, g, or t
  misc_feature (229)..(229): n is a, c, g, or t
  misc_feature (236)..(237): n is a, c, g, or t
  misc_feature (241)..(242): n is a, c, g, or t
  misc_feature (244)..(244): n is a, c, g, or t
  misc_feature (246)..(246): n is a, c, g, or t
  misc_feature (251)..(251): n is a, c, g, or t
  misc_feature (254)..(254): n is a, c, g, or t
  misc_feature (256)..(256): n is a, c, g, or t
  misc_feature (258)..(258): n is a, c, g, or t
  misc_feature (262)..(263): n is a, c, g, or t
  misc_feature (267)..(268): n is a, c, g, or t
  misc_feature (271)..(271): n is a, c, g, or t
  misc_feature (273)..(275): n is a, c, g, or t
  misc_feature (280)..(280): n is a, c, g, or t
  misc_feature (285)..(287): n is a, c, g, or t
  misc_feature (298)..(299): n is a, c, g, or t
  misc_feature (301)..(303): n is a, c, g, or t
  misc_feature (305)..(305): n is a, c, g, or t
  misc_feature (309)..(309): n is a, c, g, or t
  misc_feature (313)..(313): n is a, c, g, or t
  misc_feature (317)..(317): n is a, c, g, or t
  misc_feature (332)..(333): n is a, c, g, or t
  misc_feature (339)..(339): n is a, c, g, or t
  misc_feature (342)..(342): n is a, c, g, or t
  misc_feature (349)..(349): n is a, c, g, or t
  misc_feature (351)..(351): n is a, c, g, or t
  misc_feature (355)..(355): n is a, c, g, or t
  misc_feature (359)..(359): n is a, c, g, or t
  misc_feature (361)..(362): n is a, c, g, or t
  misc_feature (366)..(367): n is a, c, g, or t
  misc_feature (369)..(369): n is a, c, g, or t
  misc_feature (373)..(373): n is a, c, g, or t
  misc_feature (378)..(378): n is a, c, g, or t
  misc_feature (381)..(383): n is a, c, g, or t
  misc_feature (387)..(387): n is a, c, g, or t
  misc_feature (389)..(392): n is a, c, g, or t
  misc_feature (396)..(400): n is a, c, g, or t
  misc_feature (402)..(402): n is a, c, g, or t
  misc_feature (405)..(406): n is a, c, g, or t
  misc_feature (410)..(410): n is a, c, g, or t
  misc_feature (413)..(414): n is a, c, g, or t
  misc_feature (417)..(417): n is a, c, g, or t
  misc_feature (420)..(421): n is a, c, g, or t
  misc_feature (428)..(429): n is a, c, g, or t
  misc_feature (431)..(431): n is a, c, g, or t
  misc_feature (438)..(440): n is a, c, g, or t
  misc_feature (442)..(450): n is a, c, g, or t
  misc_feature (452)..(453): n is a, c, g, or t
  misc_feature (456)..(457): n is a, c, g, or t
  misc_feature (459)..(459): n is a, c, g, or t
  misc_feature (461)..(463): n is a, c, g, or t
  misc_feature (466)..(466): n is a, c, g, or t
  misc_feature (470)..(470): n is a, c, g, or t
  misc_feature (473)..(474): n is a, c, g, or t
  misc_feature (479)..(479): n is a, c, g, or t
  misc_feature (486)..(486): n is a, c, g, or t
  misc_feature (491)..(491): n is a, c, g, or t
  misc_feature (848)..(848): n is a, c, g, or t
  misc_feature (1331)..(1331): n is a, c, g, or t
  misc_feature (1985)..(1985): n is a, c, g, or t
  misc_feature (3244)..(3244): n is a, c, g, or t
  misc_feature (3663)..(3663): n is a, c, g, or t
  misc_feature (3667)..(3667): n is a, c, g, or t
  misc_feature (3673)..(3673): n is a, c, g, or t
  misc_feature (3688)..(3688): n is a, c, g, or t
  misc_feature (3697)..(3697): n is a, c, g, or t
  misc_feature (3700)..(3700): n is a, c, g, or t
ngctcgangcacngctngnngcacngctggnngcagagcgggnnnnacnccnngngctnnncgnagagcngcnncnngnnnngcnannngnngcacannnngtggcacanannntggcacncnanctcgnncncaatctcgngancnntcncgngannnntctcgncntcnnnnncgcccnnncnggcgcancngccngcgcancngcantcgcagntgnnatnncagntgctctnngcanngntnccggnacngntnccgnntcgnncgncnnntcgcnctgcnnntcgtccggccnncnnncntgancgcncgcntgactgtccgcctgnncgtcangcngtgcgtnangcgntgcntnncggnncnctgncgggngcnnngacngnnnnttgnnnnngncgnngtcntcnncgncgnnatcgtcnncnatatcgnnncnnnnnnnnntnngannancnnnggnaccnccnncggcncccccgncggcncccccgacggcgccactgcccatcagcctttcaatcagatcatcgagctgttcaagcgaactgtaatcgagccgcaaactgccgccctttccgtcgaacgcgatatcgacatgcaggccgagcgcattgccgagcgcacgttccagcgccagggtgtccgtatccttggccgctgcctgaggcttgcccttgcctttggaggcgccggccgaacgaccacggcgcgcgcggcgttccttgccaagacgctcggcatcacgaacgctcagaccttcatcgataatctgccgcgcgagcgccgcaggatccgcggcgcgcaggatcgcccgggcgtgaccagcgctgagttcgccctcngccagcattgcccttacatcttcaggcagatcgagcaggcgggtcatattggcaatatggctgcggctcttgccgacaacctcagcgacctgttcctgggtcttgccgaaatcatgggacagccgggcatatgcctccgcctcttcaagcggcgacagctcgtcgcgctggatgttttcaatcaatgcgaccgcgagcgcttcggcatcgttgaagtcgcgaatgatcaccggggcttcatgcacctgggcgcgctgggccgcacgccagcggcgttcgccagcgacgatttcaaaattcccgggatcgctccgcgtcgggcgaacgatcaaaggctgaagaataccctgctcgcggatcgagttggtcagatcgcggagcgcttcatcggcgaagtgccggcgcggctgcaacggattcggaataaggttcgcaatcgggaccatacggaacccgacagcggctccatgcgaggtgcctcgngaatcaaccgggctatccgctgccgccgccgcggcaccggctgaaacagccgcgcctgctggaattgttgtccgagttgccggcggggcttcggcctggggcaccgggtcggcagcgggtgccggtcgggcaccggcatcgaccgcttcttcggccgccgcgatattggtgcgatcctcgccgaacaaggcctcaaggccgcgtccaagctggcgcgggcggggtttttcttcactcatcgggattctcctgtcgtaccgccttcagggccagttgatgtgccgtctgatggatccgttgatacaccgcccgattcagcggcatcctgccggatctcggtgctggcagccttgtcgcgcagactgtccggcaccagactacccgttccggttgtgttcgtgtctttattcttctgtgcatcacggcggaggacttcgcccgccaggtgaacataagcctgtgatccggtgcaggcgagatcatataacagcaccggcttcccatgcgagggagcttctgaaacccttacattacggggaataacggtatcgtataccttgtcgccgaagtagctgcgcacatcgtccgacaccagggaagacagcttgttgcgggtatcgtacatggtcagcacgatcccttcgagttgcaatntagggttgaaccgacctgttacacgatcaatcgtccgcacaagctggctcagcccttcaagtgccaggaactcgcattgcagcggcaccagtaccgtatcggccgcgaccagaccgttcagggtcagcaggcccagcgccggcggacaatcgattagcacatagtcgaactgcgccacggcgctgcggatcgcatctctcagcaggtattcccgccggtccatgtcgacgagttccagctcggctgcggacaggtccatcgtcgatgccacgatgacgaggcccggcacggctgtatcgatcaacgcctggtcgagcgtgatctccccgagcagcaggtcgtaagtgccggaggtccggcgcgcgctctcaattccaagacccgtcgacgcgttgccctggggatcgagatcaaccaccagcacccggcgcccgacagcggcaagcgcggttgcaagattaatcgccgtcgtggtcttgccgaccccgcccttctggttggcaactgcaatgatccggcccggccgcaccggagacgcctcaaccgcatcgtcagctgccttttccaacggcggagggggcgcagtcaacgtatctgccggggtatcgggaaagtcttctgccatgagtctggaccagttgttgctattagggccgggatgcgtccccggaagctgttcttgtctatccggtcgcgcgccggtgcgtctccgcaggccgcacctgtcaagcgccgggcgttagcgtttcttcaggcccgtaatccgcaatatacggctttcggagctggtgacactttcaaatgtctggtgctttattctccagcgtttctccgcctcggtcaattcttcctgccagcgcccgcccttcatgaacaggcagcgctccgcaccaagcaaatcggccattgcacagagcttctcaagcggcgccagcgcccgggcagtcagaacatcaaccgagctttccaccgattcgtgacgctgcggccaccgttcccgcgcgacatcctcgacgcgggcggttgtgaccgtcacgggcgcattggtcgccgtcgccacctcgcgcagaaaagcgctcttgcgggtgtgggattcgatcagttccgtcggcagccccgtcacgatggcaagcaccaggcccgggaaacccgcgccgctgccgatatcggtgattgaccgcgcatcatccggcaggtgttcaactagctgaattgaatcacgcatatgccggtcccagaggtccgggatactgttgcgngaaacaaggttgagagtctgctgccattcctcgagatgcgccgcataaacccgcagccgttccattgtttcacgtgaaacaatcgcgatttcttcaaatttttcaggtgttaagggggaatcagcagtcataaatcatgcagctttctcgccgcggcggacatgacgaagcaacgccgtcagcgccgccggggtcacgccggggatccggcttgcagcgccgagtgtcgcggggcgggcggtgcccagtttttcccgcatttcgttggacagaccaccgatccggccataatccagcccgtccggcagagcgagcgcttcatccttgcggaacgcggtgatatccgcctgctggcggtccagatacccggcatacagggaatcattcgccacctgctgcaggatcgccggggcaaaagncgcngtttcnggccacacccgaagnaccgcctcnatncccgcatcgggcccgctgccggtatgcgcgagcattttcagcgccgtccgcggcaccccgtcctgcgagacctttatgccatgcgccgccaattcctgcggtttcgccgtcagggcagtcaatgttttgcgggcgacatcgagcgccgcgatcttttcggcaaatgcggtttcccgcaccgatccgacacaaccgagcgcaatgcccgccccggtcaggcgctgatccgcattatcggcccgcagggtcagcctgtactcggcgcgcgacgtgaacatgcgatagggctccgccgtgccg

SEQ ID NO: 849 - DNA, 4000 bp, Escherichia coli
  misc_feature (384)..(384): n is a, c, g, or t
  misc_feature (531)..(531): n is a, c, g, or t
  misc_feature (729)..(729): n is a, c, g, or t
  misc_feature (1040)..(1040): n is a, c, g, or t
  misc_feature (1180)..(1180): n is a, c, g, or t
  misc_feature (1985)..(1985): n is a, c, g, or t
  misc_feature (2557)..(2557): n is a, c, g, or t
  misc_feature (2568)..(2568): n is a, c, g, or t
  misc_feature (2582)..(2582): n is a, c, g, or t
  misc_feature (2639)..(2642): n is a, c, g, or t
  misc_feature (2681)..(2683): n is a, c, g, or t
  misc_feature (2696)..(2696): n is a, c, g, or t
  misc_feature (2706)..(2706): n is a, c, g, or t
  misc_feature (2708)..(2708): n is a, c, g, or t
  misc_feature (2715)..(2716): n is a, c, g, or t
  misc_feature (2727)..(2727): n is a, c, g, or t
  misc_feature (2730)..(2730): n is a, c, g, or t
  misc_feature (2733)..(2733): n is a, c, g, or t
  misc_feature (2735)..(2736): n is a, c, g, or t
  misc_feature (2742)..(2743): n is a, c, g, or t
  misc_feature (2745)..(2745): n is a, c, g, or t
  misc_feature (2748)..(2748): n is a, c, g, or t
  misc_feature (2754)..(2757): n is a, c, g, or t
  misc_feature (2762)..(2762): n is a, c, g, or t
  misc_feature (2775)..(2775): n is a, c, g, or t
  misc_feature (2778)..(2778): n is a, c, g, or t
  misc_feature (2781)..(2781): n is a, c, g, or t
  misc_feature (2787)..(2787): n is a, c, g, or t
  misc_feature (2790)..(2790): n is a, c, g, or t
  misc_feature (2793)..(2793): n is a, c, g, or t
  misc_feature (2798)..(2798): n is a, c, g, or t
  misc_feature (2802)..(2802): n is a, c, g, or t
  misc_feature (2805)..(2805): n is a, c, g, or t
  misc_feature (2814)..(2816): n is a, c, g, or t
  misc_feature (2819)..(2819): n is a, c, g, or t
  misc_feature (2826)..(2827): n is a, c, g, or t
  misc_feature (2830)..(2831): n is a, c, g, or t
  misc_feature (2835)..(2838): n is a, c, g, or t
  misc_feature (2841)..(2841): n is a, c, g, or t
  misc_feature (2844)..(2844): n is a, c, g, or t
  misc_feature (2847)..(2847): n is a, c, g, or t
  misc_feature (2850)..(2850): n is a, c, g, or t
  misc_feature (2852)..(2853): n is a, c, g, or t
  misc_feature (2855)..(2862): n is a, c, g, or t
  misc_feature (2870)..(2871): n is a, c, g, or t
  misc_feature (2874)..(2874): n is a, c, g, or t
  misc_feature (2876)..(2877): n is a, c, g, or t
  misc_feature (2880)..(2880): n is a, c, g, or t
  misc_feature (2894)..(2894): n is a, c, g, or t
  misc_feature (2898)..(2898): n is a, c, g, or t
  misc_feature (2901)..(2901): n is a, c, g, or t
  misc_feature (2904)..(2904): n is a, c, g, or t
  misc_feature (2908)..(2908): n is a, c, g, or t
  misc_feature (2910)..(2910): n is a, c, g, or t
  misc_feature (2912)..(2913): n is a, c, g, or t
  misc_feature (2916)..(2918): n is a, c, g, or t
  misc_feature (2922)..(2924): n is a, c, g, or t
  misc_feature (2931)..(2933): n is a, c, g, or t
  misc_feature (2935)..(2935): n is a, c, g, or t
  misc_feature (2937)..(2941): n is a, c, g, or t
  misc_feature (2943)..(2946): n is a, c, g, or t
  misc_feature (2951)..(2952): n is a, c, g, or t
  misc_feature (2954)..(2962): n is a, c, g, or t
  misc_feature (2964)..(2964): n is a, c, g, or t
  misc_feature (2972)..(2974): n is a, c, g, or t
  misc_feature (2976)..(2979): n is a, c, g, or t
  misc_feature (2981)..(2981): n is a, c, g, or t
  misc_feature (2983)..(2984): n is a, c, g, or t
  misc_feature (2986)..(2992): n is a, c, g, or t
  misc_feature (2994)..(2997): n is a, c, g, or t
  misc_feature (2999)..(3000): n is a, c, g, or t
  misc_feature (3002)..(3006): n is a, c, g, or t
  misc_feature (3009)..(3012): n is a, c, g, or t
  misc_feature (3014)..(3015): n is a, c, g, or t
  misc_feature (3018)..(3022): n is a, c, g, or t
  misc_feature (3026)..(3039): n is a, c, g, or t
  misc_feature (3041)..(3041): n is a, c, g, or t
  misc_feature (3043)..(3044): n is a, c, g, or t
  misc_feature (3046)..(3046): n is a, c, g, or t
  misc_feature (3048)..(3051): n is a, c, g, or t
  misc_feature (3053)..(3054): n is a, c, g, or t
  misc_feature (3056)..(3056): n is a, c, g, or t
  misc_feature (3058)..(3061): n is a, c, g, or t
  misc_feature (3064)..(3064): n is a, c, g, or t
  misc_feature (3067)..(3068): n is a, c, g, or t
  misc_feature (3070)..(3070): n is a, c, g, or t
  misc_feature (3073)..(3078): n is a, c, g, or t
  misc_feature (3080)..(3085): n is a, c, g, or t
  misc_feature (3088)..(3091): n is a, c, g, or t
  misc_feature (3094)..(3095): n is a, c, g, or t
  misc_feature (3097)..(3101): n is a, c, g, or t
  misc_feature (3103)..(3103): n is a, c, g, or t
  misc_feature (3106)..(3109): n is a, c, g, or t
  misc_feature (3112)..(3118): n is a, c, g, or t
  misc_feature (3121)..(3127): n is a, c, g, or t
  misc_feature (3129)..(3130): n is a, c, g, or t
  misc_feature (3134)..(3140): n is a, c, g, or t
  misc_feature (3142)..(3143): n is a, c, g, or t
  misc_feature (3145)..(3145): n is a, c, g, or t
  misc_feature (3148)..(3149): n is a, c, g, or t
  misc_feature (3151)..(3151): n is a, c, g, or t
  misc_feature (3153)..(3154): n is a, c, g, or t
  misc_feature (3156)..(3157): n is a, c, g, or t
  misc_feature (3160)..(3160): n is a, c, g, or t
  misc_feature (3163)..(3167): n is a, c, g, or t
  misc_feature (3169)..(3174): n is a, c, g, or t
  misc_feature (3177)..(3178): n is a, c, g, or t
  misc_feature (3180)..(3187): n is a, c, g, or t
  misc_feature (3192)..(3194): n is a, c, g, or t
  misc_feature (3196)..(3200): n is a, c, g, or t
  misc_feature (3203)..(3203): n is a, c, g, or t
  misc_feature (3205)..(3205): n is a, c, g, or t
  misc_feature (3207)..(3212): n is a, c, g, or t
  misc_feature (3214)..(3217): n is a, c, g, or t
  misc_feature (3220)..(3231): n is a, c, g, or t
  misc_feature (3235)..(3241): n is a, c, g, or t
  misc_feature (3245)..(3246): n is a, c, g, or t
  misc_feature (3248)..(3252): n is a, c, g, or t
  misc_feature (3254)..(3255): n is a, c, g, or t
  misc_feature (3258)..(3259): n is a, c, g, or t
  misc_feature (3261)..(3266): n is a, c, g, or t
  misc_feature (3268)..(3272): n is a, c, g, or t
  misc_feature (3274)..(3278): n is a, c, g, or t
  misc_feature (3280)..(3280): n is a, c, g, or t
  misc_feature (3282)..(3286): n is a, c, g, or t
  misc_feature (3289)..(3290): n is a, c, g, or t
  misc_feature (3292)..(3293): n is a, c, g, or t
  misc_feature (3296)..(3297): n is a, c, g, or t
  misc_feature (3300)..(3300): n is a, c, g, or t
  misc_feature (3302)..(3304): n is a, c, g, or t
  misc_feature (3306)..(3309): n is a, c, g, or t
  misc_feature (3311)..(3311): n is a, c, g, or t
  misc_feature (3314)..(3314): n is a, c, g, or t
  misc_feature (3317)..(3321): n is a, c, g, or t
  misc_feature (3323)..(3324): n is a, c, g, or t
  misc_feature (3327)..(3330): n is a, c, g, or t
  misc_feature (3332)..(3332): n is a, c, g, or t
  misc_feature (3334)..(3366): n is a, c, g, or t
  misc_feature (3368)..(3370): n is a, c, g, or t
  misc_feature (3377)..(3377): n is a, c, g, or t
  misc_feature (3379)..(3384): n is a, c, g, or t
  misc_feature (3387)..(3396): n is a, c, g, or t
  misc_feature (3398)..(3399): n is a, c, g, or t
  misc_feature (3401)..(3401): n is a, c, g, or t
  misc_feature (3403)..(3403): n is a, c, g, or t
  misc_feature (3405)..(3411): n is a, c, g, or t
  misc_feature (3413)..(3414): n is a, c, g, or t
  misc_feature (3416)..(3417): n is a, c, g, or t
  misc_feature (3421)..(3421): n is a, c, g, or t
  misc_feature (3423)..(3423): n is a, c, g, or t
  misc_feature (3425)..(3431): n is a, c, g, or t
  misc_feature (3433)..(3433): n is a, c, g, or t
  misc_feature (3436)..(3440): n is a, c, g, or t
  misc_feature (3442)..(3449): n is a, c, g, or t
  misc_feature (3451)..(3457): n is a, c, g, or t
  misc_feature (3459)..(3460): n is a, c, g, or t
  misc_feature (3462)..(3463): n is a, c, g, or t
  misc_feature (3466)..(3469): n is a, c, g, or t
  misc_feature (3471)..(3471): n is a, c, g, or t
  misc_feature (3473)..(3473): n is a, c, g, or t
  misc_feature (3475)..(3478): n is a, c, g, or t
  misc_feature (3481)..(3483): n is a, c, g, or t
  misc_feature (3485)..(3485): n is a, c, g, or t
  misc_feature (3487)..(3488): n is a, c, g, or t
  misc_feature (3490)..(3491): n is a, c, g, or t
  misc_feature (3493)..(3499): n is a, c, g, or t
  misc_feature (3501)..(3502): n is a, c, g, or t
  misc_feature (3504)..(3507): n is a, c, g, or t
  misc_feature (3512)..(3512): n is a, c, g, or t
  misc_feature (3514)..(3516): n is a, c, g, or t
  misc_feature (3518)..(3519): n is a, c, g, or t
  misc_feature (3522)..(3524): n is a, c, g, or t
  misc_feature (3527)..(3549): n is a, c, g, or t
  misc_feature (3551)..(3556): n is a, c, g, or t
  misc_feature (3558)..(3558): n is a, c, g, or t
  misc_feature (3561)..(3566): n is a, c, g, or t
  misc_feature (3569)..(3569): n is a, c, g, or t
  misc_feature (3573)..(3574): n is a, c, g, or t
  misc_feature (3576)..(3576): n is a, c, g, or t
  misc_feature (3578)..(3579): n is a, c, g, or t
  misc_feature (3581)..(3584): n is a, c, g, or t
  misc_feature (3586)..(3586): n is a, c, g, or t
  misc_feature (3589)..(3589): n is a, c, g, or t
  misc_feature (3591)..(3591): n is a, c, g, or t
  misc_feature (3594)..(3596): n is a, c, g, or t
  misc_feature (3599)..(3607): n is a, c, g, or t
  misc_feature (3610)..(3610): n is a, c, g, or t
  misc_feature (3612)..(3613): n is a, c, g, or t
  misc_feature (3615)..(3615): n is a, c, g, or t
  misc_feature (3617)..(3619): n is a, c, g, or t
  misc_feature (3621)..(3623): n is a, c, g, or t
  misc_feature (3625)..(3627): n is a, c, g, or t
  misc_feature (3629)..(3636): n is a, c, g, or t
  misc_feature (3638)..(3638): n is a, c, g, or t
  misc_feature (3640)..(3642): n is a, c, g, or t
  misc_feature (3644)..(3650): n is a, c, g, or t
  misc_feature (3656)..(3658): n is a, c, g, or t
  misc_feature (3660)..(3660): n is a, c, g, or t
  misc_feature (3662)..(3663): n is a, c, g, or t
  misc_feature (3665)..(3666): n is a, c, g, or t
  misc_feature (3669)..(3670): n is a, c, g, or t
  misc_feature (3672)..(3672): n is a, c, g, or t
  misc_feature (3674)..(3675): n is a, c, g, or t
  misc_feature (3677)..(3679): n is a, c, g, or t
  misc_feature (3681)..(3683): n is a, c, g, or t
  misc_feature (3685)..(3685): n is a, c, g, or t
  misc_feature (3688)..(3688): n is a, c, g, or t
  misc_feature (3692)..(3693): n is a, c, g, or t
  misc_feature (3695)..(3695): n is a, c, g, or t
  misc_feature (3697)..(3697): n is a, c, g, or t
  misc_feature (3699)..(3700): n is a, c, g, or t
  misc_feature (3703)..(3703): n is a, c, g, or t
  misc_feature (3707)..(3707): n is a, c, g, or t
  misc_feature (3709)..(3709): n is a, c, g, or t
  misc_feature (3711)..(3712): n is a, c, g, or t
  misc_feature (3714)..(3715): n is a, c, g, or t
  misc_feature (3718)..(3721): n is a, c, g, or t
  misc_feature (3723)..(3725): n is a, c, g, or t
  misc_feature (3727)..(3735): n is a, c, g, or t
  misc_feature (3739)..(3745): n is a, c, g, or t
  misc_feature (3747)..(3749): n is a, c, g, or t
  misc_feature (3751)..(3751): n is a, c, g, or t
  misc_feature (3759)..(3759): n is a, c, g, or t
  misc_feature (3761)..(3761): n is a, c, g, or t
  misc_feature (3767)..(3768): n is a, c, g, or t
  misc_feature (3777)..(3780): n is a, c, g, or t
  misc_feature (3783)..(3784): n is a, c, g, or t
  misc_feature (3786)..(3787): n is a, c, g, or t
  misc_feature (3791)..(3792): n is a, c, g, or t
  misc_feature (3803)..(3804): n is a, c, g, or t
  misc_feature (3807)..(3808): n is a, c, g, or t
  misc_feature (3817)..(3819): n is a, c, g, or t
  misc_feature (3822)..(3824): n is a, c, g, or t
  misc_feature (3827)..(3833): n is a, c, g, or t
  misc_feature (3835)..(3835): n is a, c, g, or t
  misc_feature (3837)..(3838): n is a, c, g, or t
  misc_feature (3840)..(3841): n is a, c, g, or t
  misc_feature (3843)..(3843): n is a, c, g, or t
  misc_feature (3848)..(3850): n is a, c, g, or t
  misc_feature (3854)..(3855): n is a, c, g, or t
  misc_feature (3860)..(3862): n is a, c, g, or t
  misc_feature (3864)..(3866): n is a, c, g, or t
  misc_feature (3868)..(3875): n is a, c, g, or t
  misc_feature (3877)..(3877): n is a, c, g, or t
  misc_feature (3879)..(3880): n is a, c, g, or t
  misc_feature (3882)..(3883): n is a, c, g, or t
  misc_feature (3887)..(3889): n is a, c, g, or t
  misc_feature (3894)..(3895): n is a, c, g, or t
  misc_feature (3897)..(3899): n is a, c, g, or t
  misc_feature (3901)..(3906): n is a, c, g, or t
  misc_feature (3908)..(3910): n is a, c, g, or t
  misc_feature (3912)..(3912): n is a, c, g, or t
  misc_feature (3914)..(3915): n is a, c, g, or t
  misc_feature (3917)..(3917): n is a, c, g, or t
  misc_feature (3920)..(3923): n is a, c, g, or t
  misc_feature (3926)..(3926): n is a, c, g, or t
  misc_feature (3928)..(3929): n is a, c, g, or t
  misc_feature (3931)..(3934): n is a, c, g, or t
  misc_feature (3939)..(3939): n is a, c, g, or t
  misc_feature (3942)..(3943): n is a, c, g, or t
  misc_feature (3945)..(3946): n is a, c, g, or t
  misc_feature (3948)..(3949): n is a, c, g, or t
  misc_feature (3951)..(3951): n is a, c, g, or t
  misc_feature (3955)..(3956): n is a, c, g, or t
  misc_feature (3958)..(3958): n is a, c, g, or t
  misc_feature (3962)..(3963): n is a, c, g, or t
  misc_feature (3968)..(3969): n is a, c, g, or t
  misc_feature (3971)..(3971): n is a, c, g, or t
  misc_feature (3973)..(3976): n is a, c, g, or t
  misc_feature (3978)..(3978): n is a, c, g, or t
  misc_feature (3981)..(3981): n is a, c, g, or t
  misc_feature (3984)..(3984): n is a, c, g, or t
  misc_feature (3987)..(3987): n is a, c, g, or t
  misc_feature (3991)..(3991): n is a, c, g, or t
  misc_feature (3993)..(3993): n is a, c, g, or t
  misc_feature (3996)..(3997): n is a, c, g, or t
aagggattaatgccttgtttcaccaccgggcttccctattaccgggtctcttcaacaaaatatgcacacccctcgtaatgctcctcccccacggccttgtccgttggatcatgcgaaccacgaaattagtgaagctagatcgataatccgacaaataacatgcgaaatatttgtcacatcaaacaaaaatcgtatctttgcaccgctttttagccccgtaccgtgtgatgggaaattaggaagcaaaataactaattttgagtaacacaaaaattaaagaaaatgaagacatttgagttagaaggaaaaggaagagagatcgtcgctcgttccgctgatcagaaaagagccttgaaagcaatgcgtaagaacaatgaaattccngctgtattatacggtggcgaaaaagtaactcacttcacggttacaaaagaagccgttcgtaagttggtttacactccggagattttcgttgttgagttaagcattgacggtaacaagacgatggcaatcgttaaggacatgcagttncaacctgtaactgacgaaatccttcacatggacttcttggaagtatctaaggacaaagccgtagtaatggaagttccggttgttttggaaggtcacgcagaaggtgttaaagccggtggtaagttgtctcttcaaatgagaaaactgaaagtgaaagctatatacgatcaaatccctgaaaagttgacgattaatgtngatcaccttggcttaggtaagactatgcaggtaggtgctttgcacttcgaaggtcttgaattgatgaacgctaaaaacgctgttgtttgcgccgttcaattgactcgtgccgctcgtggtgctcaggctaaaggataatctgaggtaaaaacattattacaatacatgaaggggaggatattcatagaatgttcttcccctttcttttatagattcgaggataatgaaatatttgataacaggacttggtaatatcggttccgaatattggggaacccgtcataatataggtttccgggttgtcaaccatntggtagagagcgtaggaggcaatttcactgaggagcgatacggggcaatcgcacgcatacgggtgaaaaactgtgacttgatcgtgctaaagccgaatacctttatgaacctcagcggcaacgccgttcggtactggttncaaaaagagaacattcccgtggaaaatctattgattgtcgtagatgatctggcattgccattcggaaccttacgtctgaaaccaaagggtagcgacgccgggcataacgggttgaagaatatcgcccagttattgaatacgcaggaatattcccgccttcgtttcggcataggcagcgattttccacggggcggacagatcgattacgtgctagggaaatttcccccggaggaattgcaattgatgccagagatattggatcgtgcgacagagatcatcaagagcttctgcctcgccggcatccagattacgatgaatcaatttaataataaataaaaagagactgagaatacagatatgaacgaggtacgtatcgataaatggatgtgggcgacccgtatctttaagacccgcacgatagccgcggaagcttgcaagaaagggcgtatcatgataggtggagtaacgatcaaaccttcccgcatgatcaaggttggcgatgtgatccaagtgcgtaaaccgccgatcaccttctcttttaaggtaatcggattgatcgagaatcgtgtgggcgcgaagctcgtcccgaattacttggagaacgtgacaaccccggatcagtatgagattctggagatgaaccgtatctccggtttcgtgaaccgtgcgaaaggtctcggacgtcctaccaagaaagaccgtcgtgaactggagcaattcactgagccggaattcatggatgacggattcgatttcgagttcgactttggagaagaggatgaggagtaagcatgctgatttccantcaattacatttaccaatattttcatcaagaagtaaaagtattttcacctagaggtaaaactgtttacatactgatgtaacgacatttacctctagaggaaaaaacatttaccattagaggtaaatgtcgttacaacggtatgtaaacggcaattattcctattgattctcctcggaaagcagattcccctcctcatcccagctacgccagacaccagatttcttccctgccgtatagaacatctcatacaacaaatttcccttatcgctccagatacgccaagggccgtccttttgcccttccttataagaagccaggccgatcagctggccgttatcgctatacgtgcgccattcaccatggaagatcccgtgatagtaggaacgcacctcggcgatcttgccatccggataatagatcacataggttccctcgggacggccatccttcaggtacagctccatcttgagcatgccatcctcatagaattccgtatagcggcccgtatacggggtggtttgtgtctcatcggtataatactgtccctcgctcaataccaagtcttgcgccngcacggtccangaggctcccgccanaaaagcggaaagtaacaatagctttttattcatgatacattcttatctaaattatannnnaaaagacaccgagggatctttccggatacctcagtgccnnnaacaaattcacancctattcaangncaagctnnattaatattcngtnttntnnggatcnnanttngtccannnngcagnccagtcattcttnccntcnaaagcnccnttntaagntacnttntcgaagaannngtngttcaannccnnatcnnnnaantcngcnccntnnannnnnnnngctacganngangnntantcaccatctttagngatnatntcnttgntngnngcnnnagtnnngttgctnnngncnnnnntnnnnaagtnntnnnnnnnnntntcatcctnnnannnntncnncnnnnnnncnnnnannannnnnttnnnnanngcnnnnncatnnnnnnnnnnnnnntncnnancnnnngnncnannnncgnaanncnagnnnnnnannnnnnagnnnnaannannnnngntgnnnntannnnnnnggnnnnnnncnncctnnnnnnnannanccnngncnncnntancannnnngnnnnnnttnncnnnnnnnncagcnnntnnnnnatngnannnnnngnnnnagnnnnnnnnnnnnaagnnnnnnntggnnannnnngnnttnntnnnnnnannnnngnnnnnancnnnnncgnngnnatnngantnnnannnntnagngtnnnnngnntcnnnnanannnnnnnnnnnnnnnnnnnnnnnnnnnnnnnnntnnnccgtatnannnnnntcnnnnnnnnnntnntnancnnnnnnntnntnngcgntnannnnnnngncannnnncnnnnnnnngnnnnnnncnnannaannnncntncnnnnatnnnancnnanngnnnnnnncnncnnnnccgcnannnannccnnngannnnnnnnnnnnnnnnnnnnnnntnnnnnncnaannnnnnacnggcnnantnnannnnancgnanttnnnttnnnnnnnnnttncnncntnnnannnannngnnnnnnnntntnnntnnnnnnnaccagnnncncnntnnatnntngnntnnntnnnangantcanncnancnntancacnantnntnngannnncnnngnnnnnnnnnaaannnnnnncnnncnctttatcngncgtaannacgatcggnnnntcnncnntacnntcggcgatgannttnncgcccggcnnnatnnncannnnnnngncnntnncncccgnnntaanngacannncnnngnnnnnnnnancnncnncaannntcaanntnnngnnnnnntnnncntnnangannnnttncnngnnnntcttntcnncnncnntnatcnntngatnngccgnnanannnncntcnaanatnaccncnttnnaag

SEQ ID NO: 850 - DNA, 4000 bp, Escherichia coli
  misc_feature (574)..(574): n is a, c, g, or t
  misc_feature (700)..(700): n is a, c, g, or t
  misc_feature (1017)..(1017): n is a, c, g, or t
  misc_feature (1502)..(1502): n is a, c, g, or t
  misc_feature (1976)..(1976): n is a, c, g, or t
  misc_feature (2021)..(2021): n is a, c, g, or t
  misc_feature (2141)..(2141): n is a, c, g, or t
  misc_feature (2417)..(2417): n is a, c, g, or t
  misc_feature (2678)..(2678): n is a, c, g, or t
  misc_feature (2883)..(2883): n is a, c, g, or t
  misc_feature (2912)..(2912): n is a, c, g, or t
  misc_feature (2918)..(2918): n is a, c, g, or t
  misc_feature (2967)..(2967): n is a, c, g, or t
  misc_feature (2975)..(2975): n is a, c, g, or t
  misc_feature (2990)..(2990): n is a, c, g, or t
  misc_feature (3215)..(3215): n is a, c, g, or t
  misc_feature (3242)..(3242): n is a, c, g, or t
  misc_feature (3247)..(3248): n is a, c, g, or t
  misc_feature (3257)..(3257): n is a, c, g, or t
  misc_feature (3266)..(3266): n is a, c, g, or t
  misc_feature (3272)..(3272): n is a, c, g, or t
  misc_feature (3275)..(3275): n is a, c, g, or t
  misc_feature (3279)..(3281): n is a, c, g, or t
  misc_feature (3284)..(3284): n is a, c, g, or t
  misc_feature (3313)..(3314): n is a, c, g, or t
  misc_feature (3327)..(3327): n is a, c, g, or t
  misc_feature (3335)..(3335): n is a, c, g, or t
  misc_feature (3338)..(3338): n is a, c, g, or t
  misc_feature (3347)..(3347): n is a, c, g, or t
  misc_feature (3350)..(3350): n is a, c, g, or t
  misc_feature (3359)..(3359): n is a, c, g, or t
  misc_feature (3365)..(3365): n is a, c, g, or t
  misc_feature (3368)..(3368): n is a, c, g, or t
  misc_feature (3371)..(3371): n is a, c, g, or t
  misc_feature (3374)..(3374): n is a, c, g, or t
  misc_feature (3389)..(3389): n is a, c, g, or t
  misc_feature (3392)..(3392): n is a, c, g, or t
  misc_feature (3395)..(3395): n is a, c, g, or t
  misc_feature (3401)..(3401): n is a, c, g, or t
  misc_feature (3404)..(3404): n is a, c, g, or t
  misc_feature (3419)..(3419): n is a, c, g, or t
  misc_feature (3427)..(3428): n is a, c, g, or t
  misc_feature (3434)..(3434): n is a, c, g, or t
  misc_feature (3437)..(3437): n is a, c, g, or t
  misc_feature (3443)..(3443): n is a, c, g, or t
  misc_feature (3449)..(3449): n is a, c, g, or t
  misc_feature (3452)..(3452): n is a, c, g, or t
  misc_feature (3464)..(3464): n is a, c, g, or t
  misc_feature (3476)..(3476): n is a, c, g, or t
  misc_feature (3482)..(3482): n is a, c, g, or t
  misc_feature (3506)..(3506): n is a, c, g, or t
  misc_feature (3512)..(3512): n is a, c, g, or t
  misc_feature (3516)..(3516): n is a, c, g, or t
  misc_feature (3518)..(3518): n is a, c, g, or t
  misc_feature (3524)..(3524): n is a, c, g, or t
  misc_feature (3530)..(3530): n is a, c, g, or t
  misc_feature (3554)..(3554): n is a, c, g, or t
  misc_feature (3560)..(3560): n is a, c, g, or t
  misc_feature (3566)..(3566): n is a, c, g, or t
  misc_feature (3575)..(3575): n is a, c, g, or t
  misc_feature (3577)..(3578): n is a, c, g, or t
  misc_feature (3584)..(3584): n is a, c, g, or t
  misc_feature (3596)..(3596): n is a, c, g, or t
  misc_feature (3602)..(3602): n is a, c, g, or t
  misc_feature (3605)..(3605): n is a, c, g, or t
  misc_feature (3621)..(3623): n is a, c, g, or t
  misc_feature (3627)..(3628): n is a, c, g, or t
  misc_feature (3631)..(3632): n is a, c, g, or t
  misc_feature (3635)..(3636): n is a, c, g, or t
  misc_feature (3638)..(3641): n is a, c, g, or t
  misc_feature (3643)..(3647): n is a, c, g, or t
  misc_feature (3649)..(3654): n is a, c, g, or t
  misc_feature (3656)..(3659): n is a, c, g, or t
  misc_feature (3663)..(3663): n is a, c, g, or t
  misc_feature (3665)..(3669): n is a, c, g, or t
  misc_feature (3671)..(3675): n is a, c, g, or t
  misc_feature (3677)..(3689): n is a, c, g, or t
  misc_feature (3691)..(3693): n is a, c, g, or t
  misc_feature (3695)..(3696): n is a, c, g, or t
  misc_feature (3698)..(3700): n is a, c, g, or t
  misc_feature (3702)..(3709): n is a, c, g, or t
  misc_feature (3712)..(3712): n is a, c, g, or t
  misc_feature (3714)..(3717): n is a, c, g, or t
  misc_feature (3719)..(3727): n is a, c, g, or t
  misc_feature (3729)..(3732): n is a, c, g, or t
  misc_feature (3734)..(3740): n is a, c, g, or t
  misc_feature (3742)..(3746): n is a, c, g, or t
  misc_feature (3748)..(3750): n is a, c, g, or t
  misc_feature (3752)..(3752): n is a, c, g, or t
  misc_feature (3754)..(3758): n is a, c, g, or t
  misc_feature (3760)..(3772): n is a, c, g, or t
  misc_feature (3774)..(3774): n is a, c, g, or t
  misc_feature (3776)..(3777): n is a, c, g, or t
  misc_feature (3780)..(3782): n is a, c, g, or t
  misc_feature (3784)..(3789): n is a, c, g, or t
  misc_feature (3792)..(3795): n is a, c, g, or t
  misc_feature (3797)..(3797): n is a, c, g, or t
  misc_feature (3800)..(3807): n is a, c, g, or t
  misc_feature (3809)..(3816): n is a, c, g, or t
  misc_feature (3818)..(3821): n is a, c, g, or t
  misc_feature (3823)..(3827): n is a, c, g, or t
  misc_feature (3831)..(3832): n is a, c, g, or t
  misc_feature (3835)..(3843): n is a, c, g, or t
  misc_feature (3845)..(3846): n is a, c, g, or t
  misc_feature (3848)..(3850): n is a, c, g, or t
  misc_feature (3852)..(3855): n is a, c, g, or t
  misc_feature (3857)..(3859): n is a, c, g, or t
  misc_feature (3861)..(3862): n is a, c, g, or t
  misc_feature (3865)..(3870): n is a, c, g, or t
  misc_feature (3872)..(3899): n is a, c, g, or t
  misc_feature (3901)..(3901): n is a, c, g, or t
  misc_feature (3903)..(3904): n is a, c, g, or t
  misc_feature (3907)..(3907): n is a, c, g, or t
  misc_feature (3909)..(3922): n is a, c, g, or t
  misc_feature (3924)..(3924): n is a, c, g, or t
  misc_feature (3926)..(3932): n is a, c, g, or t
  misc_feature (3934)..(3941): n is a, c, g, or t
  misc_feature (3943)..(3950): n is a, c, g, or t
  misc_feature (3952)..(3957): n is a, c, g, or t
  misc_feature (3959)..(3959): n is a, c, g, or t
  misc_feature (3961)..(3966): n is a, c, g, or t
  misc_feature (3968)..(3973): n is a, c, g, or t
  misc_feature (3976)..(3976): n is a, c, g, or t
  misc_feature (3979)..(3982): n is a, c, g, or t
  misc_feature (3984)..(3984): n is a, c, g, or t
  misc_feature (3986)..(3987): n is a, c, g, or t
  misc_feature (3990)..(3992): n is a, c, g, or t
  misc_feature (3994)..(3996): n is a, c, g, or t
  misc_feature (3998)..(4000): n is a, c, g, or t
gcagcgcgccgccgataagttcctgcatatgcaggtgccgtgcctcgggtatgtctttgaagacacggcagtcacgaaagcggtgcgacagcagacaccgctgatcaaggcggcaccgaatgcggccgccgcacgctgcattgacgccctcgcagaggcgttgatcacgggggatgagatgtgcatcaaacggggttggaaaggttttttacagcaaattttcaacttttcagcgtagccaaggaggaaaattcagatggcgggcgaattggtacaggcaaggagtattttagctatcgggcagaggctggaaatattctttgagaacagcgaggaggggacccaaggctacacgagccgcatagaagatatcaccggggatgaactcgttgtcgccatgcccgtggatgaacgccgcgttcctgtcatcccgcgcgtcggtgagaacctgtatgtgctcgcggccggggacgggtgccactaccgatttttcagcgttcatcacagtcacggccactatgaaggaaagcttcccgttctgcacatctctattcccgaagtcgcggagcgcttncagaaacgaggccttttccgcattcgggtgaacctgattgccaccatccgtcttgtcgacggacaggggcagatcgccgcgccgcagcgtgtgccgatcgtggatctcagcggaagcgggatggcnttctcctttgcaaagccggtgtcgctggactcatatgtagcgcttgaaatcaacgatgtgccgggcattgggacgatcgaactcatgtcacgggtaaagcgctcaacgcgtattgaacgtgaggacgacctgccgatctatcacatcggcgtgcaatttcaggggctctcacgcagcctgcgggatcagatcgtccgctacctcttccaggtacagcgcagtcaggtggagcgcgtaaaagatgactgacagcagaaagaagaccatggcaatgggcggccgaggcgatccgcacgcacgcatgcggatcgttgtgntcggttcctcgacgggaggcccccaggcgctgcaaaccgtgatcacgagtctgccggaggattttccctgtcccgtcgtcgtcgtgcagcatatgccgcccggctttaccaatgccctggcgggacgcctgcactgcgtttcgaaagtccgagtacaggaggcgcgggatggggatatactcaagccggggtgcgtgtacatcgcgcccggagatcgccacctgcgtgtcttaagtgagtccggtgcacggcgcattgtgctcagtgatgaaccgccggtcggcaatcatcggcccgcagttaatgtaatgtatgactctgttgcgcatctggggaaggatgtcgttgccgtgattctcacaggaatggggaatgacggacgcgaagggatgcgcaagatcaaagcaaacggcggctactgcattgcgcaggatgaagcaacctgcgttgtctacgggatgccaaaatccgtgattgacgcaggnctggccgatgagatatgcccattaccgcagatcgcgcatgcgattgaggcggctgtgagaagataggaagtagggggaatatcaatggataaccagtatatggacatgttcctggacgagtcacatgagcatcttcagtctctgaatgaaggcctgctccgcctcgaggagaacatggaggaggtcagcgccgtcaacgacatcttccgcaacgcgcacacgctcaagggcatgtccgcgacgatgggatttaccaagattgcggagctgacgcatgagatggaggatgttctggacctcgtccgcaaagaacaactcaaactcaatgaagacattatggatacgctgttcaaatgcctcgactctttggagcagatggtagacagcgtcggaaacggcgaggcggaggatgtcgtcgacgtttctgatctcgttgcaaagctcagctcgatctccaaggggacccctgcgccngccgcagcagcaccggcggcccccgcatctgccgggagcagcagnggagcggaggtcgatctcggctttgacgagatcgatctcgatgtcatgaaaaaggcaaaagaagccggcatgcatctctaccatgtcaaggttacactgatggaaacctgcgttctcaangcagcacgctcggttatggtcatgcatgccctcgatgaggtcggcgatgtcatcaagagcatcccgtctgcggaggatctcgagcaggagaagttcgagctcagctttgatgttgttgtggcgagctccgacgatgccgagtctgtgcagaacgctgtcgataccgtctccgaaattgaagatattgcggtcgaggaactcgaccccgataaaatcggcaaaggcggagatgctgcacctgcggctgcacccgccgcttctgcagctgccgccccngcaaagaaagagggggcaaaaaagcctgcggcggcgcccgccaagaagcagcatcaaagccagagtgttcgtgtcgatatcgaaaaactcgatacactgatgaacctcatgggcgagctcgtcatcaacaaggtgcgtctcgagcagatcggccagacacaccgcatgagcgatcttatggagaccctcgagcagatggaccgcgtgacgggcgatctgcagaacattgttatgaaggtccgcatggttccggtcagcgcngtattcaatcgcttcccccgcatggtgcgcgatgtttccaaggaactgggcaaggagatcaacctgacgatcgagggcgaagaaaccgaacttgaccgtactgtgatcgacgagatcggcgatccgatcatgcatctcctgcgcaactccctcgaccacggtgttgagagccctgatgcgcgtgaggcaaagggcaagccgcgtnccggtgaggtgggactcatcgcgcggcangagggnaacaacgttgtcatcatgattacggatgacggtgcgggtattgatgcgngcaagatncgccgcaaggcagtngaaaagggaatgatctctcaggaggaagcggaccgcctcgatgatgcagatgccgtccgcctcatcttcctgcccggcttctcgacggcagagaagatcacggatatctccggccgcggcgtcggcatggatgttgtgcgcagcaagatcgaggccctttcaggccatgtcgatgttgagacgcacatcgacgagggatccgtctttaagatcaagcttccgctnacactcgcgatcattcaggcgatgctngtgcnngtgcaggangagatgtangccatnccnctcnnntcnatcgacagcacgatcaacatcgagccganngatattcagaccntccagaanaangaggtcatngtnctgcgcggngagatnatnccnatnatccgcatggaggangcnctncaggtnccncatacgaaggactcngacgagcnnttcgtngtngtcgtncacgcnggngaggcgaaggcnggcatcgtcgtngacaanctgatcggccagcaggaaatcgtnatcaanacantnggcaanctcttngccggactcaagctcttcggcggngcaacngtgctnggcgacggnanngtcgcnctgattcttgangttgcnacnatgatacagcagtaannngggnnggnnaannannnngnnnnngnnnnnnannnngggnannnnncnnnnnannnnnnnnnnnnngnnntnnannntnnnnnnnnagnannnngnnnnnnnnntnnnnannnnnnngnnnnncnnnantnnnnngnnnnnnnnnnnnntncnnttnnngnnnnnnttnnnnanggnnnnnnnnannnnnnnngnnnngnnnnncccnntannnnnnnnnannannngnnnngnnntnncgnnnnnncnnnnnnnnnnnnnnnnnnnnnnnnnnnngntnncgntnnnnnnnnnnnnnntngnnnnnnngnnnnnnnngnnnnnnnngnnnnnnancnnnnnnannnnnncgntgnnnncnannaannnannnannn

SEQ ID NO: 851 - DNA, 4000 bp, Escherichia coli
  misc_feature (114)..(114): n is a, c, g, or t
  misc_feature (147)..(147): n is a, c, g, or t
  misc_feature (1776)..(1776): n is a, c, g, or t
  misc_feature (1842)..(1842): n is a, c, g, or t
  misc_feature (1991)..(1991): n is a, c, g, or t
  misc_feature (2034)..(2034): n is a, c, g, or t
  misc_feature (2039)..(2040): n is a, c, g, or t
  misc_feature (2608)..(2608): n is a, c, g, or t
ggtagtagtatcctcttgaggcactagatgggatagtaacgttctggtttagtagagcgtggtttgagttgagcggaacagtggcaagcagggtgtcggtggaggagatcgttnccaagttgtttgtactcaggtaaatttcaaccnaaccgcctgtaaatgcgttgaggctcgtgttcacgagtacagcgtttcctggtccaactaccgtggggagaacctgagcggtagcaccagaactcgcggtagctgaggcgtaactagttgcgaaaggaatcaccagcgaggcgaggattgctaccagtaacacttttgacagaaaacactttttttcgtccattttgtacacccttttagggtaaccaacaaaccacgagtaaatatataaggaaagctattgacttgtaaaaacctagaaaaaaactggttttttcttcaaaaagaaaaaaggggtggtcactcgtagatttcgtatatccaagatgacagagttgtttgctgcaatccgactgcgttatagtaatatcttggacctgtgttgagtacgtacgtgtagtactgttgcgttgaataggcccagtacaccgagccagagacgtttgacacgctcaagaagtacacagagtttgcgttcagcgtaatcggcgatggaagaacgaccgtgtaccagcctgtgccgttcacctggatgtttgcggagaacaggtttgacgagaacacgctggttccaagcgagacttgtaccattccgttaccagcgaggtacagcttgattatgccaacctgcgccgtgctcgaattcgtgaagaacgcttggcttgctggagcttgtgaggttatgagcatgtagaacagctggcttgcaagcgtcgccgctactacagcgggtatgctcacggtgaagctggttgaggctgagtagttgagtaggtccaccgcggtaacggtgtatgtccctgcgggaacgttgggtaccgtgaacacaccggtgaagtcgccgttaccatttgtggtgaagttggctacttgttggtttccgaagaacaccgccacgggcacaaacgagctaaaggtcacacccgttatcgaaatgtttgtgccgggtgatccagaatacgatgagagagctatagcgggtaggagtttgagtagggctcttgcgctgttacccatcgcatcctttgcgactacgtcaacggttatcgcagggcttggtggaactgtgaagcttagcgaaaagcctcctgtggagtttgtggtcagagtgaaactcagtggtggggtaaagtcagcggtgacgttcaactgtgtgtttggtgcaaaccccaatccttggagtgtaacgctaacaccctcgtgaaccacctggggtgaaagttgtagcactgggcctacgacaaagttaacggacgctagcaaggttgagccaaagtatgcagagatttcgtacacacccgaagcggttccctgttgaaccgtaaatcttgcgctgaaccctcctgtcgaattgactgtggtggttatgggtgaaaacagcctcggtgtggaagttatggttaccgttgagccagctggttcgttcgtgctaccttcaaccactacttgggcgggtagtgcattcgtgttcactgaaggaggtatcacttcaagcgcgttgactcttacacttaaaagcgcgctcgcaagtcctgttgccacaggtgttccccaacctgacacggggtcgtaccctttggtcgcgctaaagcccagaacgtttgctatcccgtttgtgantgggcttgcgccgttgttaccgtcaacaatatcgttcaacgctttaaacgctccattttctccgantcctgggttttggtatagattcatgccttcgctatacagaaacggattaaggaaaccagctggcagtttgccgtgagcttgtaaatcgctgtctaaaaccgcggttgtcgcagcccaaagcggcgaagaaaggcttgtccctcctagtntatagtagatgtcaaatccgaagatgctgtaggcgttaacaancactnntgtgaatgggtcggcgtccgccgcaacgtcgggcacaattctaccgcttgtgccctgaattccgcacacgcttgcttggtaagtcggacaagagaatatttcgcttgagccgccacccgtgccccagccaaagaaaacgttggtgctccaagcggtttcgttgattctgccaccgccagtcgaaaatggtggagaagacgtgattgagcttaccgcctgagcgtaaagcgttgttccaccaactgaggtgacataggggtcgcttgcaggatatatcacgttcggaaagcccaagtggttgtccgcagaagagtcgccagaggacgcgaacacagaaatgccttctgccgctgcctgctgataaatctggtcgagggcgaagaccacttgttttgtcaggaaaggctcgggcgctccccagctctgagttatcacattaaccgcgccgctatccaccgcgtagttcacagcttcaaaaagagagtctccagcgtcgaaagcaagatataagttgatttttgcaccgggagccgctgcgtgagcccactgcgtatcaagcagagtttcnaatatccaacctgtaaccaagccggaggcaactggtacacctgtgggataaatcacgtttatctgagtgttcggcaaggaaaagtcggcgtcgaattgattaaggtcttgctgaacacctggtgctgtgtacgcgtctacaattcctatcgtgataccagtaccgttgtacccagaagagtaaagctgtgtgagtgagtatgcctgttgaatttgctgagggatataaggaccgtcttgaaacccacatccaaaagttgtggtgcatgacgtactgatttgcatgggctttatcgttttgttcaggttgatcacttggggtgtaaacagggtgtagttggtaagtccgaaaaccgcggccacctgcaaatttgagggtaactcaacgggttgggaattcgcgtagaacacttgtcctttgtagctataaagctgtattgttgttttaagcgcttggcttacctgtgaaaccgtgccctgagctcccacgatcagcctgtttgcgctagtgtatgtcacttgtaagccctgcgattcaaggtagttcacaactgcttgatactgcgattcactcggagaaaacatcgaatggaattgatcgggcgtaagatagtggtggtaaagcggggactgtgggttgtaaatctgagtgattagttgcgcaagctggtcgcggttttgaagcggtagtataatcgcaaaactcactagtgtgttagaaggtgcatttccgaccgtttttgctgagctcactattggtagtacgctaccaggaatacttacatactgcggttgttgagaagcattggctggtgtttgactcaacacactcatagctgtcagtgaaccggttatcgatgcaatcgccaaaagagtgaccactagataactcagacttccctttctaacgctcatactacatcaacgccaattatgtaaacttctatattaacttttcttattatcaaaaaagatattatacgattttaaaaaattgtacagtaatcacaaaaagaatataacaatatatatttcagtaaccttaaaaattttgaacatccccgacttcattctttgtatgaaacatcgagtgtgacgtgatgacaaacttattcatcgatattcggtacgcatacaactttgtgtaaaaacaaagttaatatggatacgttgattattatgaccaatgaccaccactatcgaaatagacggctacttagagcgaaagcttgacctacttgtgggacttgggctttacgccacaaagtctgaagcagtaagagacgcagttcgaaggctgctagagcaaaccgacatcacaaagattgcgcttgacatgtacttaaaaggctcagtgagtctaggtttttgttgtgaaatcgccgacctttca

SEQ ID NO: 852 - DNA, 4000 bp, Escherichia coli
  misc_feature (2)..(2): n is a, c, g, or t
  misc_feature (4)..(4): n is a, c, g, or t
  misc_feature (8)..(9): n is a, c, g, or t
  misc_feature (12)..(13): n is a, c, g, or t
  misc_feature (16)..(19): n is a, c, g, or t
  misc_feature (23)..(24): n is a, c, g, or t
  misc_feature (26)..(26): n is a, c, g, or t
  misc_feature (35)..(35): n is a, c, g, or t
  misc_feature (46)..(47): n is a, c, g, or t
  misc_feature (376)..(376): n is a, c, g, or t
  misc_feature (499)..(499): n is a, c, g, or t
  misc_feature (583)..(583): n is a, c, g, or t
  misc_feature (592)..(592): n is a, c, g, or t
  misc_feature (596)..(596): n is a, c, g, or t
  misc_feature (598)..(598): n is a, c, g, or t
  misc_feature (610)..(610): n is a, c, g, or t
  misc_feature (724)..(724): n is a, c, g, or t
  misc_feature (733)..(733): n is a, c, g, or t
  misc_feature (982)..(982): n is a, c, g, or t
  misc_feature (988)..(988): n is a, c, g, or t
  misc_feature (1291)..(1291): n is a, c, g, or t
  misc_feature (1692)..(1692): n is a, c, g, or t
  misc_feature (1851)..(1851): n is a, c, g, or t
  misc_feature (1989)..(1989): n is a, c, g, or t
  misc_feature (1991)..(1991): n is a, c, g, or t
  misc_feature (2343)..(2343): n is a, c, g, or t
  misc_feature (2487)..(2487): n is a, c, g, or t
  misc_feature (2850)..(2850): n is a, c, g, or t
  misc_feature (2910)..(2910): n is a, c, g, or t
  misc_feature (3013)..(3013): n is a, c, g, or t
  misc_feature (3210)..(3210): n is a, c, g, or t
  misc_feature (3212)..(3216): n is a, c, g, or t
  misc_feature (3218)..(3218): n is a, c, g, or t
  misc_feature (3220)..(3220): n is a, c, g, or t
  misc_feature (3222)..(3223): n is a, c, g, or t
  misc_feature (3228)..(3231): n is a, c, g, or t
  misc_feature (3235)..(3236): n is a, c, g, or t
  misc_feature (3238)..(3238): n is a, c, g, or t
  misc_feature (3243)..(3245): n is a, c, g, or t
  misc_feature (3247)..(3248): n is a, c, g, or t
  misc_feature (3250)..(3252): n is a, c, g, or t
  misc_feature (3254)..(3254): n is a, c, g, or t
  misc_feature (3257)..(3260): n is a, c, g, or t
  misc_feature (3262)..(3262): n is a, c, g, or t
  misc_feature (3265)..(3274): n is a, c, g, or t
  misc_feature (3276)..(3282): n is a, c, g, or t
  misc_feature (3284)..(3285): n is a, c, g, or t
  misc_feature (3287)..(3288): n is a, c, g, or t
  misc_feature (3290)..(3299): n is a, c, g, or t
  misc_feature (3301)..(3302): n is a, c, g, or t
  misc_feature (3304)..(3307): n is a, c, g, or t
  misc_feature (3309)..(3309): n is a, c, g, or t
  misc_feature (3311)..(3316): n is a, c, g, or t
  misc_feature (3318)..(3319): n is a, c, g, or t
  misc_feature (3321)..(3326): n is a, c, g, or t
  misc_feature (3328)..(3328): n is a, c, g, or t
  misc_feature (3331)..(3338): n is a, c, g, or t
  misc_feature (3341)..(3351): n is a, c, g, or t
  misc_feature (3353)..(3355): n is a, c, g, or t
  misc_feature (3357)..(3359): n is a, c, g, or t
  misc_feature (3361)..(3362): n is a, c, g, or t
  misc_feature (3364)..(3370): n is a, c, g, or t
  misc_feature (3372)..(3372): n is a, c, g, or t
  misc_feature (3374)..(3375): n is a, c, g, or t
  misc_feature (3377)..(3383): n is a, c, g, or t
  misc_feature (3385)..(3395): n is a, c, g, or t
  misc_feature (3397)..(3398): n is a, c, g, or t
  misc_feature (3400)..(3401): n is a, c, g, or t
  misc_feature (3403)..(3405): n is a, c, g, or t
  misc_feature (3407)..(3407): n is a, c, g, or t
  misc_feature (3411)..(3411): n is a, c, g, or t
  misc_feature (3413)..(3413): n is a, c, g, or t
  misc_feature (3415)..(3417): n is a, c, g, or t
  misc_feature (3419)..(3429): n is a, c, g, or t
  misc_feature (3431)..(3435): n is a, c, g, or t
  misc_feature (3438)..(3441): n is a, c, g, or t
  misc_feature (3443)..(3449): n is a, c, g, or t
  misc_feature (3451)..(3453): n is a, c, g, or t
  misc_feature (3468)..(3468): n is a, c, g, or t
  misc_feature (3473)..(3473): n is a, c, g, or t
  misc_feature (3487)..(3488): n is a, c, g, or t
  misc_feature (3490)..(3494): n is a, c, g, or t
  misc_feature (3496)..(3497): n is a, c, g, or t
  misc_feature (3500)..(3500): n is a, c, g, or t
  misc_feature (3502)..(3505): n is a, c, g, or t
  misc_feature (3507)..(3509): n is a, c, g, or t
  misc_feature (3511)..(3511): n is a, c, g, or t
  misc_feature (3513)..(3518): n is a, c, g, or t
  misc_feature (3520)..(3520): n is a, c, g, or t
  misc_feature (3523)..(3525): n is a, c, g, or t
  misc_feature (3527)..(3528): n is a, c, g, or t
  misc_feature (3530)..(3533): n is a, c, g, or t
  misc_feature (3535)..(3541): n is a, c, g, or t
  misc_feature (3543)..(3543): n is a, c, g, or t
  misc_feature (3545)..(3545): n is a, c, g, or t
  misc_feature (3547)..(3548): n is a, c, g, or t
  misc_feature (3550)..(3550): n is a, c, g, or t
  misc_feature (3552)..(3559): n is a, c, g, or t
  misc_feature (3562)..(3563): n is a, c, g, or t
  misc_feature (3565)..(3569): n is a, c, g, or t
  misc_feature (3571)..(3577): n is a, c, g, or t
  misc_feature (3579)..(3580): n is a, c, g, or t
  misc_feature (3582)..(3582): n is a, c, g, or t
  misc_feature (3584)..(3587): n is a, c, g, or t
  misc_feature (3589)..(3589): n is a, c, g, or t
  misc_feature (3594)..(3601): n is a, c, g, or t
  misc_feature (3603)..(3605): n is a, c, g, or t
  misc_feature (3608)..(3610): n is a, c, g, or t
  misc_feature (3613)..(3613): n is a, c, g, or t
  misc_feature (3615)..(3617): n is a, c, g, or t
  misc_feature (3620)..(3624): n is a, c, g, or t
  misc_feature (3626)..(3626): n is a, c, g, or t
  misc_feature (3628)..(3628): n is a, c, g, or t
  misc_feature (3630)..(3632): n is a, c, g, or t
  misc_feature (3634)..(3636): n is a, c, g, or t
  misc_feature (3639)..(3652): n is a, c, g, or t
  misc_feature (3654)..(3664): n is a, c, g, or t
  misc_feature (3666)..(3669): n is a, c, g, or t
  misc_feature (3672)..(3683): n is a, c, g, or t
  misc_feature (3687)..(3697): n is a, c, g, or t
  misc_feature (3699)..(3700): n is a, c, g, or t
  misc_feature (3702)..(3705): n is a, c, g, or t
  misc_feature (3707)..(3710): n is a, c, g, or t
  misc_feature (3712)..(3713): n is a, c, g, or t
  misc_feature (3715)..(3715): n is a, c, g, or t
  misc_feature (3717)..(3719): n is a, c, g, or t
  misc_feature (3722)..(3722): n is a, c, g, or t
  misc_feature (3725)..(3725): n is a, c, g, or t
  misc_feature (3727)..(3727): n is a, c, g, or t
  misc_feature (3729)..(3733): n is a, c, g, or t
  misc_feature (3736)..(3740): n is a, c, g, or t
  misc_feature (3742)..(3750): n is a, c, g, or t
  misc_feature (3752)..(3756): n is a, c, g, or t
  misc_feature (3760)..(3763): n is a, c, g, or t
  misc_feature (3765)..(3765): n is a, c, g, or t
  misc_feature (3767)..(3767): n is a, c, g, or t
  misc_feature (3769)..(3773): n is a, c, g, or t
  misc_feature (3775)..(3775): n is a, c, g, or t
  misc_feature (3777)..(3780): n is a, c, g, or t
  misc_feature (3782)..(3782): n is a, c, g, or t
  misc_feature (3784)..(3789): n is a, c, g, or t
  misc_feature (3792)..(3793): n is a, c, g, or t
  misc_feature (3795)..(3796): n is a, c, g, or t
  misc_feature (3800)..(3805): n is a, c, g, or t
  misc_feature (3807)..(3809): n is a, c, g, or t
  misc_feature (3812)..(3813): n is a, c, g, or t
  misc_feature (3816)..(3818): n is a, c, g, or t
  misc_feature (3820)..(3821): n is a, c, g, or t
  misc_feature (3823)..(3823): n is a, c, g, or t
  misc_feature (3825)..(3826): n is a, c, g, or t
  misc_feature (3829)..(3829): n is a, c, g, or t
  misc_feature (3832)..(3832): n is a, c, g, or t
  misc_feature (3835)..(3841): n is a, c, g, or t
  misc_feature (3844)..(3849): n is a, c, g, or t
  misc_feature (3851)..(3851): n is a, c, g, or t
  misc_feature (3853)..(3853): n is a, c, g, or t
  misc_feature (3856)..(3862): n is a, c, g, or t
  misc_feature (3864)..(3867): n is a, c, g, or t
  misc_feature (3869)..(3873): n is a, c, g, or t
  misc_feature (3875)..(3879): n is a, c, g, or t
  misc_feature (3881)..(3886): n is a, c, g, or t
  misc_feature (3888)..(3894): n is a, c, g, or t
  misc_feature (3898)..(3901): n is a, c, g, or t
  misc_feature (3904)..(3909): n is a, c, g, or t
  misc_feature (3911)..(3911): n is a, c, g, or t
  misc_feature (3916)..(3919): n is a, c, g, or t
  misc_feature (3921)..(3923): n is a, c, g, or t
  misc_feature (3925)..(3935): n is a, c, g, or t
  misc_feature (3938)..(3941): n is a, c, g, or t
  misc_feature (3943)..(3944): n is a, c, g, or t
gnantaannccnnctnnnntggnncnggggggccnaaaaaagaaannaattgttaattttatgtcaaatattctaattttaaagtatgttattactaggaattgatttaggaagctcttcagttaaggtttctgttattgatggagagtcaggcaagtgtctggctacagcgtttaatccatctgatgagatgaaaataatagccttgaaaccgggttgggcagagcaggatactgaaatctggtggtctaacctgaaggcttcaattgcagattgtacaaataagcttgggcagaagaaaaacgatatcggtgcaataggtatctcttatcagatgcacgggcttgtcactgttgataagaataataaagtattncgtccatctataatctggtgcgacagcagggctgtcccatatggtgaaaaagctttaaactatctgggcaatgatttctgtctttcacatcttctaaattcccctggtaattttacagctacnaaactagcctgggttaaggaatgtgagccggagttgtattccagaatagataagattatgctgccgggtgattatattgcgctnaggcttacnggananataagtacttcntattcaggactttcagaaggtattttttgggatttttcaactaaccgggtttcggcagagctgctgaaatattttggttttgattcaacccttttaccccaggcggctccttcnttctcgatnagcggaagacttcttaaatcaatagcatcggaattgggtttgcctgaaggaatacctgtctcatacagagccggggatcagccaaataatgctctatctctgaatgtttttaatccgggtgaagttgcagcaactgctggtacttctggagttatatatggaattactgacaagaaaaaatatgatcctctttcacgggttaatacgtttttgcatgtaaacaatagtgacacagatgcccgtctgggngttttnttatgcataagcggaacagggatactcaattcatggcttagacgaaatagtagtggtaaattgtcatataatgatatgaatgatatggctgcaaaagttgctccgggatctgatgggctttgcattttaccctttggcaacggtgccgaaaggatgcttgggaacaaagattcaggagcaaggattgaaggattgaactttaacactcataccaatgcacatatgttcagagcagctcaggagggaatagcattttcattcaggtatggactcgatattttaaaggaaacaggaattgatccnaaggtgatgagagccggtgaagcaaatatgttccttagtaaagttttcagggaaactttatcatcagttaccggaactacaattcatctttataatacagatggatcgataggagctgccagaggtgccggaatcggatgcggtttttacaagtcggaaaaagaagcatttaaaggacttgctgctgtaggtgtcactgaacctgacaaatcaaaatcaacagaatatgaaaaggcatatataaagtggaaggagttgctttcagagttgtaaaaaattgatttatctatgcggtttttacgcaaacttttcgaactttgcatttaatggctttaaatactaatcacatataaaaaattttcattatgatttacaaaggaaaaaaagaggtatatcccggnattggaaagattgaatatgagggtaaaaaatcgaaaaatccgttggctttcaggtggtataatcctgaagaggaagtgggcggaaaaaagatgaaagatcatcttcgttttgcagtcgcttactggcactcattctgtggtgatggttcagatccgttnggggatgctaccaggttctatccctggaaagatgctaaaaacgatgataaaacaaaacaaaggcttgatgctgcctttgagtttataacaaaaattggcgcaggttattattgttttcatgatactgatattgtaggngncggtactgtttttgaaatcgaaaaaagactggaaaaaattgttccggtgatgaaaaagatgcaggaacaaactggagttaaattactttggggtactgcaaatctcttttcaaatccaaggtatatgaatggcgctgcgacaaatcctgatttcactgttgttgctaatgcagctgttcagcttaagaatgctattgctgctactgttgcccttggtggtgagaattatgttttctggggaggccgtgaaggctatatgagccttcataataccgatatgaaaagggaacttgaacacatgggtacaatgttatccatggcacgtgactatggtagaaaaattggattcaangggacattccttgttgaaccaaaaccgatggagccatcaaaacatcaatacgattttgatgtagccaccataatcggattcttacgtcaacatggtctggataaagattttaaactgaatattgaagtcaatcatgccaccctngccggtcatactttccagcatgagctccaggttgctacagatgccggtcttcttggcagcattgatgccaacaaaggtgattatcagaacggttgggatacagatgagtttcctacaaatatctatgaggtcactgaagctatgatggttattcttcaggctggtggattttcaaccggaggtataaatttcgatgccaagataagacgtaattcaaccgatattgaagatattttcatagctcatgtaagcggcatggatacttttgccagggctcttgtaattgctgataaaattctgaaagatagcgactatcttaagatgagaaagaagagatatgaatcgttcgataaaggtgccggnaaagattttgaaaaaggtaaactaaccctggcaaaattgagagatattgcttctgaactnggagaacctgaaacaagaagcggtaagcaggagctctatgagcagctgataaatatgtatctggcataaaatattgtagggacgttacatgcaacgtccctanttatttatattggtgaagtaataacctcaaacacaggtggagaggccattgactttttaaccttgcataattcggctaccgagataacagcttctttatatttatccggaaaatccggaggcagtttgatatccagtttgatattgaccggcaatcctgtttcttcatcatactcggaactctgaattattttaatntnnnnngnangnnttttnnnnttannanaaaannntnntnnntntannnngntgnnnnnnnnnntnnnnnnnannannannnnnnnnnncnnannnncngnnnnnngnncnnnnnnangcnnnnnnnnatnnnnnnnnnnnannngnnnanntnnnnnnncngnnannnnnnngnnnnnnnnnnntnntnntnnnancatntnannntnnnnnnnnnnntnnnnntcnnnnannnnnnntnnnaacagcttccccggnaaaanatatttcagcatcnngnnnnntnnttncnnnnannntncnnnnnnanatnnntnncnnnntnnnnnnnantntnngntnnnnnnnngcnntnnnnnannnnnnncnngntnnnntncattnnnnnnnncnnnctnnnttntnnncannnnntncngnnntnnntcnnnnnnnnnnnnnntnnnnnnnnnnngnnnnagnnnnnnnnnnnngttnnnnnnnnnnntnntnnnnannnntnngngnnnganaantncnnnnnttnnnnnannnnnnnnnannnnnatcnnnngngntnnnnngnannnntntnnnnnnaanntnnctgnnnnnnannntgnntgnnncnntnannccntcnatnnnnnnnttnnnnnnanantannnnnnntnnnncnnnnntnnnnncnnnnnncnnnnnnnactnnnnttnnnnnntntaccnnnncnnngnnnnnnnnnnncannnnanncttgatattttctattggtgatgtttcgattggtccaccggtatgcataccggcat

SEQ ID NO: 853 - DNA, 4000 bp, Escherichia coli
  misc_feature (502)..(502): n is a, c, g, or t
  misc_feature (504)..(505): n is a, c, g, or t
  misc_feature (507)..(510): n is a, c, g, or t
  misc_feature (513)..(513): n is a, c, g, or t
  misc_feature (518)..(519): n is a, c, g, or t
  misc_feature (522)..(522): n is a, c, g, or t
  misc_feature (524)..(527): n is a, c, g, or t
  misc_feature (534)..(534): n is a, c, g, or t
  misc_feature (536)..(538): n is a, c, g, or t
  misc_feature (540)..(540): n is a, c, g, or t
  misc_feature (542)..(545): n is a, c, g, or t
  misc_feature (547)..(550): n is a, c, g, or t
  misc_feature (552)..(553): n is a, c, g, or t
  misc_feature (555)..(555): n is a, c, g, or t
  misc_feature (558)..(558): n is a, c, g, or t
  misc_feature (561)..(566): n is a, c, g, or t
  misc_feature (568)..(571): n is a, c, g, or t
  misc_feature (575)..(577): n is a, c, g, or t
  misc_feature (579)..(581): n is a, c, g, or t
  misc_feature (586)..(589): n is a, c, g, or t
  misc_feature (591)..(592): n is a, c, g, or t
  misc_feature (594)..(595): n is a, c, g, or t
  misc_feature (597)..(598): n is a, c, g, or t
  misc_feature (600)..(600): n is a, c, g, or t
  misc_feature (607)..(607): n is a, c, g, or t
  misc_feature (609)..(609): n is a, c, g, or t
  misc_feature (613)..(613): n is a, c, g, or t
  misc_feature (615)..(616): n is a, c, g, or t
  misc_feature (618)..(621): n is a, c, g, or t
  misc_feature (623)..(623): n is a, c, g, or t
  misc_feature (625)..(626): n is a, c, g, or t
  misc_feature (629)..(631): n is a, c, g, or t
  misc_feature (634)..(638): n is a, c, g, or t
  misc_feature (640)..(643): n is a, c, g, or t
  misc_feature (646)..(647): n is a, c, g, or t
  misc_feature (649)..(650): n is a, c, g, or t
  misc_feature (658)..(661): n is a, c, g, or t
  misc_feature (664)..(665): n is a, c, g, or t
  misc_feature (668)..(668): n is a, c, g, or t
  misc_feature (672)..(672): n is a, c, g, or t
  misc_feature (674)..(676): n is a, c, g, or t
  misc_feature (678)..(680): n is a, c, g, or t
  misc_feature (683)..(685): n is a, c, g, or t
  misc_feature (687)..(688): n is a, c, g, or t
  misc_feature (690)..(691): n is a, c, g, or t
  misc_feature (693)..(694): n is a, c, g, or t
  misc_feature (697)..(697): n is a, c, g, or t
  misc_feature (699)..(699): n is a, c, g, or t
  misc_feature (701)..(707): n is a, c, g, or t
  misc_feature (709)..(710): n is a, c, g, or t
  misc_feature (715)..(716): n is a, c, g, or t
  misc_feature (718)..(719): n is a, c, g, or t
  misc_feature (722)..(723): n is a, c, g, or t
  misc_feature (725)..(725): n is a, c, g, or t
  misc_feature (728)..(728): n is a, c, g, or t
  misc_feature (732)..(732): n is a, c, g, or t
  misc_feature (734)..(739): n is a, c, g, or t
  misc_feature (741)..(741): n is a, c, g, or t
  misc_feature (745)..(747): n is a, c, g, or t
  misc_feature (752)..(752): n is a, c, g, or t
  misc_feature (755)..(755): n is a, c, g, or t
  misc_feature (759)..(762): n is a, c, g, or t
  misc_feature (765)..(765): n is a, c, g, or t
  misc_feature (767)..(780): n is a, c, g, or t
  misc_feature (782)..(782): n is a, c, g, or t
  misc_feature (784)..(784): n is a, c, g, or t
  misc_feature (788)..(790): n is a, c, g, or t
  misc_feature (794)..(796): n is a, c, g, or t
  misc_feature (799)..(800): n is a, c, g, or t
  misc_feature (804)..(805): n is a, c, g, or t
  misc_feature (807)..(807): n is a, c, g, or t
  misc_feature (809)..(809): n is a, c, g, or t
  misc_feature (812)..(813): n is a, c, g, or t
  misc_feature (886)..(888): n is a, c, g, or t
  misc_feature (893)..(893): n is a, c, g, or t
  misc_feature (895)..(899): n is a, c, g, or t
  misc_feature (903)..(905): n is a, c, g, or t
  misc_feature (909)..(909): n is a, c, g, or t
  misc_feature (914)..(914): n is a, c, g, or t
  misc_feature (917)..(921): n is a, c, g, or t
  misc_feature (924)..(924): n is a, c, g, or t
  misc_feature (927)..(927): n is a, c, g, or t
  misc_feature (931)..(931): n is a, c, g, or t
  misc_feature (942)..(942): n is a, c, g, or t
  misc_feature (945)..(946): n is a, c, g, or t
  misc_feature (950)..(950): n is a, c, g, or t
  misc_feature (953)..(953): n is a, c, g, or t
  misc_feature (1975)..(1975): n is a, c, g, or t
  misc_feature (1992)..(1992): n is a, c, g, or t
tgggcagcgagtccagcatggcgcgcgtgctcaaggccgccgggcagcgcaagcgccgaggacgtgccaaggcacccagggcaacaaagccgcccaccacccacatcgccaccgcctcaggccaggtctggtgctgggacatgacctacctgcccgccagggtgatgggccgctggttccacctgaacctgatccttgccctgtacagccggaagatcgtgggtgccgaggtgcacgacagcgatgactccgaccacgccgtgcacctggtgcgccgcaccgcgctggctgagggcatcgcggcgatgacaccgaagcccgtgctgcatggcgacaacggctccacgagcaaggccaccacggtgttgaccatgctcaactggcagggcatcaagccctcctactcgcggcctcgtgtcagcgatgacaacgcgtttgcagagtcgttgttccgcacggccaaataccgccaggagttccaggcgcagggctttgagacacngnncnnnnccngcgcnnggncnnnngggttcntnnntngnnnnannnncnngnacngcnnnnnngnnnnccgnnntnnnagccnnnngnngnncnncncccccgncngatnanncnnnntngnnggnnnggnnnnngnnnnatnncnnggcccaannnngcnnccnggcncnnngnnnggnnncnncnngnnacngntnnnnnnncnncgggnngnnccnnantcnggancnnnnnnanatgnnnaaaanggntgcnnnngtncnnnnnnnnnnnnnnangnctgnnngacnnnggnnacanntncnttnncgcgcgccgggccgcgcctcaaggccgtgagttgttcgcgctgcgcatcgttgagcaccagttccgtcttggnnnttccncnnnnnaagnnncggnggccnccnnnnnggnggngtgngggttagtccnaannatgngangcaaattcaactgctatattagttgtgcgtaatttgtatcgcaatcgcgataaactgcttcgacagactcatattaaggacacggtatgcgaaaaagcttattgaatttccttgcatcagcggcgctcagcttcggccttgcaagccccgttgctgcgcaggatgccatcaagatcggtcagatcgaggcccagaccggcccgtctagcagtctgggtttcatggccacacagggtgcaaagcttgcagttcaccagatcaatcaagccggtggcgtggaggtcggtggcaagaagtacccgatcgacctagactcgcccgacacacagggcagtcctcagcagggcctgattcagcttaagaagatgctcgagcaggaccaccggaagtacatctttgggccgacgctctcgaacgtcttcaatggggtgcgtgagtacgctcgcggctacgatggcaaactgctgatgttcgcgccggccaccgctgcgcaccccgagctgggcaagcccggttacggctttctgctgcgcccagtcctcttcgacactgccccggagggtttcggcacctacatggtcgaaatgcttcgcagcaagggcgcgaagaaggtcgccatcctgatgcagaacgacgccttcggacggttcgcggtggacatctacaaggacagcttcgccaaggcagggatcgaaattcagacacattggttcgaggcaagcaccaaggactactcggctgtgttggcgcgcatcgccgcatggaagccagactacctcttccctggttacaccgacgccgcgctctacgacattgtgcagcaggctacccagctcgggctcaccaaattctggctggtgcgcggctcgctcggccccgccatccgcaacaaggcctcgatcgacgaatacatcgcctatatgcccaaatactttgaagaggccgagaaagtcgactctaaagtggcgaaattcatcaaggactacaaggacttcttcaaggtcaaggacttcccgtacganctggccccgcttctgtntatggcatcctatgaccacgtcttcatgcttgccgaggccatgaagcgcgcgggctcgatcaacgacgtggctgcgatcaagaaggaacttttgtcgatgacctacgacggtctatgggtgcagaaattcgaccccgtaggcggtggcatccacagctatgagattgcagagatgcggcgcggcggtgccctcaagatgactctcgtgaagccggccagcaaatgatgcaattgatcgcgggccagttgatcaacggaatcatcgtgggttccctctacggaatcatcgcgctggcggtatcgttgacgagcggaatcacgggcgtcgtaaacttcgcgctgggtgcattcatgttggtcggtgcctacctcacctggcacctcaacgaaacctacggcgtggccttcccgtttgccgtgatcttggttatgggtgtggtcgccttgatcggcctagtggccgatgtgctgctgttccgccatacgcgcaacaacctgatcaacggcttgatcgtctcgatcggtctggtctcagtgatcgtggcgctcgtgcacatgacgtggacatccaccccgcagaacatgcagcccttcgtcacgggcgtattcaccgtgggtggggtagtcgtgccgaagatgaagctactgatgggggtggtgctcatattgatcgtcagcatgacctacctgggactcacgcggacgtggatggggcgcgcggcctacgcctatgcgcaaaaccccgaggccgctgccttgatgggggtcgctaccggtcgcctccaggttggcgtggccgcctttggtgcggccttgtgcggactcgctgggtcgatgtacgccacgctttactcactgacccccgacattggcgcgctgtacatgctgaagggcgtcgaaggggcgctactggccggcatcggcagcgtgatcggggcgctgttcggcggcattctaatcggtgtggccgaaggcctgggttcggtgttcctgccgcttgcattcaacgacgcctatggcttgctgatgctggtactagtgctgcttttcaggccggccggtctgttcgggaggcgttgatgcgagtgcttctgcttgtgttgtgtggcgctgtcgcgctcgtcccagcgctcaccgcgaacaacgtcgtgctgtcggtgctcacgttcacgttcatcctgggcatccttgccgtcagcttcaaccttatctacggaatcactggccaactcacgctctttcacgcggcggccttcggtgtaggggcgtacgccacccacctctcgatggcccactggtccatctccttctggctgggatcggccttcgcgatgggctgcgtggccgtggtctcgctgctcctgggcatcgtgtgctttcgcttcaggctcaaggagttctacttcgcggtcgtgaccctggcgttcgcagaaatgatccgcctggtggtgatgaattggcacggcctgaccaatggctcgctaggaatcaacttcaacctcaagcccagcgtgggggtacccggagtcggagcgctggtcatcgaagggcctgtacgttggtactacttttcgctagcttgtgtcgtcgttatcgtgctggcatatcaactggtcgtgaactcatggataggcaacgcgttcaaggccatacgcctcaacgaggacgtggcagcctccctcggcctcaatgccttccgctacaagcttctgtcgttcgtgctgggcagcatgggggcctcgttcgccggcggtctgtactcgcactacatgggtttcgtcgacccgcacctgctcgacatcaaccagtcgctggccatcttgtcgatggcgctgatcggcggcacggggtcggtggccgcccccgtggtcggggcgttggtggtcactgcactgccgcacctgatcgacctcaatgccgagtggcgtctgttgatctatggcctcatcttaatcctcacaatcctgctcatgcctcaaggcatcgtcggatcactgcagaggcttcg

SEQ ID NO: 854 - DNA, 4000 bp, Escherichia coli
  misc_feature (4)..(5): n is a, c, g, or t
  misc_feature (7)..(8): n is a, c, g, or t
  misc_feature (10)..(10): n is a, c, g, or t
  misc_feature (13)..(14): n is a, c, g, or t
  misc_feature (16)..(16): n is a, c, g, or t
  misc_feature (23)..(25): n is a, c, g, or t
  misc_feature (27)..(28): n is a, c, g, or t
  misc_feature (34)..(34): n is a, c, g, or t
  misc_feature (37)..(38): n is a, c, g, or t
  misc_feature (41)..(41): n is a, c, g, or t
  misc_feature (44)..(44): n is a, c, g, or t
  misc_feature (46)..(48): n is a, c, g, or t
  misc_feature (54)..(54): n is a, c, g, or t
  misc_feature (56)..(56): n is a, c, g, or t
  misc_feature (58)..(58): n is a, c, g, or t
  misc_feature (61)..(65): n is a, c, g, or t
  misc_feature (68)..(69): n is a, c, g, or t
  misc_feature (71)..(71): n is a, c, g, or t
  misc_feature (73)..(73): n is a, c, g, or t
  misc_feature (75)..(75): n is a, c, g, or t
  misc_feature (78)..(79): n is a, c, g, or t
  misc_feature (81)..(83): n is a, c, g, or t
  misc_feature (85)..(85): n is a, c, g, or t
  misc_feature (88)..(89): n is a, c, g, or t
  misc_feature (92)..(93): n is a, c, g, or t
  misc_feature (95)..(96): n is a, c, g, or t
  misc_feature (100)..(101): n is a, c, g, or t
  misc_feature (106)..(106): n is a, c, g, or t
  misc_feature (108)..(108): n is a, c, g, or t
  misc_feature (110)..(110): n is a, c, g, or t
  misc_feature (115)..(115): n is a, c, g, or t
  misc_feature (118)..(118): n is a, c, g, or t
  misc_feature (120)..(122): n is a, c, g, or t
  misc_feature (125)..(125): n is a, c, g, or t
  misc_feature (129)..(129): n is a, c, g, or t
  misc_feature (131)..(131): n is a, c, g, or t
  misc_feature (133)..(134): n is a, c, g, or t
  misc_feature (137)..(138): n is a, c, g, or t
  misc_feature (140)..(145): n is a, c, g, or t
  misc_feature (149)..(150): n is a, c, g, or t
  misc_feature (153)..(158): n is a, c, g, or t
  misc_feature (160)..(161): n is a, c, g, or t
  misc_feature (163)..(167): n is a, c, g, or t
  misc_feature (170)..(174): n is a, c, g, or t
  misc_feature (176)..(177): n is a, c, g, or t
  misc_feature (179)..(183): n is a, c, g, or t
  misc_feature (185)..(185): n is a, c, g, or t
  misc_feature (188)..(188): n is a, c, g, or t
  misc_feature (190)..(194): n is a, c, g, or t
  misc_feature (198)..(198): n is a, c, g, or t
  misc_feature (200)..(201): n is a, c, g, or t
  misc_feature (203)..(203): n is a, c, g, or t
  misc_feature (205)..(207): n is a, c, g, or t
  misc_feature (210)..(211): n is a, c, g, or t
  misc_feature (213)..(213): n is a, c, g, or t
  misc_feature (215)..(215): n is a, c, g, or t
  misc_feature (217)..(219): n is a, c, g, or t
  misc_feature (222)..(224): n is a, c, g, or t
  misc_feature (227)..(227): n is a, c, g, or t
  misc_feature (230)..(233): n is a, c, g, or t
  misc_feature (235)..(236): n is a, c, g, or t
  misc_feature (238)..(245): n is a, c, g, or t
  misc_feature (247)..(247): n is a, c, g, or t
  misc_feature (249)..(252): n is a, c, g, or t
  misc_feature (256)..(256): n is a, c, g, or t
  misc_feature (258)..(259): n is a, c, g, or t
  misc_feature (261)..(261): n is a, c, g, or t
  misc_feature (263)..(263): n is a, c, g, or t
  misc_feature (265)..(265): n is a, c, g, or t
  misc_feature (268)..(271): n is a, c, g, or t
  misc_feature (275)..(275): n is a, c, g, or t
  misc_feature (277)..(278): n is a, c, g, or t
  misc_feature (282)..(284): n is a, c, g, or t
  misc_feature (287)..(294): n is a, c, g, or t
  misc_feature (296)..(297): n is a, c, g, or t
  misc_feature (299)..(304): n is a, c, g, or t
  misc_feature (306)..(312): n is a, c, g, or t
  misc_feature (314)..(314): n is a, c, g, or t
  misc_feature (316)..(320): n is a, c, g, or t
  misc_feature (322)..(325): n is a, c, g, or t
  misc_feature (327)..(329): n is a, c, g, or t
  misc_feature (331)..(332): n is a, c, g, or t
  misc_feature (334)..(334): n is a, c, g, or t
  misc_feature (336)..(336): n is a, c, g, or t
  misc_feature (339)..(349): n is a, c, g, or t
  misc_feature (351)..(352): n is a, c, g, or t
  misc_feature (354)..(354): n is a, c, g, or t
  misc_feature (356)..(363): n is a, c, g, or t
  misc_feature (366)..(368): n is a, c, g, or t
  misc_feature (370)..(371): n is a, c, g, or t
  misc_feature (375)..(375): n is a, c, g, or t
  misc_feature (377)..(379): n is a, c, g, or t
  misc_feature (381)..(381): n is a, c, g, or t
  misc_feature (385)..(385): n is a, c, g, or t
  misc_feature (388)..(389): n is a, c, g, or t
  misc_feature (391)..(391): n is a, c, g, or t
  misc_feature (393)..(396): n is a, c, g, or t
  misc_feature (398)..(400): n is a, c, g, or t
  misc_feature (402)..(403): n is a, c, g, or t
  misc_feature (405)..(405): n is a, c, g, or t
  misc_feature (408)..(408): n is a, c, g, or t
  misc_feature (410)..(410): n is a, c, g, or t
  misc_feature (412)..(413): n is a, c, g, or t
  misc_feature (418)..(419): n is a, c, g, or t
  misc_feature (423)..(425): n is a, c, g, or t
  misc_feature (427)..(427): n is a, c, g, or t
  misc_feature (431)..(431): n is a, c, g, or t
  misc_feature (433)..(435): n is a, c, g, or t
  misc_feature (437)..(437): n is a, c, g, or t
  misc_feature (439)..(442): n is a, c, g, or t
  misc_feature (444)..(446): n is a, c, g, or t
  misc_feature (448)..(455): n is a, c, g, or t
  misc_feature (457)..(457): n is a, c, g, or t
  misc_feature (459)..(459): n is a, c, g, or t
  misc_feature (462)..(462): n is a, c, g, or t
  misc_feature (464)..(464): n is a, c, g, or t
  misc_feature (466)..(466): n is a, c, g, or t
  misc_feature (468)..(468): n is a, c, g, or t
  misc_feature (471)..(472): n is a, c, g, or t
  misc_feature (474)..(482): n is a, c, g, or t
  misc_feature (485)..(485): n is a, c, g, or t
  misc_feature (488)..(488): n is a, c, g, or t
  misc_feature (490)..(492): n is a, c, g, or t
  misc_feature (495)..(500): n is a, c, g, or t
  misc_feature (502)..(503): n is a, c, g, or t
  misc_feature (506)..(511): n is a, c, g, or t
  misc_feature (513)..(518): n is a, c, g, or t
  misc_feature (520)..(525): n is a, c, g, or t
  misc_feature (527)..(527): n is a, c, g, or t
  misc_feature (529)..(530): n is a, c, g, or t
  misc_feature (532)..(532): n is a, c, g, or t
  misc_feature (534)..(535): n is a, c, g, or t
  misc_feature (537)..(541): n is a, c, g, or t
  misc_feature (543)..(543): n is a, c, g, or t
  misc_feature (545)..(552): n is a, c, g, or t
  misc_feature (556)..(560): n is a, c, g, or t
  misc_feature (563)..(564): n is a, c, g, or t
  misc_feature (567)..(568): n is a, c, g, or t
  misc_feature (570)..(571): n is a, c, g, or t
  misc_feature (575)..(578): n is a, c, g, or t
  misc_feature (580)..(581): n is a, c, g, or t
  misc_feature (583)..(587): n is a, c, g, or t
  misc_feature (589)..(593): n is a, c, g, or t
  misc_feature (597)..(597): n is a, c, g, or t
  misc_feature (599)..(602): n is a, c, g, or t
  misc_feature (604)..(604): n is a, c, g, or t
  misc_feature (606)..(606): n is a, c, g, or t
  misc_feature (611)..(613): n is a, c, g, or t
  misc_feature (615)..(616): n is a, c, g, or t
  misc_feature (618)..(620): n is a, c, g, or t
  misc_feature (622)..(622): n is a, c, g, or t
  misc_feature (625)..(630): n is a, c, g, or t
  misc_feature (633)..(633): n is a, c, g, or t
  misc_feature (638)..(641): n is a, c, g, or t
  misc_feature (643)..(644): n is a, c, g, or t
  misc_feature (646)..(652): n is a, c, g, or t
  misc_feature (654)..(655): n is a, c, g, or t
  misc_feature (657)..(657): n is a, c, g, or t
  misc_feature (659)..(666): n is a, c, g, or t
  misc_feature (668)..(672): n is a, c, g, or t
  misc_feature (675)..(676): n is a, c, g, or t
  misc_feature (679)..(689): n is a, c, g, or t
  misc_feature (691)..(691): n is a, c, g, or t
  misc_feature (694)..(698): n is a, c, g, or t
  misc_feature (701)..(702): n is a, c, g, or t
  misc_feature (704)..(704): n is a, c, g, or t
  misc_feature (707)..(708): n is a, c, g, or t
  misc_feature (710)..(711): n is a, c, g, or t
  misc_feature (713)..(714): n is a, c, g, or t
  misc_feature (716)..(718): n is a, c, g, or t
  misc_feature (720)..(723): n is a, c, g, or t
  misc_feature (728)..(729): n is a, c, g, or t
  misc_feature (734)..(739): n is a, c, g, or t
  misc_feature (741)..(747): n is a, c, g, or t
  misc_feature (749)..(755): n is a, c, g, or t
  misc_feature (757)..(767): n is a, c, g, or t
  misc_feature (769)..(771): n is a, c, g, or t
  misc_feature (775)..(778): n is a, c, g, or t
  misc_feature (780)..(780): n is a, c, g, or t
  misc_feature (782)..(782): n is a, c, g, or t
  misc_feature (784)..(786): n is a, c, g, or t
  misc_feature (788)..(790): n is a, c, g, or t
  misc_feature (792)..(794): n is a, c, g, or t
  misc_feature (796)..(798): n is a, c, g, or t
  misc_feature (800)..(801): n is a, c, g, or t
  misc_feature (803)..(804): n is a, c, g, or t
  misc_feature (806)..(809): n is a, c, g, or t
  misc_feature (812)..(816): n is a, c, g, or t
  misc_feature (818)..(819): n is a, c, g, or t
  misc_feature (821)..(824): n is a, c, g, or t
  misc_feature (826)..(827): n is a, c, g, or t
  misc_feature (829)..(830): n is a, c, g, or t
  misc_feature (832)..(837): n is a, c, g, or t
  misc_feature (839)..(839): n is a, c, g, or t
  misc_feature (841)..(842): n is a, c, g, or t
  misc_feature (850)..(850): n is a, c, g, or t
  misc_feature (858)..(858): n is a, c, g, or t
  misc_feature (861)..(861): n is a, c, g, or t
  misc_feature (863)..(864): n is a, c, g, or t
  misc_feature (869)..(869): n is a, c, g, or t
  misc_feature (873)..(873): n is a, c, g, or t
  misc_feature (883)..(883): n is a, c, g, or t
  misc_feature (885)..(885): n is a, c, g, or t
  misc_feature (892)..(893): n is a, c, g, or t
  misc_feature (909)..(910): n is a, c, g, or t
  misc_feature (925)..(928): n is a, c, g, or t
  misc_feature (939)..(939): n is a, c, g, or t
  misc_feature (1044)..(1044): n is a, c, g, or t
  misc_feature (1108)..(1108): n is a, c, g, or t
  misc_feature (1120)..(1120): n is a, c, g, or t
  misc_feature (1123)..(1123): n is a, c, g, or t
  misc_feature (1624)..(1624): n is a, c, g, or t
tagnnanncngcnngngaaaatnnnannaaaaanatnncanaantnnnaacaanantngannnnnaannanangnaannannnanacnncanngnnaaanncaaantnanagccnaanannnaanctcngnannaannannnnnngaanntgnnnnnnannannnnnatnnnnnannannnnnancangnnnnnaagnanngnannnaannanangnnnaannncanagnnnnannannnnnnnncngnnnnaaancnnanangnagnnnnaaancnnagcnnnaannnnnnnnannannnnnnannnnnnncnannnnnannnncnnnanntnanagnnnnnnnnnnnannanannnnnnnngtnnngnnaagnannngnatcnaanntngnnnncnnngnnangtntngnnctaanngtgnnncnaagngnnngntnnnnannnannnnnnnngnangcnanananaannannnnnnnnnttngtntnnnaannnnnntnnttnnnnnngnnnnnntnnnnnntntnntngnngnnnnngnannnnnnnnaggnnnnnttnnagnngnnggannnngnnannnnncnnnnntagnannnngngnatgtnnncnngnnncngtnnnnnntantggannnngnnannnnnnngnntnannnnnnnntnnnnntcnnctnnnnnnnnnnncnggnnnnncanntncannanncnntnnngnnnntgganntgtcnnnnnngnnnnnnnannnnnnngnnnnnnnnnnncnnnaaannnngnancnnnannncnnnannntnntnngnnnnagnnnnnannannnnanngnnannnnnntncnngaaaaccngcagaganaanannaacancttnatcttgtaananttgtggnnccagactaaagccaanngcaaagttttgtggnnnntgtggcacccnacgttcgtaatcactattatagagaaaagccaaatcgtaattattggaattaacagaggacgaagaggaatctctaaacggagaacatggcgaagcgctgcaaanagcatacaggatattgtcagctaccggtgaggcaaccgacgctgaaaaacttgtaccgattcantgggcgcatgtntcnggcgtaaactataacacgataggagatgccggcgaggaatttttagcaactctaagcaagaatgcaaagttcaaggtaagaaccacagtaaacccgatgggctatgacagggatagcgtagaaaagtttggtcttgatgaaaattttatacaaaagcaggaaagcattaaaaaatcatacaaaaagatgggagtcactccatcgttctcctgcattccttatgagatctatgatatgccacaggaaggcacacaagtagcctttgcggaaaccaacgcggcaatatatgcaaactcgattggaaagctaaagacaaacaaggaaagtgcgttttctgctctggcaagcgcaattactggcaaaagtccatactctgacctccgaaaggatgactccccaaccatgtcaattgcaatgaaggtttcagatccaaacgagctgacatttggactgttgggatattttgctggaaaggtggcggacaagtctgttgcaatttcnggcgtaaagaatttggataaaagatgtaacaagtcattgtgtgccagcatgggaacttctggaacctgtggcaagtttgttttggatgataattcaagcgcatccgaaaaggtagactttgatgaaaaggagatgcagaaagtttacgacgagctaaacaccgcagagtcgggtgacctgattacacttggcagcccacagcttggactggaggagatgagtggcctagcttcaatgctaaagggaagggcattcaagaaaagatgtctgatattttgcccaagggcaattcaggaacaggcaagacatctaggatatgcaggccaacttgaaagtgctgggtgtgaattgatgtcagattgttgtacatgtctaaccccattggttaccaaaaaggatgcagacagcgttaccacaaacagcatcaagggtgcatactatctgaaaaactcaaacggtttggatgtcaacctaaagccactatcagaaatagtgagggatgagacaagttgactctgaaaactattgtaaaaggaaaagtcactggcaaggttctcaagtccagccaaccaatcaactttctgggttctgttgataaaaaaacaggagcaattactgaccaaaaacatgatctgtttggaaaaaagattgcaggctccatcctagtttttccaaatgggataggcagcagcgttggcgcatacaccatctattcgctaaaatcaaataactctgctcctgccgcaatggcttgccaaaaagcggaccttacagttgcctctggatgtgcacttgcaaacattcctttgtttattttgtcgcctgacgaatatgacagtatgaaagacggggatgagatatcgcttggataagagtgtcaggaagaaaaaaagatacaaagatccttacaaaaaaagataccgagaaaatttaggttcctgaaccagattctgttatgttacatgcgcctgtaggcaaaactcgtacaaaatcatcaatactaaatggctttgcaatctcctcattgcttgacaaaaattcgtaacgaattctttttgcaacatcaggcatatcttgtcctgtaggttctatcatggcgtagcaaactgctgtatttttcaggcttggtggaccacaagtaagcaaataactttcttcatgcttgattatagcaacacacatcttcaaacttgatatttttacaaagttgcgctgtccttcaatcataaaagagcccttggccatagactgtccgctgggagcaccttttttgacctggtctgggttaacccagtaagcgcttgaaccatagaacgcttccttccatactttgctaaagcacactgtggcatgagcaacttcagtaaggcttgcaggcgtggatgtaacattatcctttaacagaaaaaatggtgaaccggaaatttcagcatggaaaactttgtcatttttctgaagatgctttcggataatagcagagtttgacgaagagtcacgtcctcctattgccaagacaccatctatcgtgtaaaaccatcgataccgttcaaaccagtttttctttctaacctgtgtaaaaccaacaggctttgcactctcacctttctcaatcactttttctaaatcctttttagttttttttagtaatttttcaatggagccaatggcagctttttgcttttttgattcgttgaataatgcggaagcagttgtgggaagagacgagttcaaatccaccttgattttttcatcctcaactttgagatatgttattcctttttcttttacaatctctgagttgttcttttttagcaaggcagtaattttagaatcatccattgatgaaattccttgagaaagtccttcaaaaagtgagtttgctactgcagcaattttttccgatttttcagttactatcttaattgcctttgtttgctcatgaactcttgtttccaattctgaaatttttttggtaaacgaggagctctgaattgtttttcctttgctaagaatattttcggtgaaaactgtatcaagaccatccataaagctagcaattttttcatggttttctccttctaaggaaattggattaacatacatctcatcatttcgaacaatttcaggatcatgttgaccatttacaacattgttaataatttgtgtggcggagtcaaataatcgctttacctcctcattcgacgtttcttctcctttcttttttgattctacttttgctaatcttgttatttcctcaatatactttctgggcaatcccaaggtttttcctatccattttgccacagggatggattcagaacgaatagcctcaaaacctttctcagtcatattcaaaacatccaagttgtcttgcgg

SEQ ID NO: 855 - DNA, 4000 bp, Escherichia coli
  misc_feature (1)..(1): n is a, c, g, or t
  misc_feature (3)..(3): n is a, c, g, or t
  misc_feature (6)..(6): n is a, c, g, or t
  misc_feature (8)..(8): n is a, c, g, or t
  misc_feature (10)..(13): n is a, c, g, or t
  misc_feature (15)..(17): n is a, c, g, or t
  misc_feature (19)..(19): n is a, c, g, or t
  misc_feature (21)..(27): n is a, c, g, or t
  misc_feature (29)..(29): n is a, c, g, or t
  misc_feature (32)..(37): n is a, c, g, or t
  misc_feature (40)..(43): n is a, c, g, or t
  misc_feature (46)..(47): n is a, c, g, or t
  misc_feature (49)..(50): n is a, c, g, or t
  misc_feature (52)..(52): n is a, c, g, or t
  misc_feature (56)..(58): n is a, c, g, or t
  misc_feature (61)..(61): n is a, c, g, or t
  misc_feature (63)..(63): n is a, c, g, or t
  misc_feature (65)..(66): n is a, c, g, or t
  misc_feature (68)..(76): n is a, c, g, or t
  misc_feature (78)..(89): n is a, c, g, or t
  misc_feature (91)..(97): n is a, c, g, or t
  misc_feature (99)..(102): n is a, c, g, or t
  misc_feature (108)..(112): n is a, c, g, or t
  misc_feature (115)..(116): n is a, c, g, or t
  misc_feature (119)..(119): n is a, c, g, or t
  misc_feature (122)..(122): n is a, c, g, or t
  misc_feature (124)..(127): n is a, c, g, or t
  misc_feature (130)..(134): n is a, c, g, or t
  misc_feature (136)..(142): n is a, c, g, or t
  misc_feature (144)..(144): n is a, c, g, or t
  misc_feature (147)..(148): n is a, c, g, or t
  misc_feature (150)..(151): n is a, c, g, or t
  misc_feature (153)..(156): n is a, c, g, or t
  misc_feature (158)..(159): n is a, c, g, or t
  misc_feature (162)..(162): n is a, c, g, or t
  misc_feature (165)..(173): n is a, c, g, or t
  misc_feature (175)..(176): n is a, c, g, or t
  misc_feature (178)..(181): n is a, c, g, or t
  misc_feature (183)..(183): n is a, c, g, or t
  misc_feature (187)..(187): n is a, c, g, or t
  misc_feature (190)..(190): n is a, c, g, or t
  misc_feature (192)..(192): n is a, c, g, or t
  misc_feature (194)..(194): n is a, c, g, or t
  misc_feature (197)..(201): n is a, c, g, or t
  misc_feature (203)..(206): n is a, c, g, or t
  misc_feature (208)..(212): n is a, c, g, or t
  misc_feature (215)..(222): n is a, c, g, or t
  misc_feature (224)..(228): n is a, c, g, or t
  misc_feature (230)..(232): n is a, c, g, or t
  misc_feature (234)..(240): n is a, c, g, or t
  misc_feature (242)..(242): n is a, c, g, or t
  misc_feature (244)..(244): n is a, c, g, or t
  misc_feature (246)..(248): n is a, c, g, or t
  misc_feature (250)..(257): n is a, c, g, or t
  misc_feature (259)..(267): n is a, c, g, or t
  misc_feature (269)..(269): n is a, c, g, or t
  misc_feature (271)..(271): n is a, c, g, or t
  misc_feature (273)..(275): n is a, c, g, or t
  misc_feature (279)..(280): n is a, c, g, or t
  misc_feature (282)..(293): n is a, c, g, or t
  misc_feature (295)..(296): n is a, c, g, or t
  misc_feature (298)..(304): n is a, c, g, or t
  misc_feature (307)..(318): n is a, c, g, or t
  misc_feature (320)..(322): n is a, c, g, or t
  misc_feature (324)..(330): n is a, c, g, or t
  misc_feature (333)..(333): n is a, c, g, or t
  misc_feature (335)..(342): n is a, c, g, or t
  misc_feature (346)..(348): n is a, c, g, or t
  misc_feature (350)..(353): n is a, c, g, or t
  misc_feature (355)..(362): n is a, c, g, or t
  misc_feature (365)..(365): n is a, c, g, or t
  misc_feature (367)..(367): n is a, c, g, or t
  misc_feature (369)..(374): n is a, c, g, or t
  misc_feature (376)..(382): n is a, c, g, or t
  misc_feature (385)..(404): n is a, c, g, or t
  misc_feature (406)..(413): n is a, c, g, or t
  misc_feature (416)..(416): n is a, c, g, or t
  misc_feature (418)..(421): n is a, c, g, or t
  misc_feature (423)..(428): n is a, c, g, or t
  misc_feature (430)..(430): n is a, c, g, or t
  misc_feature (433)..(433): n is a, c, g, or t
  misc_feature (435)..(435): n is a, c, g, or t
  misc_feature (437)..(438): n is a, c, g, or t
  misc_feature (440)..(440): n is a, c, g, or t
  misc_feature (443)..(447): n is a, c, g, or t
  misc_feature (449)..(449): n is a, c, g, or t
  misc_feature (451)..(451): n is a, c, g, or t
  misc_feature (453)..(463): n is a, c, g, or t
  misc_feature (465)..(465): n is a, c, g, or t
  misc_feature (468)..(470): n is a, c, g, or t
  misc_feature (474)..(475): n is a, c, g, or t
  misc_feature (477)..(478): n is a, c, g, or t
  misc_feature (480)..(480): n is a, c, g, or t
  misc_feature (482)..(484): n is a, c, g, or t
  misc_feature (486)..(507): n is a, c, g, or t
  misc_feature (509)..(514): n is a, c, g, or t
  misc_feature (516)..(516): n is a, c, g, or t
  misc_feature (520)..(522): n is a, c, g, or t
  misc_feature (524)..(535): n is a, c, g, or t
  misc_feature (538)..(539): n is a, c, g, or t
  misc_feature (541)..(541): n is a, c, g, or t
  misc_feature (543)..(548): n is a, c, g, or t
  misc_feature (550)..(557): n is a, c, g, or t
  misc_feature (559)..(563): n is a, c, g, or t
  misc_feature (565)..(566): n is a, c, g, or t
  misc_feature (568)..(575): n is a, c, g, or t
  misc_feature (580)..(581): n is a, c, g, or t
  misc_feature (584)..(589): n is a, c, g, or t
  misc_feature (591)..(594): n is a, c, g, or t
  misc_feature (597)..(597): n is a, c, g, or t
  misc_feature (599)..(604): n is a, c, g, or t
  misc_feature (606)..(606): n is a, c, g, or t
  misc_feature (608)..(612): n is a, c, g, or t
  misc_feature (614)..(617): n is a, c, g, or t
  misc_feature (619)..(620): n is a, c, g, or t
  misc_feature (622)..(633): n is a, c, g, or t
  misc_feature (635)..(636): n is a, c, g, or t
  misc_feature (638)..(640): n is a, c, g, or t
  misc_feature (643)..(645): n is a, c, g, or t
  misc_feature (648)..(649): n is a, c, g, or t
  misc_feature (651)..(651): n is a, c, g, or t
  misc_feature (653)..(663): n is a, c, g, or t
  misc_feature (666)..(673): n is a, c, g, or t
  misc_feature (675)..(679): n is a, c, g, or t
  misc_feature (681)..(683): n is a, c, g, or t
  misc_feature (686)..(691): n is a, c, g, or t
  misc_feature (693)..(701): n is a, c, g, or t
  misc_feature (703)..(703): n is a, c, g, or t
  misc_feature (709)..(710): n is a, c, g, or t
  misc_feature (712)..(715): n is a, c, g, or t
  misc_feature (717)..(717): n is a, c, g, or t
  misc_feature (720)..(721): n is a, c, g, or t
  misc_feature (723)..(725): n is a, c, g, or t
  misc_feature (727)..(736): n is a, c, g, or t
  misc_feature (739)..(739): n is a, c, g, or t
  misc_feature (741)..(741): n is a, c, g, or t
  misc_feature (743)..(745): n is a, c, g, or t
  misc_feature (747)..(759): n is a, c, g, or t
  misc_feature (761)..(761): n is a, c, g, or t
  misc_feature (763)..(766): n is a, c, g, or t
  misc_feature (768)..(769): n is a, c, g, or t
  misc_feature (771)..(773): n is a, c, g, or t
  misc_feature (775)..(775): n is a, c, g, or t
  misc_feature (777)..(784): n is a, c, g, or t
  misc_feature (787)..(789): n is a, c, g, or t
  misc_feature (791)..(797): n is a, c, g, or t
  misc_feature (799)..(803): n is a, c, g, or t
  misc_feature (805)..(807): n is a, c, g, or t
  misc_feature (810)..(810): n is a, c, g, or t
  misc_feature (813)..(816): n is a, c, g, or t
  misc_feature (818)..(825): n is a, c, g, or t
  misc_feature (827)..(828): n is a, c, g, or t
  misc_feature (830)..(835): n is a, c, g, or t
  misc_feature (837)..(837): n is a, c, g, or t
  misc_feature (839)..(840): n is a, c, g, or t
  misc_feature (842)..(842): n is a, c, g, or t
  misc_feature (870)..(870): n is a, c, g, or t
  misc_feature (874)..(874): n is a, c, g, or t
  misc_feature (877)..(877): n is a, c, g, or t
  misc_feature (880)..(880): n is a, c, g, or t
  misc_feature (891)..(891): n is a, c, g, or t
  misc_feature (893)..(895): n is a, c, g, or t
  misc_feature (898)..(898): n is a, c, g, or t
  misc_feature (909)..(910): n is a, c, g, or t
  misc_feature (917)..(917): n is a, c, g, or t
  misc_feature (928)..(928): n is a, c, g, or t
  misc_feature (932)..(932): n is a, c, g, or t
  misc_feature (936)..(936): n is a, c, g, or t
  misc_feature (940)..(940): n is a, c, g, or t
  misc_feature (971)..(972): n is a, c, g, or t
  misc_feature (975)..(975): n is a, c, g, or t
  misc_feature (982)..(983): n is a, c, g, or t
  misc_feature (985)..(985): n is a, c, g, or t
  misc_feature (987)..(988): n is a, c, g, or t
  misc_feature (990)..(991): n is a, c, g, or t
  misc_feature (996)..(996): n is a, c, g, or t
  misc_feature (999)..(1000): n is a, c, g, or t
  misc_feature (1014)..(1014): n is a, c, g, or t
  misc_feature (1019)..(1021): n is a, c, g, or t
  misc_feature (1027)..(1030): n is a, c, g, or t
  misc_feature (1041)..(1041): n is a, c, g, or t
  misc_feature (1043)..(1046): n is a, c, g, or t
  misc_feature (1051)..(1051): n is a, c, g, or t
  misc_feature (1053)..(1055): n is a, c, g, or t
  misc_feature (1057)..(1057): n is a, c, g, or t
  misc_feature (1066)..(1066): n is a, c, g, or t
  misc_feature (1071)..(1071): n is a, c, g, or t
  misc_feature (1076)..(1076): n is a, c, g, or t
  misc_feature (1079)..(1085): n is a, c, g, or t
  misc_feature (1093)..(1094): n is a, c, g, or t
  misc_feature (1097)..(1097): n is a, c, g, or t
  misc_feature (1100)..(1100): n is a, c, g, or t
  misc_feature (1102)..(1102): n is a, c, g, or t
  misc_feature (1104)..(1104): n is a, c, g, or t
  misc_feature (1106)..(1106): n is a, c, g, or t
  misc_feature (1109)..(1109): n is a, c, g, or t
  misc_feature (1114)..(1114): n is a, c, g, or t
  misc_feature (1119)..(1119): n is a, c, g, or t
  misc_feature (1126)..(1127): n is a, c, g, or t
  misc_feature (1131)..(1131): n is a, c, g, or t
  misc_feature (1156)..(1156): n is a, c, g, or t
  misc_feature (1160)..(1160): n is a, c, g, or t
  misc_feature (1165)..(1165): n is a, c, g, or t
  misc_feature (1175)..(1175): n is a, c, g, or t
  misc_feature (1203)..(1203): n is a, c, g, or t
  misc_feature (1210)..(1210): n is a, c, g, or t
  misc_feature (1215)..(1215): n is a, c, g, or t
  misc_feature (1217)..(1217): n is a, c, g, or t
  misc_feature (1244)..(1244): n is a, c, g, or t
  misc_feature (1248)..(1248): n is a, c, g, or t
  misc_feature (1251)..(1252): n is a, c, g, or t
  misc_feature (1255)..(1255): n is a, c, g, or t
  misc_feature (1263)..(1263): n is a, c, g, or t
  misc_feature (1272)..(1272): n is a, c, g, or t
  misc_feature (1275)..(1275): n is a, c, g, or t
  misc_feature (1294)..(1298): n is a, c, g, or t
  misc_feature (1302)..(1302): n is a, c, g, or t
  misc_feature (1304)..(1305): n is a, c, g, or t
  misc_feature (1353)..(1353): n is a, c, g, or t
  misc_feature (1355)..(1355): n is a, c, g, or t
  misc_feature (1377)..(1377): n is a, c, g, or t
  misc_feature (1379)..(1379): n is a, c, g, or t
  misc_feature (1990)..(1990): n is a, c, g, or t
  misc_feature (2062)..(2062): n is a, c, g, or t
  misc_feature (2323)..(2323): n is a, c, g, or t
  misc_feature (2362)..(2362): n is a, c, g, or t
  misc_feature (2404)..(2404): n is a, c, g, or t
  misc_feature (2407)..(2407): n is a, c, g, or t
  misc_feature (2527)..(2527): n is a, c, g, or t
  misc_feature (2530)..(2530): n is a, c, g, or t
  misc_feature (2545)..(2545): n is a, c, g, or t
  misc_feature (2566)..(2566): n is a, c, g, or t
  misc_feature (2608)..(2608): n is a, c, g, or t
  misc_feature (2626)..(2626): n is a, c, g, or t
  misc_feature (2638)..(2638): n is a, c, g, or t
  misc_feature (2737)..(2737): n is a, c, g, or t
  misc_feature (3398)..(3398): n is a, c, g, or t
  misc_feature (3789)..(3789): n is a, c, g, or t
  misc_feature (3798)..(3799): n is a, c, g, or t
  misc_feature (3801)..(3801): n is a, c, g, or t
  misc_feature (3903)..(3903): n is a, c, g, or t
  misc_feature (3918)..(3918): n is a, c, g, or t
nanagngngnnnnannncncnnnnnnngngannnnnngcnnnnaanntnncngggnnnaananannannnnnnnnntnnnnnnnnnnnnannnnnnngnnnnaggagnnnnntcnnagngcngnnnngcnnnnncnnnnnnncntgnngnncnnnnannagngannnnnnnnntnngnnnngngaangangngngannnnncnnnncnnnnnatnnnnnnnntnnnnngnnnannnnnnntncncnnngnnnnnnnngnnnnnnnnngngngnnngatnngnnnnnnnnnnnnannannnnnnnatnnnnnnnnnnnncnnnannnnnnntgngnnnnnnnnggannnannnngnnnnnnnnagngnannnnnngnnnnnnncgnnnnnnnnnnnnnnnnnnnnannnnnnnnatncnnnncnnnnnngnganangnngngannnnnangnannnnnnnnnnngnagnnnctgnngnnanannncnnnnnnnnnnnnnnnnnnnnnntnnnnnnanccgnnncnnnnnnnnnnnnagnnantnnnnnngnnnnnnnnannnnnanngnnnnnnnnctcgnnaannnnnncnnnnaantnnnnnngnannnnngnnnnanngnnnnnnnnnnnnannannngcnnnagnnantnnnnnnnnnnnacnnnnnnnnannnnnannngtnnnnnnannnnnnnnngntgacgnntnnnngntgnngnnngnnnnnnnnnngangntnnngnnnnnnnnnnnnngnannnnanncnnngnannnnnnnnccnnnannnnnnngnnnnnannntancgnnnntnnnnnnnngnnannnnnngncnngnaagttccgacccgcacgaaaggcgtaangatntgngcnctgtctcaacnannnacncggtgaaattnnagtaccngtgaagatgcnggtnaccngcgncaggacggaaagaccccatggagctttactnnagnttgatanngngnntnngtgtnacnngtacaggataggtnggagnnnaagaannnnggacgccagtntnnnnggagncnnngntgggatacnacccntgtgncannnnnnntctaaccnncanccntnancnggntgggngacantgtcagnngggnagtttgactggggcggtcgcctccnaaantgtancggaggcgcncaaaggttccctcagaatggttggaaancattcgnagagngnaaaggcagaagggagcttgactgcganaccnacnngtngagcaggnacgaaagtnggncttagtgatccggtggtannnnntggnanngccatcgctcaacggataaaagctaccctggggataacaggcttatcncncccaagagttcacatcgacggngnggtttggcacctcgatgtcggctcatcgcatcctggggctgaagtcggtcccaagggttgggctgttcgcccattaaagcggtacgcgagctgggttcagaacgtcgtgagacagttcggtccctatccgtcgcgggcgttggaaatttgagaggagctgtccttagtacgagaggaccgggatggacacaccgctggtgtaccagttgttctgccaagagcatcgctgggtagctatgtgtggacgggataaacgctgaaagcatctaagcgtgaagcccccctcgagatgagatttcccatcattttaaatgagtaagacccctgagagacgatcaggtagataggctagaagtggaagtgccgcgaggcatggagcggactagtactaatcggtcgaggacttaaccacgagttgtatagctggtagattgatggagttggatatagattcagttttgaaagaacgaaagttttttcagaagataaagtgtggtgacgatggcaagaaggatacacctgttcccatctcgaacacagaagttaagcttcttagcgccgatagtagttgggggtttctccctgcgagggtaggacgttgccacgcaaantgtgtaagctgggcctagtgcccagcttattttgtagctatttttctaatattttattttaagagaattttngaaggaagtttgctataataaaacggatgataaggaggaggtaaaatcatgaaatggattaaaagtacagtattaatggcgtttctatgcgttttatctgcttgtggaaatggcttatcaacagaggcggttcaagaccaaatcgtaagttctgaagagtcggtttccaattatcatattaccgtgaagcaatcggactataaggaagggtcgaaaacacctggagcacaaacggtggcgagtgctagcgcgtggaaaganggcacaggatacggctcgaaaatcgataaaaatgctggnaaggtaacgaaccaactcgaagtgattgcggatgccaatgtnggntttattcgctactatcaagacaagtgggaacaaaccatcacggcagcctcaagtcttcaaaatacggttgttttcccgtatgcaaaggtgattcaattaacgaaggaaattcatcaagangtnccttggaagaagacnttctctggatacgagaagacntatacaggaaacgacgaatcgattcgtaaggcattgacgtcngttcttggaattgcgacnacggatacgtcnaaagtcgagttaaaaatcaagacagatggcgctggaaatctgattacaaatgttgaaatcaaggtaacggatgaaggcgaacaaatgcgtaaagaatantcgattgcgtacttacaatttaatgaacaacaaaagaaagctttgccgcaataagggcgaagcttttttcgtaaaataaaccgctatgactacaaaaaaaggcgcttttttgttacaatagaaaagaacaaaatattgcgagaaatgaagaacattttgtagacatgcgagagggagaatgcttgcattctcccttttttataacaagaaaacatggaggaagaatatgggacgtgtgatatccgttgccaaccaaaaaggtggagttggtaagacaacttcgacagtgagtttggctgcagcacttgccgttcatggcaaaaaagtattgattattgatagtgaccctcaaggaaatgcgacgagtggtcttggcgtgcaaaaaggagagctagaacaagatgtatatgatgttttagtgaaccaagtaccaatggctgatgtcattgtaccgacaacgcgcgaaaacttgatgattgctccttctacgattcagttagcaggtgccgaaatcgagttaacgagtcaaccacgtcgtgaacaacgcttgaaggaagccgtgaagaagattaaagatgactacgattatatctttatcgactgcccaccttcactagggcatttgacaatgaatgcttttacggccagcgacacagttctnatccctgtgcaatgtgaatactacgcacttgaagggttgtcacaactcatgaacacgatcacgatggttcgcaagcacttcaatccgcagttgaagattgagggcgttcttttaacgatgtacgatgcgcgtacgaacttagggaacgaagtgaaagacgatgtgattaagtatttccgtgaaaaagtatataaaacaattattcctcgaaacgtacgtctatctgaggcgccaagttacggacaagcgattgtcgactatgatccacgctctcgtggtgctgaagtgtacatggagttagcaaaggaagtgttggcacatgagtaaaaatcaaaaaggaaaaggtcttggacgcggtattgatgcgctctttatgaatgacttggatacnatcgatgcnntngagcaagttcaagattcagaacaaattcaacaaattgctgtttcagaaattcgtccaaacccatatcaacctcgtaaagagttcgatgaagagggcttggcngaattagcagaatcnattcgtcaaaatggagtcttccaaccaatcatcgttcgtaagtcgaaaattaaaggctacgagcttgtggctggggaacgtc

SEQ ID NO: 856 - DNA, 4000 bp, Escherichia coli
  misc_feature (3)..(3): n is a, c, g, or t
  misc_feature (118)..(118): n is a, c, g, or t
  misc_feature (230)..(230): n is a, c, g, or t
  misc_feature (266)..(266): n is a, c, g, or t
  misc_feature (359)..(359): n is a, c, g, or t
  misc_feature (362)..(362): n is a, c, g, or t
  misc_feature (863)..(863): n is a, c, g, or t
  misc_feature (875)..(875): n is a, c, g, or t
  misc_feature (1984)..(1984): n is a, c, g, or t
  misc_feature (2643)..(2643): n is a, c, g, or t
  misc_feature (2892)..(2892): n is a, c, g, or t
tanctcgatcaatccgcttattcgtcgatggtgaagtcgtcacattccttcaatcagaaggcgagaaaatagacgtacgcgtcaaatcaaatttgactaatttagaggatattgatgngttactttctcagtctattacaacactaaccggagaaaatattcctctaaggcaattggtccactttgataccggcaagtctcgagagagtattcgacactataacttcagncgaacgatcaccttagaagcagatattgaccgagancgtattaacgaaatccaagttaacgaactaatcaaagaggagtgggcaagaattaagttcgaccatcctaacgtctcgctagatttctcgggngcnctcgatgatattcaagaaagtttagacgccatgctcttgctattcttacttggaattagcctaatttatctattaattgggacgcaatttaaaagctacttccaaccgctaatgattctagccaccgtccctttagcttttattggcgttgtaatcggcttaattatcacccaaaatcccctgagtttatatacgatgtatggcattgttgcgcttactggtatttcggtaaatagcgcaattgtgttgattgacgcggccaatacacgccgaaaatcgggcatgaatggcgtgcatgctattgtctttgcagcacggcgtcgagttgtaccgattttaattacatcgttcacaacgatcgcagggctgctctccttggcattaggtctcggtggaaactcgctactgtggggcccagttgcctcagcaattatgtggggattagcagtctccacaatgatgacgctttttgtaattccactactctataaaacgttctcncgataggtttantttgaatccgtcacccagacggattttgatgctcgcttacttaatttcaatttatgaattaaggcttcaggacaatcagaagtacataaacttttaaaatgctcttcagctaaaaaatcctgatctaccattgtgtgcagataattggtcaagctatcaaaataaccctctacatttaagagccctactggcttttcgtgaattcctaattgataccaagtccaagcctcaaagaactcgtccatagtaccgattcccccgggcattgcgataaatgcatctgccaaatccagcatctttgccttacgttcatgcatatccgaaacagtcactaattctgttagattttggtgcactacttccctggtacttaacccagtcggtatcactccggtcacctttcccccttgggtaataatgctatccgccaatatacccatcaatccgactctacctccgccgaagacgagctctatttcaccttcaacaagaatctttgcgagtcgtttggccgctaactcatacgcatctttagtcccttttctcgagccacaaaaaacagcaattcgtttgatcatttgttaattacctccgggtaatggtaacgctgttttatacttaacctgcttgagtgcaaagctcgatttgatattacctacacccggaatttttgataaaaaatttaaaataaacgcttctagtacttggatatctgctacgactactcgaatcaagtaatcggcttctcccgtcatgagataacactccattacctcagggcgtgctttgattgattcctcaaaacgctccagcgccgactccacctgacgctctaatgccacattaataaagacactcacttttaatccaacttttaaggaatcaatcaaggttacataccgactgatgtggccagatttctcaagcgcttttacgcgtgccaacgttggagaaggcgagagtccaacagctttggacagttcgatattggtgattctcgcgttattctgcaataaccttaatatttcccaatcaattgaatcaatcataataatcaaaataatatgctgtatataaataaatattagcataataattctgttaaatantgatttttaaagcataaacagaatcacatgctccataactttcgatatgatggacgctaaatacaaatttaaatggcaaacaagctggagcaacacacatgaccgatatgtccgaccaaaagcaaatgaatgtatcagcattttggcgagtactgcctcaagatttagatcctatcgagactcaagaatgggtagacgcttttaaccaactcgtcgcaatcgaaggtgaagagcgtgcaacttttttattgatgaaattgctagaacaagcgaggcgacttagggttcctatgcctcccgtgctcaatacaccgtactcaaacacgatatcgttggcagaccagcctccgttcccaggaaatcttgacgcagaggctaaattatctgccattattcgatggaacgctctagccatggttgtgagggcaaaccgcgtaaactcagatttaggtgggcacattgcaacctatacctcgtcagccgatctcttcgaggtagggttcaaccatttttttagagctggtctcgatggtgattgcgtatattttcagccgcactcggctcctggcgtttattcaagagcctttctcgaggggcgattaagcgaagaaaacgttgctaattatcgacaagaaacaggtggtgtcggtctctcctcntattgtcacccatggctgatgccggatttttggcagtttcccactgggtcgatgggcctaggtgcgatcaccgctatctatcaagcacgtttcatccgctaccttgagaacagagaacttcataatacgagtgaccgcaaagtttggtgttttgtgggcgatggagaaatggatgagccggagtctatcgccggactctcattagcctcacgcgaggggcttgataatctcattttcgttgtgaactgnaatttacagcgcttggatggtcccgtgcgcggtaatagctcgatcgtccaggaacttgaaggtcttttcggcggcgctggatggaatgtgattaaggtaatgtggggatctgattgggacccactgtttgcgattgaccaagagaacgtgattattaaaagactgcatgaaactgttgatggtgaatttcaaaagtacgcggcaacggatgggcaatttaatcgcgaaacattttttaataaatatccggaattgcagaaactcgtctcgcacttgtctgataaggatatcgatcggcttgagcgaggcggacatgacccaatcaaaatttattcagcctaccattcggcggtaagtcataaaggaagaccaactgtgattcttgctcaaactaaaaaaggatacggtatgggacactggggacaaggcaaaatgacgtcccatcaacagaaaaagttagaaaacgacgcattattcgcattccgggatcgtttctccattcccatacctgatgaggatgttgaaaatcttcggttttataaacccgaagaggatacaccggagatgaaatacttacatgagcaaagacataagctcggcggatatttaccagcgcgtatcaagaataaagaaaatttagctgcgccgaaacttaccgactttgccaaactaactggaggttcaggacaaagggagcaatccagcaccatggtattcgtacaaatgctgtctcagctattaaaaaataaagaattaggcaagcgggtagtgcctattgtagccgacgaggcacgtacctttggtatgcaatcattattccgacaagttgcaatttactctccctttggtcagttatatgaccccgaagaccgtgacgaactgttgtattacaaagaagcaaaaaatggtcaaattcttgaggagggaattacggaggcgggtgctatctcatcatggatagccgctgcaacatcctactcaacacacggcactactatgctgcctttttatattttctactcttgctttggttttcaacgaattggtgatttagtttatgccgccggagattcaagagctcgcggattcttgcttggagctacggccg

SEQ ID NO: 857 - DNA, 4000 bp, Escherichia coli
  misc_feature (81)..(81): n is a, c, g, or t
  misc_feature (439)..(439): n is a, c, g, or t
  misc_feature (1092)..(1092): n is a, c, g, or t
  misc_feature (1487)..(1487): n is a, c, g, or t
  misc_feature (1552)..(1552): n is a, c, g, or t
  misc_feature (1718)..(1718): n is a, c, g, or t
  misc_feature (1783)..(1784): n is a, c, g, or t
  misc_feature (1985)..(1985): n is a, c, g, or t
  misc_feature (1989)..(1989): n is a, c, g, or t
  misc_feature (3322)..(3322): n is a, c, g, or t
  misc_feature (3724)..(3724): n is a, c, g, or t
ccccaacctggcgcgacacaccactcctccggtggacggcttgagcttcgcgagagcggacggacggtcacggtcgagggngaggttcgttcgctcggcggatgatccgcctcccgtcgcttcccgcgaagacggtcccgccggcgacgcgcgtcctcgggcgtccgcggggtctcgggaagaaccgaggcatctctcgacgtgcgcgttgatgtcgtgcttcgggacctgtgcgtcgcacactgggcaagcgacgtacctggacttcgtgtccgccagacgccgctgggcgagtgcggacgtcgctccgcccgactgccgtcgtttcatccccggacgacgcgacgcgcacggcagggacgcacgcgccgcgcgcatcggcgagtgtcgttgtgatgcagagtcgccgaaacgcgcgtcggcacttccggggatttgngaagtttccagtcagcatgtgtgaaacacaacgttcgaatggaaacgccaaggtcccccagaccccagcgcgcgacgggcgcagacgacgctgggtctcctgaactatgcgtggcgatagcggagtcgatcgcgccgcgagcgtgatggagtcagcctcgaggtgcgcgccgagaccaccggacacgcgcgcgtgatctggagatattccgtttttcgtgtaccgtttcgttgttgcctcggccttagcgtcccccgtctccgagcctgaccgccacgctccctctccctcgctcgcaggtcctcctcgaacgtagcgtccgacgtgggcgagacggtgaaggacctggcgcggttcgcccccgcggcatccatcgccgtcgcgtccgcgtccgcgttcgtcatcacggcccgcgtcgcgaggcgcgcggcgtacgcggcgggcgtgtcgtgcgcgactcccgtgctcggcacgctgtggggcatcgcctccgtcggcggcgcgagcgcgctcgccggtcaggtggcgcggaccgtgctggagtggccgaacggcgccgtgccccagggcgtgcccgggtgggggggcatgaccctcgggggcctgcgacggccgctggagacgttacacggcacgagacagtttgagcacgncgcgagcgtcgaagcggtgaaggatgccatcttcggctcgctggcgtacgccgtgctcgggcgcggcgtgcagtccgcgctcccgagcgacatctcgcaccccggcgctctggcgaagcgctcgatgcgctccagcggcgcgcactacgcgacggaggcgcagaggcgcacgctcgccgggtggctgcgccgcgacgggtgccaccactgcgggtcgcgcgttgggaaagtggtcggtgatcacatgccgcccaacaagatggcgttcgggtcggcggcggcggcgcaggcggcgcgcgaggggtcgtggaagaccaggctgtggaacttcctgcgcatggtcccgaagcagaggttctacccgcagtgccggccgtgctcggacgtgcagtccnccgcggtgcgcacggggaaaaagattctcgtgcggcacaacggaggcgccaaggtgggcgccgcngtcgccgtcgccgtcgccgcgaggcactacgccatgaagcaccacccggaggagtacgggaagctgcagaagaaactcgaggggttcccgctgctcatcacgtgagacgcgatcgatcgattggccgtacagcgaggagtaccgaggcggagtaccgaggcggagncggagtcggagacggacgtagtctgacttgtattattaatacgtacgcgtgtaccatcataactnnctacgaactcgttctatcaatacacctatacgagcctaactacttgagcgccttgacttgctccacgacgagcgcctcgaaggtttcgcgcacgcccccctcggtctgctccatcggcaagtgtgcggcgctcggcaggagctcgaaccgcaggttctccggtcgaacgcccgatcgcgccagcgcgtcccgcagactctncgcnagacgcggaggcgtggtctcgtccttcgcgcccaccaccactagcgccttgaacggctttttgtccttcaaatcatcgtccttcaaatcacacagcctcggcatctcgcgccgcagccgcgcgccgtcgccgccgaaaccgccgagtccggcgcggaacagctgcagcagcccgacgtcccacccctcggcgagggtggggcgcacgtacgcgtcgcgggtttcgcggtccaggtcgccgtacgtcgcgccgctctccacggcggcggtctggcggcgcaccgagccgcgcacgacgttcagcccgggcccgttttgcgagacgaggaagcggaaccacgcgaaccgaagcgcgcggtccagtgggagcttcagcccgccgccgccgctcgagtttagggagcccgttttcgtttcgggatgttcggaatccgcctcgccctcgggcgcgtccccgacgaacacggcgggcgcgatcgcgagcagcgccgcgcaccgcggcgggtcgagcaaagccgcgtccagcgccacgggcgcgcccgcggagtggcccagcaacgccgcgcgctcgacgcccagcgcggacatcactttcaaagtcagctcggcggcgccctccgcgctgtacacgcggtggaacgactcgggcctgtccggcggcggcggcgggcgcgacgtcagtccgtacggcgggcggtctatggcgatcgtgcgcacgtttgcctccgccgcgacgcgcggaagcaggtgccggaacgagtacgtcgagccgttcgcgccgtgcatgcacaccagggcgtcgacgttttcgttcgcgcccgccgccgccgcggaggaggcgggcgggaggctctctttgtagtgcacgcagatgggcacgccgtccatctcgacggtgacgaacttggagtccgcgtccgcgagcgaagagggggggacgaggccctggagcggtttcgggtccggctcggagaagggctccaccacgagctcgtcgaagtccttctggaccttcgtgcgcccggcgtcgagcagcgaccgaacgaggtccgcgagcagatcgtctttcgacgcgcgcgcaaccgtcgatcgacgcgaaccgcgggtcggcgcgcggcgcgcggcgcatcgcgccgcggcgcgaggcccgcgcctcgagggcgtcgcgccactcggacgacgcggggagcacgccgcgctgtccacggcgtgaagcatcgcgcgcatgtcggtggacgcgcgcgtgcgttatgatgatgccacgacagtcgacgtggagacgtcagagcaagcgcgtgtgtgacaagtcagcggacgagcacttcccacacatnttcgaaacactttttcggctttcccgagacccgagggggcttcagaggcgcgggcgcggcgtgcaatgcccgcgcgtcccctccccgtggataccgcgggtgatggcgacacccctccgacgctcgcgcggagagaagagaagcgcgcgcacgtcccccgcgaggaatggcgcaggcttcaccccaaaccccctcgcgaaaaaggttcgggcgatgatttcggggcgaaaggagggcccgcgcgcgcgcgcctcgtgcgcggtgttctgcgcagccaggctgagctggaagtggcgagcccccgcaacttgaagctgtggggcttggattcggtggaggcgtacttcgagaccgaggaccgaaggacacaggctaaggtgtcgttggacgccttgcttcggnatcccgaaatctccccggctcgaaagcacgacgccgcggcgcggcaccacgtcgtctggggccgctcgacgttcgcctgcgccgagtgctggctcttgaaagggaactgcgtgtgccggtcactcgtcaaagcaacgaaagccgctcgtgaaagcagcgaaaggtcgcgtgttgaccgcgatcgggtcacgatgtctccgccgtacgcgcgggtcgtcgcgtacgcgcaccaaaacgaagtggcgcgcgggaacagcacggggaacttgatcccgg

SEQ ID NO: 858 - DNA, 4000 bp, Escherichia coli
  misc_feature (1507)..(1507): n is a, c, g, or t
  misc_feature (3358)..(3359): n is a, c, g, or t
  misc_feature (3363)..(3363): n is a, c, g, or t
  misc_feature (3892)..(3892): n is a, c, g, or t
  misc_feature (3921)..(3921): n is a, c, g, or t
gaaccaccggtcgtgcgagatgcacatcgtgacgccgttccaggacatcaccgcctcttccagcgcgcgcagcgtggtgacatccaagtcgttcgtgggctcgtccagcatcagcacgttcccgcccgacgtgagcgtcttcgccagctgcaggcggttgcgctcgccgccggacaagtcgcccaccttcttctgctggtcggagctcttgaagttgtaccacgagcagtacgcgcgcgcgttgacggttctgctgcccagggaaatttcctccgcccccccgctgagctcctcgaacaccgtcttgtccgcgttcaggcttccgcggtcctggtccacgtacatcagcttgacggtctcgcccaccgtcaccgtcccggcgtccggcgcgtcgacgccggtgatcatcttgaacagcgtcgtcttgcccgcgccgttagcgccgacgatgcccaccaccgcgcccgcggggatgatgcagtccaggccctcgatgagcagaccgcgcccctcgtaccccttcgagacaccggacacggtgatcacctccgaccccaaccgaggcgccgcggggatcgtgatgctgtccagctctgcgcgcgcggtgaacgcgttcgccgcgtcgcacagctcttcgtacgcgcgcagcctggctttgcccttcttctgctggcccttggcgttggagcgcacccactccagctcctggttgatcgtgcgctgcagcgagtcttgtttcttcccctccgcctccagccgcttggacttcgagtccagccaagtcgagtagttgccctcgaaggggatgccctcgccgcggtcgagctccaggatccaccccgcgacgttgtccaggaagtaccggtcgtgcgtgatggccaccaccgtgccggggaaactcgccaggaactgctccagccacgccacggactgcgcgtccaggtggttcgtgggctcgtccaagagcaggatgtcgggctgcgcgagcagcaggcggcagatggcgacgcgtcgcctctcgccgccggacaggttcttcacgagcgcgtccccggggggacagcgcagagcgtccatggcgcgcgacacggtgcggtcaatctcccaagcgtcggaggcatccagcttggtctgcagcgcgtccatgcgcgccatgagcttgtccatgtcgcagtccggctcggccatctgcatggagacgtcgttgtactccgccaagtcagccttgaccgccttgacgcccacctcgatgttctccatcaccgtctcgccgtcgtccagcggcggctcctggggaaggtacccgactttgatgccgtcgtcgaggtgtatttcgccgtcgaaatccttgtcgacgccggcgaggatcttcatcagcgtggacttacccgcgccgttcgcgcctaaaataccaatcttcgcgccgaggtacatcccgaggttaatgttcttgatgagctccttgccgttgggagtgaccttgcgcaccttgccgagagacaagatnattttacgcgtctccgtctggtacgccgagccctccttgaccttcccgggggacttgtggccttggttgccgccggtcttagcgccgccgccgccaccaccgccgccgccgccgctcttgcgcttgtccttcttgcccgcgcggacgcacaaatcgccgcgacgcgcggacgagcggcgcgcggtcgcgccggggaggcgcgcgccggcgacgccgtggcggaaatcgaaacccacgggcgactgggacgcgacgtggggcaccgccgaggcgcgcgcgccgcggcgcgccgagccgacggcgcgggggacggcgagggggagcgatgagcacacggaagccatcgtgggagagatcgcgagggggaaaggacgcgagctccgcgcgaccgccagtgacgaaagccttccctcgtcgctttatccgtcgccgtcgacgcgaaaagcgagcgacttcgccgccgacgcgcctgcagctgagcgcaaagccgtcggcaaaccaggctttcggagttccgaaaacgagccgcggaccgcacgcacagcacaattcacgacgcgatccgctagcatggccggcacgcgttcgaccgcggcgaaagcggcggcggaggagaaggcgatggacgattcgcttcacgtcgccgccccgctcgcgcacttggcgctcatagccctcgcggtcgcgccgctatttaccgcggtggagacgaatctgaacatcctcggcaccgcgacgttggctgtgttcgcgggggcgcaccgctccgtgcggccggtcgccgcggggaacaccgaggccatgaccaagcaggacgccatgcgcttccccctgatcggatcgtgcgtgctgttcgggttcttcctcctgttcaagttccttcccaaggacctggtgaacaagctcctgacgggatacttcgtgctgatcggcatcttcgcgttaaccggcacgctcgcgccggtggtgggcgcggggatgccccgcggcgtggccacccgggcgctgtacttcgggacgtgccccaagatcccgctcctgatggacgagcccacgcgcgtggagctgagcgtccccgagctgctcgcgggcgccggcggcgtcgcgttctgcggatggtacgtcgccgagaagcactggctggcgaacaacgcgctcgggctggcgttttcgctgcagggcatcgagttcctcaccctggactccgttcagatcggcgtgatcctgctcacggggctcttcttctacgatatcttctgggtgttcttcacgccggtcatggtcacggttgcgaaatcgttcgacgcgcccatcaagctgctgttcccgcgcgccgtcgcgccgggcgcggacgtcccgccgttctccatgctcggcctcggggacatcgtgatcccgggcatctacgtcgcgctgacgctgcgcatggaccacgcgcgcagggcgagggcgctcgcgaagggcctcccggcaccgcccgcgtacttcaacgcggtggtcttcgggtacttcgcggggctcgtcgcgaccatcgtcgtgatgcacgcgttcaaagccgcgcagccggcgctgctgtacatcgttcccggcgtgctggccgcgacgttcggccgcgcgctcgtcggggggggctggcgcgagatcaaagccgtgtgggggttcgacgaggccggggaggagctcgaggaggcccaggaaaagaaggccaagtgaagcgcgagccgagcgcgtaaaagcgcgtaaaagcgcgaaacgcgcgtacgaaagtacgtctctttttggaccgtctatacagtacgtactagcgagcgcgcgtctgtgagacgcggtaaaagccgatgcgcgttcgtnntttngttctgcgtttagttctgcttcggtcccctggcgtacgccatcgccgccgcctccgtggcgctcctcgcgccgaacccgcccccctgtcctctctgcgcgccctgcggcagcgccgtgagcgccgccgcgaacttctcgcgcgcaaactcgacggcgtcgcgcgcgcgccgcgcgacgacgtccccgacgctcaccctcgtttcgtcgatgtgcctgtcgatggcggtctcgtgcctcgccaggaacggtgcgacgaacgcgtcgtacacgtacagcgcgccctgcgtgcgcgggtgccacaggtacaccacgaacgccaccttcgcctcgctgtacatgggcagccaaaacacgaaccgatccgaaacctgcgtcccggcggtgtacagcgccatgaccgtccagtagatgcaccagccgcgcagcgcctcgggcttgcgtttgtgcttctccaacgcctgcgggtcgcgggtcgcgggtcgcgggccgttcggaaaaggagaaacggggaggaaggcggtcagaacncgccaccgcgagcgccgcgaggtggagtngagggggaagacatctggaagtccggccgcgctcgggacgggggacgggacgggaggcgcaccttgaagcacaggtacg

SEQ ID NO: 859 - DNA, 4000 bp, Escherichia coli
  misc_feature (206)..(206): n is a, c, g, or t
  misc_feature (1986)..(1986): n is a, c, g, or t
  misc_feature (3428)..(3428): n is a, c, g, or t
gattctcgttccagaacgccacgtgatgcagcaccgttcccggcacggagtttccgcccgcatcgactagcttcgggtgatacgccagcagccagccatcgaggggcactgtccaaatcaggtccggcggctgcggcattttcatgtgcgaggtgtgcgccggcaaattcatgggacccacgcgaagcgtgattgtatgcgtggcnatgtcgaaattcggatcgagcttgacccccttcgccaccgcgtggtgcatgccttcctgcatgaatccatgatgctcgtgctgcatgggcatcggtttcgctgcgccttccgtttgtttttcctgggcgagggctgcgctcgcggccagcaaaagcgttccgcaaatggctattgttttgattatttctttgatgaccgttttaatcattggacttctccgggtattccatctcttggaccggaccttctttcatcatactcccggccggatatgacggaatgaatcgccgtaagcgaattgttctgcgtgaactccatgcggaaagcagatagtatccgggcaatgaaaattcacgaacgcattaagccgcacttcggcgtcgttcttctgttctgcctgtgtttcggcgcagcgagccacgcgcagaagcccacagcgagcgaccagttggtgctcagcaatgtgaccgtcgtcgatgttcgtacgggcgctttgcatgcggaacaaaccgtagtcctcgaaggcaatcgcattgcttccgtggaaccgagcaaatcggcgaagcatccgcgcaatgcgccgatcgtgaatagccgcggccttttcctcatccccgggctctgggacatgcacgtgcacctggtgtttggcgactggtttccggatgcgcgagatatttcgctgccgctcttcatcgccaacggcgtcaccggcgtgcgggacatgggcagcgagctggacatcgtgcaggcatggcgcaacgaaattgcggccggacgcctggtcggcccgcgcatttacacctccgggcccatgctggatgggcccaggccccgctttccgagttccgtggcgattgccacaccggaagatgcgcatcgcaccgtcgcggatctcaagcgacgcggcgcggattttatcaagctgcaatcgctgattccgcgcgaagcagtttttgccatcgcggaagaagccaggaagcagcagatacctttcgagggacacgtgcccgactccgtccgggcgagcgaaatgtctgaaacgggcatgaaaagcttcgagcacctcatcggcatttttgaagggagctcgcccaacgaggacgatttcttgaaaggggacaagacagaagggaagttccttgcgacttacgatgcggcacgcgctgctgcgctggcggcgattctggcgaagaatcagacctggcaatgccccacgctggtgtgggaacgcggcggcaacctcgtcgatgtgagcgacttcagcaaagacacgcgcgtgaaatacgtgccggcagcatggaagaacaaaacgtggaaacgattcaccgatgaaatcacgcaaggctacggcacggatgatctcgacacgcgcaaacaattcatcgagagagaattagaagtcgtgcaaatgctgcgcaagaccggcgtgccatttctagccggaacggatacgcccgccggcgtccatattttccctgggttcagcttgcatgaagaattgcagcgattcgtggccgcgggtttcactccgctggacgcgctgcaaactgcgacgatcaatcctgcgcgttttttgggaatcgaagaccaggccggaaccgtcgaaaaaggaaagctcggggaccttttgctgctttccgccaatcctctcgaagatattgccaacacgcaaaagatcgcgggcgtcgtcgttaacggccgctattacagccgcgccgagctcgataagatgctcagccgcgtagaaatcgccgcggacggcccgagttcgcaagngataaaatgaataagtattcgtcgcaataatattgtgccgttcgtttttaatatttttttcacggagtagcctcttgacagcagaaccaagcaggcgtaagaaaacaactattggggtagggatttcaaagacttgagggaaccggcgtgttccgcaaccgcgacttccgctgttgaagtgtgtcgtaaaggaggttgtatgcctgcaaaccagccaagcgaggcacttcgcgcactttgttatgagcaccacgtggagatgaggctgaagcaaaacttttccaacggcgagcaaaacaccaggaaaactgcaatgtttgcttgtccggaggccagttgcctcgtccactacagcatctctggtggatatttcctggcaagccaaaacggacatagaaatgatttggaagtgattcccgcagtgcggtgcctcgacgacgggacgcccatgtaccttgccgaaatcgatttggacaagagggactatcgtttgtggatatgcccgcaatgcggcggcagacgcacgcatgagcaaggcttagtaggcgtggcgtcgcggggaaatcaggatgtcagcgggcaacgcgaagcagaatcgcaaactccgtaaagcttcaacacataatcttccggcatcattctcgcaacgaattaattcggtttgctccattcttttcccggcgatacgagttccagcccaacagcatacttctgtttttccacgcgttgacagtagacgacccgcgcttcggaatggatgccaagctcgggagaggtcagcagaacgatagaccctacgctccacacgtgttctgtcgccacgcgtatcccgcgcgcacttatgttttccgcaacggccaagctctacaatggctctttttgcgatccgcgggcgagatcggctagagcgctctggcataagataccgactcctgtagcgggagcctccatgggaggcggcacggagtcccggtgagggctagaggataatagtatgtcgcactgccactttgttgggtagcccctccgcgacttcgcaaaacatggcgtgtgtggccgtgtcgttggtagactttcgtgcacttcgaggtgcctgcgaaatgaagctgattcgattcggcgagatgggccgcgaaaagcccggcgtactacttgaggatggaacacggctggacgtttccggatttggttcggactacgacgaggattttttcgcgggcagcggaattgccaaacttcggaactggctggcgaggcaaggcgcttcgtcgctacgagtgcgggaatcggtgcgattggggccgccgatttgccgaccgagcaagattgtgtgcatcggactgaatttccgggaccacgcgcaagagagcggaatggaaattccgaaagagccggtgatttttttcaaggcgacttctgcgctggtgggaccaaatgatccnctggtgattccgaaaaatgcgacgaaagtggactgggaagtggaattggcggtcgtgatggagaaaaaagcgagttacgtcagcagagaaaccgcgatggatcacgtggccggttttgcgctgcacaacgattattcggagcgcagctttcagctggaacgcggagggcaatgggtaaaggggaagagcgcgaattcgttcgcgccgctgggaccgttcctggcaacaaaagacgaaattcgagatttcaatcagttgggaatgtggttgaaggtgaatggggaattccggcaaagaggttccacttccaagatgatttttgatgtgccggcgctagtggcgtatatcagcgaattcatgacgctgctgccgggagacgtgatcagcacggggacgccgccgggtgtgggcctggggatgaagccgccgcagtatctgaaagcgggcgacgtggtggaattggggatcgatgggttaggggagtcgcggcaggaagttgtggactaccgatgagagagaattcggggccggcggaaacattgcgatcagttttgatgcgagccgagagcgat

SEQ ID NO: 860 - DNA, 4000 bp, Escherichia coli
  misc_feature (829)..(829): n is a, c, g, or t
  misc_feature (1464)..(1464): n is a, c, g, or t
  misc_feature (1988)..(1988): n is a, c, g, or t
cgggttcgggtgagttcaccatcatccggatcaagctccttgtgcagaatcaggaatcgcttgatctgagaggctgataaatgtgcatccgaggcaagactttgattgacctgctcaatgcactcctgaatcaactggtaaacctgggggtgagccgcaagctcctgataacttgcgtaggagacgttattgcgctcggcccaattgccgaccgcatcaagatcaatatttacaaaggccgttacaaagtcacgaccatctccaaacgtcacgacttccttgatctccgggaagaatttaagtttgttttcaagaaatttaggcgcgaacatgctgctgtcagtcaacttaccgacatcctttgcccgatcaataatgcggagatggccttcgccatcgatgtagcccgcatcgcctgtgcgaacccagttgtcgtcggttttggtttctgaggttgcctctgcgttcttgaaatattcaagaaataccccgggacttctatacaagacctcgccgttgtcctcaatgcggagctcaacgccaggtggaggtgtacccacgctttctgaacgaacgaggccgtcgggctgcatggtgatgaataccgtggcctcggtctgcccgtacaactgcttgaggttaatgcctatagatcgataaaaatcaaaaatctcggggccaatcgcctctcccgctgtgtaggccacgcgcacgcggcccagacccagcgtatttttgagcggcccaaaaatgagcacctcgccaagcgcgtatttgatgcgatccataagcggcacggatttgccatccatcaagtcgacgccagtcntctttgcgaccgccatgaagtagttgaacaggcgctgcttgaacgggccagcatccttcatgcggatcatcacgctggtaagcacgctctcaaaaacgcgtggtggcgcaaaataataggtcggaccgatctcgcgaaggttctgcgcaacggtgctcgaactttcgggacaattaacgcaaaagcctgcgacaagccccatggcaaacgagaacgcgttatcacccacccacgccatgggcaggtaggccagtgtttcttcgtcggccgtaatattgtcaaaggcgtttgcgttttttgcggtgacgactaaattttcatgcgtcagcacaacacccttgggtcgaccggtcgtccccgaggtgtagagaataatcgccggatctgaaagccgtccggcagcgatctcttgatcgacaaggtcgggggttttcgcgagagcatttcgaccgcgcttcataacctcctgaatatccaccacaacattgggatcgtattttcgcaaccctttcgggtcgcagtagatgatcttttcaacgcgcgggcagtgctcttttatttcaagtgacttatcgacctgctcctggttttccgcaacgataaagcgagcctctgcatgctcgacaacgtattgnatttcttcagccactgagtcctggtaggcaggaacgggaataccgcccaacgactgcaccgcgagcatggcgccatagagtcgggggcggttgtcgccaatgatgacgagggtttcgccacgttgaaaaccgaggtcagaaagaccggcagccagcgccgtcgcctcgttacagaattcgttaagcgtccaggtctgccagatcccatacgctttttcgcgcattgcgggacgatcgccatcacgctgcagtcgaactttgagtagctgtgggaacgttcccatcagcgactcagtggaatcgctcatatcctcttcctcatatcagatcgcggtccgactctcttcggcccagaatggttgggcgacggtgaactcgcggagaatctcctcgcaagaagatcgaaattgattatgaggaattcgttaattgagcgcaaaaaattcggcgtgacgataatctcttaaaaaaaaagagggaacttaagaggcggcagggttgccacagatggctccgaaaatatncggaattaagggttttccctatatcagcaggttcggactgctgtaggcggccgtgatccgtcctcagcgaaccacgaaccctagcctcgggacggtcaggtaacccgtggcatcttcaaagctcggaatcatatcctccggaaccgtcatgtccgcccagactgggatcaacagattcccgtccggatctggtgattcccgaaaatggatttcgattactcgatcgccgataaattccacattgaggacttcggcatccttgagttcctcaaggccctcaagagcaggcgcgtcggtccgaatccagcgattgaatcgactgaggttgagctcatcatggaatccttcgaaagcggtcgttgcatgccaaccctcttcccatttataggtcgcgctgatatgccgcccctcgaaccattcacaccagaagtatccgggttctaccgcgcgattattccccgcctcgatccattgcttcctggcgccgacccccatgccggcaaggttcatcacggggcgcacgcagtaccaattacttgtatctggcgcgacaccggccgggccgcaccggtaaccgaacgctaacgaaacaaataatttgttgaaccagtggtggaactggggaaattttttccacgccaacgcatcaggctcttccataacggaacgacgctagcagttcaactttgcgggagtgaataaatcgggcttggactggcggtgggctggtaattcgcgggccgtcttcaggagtttaatcgtgacccggtagcgcacgttttatttgatcgactagaacgggatatcgtcgtcaaaatctcccccgggggcagcgtcagcctggccgtaatcgggcggcgcgctgctgggtgcatcgccaccgcggccaccgagcatctgcatatccgtagcaactatctcggtggtgtacttttcattgccgtcgcgatcctcccacttgcgggtttgcagacgcccttctacatagacctgagagcctttcttaagatattcccccgcaatttcagcaagacgtccgaagaacactacccggtgccattcggttttctcctgtctctcaccggactgcttgtctttccagctatcggtcgttgcgagcgtgacgttggcaatcgcgttgccatttgcggagtaccgtacctcaggatcgcgccctaaatttccaaccactattgccttgttgattcctcttgccataccttgatcctgcctatactttcgatgcgtgttctgtgttgttttgatttacccgtccaaacgagcctgtttcgccagtggtgacgaggtaacgctcggaataagtataccgccggcggcccttctgtcatctattgccggtgtgattatttttactgacgcacggccttctggcgtgatcggatgtcggagcgagtttggattgacggggtctggcgaattgtctataaccgacggagcgaacggtctttttgtgccggccagtcaacacacgatttcactcaagtgagcgcactcggagcaggaatgggagaaaccattgccatagacatccagcatgtctcgaaaattttcggtgcgcagtccgatcaagaagtgcgagcgcttgacgatgtctcggtggcaattctccagaacgagtttttcacgctgctcggcccatcaggctgcgggaagaccacgctgcttcggctgattgctggattcgagcagcccacaaacggatccattctgcttgagggcgctgagatcagcacgcttccgcctttcgagcgcccggtcaacactgttttccagaattacgcgctctttccgcacatgaccgtggctcagaatatcggcttcgggctggagatgcaggcccgctccaaggacgaggtgacctctacggttaccgagatgctcgacctcgtgcgcatgggcgcgctcaaggaccgccgaatcgaccagatctcaggcggtcagcaacagcgtgtagcgcttgcccgagccttggcgcctagacctaaagtatt

SEQ ID NO: 861 - DNA, 4000 bp, Escherichia coli
  misc_feature (1986)..(1986): n is a, c, g, or t
  misc_feature (1990)..(1991): n is a, c, g, or t
  misc_feature (2004)..(2004): n is a, c, g, or t
  misc_feature (2015)..(2015): n is a, c, g, or t
  misc_feature (2466)..(4000): n is a, c, g, or t
taacgtagtggtaaagaaattagagcagaagcaacacctccattgctgtaagcaaaagcgtcagtatcagttcctgttgctctagatagcgccgctctttgaaaaggaatgttcttttcttcagctgtttctgtaattaaatctctaagtttttgctgaacagcaggagcataggcaataacagggccttttccgttctcaatatgaccttccttctttttatctatcattggagtagtggtgtcatgagtcacatcagtaactatagctagatttggttttatagtatgtgatatcatctcagcaccgcgtaatccaatttcttcttgaacagaattggtgatgtaaagcccaaatggaagctgttttttattttcataaattagtcttgcaacttcagctatcataaagccacccattctgttgtctaaagctctgcaaacaaaatttgattcatttagtatatgaaattcatctggataggtaattacacagcctacatgaactcctaatttttcaacttcttcttttgttttacaaccgcagtcaataaaaatattttcaggtttaggagcttcttcattcgctttatttcttgtgtggattgcaggccaaccgaaaattcccttcacaactcctttcttagtatgaatatttacaattttactcggagcaatttgatgatcactaccaccatttcttatcacataaattaaaccattatcagaaatataattaacataccaagatatttcatctgcatgaccttctataactactttgtatttagcttcaggattaattacagctacggctgaaccataggtgtctgtgataaattcatctacatatggttttaagtaattcatccatattttttgcccttcccattcataacctgttggtgcagcattatttaaatatttttctaaaaaggaaattgattttttatttaatattgattctttactcataatatattttctgtttctgtaaaaataaaccatttctcacaccttaaaaacaattagtaaaacttattgtaaattttatgaataatttaccattgaacgtatcatctgtgatgtattaagttttgttaattgtaatatctttgtaataaaaatagaaccttttgaaaaaaatattttttcttttactttttcttcctttaactttagtagcgcaaaaaaaagattcagctccactagatttagaagattatctcttggttaaaagaggggataccttgactatagctttagatgaaatcgctattctaccaaaacatgattttaattcacctacagatgcccgttactattattggtttaagagaaaagtatttaaagcatatccctatgctaaaacagcctcacaaaggttggattcgttaaattctagattaaaaagaattaaaactaaaagagggaaaattaagtataccaaaaaagcacaaaagtatcttgaaggagaatttacagatcaattaaaaaaaatgactcgtacagaagggagaattctaataaaactaatctttagacaaactgggaaaactgccttcaataatattaaaacattaagaagtggatggaaagccttttggtataatacaactgcaaatttttttaaactttctcttaaaagtgaatatcatccagaatcaataaatgaagattatttgattgaagatgttcttcaaagggcttttattgaagaaagattagtggatcaaaagtcaaaacttactattgattttccaaaaatagcagctgctaaaaaaggcaaaataaatgtagaagtgtataaattgatgtttgcgaagaataaaaagaaggcttctaaaaaaaataacaaacgctaacataaaggtttttagtttattagaactaatgttatcaattctataaaaatatttcatttatttcttgtttaggttttcaaataaactgtatctttgcgacccgttttggggtataggtttcnagcnnatttatatttagnagttgtttgangtattggattgcaaaaagattaaaaaaaagattatttttttcttgttgattagaaaatagtttttacatttgcaaccgcttagaaaaacaagcgaagttcacagaggttttggaaggcatttaaagatagaaaatgttgttagttcgagtctaacatttctacaaaaatttagggggattattggttgagattacaccgatttaagatctttagatgagttcattgaaaatattgaaattgacagcgtaaacaaagagtaaagtaaccatgtttaacttcgttaaacaaattcttttgaaacttattcatacatattattaaaatatacaatgaagagtttgatcctggctcaggatgaacgctagcggcaggcttaacacatgcaagtcgaggggtaacaggagtgcttgcactcgctgacgaccggcgcacgggtgcgtaacgcgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 862 - DNA, 4000 bp, Escherichia coli
  misc_feature (1)..(2): n is a, c, g, or t
  misc_feature (5)..(9): n is a, c, g, or t
  misc_feature (11)..(13): n is a, c, g, or t
  misc_feature (15)..(19): n is a, c, g, or t
  misc_feature (21)..(23): n is a, c, g, or t
  misc_feature (25)..(29): n is a, c, g, or t
  misc_feature (31)..(33): n is a, c, g, or t
  misc_feature (36)..(39): n is a, c, g, or t
  misc_feature (41)..(41): n is a, c, g, or t
  misc_feature (43)..(43): n is a, c, g, or t
  misc_feature (45)..(49): n is a, c, g, or t
  misc_feature (51)..(56): n is a, c, g, or t
  misc_feature (58)..(75): n is a, c, g, or t
  misc_feature (78)..(80): n is a, c, g, or t
  misc_feature (82)..(83): n is a, c, g, or t
  misc_feature (87)..(87): n is a, c, g, or t
  misc_feature (89)..(90): n is a, c, g, or t
  misc_feature (92)..(92): n is a, c, g, or t
  misc_feature (95)..(98): n is a, c, g, or t
  misc_feature (100)..(103): n is a, c, g, or t
  misc_feature (106)..(109): n is a, c, g, or t
  misc_feature (112)..(117): n is a, c, g, or t
  misc_feature (120)..(122): n is a, c, g, or t
  misc_feature (124)..(126): n is a, c, g, or t
  misc_feature (128)..(132): n is a, c, g, or t
  misc_feature (135)..(135): n is a, c, g, or t
  misc_feature (137)..(137): n is a, c, g, or t
  misc_feature (141)..(141): n is a, c, g, or t
  misc_feature (143)..(149): n is a, c, g, or t
  misc_feature (151)..(151): n is a, c, g, or t
  misc_feature (153)..(153): n is a, c, g, or t
  misc_feature (157)..(160): n is a, c, g, or t
  misc_feature (162)..(162): n is a, c, g, or t
  misc_feature (166)..(167): n is a, c, g, or t
  misc_feature (169)..(169): n is a, c, g, or t
  misc_feature (171)..(173): n is a, c, g, or t
  misc_feature (176)..(183): n is a, c, g, or t
  misc_feature (186)..(187): n is a, c, g, or t
  misc_feature (190)..(190): n is a, c, g, or t
  misc_feature (192)..(193): n is a, c, g, or t
  misc_feature (198)..(198): n is a, c, g, or t
  misc_feature (203)..(207): n is a, c, g, or t
  misc_feature (209)..(210): n is a, c, g, or t
  misc_feature (212)..(214): n is a, c, g, or t
  misc_feature (217)..(219): n is a, c, g, or t
  misc_feature (221)..(223): n is a, c, g, or t
  misc_feature (226)..(226): n is a, c, g, or t
  misc_feature (228)..(230): n is a, c, g, or t
  misc_feature (232)..(232): n is a, c, g, or t
  misc_feature (235)..(237): n is a, c, g, or t
  misc_feature (239)..(243): n is a, c, g, or t
  misc_feature (246)..(247): n is a, c, g, or t
  misc_feature (250)..(252): n is a, c, g, or t
  misc_feature (254)..(255): n is a, c, g, or t
  misc_feature (257)..(259): n is a, c, g, or t
  misc_feature (262)..(262): n is a, c, g, or t
  misc_feature (264)..(264): n is a, c, g, or t
  misc_feature (266)..(268): n is a, c, g, or t
  misc_feature (271)..(271): n is a, c, g, or t
  misc_feature (273)..(274): n is a, c, g, or t
  misc_feature (276)..(276): n is a, c, g, or t
  misc_feature (283)..(288): n is a, c, g, or t
  misc_feature (291)..(291): n is a, c, g, or t
  misc_feature (293)..(294): n is a, c, g, or t
  misc_feature (296)..(296): n is a, c, g, or t
  misc_feature (298)..(299): n is a, c, g, or t
  misc_feature (301)..(303): n is a, c, g, or t
  misc_feature (306)..(309): n is a, c, g, or t
  misc_feature (312)..(315): n is a, c, g, or t
  misc_feature (318)..(318): n is a, c, g, or t
  misc_feature (320)..(320): n is a, c, g, or t
  misc_feature (323)..(325): n is a, c, g, or t
  misc_feature (327)..(327): n is a, c, g, or t
  misc_feature (330)..(331): n is a, c, g, or t
  misc_feature (333)..(335): n is a, c, g, or t
  misc_feature (338)..(340): n is a, c, g, or t
  misc_feature (342)..(345): n is a, c, g, or t
  misc_feature (348)..(348): n is a, c, g, or t
  misc_feature (350)..(354): n is a, c, g, or t
  misc_feature (356)..(357): n is a, c, g, or t
  misc_feature (359)..(361): n is a, c, g, or t
  misc_feature (363)..(363): n is a, c, g, or t
  misc_feature (365)..(366): n is a, c, g, or t
  misc_feature (368)..(368): n is a, c, g, or t
  misc_feature (371)..(372): n is a, c, g, or t
  misc_feature (377)..(380): n is a, c, g, or t
  misc_feature (382)..(395): n is a, c, g, or t
  misc_feature (397)..(399): n is a, c, g, or t
  misc_feature (401)..(407): n is a, c, g, or t
  misc_feature (410)..(411): n is a, c, g, or t
  misc_feature (416)..(423): n is a, c, g, or t
  misc_feature (425)..(426): n is a, c, g, or t
  misc_feature (428)..(432): n is a, c, g, or t
  misc_feature (434)..(434): n is a, c, g, or t
  misc_feature (436)..(439): n is a, c, g, or t
  misc_feature (441)..(441): n is a, c, g, or t
  misc_feature (443)..(444): n is a, c, g, or t
  misc_feature (446)..(447): n is a, c, g, or t
  misc_feature (451)..(451): n is a, c, g, or t
  misc_feature (453)..(453): n is a, c, g, or t
  misc_feature (455)..(455): n is a, c, g, or t
  misc_feature (457)..(457): n is a, c, g, or t
  misc_feature (460)..(460): n is a, c, g, or t
  misc_feature (466)..(471): n is a, c, g, or t
  misc_feature (474)..(475): n is a, c, g, or t
  misc_feature (477)..(479): n is a, c, g, or t
  misc_feature (482)..(482): n is a, c, g, or t
  misc_feature (484)..(485): n is a, c, g, or t
  misc_feature (487)..(487): n is a, c, g, or t
  misc_feature (489)..(494): n is a, c, g, or t
  misc_feature (497)..(500): n is a, c, g, or t
  misc_feature (504)..(504): n is a, c, g, or t
  misc_feature (508)..(509): n is a, c, g, or t
  misc_feature (511)..(514): n is a, c, g, or t
  misc_feature (516)..(519): n is a, c, g, or t
  misc_feature (522)..(522): n is a, c, g, or t
  misc_feature (524)..(524): n is a, c, g, or t
  misc_feature (526)..(527): n is a, c, g, or t
  misc_feature (529)..(531): n is a, c, g, or t
  misc_feature (533)..(534): n is a, c, g, or t
  misc_feature (536)..(537): n is a, c, g, or t
  misc_feature (540)..(541): n is a, c, g, or t
  misc_feature (543)..(545): n is a, c, g, or t
  misc_feature (547)..(549): n is a, c, g, or t
  misc_feature (551)..(552): n is a, c, g, or t
  misc_feature (554)..(556): n is a, c, g, or t
  misc_feature (558)..(561): n is a, c, g, or t
  misc_feature (563)..(564): n is a, c, g, or t
  misc_feature (566)..(568): n is a, c, g, or t
  misc_feature (573)..(573): n is a, c, g, or t
  misc_feature (577)..(579): n is a, c, g, or t
  misc_feature (581)..(582): n is a, c, g, or t
  misc_feature (584)..(585): n is a, c, g, or t
  misc_feature (587)..(588): n is a, c, g, or t
  misc_feature (590)..(597): n is a, c, g, or t
  misc_feature (599)..(600): n is a, c, g, or t
  misc_feature (602)..(607): n is a, c, g, or t
  misc_feature (610)..(610): n is a, c, g, or t
  misc_feature (612)..(614): n is a, c, g, or t
  misc_feature (616)..(616): n is a, c, g, or t
  misc_feature (618)..(618): n is a, c, g, or t
  misc_feature (622)..(631): n is a, c, g, or t
  misc_feature (633)..(635): n is a, c, g, or t
  misc_feature (637)..(637): n is a, c, g, or t
  misc_feature (639)..(640): n is a, c, g, or t
  misc_feature (642)..(642): n is a, c, g, or t
  misc_feature (645)..(647): n is a, c, g, or t
  misc_feature (649)..(651): n is a, c, g, or t
  misc_feature (653)..(653): n is a, c, g, or t
  misc_feature (655)..(655): n is a, c, g, or t
  misc_feature (657)..(659): n is a, c, g, or t
  misc_feature (661)..(667): n is a, c, g, or t
  misc_feature (669)..(672): n is a, c, g, or t
  misc_feature (676)..(676): n is a, c, g, or t
  misc_feature (678)..(682): n is a, c, g, or t
  misc_feature (684)..(688): n is a, c, g, or t
  misc_feature (691)..(691): n is a, c, g, or t
  misc_feature (693)..(696): n is a, c, g, or t
  misc_feature (698)..(700): n is a, c, g, or t
  misc_feature (702)..(702): n is a, c, g, or t
  misc_feature (706)..(706): n is a, c, g, or t
  misc_feature (708)..(720): n is a, c, g, or t
  misc_feature (722)..(731): n is a, c, g, or t
  misc_feature (733)..(733): n is a, c, g, or t
  misc_feature (737)..(738): n is a, c, g, or t
  misc_feature (740)..(740): n is a, c, g, or t
  misc_feature (742)..(744): n is a, c, g, or t
  misc_feature (746)..(747): n is a, c, g, or t
  misc_feature (751)..(751): n is a, c, g, or t
  misc_feature (753)..(753): n is a, c, g, or t
  misc_feature (756)..(756): n is a, c, g, or t
  misc_feature (758)..(758): n is a, c, g, or t
  misc_feature (760)..(764): n is a, c, g, or t
  misc_feature (766)..(774): n is a, c, g, or t
  misc_feature (776)..(778): n is a, c, g, or t
  misc_feature (780)..(780): n is a, c, g, or t
  misc_feature (784)..(785): n is a, c, g, or t
  misc_feature (787)..(787): n is a, c, g, or t
  misc_feature (790)..(794): n is a, c, g, or t
  misc_feature (798)..(806): n is a, c, g, or t
  misc_feature (809)..(814): n is a, c, g, or t
  misc_feature (816)..(822): n is a, c, g, or t
  misc_feature (826)..(837): n is a, c, g, or t
  misc_feature (842)..(850): n is a, c, g, or t
  misc_feature (852)..(853): n is a, c, g, or t
  misc_feature (855)..(858): n is a, c, g, or t
  misc_feature (860)..(865): n is a, c, g, or t
  misc_feature (869)..(870): n is a, c, g, or t
  misc_feature (872)..(874): n is a, c, g, or t
  misc_feature (876)..(877): n is a, c, g, or t
  misc_feature (879)..(879): n is a, c, g, or t
  misc_feature (881)..(883): n is a, c, g, or t
  misc_feature (885)..(891): n is a, c, g, or t
  misc_feature (893)..(896): n is a, c, g, or t
  misc_feature (898)..(898): n is a, c, g, or t
  misc_feature (900)..(904): n is a, c, g, or t
  misc_feature (906)..(910): n is a, c, g, or t
  misc_feature (913)..(913): n is a, c, g, or t
  misc_feature (916)..(917): n is a, c, g, or t
  misc_feature (919)..(928): n is a, c, g, or t
  misc_feature (931)..(938): n is a, c, g, or t
  misc_feature (940)..(941): n is a, c, g, or t
  misc_feature (943)..(943): n is a, c, g, or t
  misc_feature (945)..(947): n is a, c, g, or t
  misc_feature (949)..(953): n is a, c, g, or t
  misc_feature (956)..(960): n is a, c, g, or t
  misc_feature (963)..(963): n is a, c, g, or t
  misc_feature (965)..(972): n is a, c, g, or t
  misc_feature (974)..(976): n is a, c, g, or t
  misc_feature (982)..(983): n is a, c, g, or t
  misc_feature (985)..(985): n is a, c, g, or t
  misc_feature (987)..(989): n is a, c, g, or t
  misc_feature (991)..(992): n is a, c, g, or t
  misc_feature (994)..(998): n is a, c, g, or t
  misc_feature (1002)..(1010): n is a, c, g, or t
  misc_feature (1012)..(1013): n is a, c, g, or t
  misc_feature (1015)..(1016): n is a, c, g, or t
  misc_feature (1018)..(1018): n is a, c, g, or t
  misc_feature (1020)..(1020): n is a, c, g, or t
  misc_feature (1024)..(1028): n is a, c, g, or t
  misc_feature (1030)..(1034): n is a, c, g, or t
  misc_feature (1040)..(1044): n is a, c, g, or t
  misc_feature (1046)..(1047): n is a, c, g, or t
  misc_feature (1049)..(1053): n is a, c, g, or t
  misc_feature (1055)..(1057): n is a, c, g, or t
  misc_feature (1059)..(1059): n is a, c, g, or t
  misc_feature (1061)..(1061): n is a, c, g, or t
  misc_feature (1063)..(1063): n is a, c, g, or t
  misc_feature (1065)..(1065): n is a, c, g, or t
  misc_feature (1068)..(1070): n is a, c, g, or t
  misc_feature (1072)..(1075): n is a, c, g, or t
  misc_feature (1077)..(1085): n is a, c, g, or t
  misc_feature (1087)..(1087): n is a, c, g, or t
  misc_feature (1092)..(1095): n is a, c, g, or t
  misc_feature (1097)..(1097): n is a, c, g, or t
  misc_feature (1099)..(1099): n is a, c, g, or t
  misc_feature (1101)..(1105): n is a, c, g, or t
  misc_feature (1107)..(1109): n is a, c, g, or t
  misc_feature (1111)..(1111): n is a, c, g, or t
  misc_feature (1113)..(1113): n is a, c, g, or t
  misc_feature (1117)..(1117): n is a, c, g, or t
  misc_feature (1119)..(1119): n is a, c, g, or t
  misc_feature (1123)..(1123): n is a, c, g, or t
  misc_feature (1125)..(1125): n is a, c, g, or t
  misc_feature (1127)..(1132): n is a, c, g, or t
  misc_feature (1134)..(1134): n is a, c, g, or t
  misc_feature (1137)..(1143): n is a, c, g, or t
  misc_feature (1145)..(1147): n is a, c, g, or t
  misc_feature (1149)..(1151): n is a, c, g, or t
  misc_feature (1153)..(1153): n is a, c, g, or t
  misc_feature (1155)..(1164): n is a, c, g, or t
  misc_feature (1166)..(1167): n is a, c, g, or t
  misc_feature (1172)..(1172): n is a, c, g, or t
  misc_feature (1174)..(1177): n is a, c, g, or t
  misc_feature (1183)..(1188): n is a, c, g, or t
  misc_feature (1190)..(1195): n is a, c, g, or t
  misc_feature (1197)..(1202): n is a, c, g, or t
  misc_feature (1204)..(1204): n is a, c, g, or t
  misc_feature (1206)..(1211): n is a, c, g, or t
  misc_feature (1213)..(1216): n is a, c, g, or t
  misc_feature (1218)..(1221): n is a, c, g, or t
  misc_feature (1224)..(1225): n is a, c, g, or t
  misc_feature (1227)..(1230): n is a, c, g, or t
  misc_feature (1232)..(1235): n is a, c, g, or t
  misc_feature (1237)..(1237): n is a, c, g, or t
  misc_feature (1239)..(1242): n is a, c, g, or t
  misc_feature (1248)..(1249): n is a, c, g, or t
  misc_feature (1252)..(1254): n is a, c, g, or t
  misc_feature (1256)..(1256): n is a, c, g, or t
  misc_feature (1259)..(1262): n is a, c, g, or t
  misc_feature (1264)..(1264): n is a, c, g, or t
  misc_feature (1268)..(1271): n is a, c, g, or t
  misc_feature (1273)..(1273): n is a, c, g, or t
  misc_feature (1275)..(1276): n is a, c, g, or t
  misc_feature (1278)..(1278): n is a, c, g, or t
  misc_feature (1280)..(1281): n is a, c, g, or t
  misc_feature (1283)..(1283): n is a, c, g, or t
  misc_feature (1285)..(1285): n is a, c, g, or t
  misc_feature (1287)..(1287): n is a, c, g, or t
  misc_feature (1289)..(1291): n is a, c, g, or t
  misc_feature (1293)..(1302): n is a, c, g, or t
  misc_feature (1304)..(1304): n is a, c, g, or t
  misc_feature (1307)..(1309): n is a, c, g, or t
  misc_feature (1311)..(1311): n is a, c, g, or t
  misc_feature (1313)..(1314): n is a, c, g, or t
  misc_feature (1316)..(1323): n is a, c, g, or t
  misc_feature (1325)..(1330): n is a, c, g, or t
  misc_feature (1332)..(1340): n is a, c, g, or t
  misc_feature (1342)..(1352): n is a, c, g, or t
  misc_feature (1355)..(1356): n is a, c, g, or t
  misc_feature (1359)..(1363): n is a, c, g, or t
  misc_feature (1365)..(1368): n is a, c, g, or t
  misc_feature (1371)..(1372): n is a, c, g, or t
  misc_feature (1374)..(1382): n is a, c, g, or t
  misc_feature (1385)..(1385): n is a, c, g, or t
  misc_feature (1388)..(1389): n is a, c, g, or t
  misc_feature (1393)..(1395): n is a, c, g, or t
  misc_feature (1397)..(1397): n is a, c, g, or t
  misc_feature (1400)..(1405): n is a, c, g, or t
  misc_feature (1407)..(1407): n is a, c, g, or t
  misc_feature (1410)..(1411): n is a, c, g, or t
  misc_feature (1414)..(1416): n is a, c, g, or t
  misc_feature (1418)..(1422): n is a, c, g, or t
  misc_feature (1424)..(1429): n is a, c, g, or t
  misc_feature (1431)..(1431): n is a, c, g, or t
  misc_feature (1433)..(1433): n is a, c, g, or t
  misc_feature (1435)..(1435): n is a, c, g, or t
  misc_feature (1438)..(1439): n is a, c, g, or t
  misc_feature (1441)..(1447): n is a, c, g, or t
  misc_feature (1450)..(1450): n is a, c, g, or t
  misc_feature (1452)..(1454): n is a, c, g, or t
  misc_feature (1456)..(1456): n is a, c, g, or t
  misc_feature (1458)..(1458): n is a, c, g, or t
  misc_feature (1461)..(1463): n is a, c, g, or t
  misc_feature (1466)..(1469): n is a, c, g, or t
  misc_feature (1960)..(1960): n is a, c, g, or t
  misc_feature (2142)..(2142): n is a, c, g, or t
  misc_feature (2213)..(2213): n is a, c, g, or t
  misc_feature (2388)..(2388): n is a, c, g, or t
  misc_feature (2390)..(2390): n is a, c, g, or t
  misc_feature (2400)..(2400): n is a, c, g, or t
  misc_feature (2403)..(2403): n is a, c, g, or t
  misc_feature (2407)..(2407): n is a, c, g, or t
  misc_feature (2532)..(2532): n is a, c, g, or t
  misc_feature (2617)..(2617): n is a, c, g, or t
  misc_feature (2664)..(2664): n is a, c, g, or t
  misc_feature (2677)..(2677): n is a, c, g, or t
  misc_feature (2814)..(2814): n is a, c, g, or t
  misc_feature (2820)..(2820): n is a, c, g, or t
  misc_feature (2853)..(2853): n is a, c, g, or t
  misc_feature (2901)..(2901): n is a, c, g, or t
  misc_feature (2911)..(2911): n is a, c, g, or t
  misc_feature (2913)..(2913): n is a, c, g, or t
  misc_feature (3054)..(3054): n is a, c, g, or t
  misc_feature (3060)..(3060): n is a, c, g, or t
  misc_feature (3087)..(3087): n is a, c, g, or t
  misc_feature (3144)..(3144): n is a, c, g, or t
  misc_feature (3177)..(3177): n is a, c, g, or t
  misc_feature (3249)..(3249): n is a, c, g, or t
  misc_feature (3252)..(3252): n is a, c, g, or t
  misc_feature (3258)..(3258): n is a, c, g, or t
  misc_feature (3315)..(3315): n is a, c, g, or t
  misc_feature (3324)..(3324): n is a, c, g, or t
  misc_feature (3360)..(3360): n is a, c, g, or t
  misc_feature (3472)..(3472): n is a, c, g, or t
  misc_feature (3512)..(3512): n is a, c, g, or t
  misc_feature (3519)..(3519): n is a, c, g, or t
  misc_feature (3554)..(3555): n is a, c, g, or t
  misc_feature (3562)..(3562): n is a, c, g, or t
  misc_feature (3568)..(3568): n is a, c, g, or t
  misc_feature (3572)..(3572): n is a, c, g, or t
  misc_feature (3574)..(3575): n is a, c, g, or t
  misc_feature (3579)..(3579): n is a, c, g, or t
  misc_feature (3581)..(3581): n is a, c, g, or t
  misc_feature (3586)..(3587): n is a, c, g, or t
  misc_feature (3590)..(3593): n is a, c, g, or t
  misc_feature (3598)..(3599): n is a, c, g, or t
  misc_feature (3602)..(3605): n is a, c, g, or t
  misc_feature (3607)..(3613): n is a, c, g, or t
  misc_feature (3616)..(3617): n is a, c, g, or t
  misc_feature (3619)..(3621): n is a, c, g, or t
  misc_feature (3625)..(3625): n is a, c, g, or t
  misc_feature (3627)..(3629): n is a, c, g, or t
  misc_feature (3631)..(3634): n is a, c, g, or t
  misc_feature (3638)..(3638): n is a, c, g, or t
  misc_feature (3640)..(3640): n is a, c, g, or t
  misc_feature (3643)..(3643): n is a, c, g, or t
  misc_feature (3645)..(3646): n is a, c, g, or t
  misc_feature (3648)..(3648): n is a, c, g, or t
  misc_feature (3651)..(3652): n is a, c, g, or t
  misc_feature (3659)..(3660): n is a, c, g, or t
  misc_feature (3662)..(3662): n is a, c, g, or t
  misc_feature (3666)..(3667): n is a, c, g, or t
  misc_feature (3669)..(3671): n is a, c, g, or t
  misc_feature (3675)..(3675): n is a, c, g, or t
  misc_feature (3680)..(3681): n is a, c, g, or t
  misc_feature (3683)..(3683): n is a, c, g, or t
  misc_feature (3686)..(3687): n is a, c, g, or t
  misc_feature (3689)..(3690): n is a, c, g, or t
  misc_feature (3692)..(3694): n is a, c, g, or t
  misc_feature (3696)..(3697): n is a, c, g, or t
  misc_feature (3699)..(3703): n is a, c, g, or t
  misc_feature (3705)..(3705): n is a, c, g, or t
  misc_feature (3709)..(3712): n is a, c, g, or t
  misc_feature (3715)..(3718): n is a, c, g, or t
  misc_feature (3720)..(3721): n is a, c, g, or t
  misc_feature (3728)..(3732): n is a, c, g, or t
  misc_feature (3738)..(3739): n is a, c, g, or t
  misc_feature (3741)..(3742): n is a, c, g, or t
  misc_feature (3745)..(3747): n is a, c, g, or t
  misc_feature (3755)..(3757): n is a, c, g, or t
  misc_feature (3759)..(3760): n is a, c, g, or t
  misc_feature (3762)..(3762): n is a, c, g, or t
  misc_feature (3764)..(3764): n is a, c, g, or t
  misc_feature (3766)..(3767): n is a, c, g, or t
  misc_feature (3769)..(3769): n is a, c, g, or t
  misc_feature (3772)..(3776): n is a, c, g, or t
  misc_feature (3778)..(3779): n is a, c, g, or t
  misc_feature (3782)..(3783): n is a, c, g, or t
  misc_feature (3785)..(3785): n is a, c, g, or t
  misc_feature (3787)..(3788): n is a, c, g, or t
  misc_feature (3791)..(3793): n is a, c, g, or t
  misc_feature (3797)..(3797): n is a, c, g, or t
  misc_feature (3800)..(3801): n is a, c, g, or t
  misc_feature (3804)..(3805): n is a, c, g, or t
  misc_feature (3809)..(3811): n is a, c, g, or t
  misc_feature (3813)..(3813): n is a, c, g, or t
  misc_feature (3815)..(3820): n is a, c, g, or t
  misc_feature (3822)..(3824): n is a, c, g, or t
  misc_feature (3826)..(3832): n is a, c, g, or t
  misc_feature (3837)..(3837): n is a, c, g, or t
  misc_feature (3839)..(3840): n is a, c, g, or t
  misc_feature (3842)..(3842): n is a, c, g, or t
  misc_feature (3844)..(3846): n is a, c, g, or t
  misc_feature (3848)..(3851): n is a, c, g, or t
  misc_feature (3853)..(3853): n is a, c, g, or t
  misc_feature (3855)..(3856): n is a, c, g, or t
  misc_feature (3858)..(3861): n is a, c, g, or t
  misc_feature (3863)..(3865): n is a, c, g, or t
  misc_feature (3867)..(3868): n is a, c, g, or t
  misc_feature (3870)..(3870): n is a, c, g, or t
  misc_feature (3872)..(3872): n is a, c, g, or t
  misc_feature (3874)..(3876): n is a, c, g, or t
  misc_feature (3878)..(3878): n is a, c, g, or t
  misc_feature (3880)..(3881): n is a, c, g, or t
  misc_feature (3883)..(3883): n is a, c, g, or t
  misc_feature (3885)..(3888): n is a, c, g, or t
  misc_feature (3890)..(3890): n is a, c, g, or t
  misc_feature (3892)..(3904): n is a, c, g, or t
  misc_feature (3907)..(3908): n is a, c, g, or t
  misc_feature (3916)..(3920): n is a, c, g, or t
  misc_feature (3923)..(3925): n is a, c, g, or t
  misc_feature (3928)..(3933): n is a, c, g, or t
  misc_feature (3935)..(3949): n is a, c, g, or t
  misc_feature (3951)..(3954): n is a, c, g, or t
  misc_feature (3956)..(3956): n is a, c, g, or t
  misc_feature (3958)..(3966): n is a, c, g, or t
  misc_feature (3968)..(3969): n is a, c, g, or t
  misc_feature (3971)..(3977): n is a, c, g, or t
  misc_feature (3979)..(3982): n is a, c, g, or t
  misc_feature (3984)..(3988): n is a, c, g, or t
  misc_feature (3990)..(3990): n is a, c, g, or t
  misc_feature (3992)..(4000): n is a, c, g, or t
nnaannnnngnnngnnnnngnnnannnnngnnnaannnntnangnnnnntnnnnnnannnnnnnnnnnnnnnnnnccnnnannaaancnntnccnnnncnnnnttnnnnggnnnnnnttnnntnnncnnnnnttncntttncnnnnnnncngnaaannnngntttnnangnnnttnnnnnnnnggnnaangnnggggnaaaannnnntnntnnnggnnncnnnggntnnngnaannncnnnnnttnnaannntnntnnnggnantnnnggnanncnagggggnnnnnnttncnntngnnannnggnnnnttnnnnccntnccnnngnaanncnnnttnnntnnnnttncnnnnntnnannngnanntnttnnttttnnnngnnnnnnnnnnnnnnannntnnnnnnnttnnaaaannnnnnnnannannnnntnannnngncnntnnaaangncngnttnaaaaannnnnnttnngnnnaangnntngnnnnnnccnnnngggnaaanngnnnngnnnnttncngnngnnnanngnnaannannnannntnncnnnannnntnntnnnaaaancccnnntnntnntnncnnnnnnnntnncnnnnnnttngnnnangnaaannnnnnnnnngnnntngnntnccnnntnnncntngnnnannnnnnngnnnntttngnnnnncnnnnnttngnnnncnnnantttnannnnnnnnnnnnngnnnnnnnnnntnaaannangnnnanntttngnagnangnnnnntnnnnnnnnntnnngnaaannanggnnnnntttnnnnnnnnnttnnnnnngnnnnnnnaaannnnnnnnnnnnaaaannnnnnnnntnntnnnngnnnnnnaaannannnannangnnnannnnnnnannnnanannnnngnnnnnggnaannannnnnnnnnnttnnnnnnnntnntnannntnnnnnaannnnnaangnnnnnnnntnnnaaaaanntnannnannannnnntttnnnnnnnnnannanntngnaaannnnntnnnnnaaaaannnnngnngnnnnntnnngntncngnttnnntnnnnannnnnnnnnanttttnnnnancnannnnncnnnantnaaangntttnancnnnnnngnttnnnnnnnannnannnantnnnnnnnnnntnnaaggncnnnnaaaaannnnnnannnnnntnnnnnnantnnnnnngnnnnannnnttnnannnnannnncngnnnnaaaaannaannngnaannnnantttnnnntnanntngnnantnangnnnannnnnnnnnncnggnnntngnnannnnnnnngnnnnnngnnnnnnnnnannnnnnnnnnnttnnaannnnnannnnttnncnnnnnnnnnaanggnnaaannngnaannnnnnanttnnttnnngnnnnntnnnnnntngnanttnntnnnnnnnccnannntngnaannnaannnnatttcagaaatcaattcttgacaatttgaagaactttatcttagaaattggaaaagatttttcctttataagtaatgagtatagagtacaggttggaaaccatgattactatattgatttgttattttatcatagaggtctgtcctgcttagtggcttttgaacttaagattggagaattcaagccggaatatattgggaaaatgaatctatatttggaagcattggatagagaagtgaagaaacaaagcgaaaatccaagtgttggagtcatactttgtgcatcaaaagatgatgaggtggtagagtttgcattaagcagaagtctttcaccaacaatggtatcagagtatacattgaaacttattgatagggggttgttacaaagaaagcttagagagtatacagaaattgctgaagaagcaaatgaataaaatcatattatggttatgataagctacagattttttcatgaaatgtgagaaaaaggcnaaaagtggctcataaaatgtgagaaaaaggcgaaaagtggctcatgaaatgtgatgaaaggcgttgaagtggctatttttttgtgataccatccctctatggaggggtgaaaaatgtattttaaaagaaagatagatgattttttgcaggaatggaaggcggatgccaagcataagcctttnattattaagggcgccagacaaataggaaagacggaatccattttacattttgcaaaacagaactataaaantatcgtttatatcaattttgctctggaaaaaaagttcatgcagattttagcagatgggtatgatgtggaaagtgtgaccagaaatatcaccttggcagacccgtctattcagtttattccgaaggaaagcattattctttttgatgaaatacaggaaaatcctgatgtggctacnancttgaaatcnttncatngagatggaaattacgatgtgatttgtagcggttccatgctgggcataaattataaaagaattcacagtaatagcgttggctctaaaacggactatgaaatgttttccatggattttgaagaattnctttgggcaaagggctatagggaggagcagattgccagtatccttagccacatgctggagaacaagccatttaacgagaatgagntctccattttcaaagagctctttctcacctactcagtcctggggggnatgccggatgtgntaaagcagtatttggagacaggaacattttccggtacactggatttgcagaatcagattcgcttggactatgaagaggatgtcagaaagtacgcagagggcttggatcagacgaagattatcagtgtctatcgaagnattccngctcagctggctaaggaaaataagaaatttcantttaataaggtggcgaagaatgccagatcccgggaatatagcggctgnatcgattggntnaaggatgcaggcatcatcatggaatgtaactgcctccaattccccgagcttcctttaaagggaaatgtcgaagaaagcaaatacaaactatattatatggataccggtctgttgatttcttccttggatgaggaggcgcangaggancttagagtcaataagaatctgggggtntacaagggggctttgtatgaaaactttgttgcagaggcttttgtgaagcaaggcttnggactctattactataagaaggaaaatgccagnctggaggaagatttttttgtgcgtacccaaaatgctttggttccggtagaggtgaaggctaatagcaatcantcnaaggcnctttccgccttgattagcaataagcgatatcaggatatttcctttgggataaaactnggagatgtnaatgtgggatatgccaatcagatttataccttcccntatttttgtgcctttaaattgaaggagtatttgaagaaaaaggattttcatatggacatgtgagttatagaaattcgaagaaaagtatcgatgttagctcattagaatttgnttagttccttagagtaatgtatgagcattgtgtattgtcngatgctntaaaattgttctaagaccttatatagaaagtaagnnaatatgngtaaanaagnannaatnantggannagnnnnttctnnctnnnntnnnnnnntanntnnnttgnannntnnnnattnantananntntannaaaaaannanaatnncnnntggngagtnngnagnntnnannngnnannnnnancatnnnnatnnnngnnttcattnnnnngttggnngnnatnnngatgaacnnntnnanananngnggnnnnntnnagnngntnnttnnnatanttnnganntttnnngngnnnnnnannntnnnnnnntggananngncnnngnnnnantnnannnntnnngnnantnannnanannangnnnngngnnnnnnnnnnnnnctnnagaagatnnnnnagnnntannnnnntnnnnnnnnnnnnnnnannnntnannnnnnnnnanncnnnnnnntnnnntnnnnntngnnnnnnnnn

SEQ ID NO: 863 - DNA, 4000 bp, Escherichia coli
  misc_feature (366)..(366): n is a, c, g, or t
  misc_feature (1228)..(1228): n is a, c, g, or t
  misc_feature (1968)..(1968): n is a, c, g, or t
  misc_feature (1984)..(1988): n is a, c, g, or t
  misc_feature (2789)..(2789): n is a, c, g, or t
  misc_feature (2851)..(2853): n is a, c, g, or t
  misc_feature (2855)..(2856): n is a, c, g, or t
  misc_feature (2858)..(2864): n is a, c, g, or t
  misc_feature (2868)..(2871): n is a, c, g, or t
  misc_feature (2874)..(2874): n is a, c, g, or t
  misc_feature (2876)..(2877): n is a, c, g, or t
  misc_feature (2880)..(2885): n is a, c, g, or t
  misc_feature (2887)..(2888): n is a, c, g, or t
  misc_feature (2890)..(2894): n is a, c, g, or t
  misc_feature (2897)..(2898): n is a, c, g, or t
  misc_feature (2901)..(2902): n is a, c, g, or t
  misc_feature (2904)..(2906): n is a, c, g, or t
  misc_feature (2908)..(2909): n is a, c, g, or t
  misc_feature (2911)..(2912): n is a, c, g, or t
  misc_feature (2914)..(2918): n is a, c, g, or t
  misc_feature (2921)..(2922): n is a, c, g, or t
  misc_feature (2924)..(2924): n is a, c, g, or t
  misc_feature (2926)..(2931): n is a, c, g, or t
  misc_feature (2933)..(2934): n is a, c, g, or t
  misc_feature (2936)..(2936): n is a, c, g, or t
  misc_feature (2938)..(2942): n is a, c, g, or t
  misc_feature (2944)..(2944): n is a, c, g, or t
  misc_feature (2948)..(2951): n is a, c, g, or t
  misc_feature (2953)..(2958): n is a, c, g, or t
  misc_feature (2960)..(2967): n is a, c, g, or t
  misc_feature (2970)..(2971): n is a, c, g, or t
  misc_feature (2973)..(2981): n is a, c, g, or t
  misc_feature (2983)..(2985): n is a, c, g, or t
  misc_feature (2987)..(2987): n is a, c, g, or t
  misc_feature (2989)..(2992): n is a, c, g, or t
  misc_feature (2994)..(2994): n is a, c, g, or t
  misc_feature (3138)..(3142): n is a, c, g, or t
  misc_feature (3147)..(3153): n is a, c, g, or t
  misc_feature (3155)..(3158): n is a, c, g, or t
  misc_feature (3161)..(3161): n is a, c, g, or t
  misc_feature (3173)..(3176): n is a, c, g, or t
  misc_feature (3180)..(3180): n is a, c, g, or t
  misc_feature (3182)..(3182): n is a, c, g, or t
  misc_feature (3185)..(3186): n is a, c, g, or t
  misc_feature (3189)..(3190): n is a, c, g, or t
  misc_feature (3193)..(3193): n is a, c, g, or t
  misc_feature (3195)..(3195): n is a, c, g, or t
  misc_feature (3197)..(3198): n is a, c, g, or t
  misc_feature (3203)..(3203): n is a, c, g, or t
  misc_feature (3206)..(3209): n is a, c, g, or t
  misc_feature (3211)..(3211): n is a, c, g, or t
  misc_feature (3213)..(3214): n is a, c, g, or t
  misc_feature (3217)..(3219): n is a, c, g, or t
  misc_feature (3222)..(3222): n is a, c, g, or t
  misc_feature (3225)..(3225): n is a, c, g, or t
  misc_feature (3227)..(3227): n is a, c, g, or t
  misc_feature (3232)..(3232): n is a, c, g, or t
  misc_feature (3234)..(3235): n is a, c, g, or t
  misc_feature (3237)..(3238): n is a, c, g, or t
  misc_feature (3240)..(3240): n is a, c, g, or t
  misc_feature (3242)..(3242): n is a, c, g, or t
  misc_feature (3245)..(3247): n is a, c, g, or t
  misc_feature (3251)..(3253): n is a, c, g, or t
  misc_feature (3255)..(3255): n is a, c, g, or t
  misc_feature (3257)..(3257): n is a, c, g, or t
  misc_feature (3259)..(3259): n is a, c, g, or t
  misc_feature (3262)..(3262): n is a, c, g, or t
  misc_feature (3267)..(3267): n is a, c, g, or t
  misc_feature (3273)..(3274): n is a, c, g, or t
  misc_feature (3276)..(3277): n is a, c, g, or t
  misc_feature (3279)..(3279): n is a, c, g, or t
  misc_feature (3281)..(3283): n is a, c, g, or t
  misc_feature (3287)..(3289): n is a, c, g, or t
  misc_feature (3291)..(3300): n is a, c, g, or t
  misc_feature (3302)..(3302): n is a, c, g, or t
  misc_feature (3304)..(3306): n is a, c, g, or t
  misc_feature (3308)..(3308): n is a, c, g, or t
  misc_feature (3310)..(3311): n is a, c, g, or t
  misc_feature (3314)..(3318): n is a, c, g, or t
  misc_feature (3320)..(3322): n is a, c, g, or t
  misc_feature (3324)..(3328): n is a, c, g, or t
  misc_feature (3331)..(3331): n is a, c, g, or t
  misc_feature (3333)..(3333): n is a, c, g, or t
  misc_feature (3335)..(3337): n is a, c, g, or t
  misc_feature (3340)..(3340): n is a, c, g, or t
  misc_feature (3343)..(3344): n is a, c, g, or t
  misc_feature (3346)..(3346): n is a, c, g, or t
  misc_feature (3348)..(3348): n is a, c, g, or t
  misc_feature (3350)..(3350): n is a, c, g, or t
  misc_feature (3352)..(3352): n is a, c, g, or t
  misc_feature (3354)..(3357): n is a, c, g, or t
  misc_feature (3361)..(3361): n is a, c, g, or t
  misc_feature (3363)..(3366): n is a, c, g, or t
  misc_feature (3369)..(3370): n is a, c, g, or t
  misc_feature (3372)..(3374): n is a, c, g, or t
  misc_feature (3379)..(3379): n is a, c, g, or t
  misc_feature (3382)..(3382): n is a, c, g, or t
  misc_feature (3385)..(3385): n is a, c, g, or t
  misc_feature (3387)..(3387): n is a, c, g, or t
  misc_feature (3389)..(3389): n is a, c, g, or t
  misc_feature (3391)..(3394): n is a, c, g, or t
  misc_feature (3397)..(3398): n is a, c, g, or t
  misc_feature (3401)..(3401): n is a, c, g, or t
  misc_feature (3410)..(3411): n is a, c, g, or t
  misc_feature (3413)..(3415): n is a, c, g, or t
  misc_feature (3417)..(3417): n is a, c, g, or t
  misc_feature (3420)..(3423): n is a, c, g, or t
  misc_feature (3425)..(3425): n is a, c, g, or t
  misc_feature (3430)..(3430): n is a, c, g, or t
  misc_feature (3432)..(3432): n is a, c, g, or t
  misc_feature (3434)..(3434): n is a, c, g, or t
  misc_feature (3437)..(3437): n is a, c, g, or t
  misc_feature (3440)..(3441): n is a, c, g, or t
  misc_feature (3445)..(3445): n is a, c, g, or t
  misc_feature (3447)..(3448): n is a, c, g, or t
  misc_feature (3453)..(3454): n is a, c, g, or t
  misc_feature (3459)..(3460): n is a, c, g, or t
  misc_feature (3462)..(3462): n is a, c, g, or t
  misc_feature (3464)..(3464): n is a, c, g, or t
  misc_feature (3466)..(3467): n is a, c, g, or t
  misc_feature (3471)..(3471): n is a, c, g, or t
  misc_feature (3476)..(3477): n is a, c, g, or t
  misc_feature (3480)..(3480): n is a, c, g, or t
  misc_feature (3482)..(3486): n is a, c, g, or t
  misc_feature (3488)..(3490): n is a, c, g, or t
  misc_feature (3493)..(3493): n is a, c, g, or t
  misc_feature (3500)..(3501): n is a, c, g, or t
  misc_feature (3506)..(3510): n is a, c, g, or t
  misc_feature (3512)..(3513): n is a, c, g, or t
  misc_feature (3515)..(3515): n is a, c, g, or t
  misc_feature (3517)..(3521): n is a, c, g, or t
  misc_feature (3525)..(3528): n is a, c, g, or t
  misc_feature (3531)..(3534): n is a, c, g, or t
  misc_feature (3536)..(3537): n is a, c, g, or t
  misc_feature (3541)..(3541): n is a, c, g, or t
  misc_feature (3543)..(3544): n is a, c, g, or t
  misc_feature (3547)..(3547): n is a, c, g, or t
  misc_feature (3551)..(3552): n is a, c, g, or t
  misc_feature (3554)..(3554): n is a, c, g, or t
  misc_feature (3556)..(3558): n is a, c, g, or t
  misc_feature (3560)..(3566): n is a, c, g, or t
  misc_feature (3570)..(3571): n is a, c, g, or t
  misc_feature (3573)..(3573): n is a, c, g, or t
  misc_feature (3576)..(3577): n is a, c, g, or t
  misc_feature (3580)..(3580): n is a, c, g, or t
  misc_feature (3582)..(3582): n is a, c, g, or t
  misc_feature (3586)..(3587): n is a, c, g, or t
  misc_feature (3590)..(3593): n is a, c, g, or t
  misc_feature (3597)..(3597): n is a, c, g, or t
  misc_feature (3604)..(3604): n is a, c, g, or t
  misc_feature (3610)..(3611): n is a, c, g, or t
  misc_feature (3615)..(3617): n is a, c, g, or t
  misc_feature (3620)..(3622): n is a, c, g, or t
  misc_feature (3625)..(3625): n is a, c, g, or t
  misc_feature (3627)..(3630): n is a, c, g, or t
  misc_feature (3633)..(3639): n is a, c, g, or t
  misc_feature (3642)..(3643): n is a, c, g, or t
  misc_feature (3645)..(3645): n is a, c, g, or t
  misc_feature (3648)..(3649): n is a, c, g, or t
  misc_feature (3651)..(3651): n is a, c, g, or t
  misc_feature (3656)..(3656): n is a, c, g, or t
  misc_feature (3658)..(3658): n is a, c, g, or t
  misc_feature (3663)..(3670): n is a, c, g, or t
  misc_feature (3675)..(3675): n is a, c, g, or t
  misc_feature (3677)..(3677): n is a, c, g, or t
  misc_feature (3681)..(3681): n is a, c, g, or t
  misc_feature (3683)..(3685): n is a, c, g, or t
  misc_feature (3689)..(3692): n is a, c, g, or t
  misc_feature (3694)..(3695): n is a, c, g, or t
  misc_feature (3697)..(3697): n is a, c, g, or t
  misc_feature (3700)..(3702): n is a, c, g, or t
  misc_feature (3707)..(3709): n is a, c, g, or t
  misc_feature (3712)..(3713): n is a, c, g, or t
  misc_feature (3718)..(3718): n is a, c, g, or t
  misc_feature (3720)..(3721): n is a, c, g, or t
  misc_feature (3726)..(3726): n is a, c, g, or t
  misc_feature (3728)..(3730): n is a, c, g, or t
  misc_feature (3733)..(3733): n is a, c, g, or t
  misc_feature (3735)..(3736): n is a, c, g, or t
  misc_feature (3742)..(3742): n is a, c, g, or t
  misc_feature (3744)..(3744): n is a, c, g, or t
  misc_feature (3746)..(3746): n is a, c, g, or t
  misc_feature (3748)..(3751): n is a, c, g, or t
  misc_feature (3753)..(3753): n is a, c, g, or t
  misc_feature (3755)..(3755): n is a, c, g, or t
  misc_feature (3758)..(3758): n is a, c, g, or t
  misc_feature (3761)..(3761): n is a, c, g, or t
  misc_feature (3768)..(3769): n is a, c, g, or t
  misc_feature (3772)..(3773): n is a, c, g, or t
  misc_feature (3775)..(3775): n is a, c, g, or t
  misc_feature (3777)..(3777): n is a, c, g, or t
  misc_feature (3781)..(3781): n is a, c, g, or t
  misc_feature (3783)..(3783): n is a, c, g, or t
  misc_feature (3787)..(3789): n is a, c, g, or t
  misc_feature (3791)..(3791): n is a, c, g, or t
  misc_feature (3793)..(3795): n is a, c, g, or t
  misc_feature (3797)..(3798): n is a, c, g, or t
  misc_feature (3803)..(3806): n is a, c, g, or t
  misc_feature (3809)..(3809): n is a, c, g, or t
  misc_feature (3811)..(3811): n is a, c, g, or t
  misc_feature (3814)..(3814): n is a, c, g, or t
  misc_feature (3816)..(3816): n is a, c, g, or t
  misc_feature (3819)..(3819): n is a, c, g, or t
  misc_feature (3821)..(3821): n is a, c, g, or t
  misc_feature (3826)..(3826): n is a, c, g, or t
  misc_feature (3828)..(3828): n is a, c, g, or t
  misc_feature (3830)..(3832): n is a, c, g, or t
  misc_feature (3836)..(3840): n is a, c, g, or t
  misc_feature (3842)..(3842): n is a, c, g, or t
  misc_feature (3847)..(3848): n is a, c, g, or t
  misc_feature (3850)..(3852): n is a, c, g, or t
  misc_feature (3854)..(3854): n is a, c, g, or t
  misc_feature (3856)..(3859): n is a, c, g, or t
  misc_feature (3861)..(3864): n is a, c, g, or t
  misc_feature (3867)..(3867): n is a, c, g, or t
  misc_feature (3869)..(3870): n is a, c, g, or t
  misc_feature (3872)..(3872): n is a, c, g, or t
  misc_feature (3874)..(3874): n is a, c, g, or t
  misc_feature (3877)..(3877): n is a, c, g, or t
  misc_feature (3879)..(3880): n is a, c, g, or t
  misc_feature (3882)..(3882): n is a, c, g, or t
  misc_feature (3885)..(3886): n is a, c, g, or t
  misc_feature (3889)..(3889): n is a, c, g, or t
  misc_feature (3892)..(3894): n is a, c, g, or t
  misc_feature (3901)..(3902): n is a, c, g, or t
  misc_feature (3905)..(3906): n is a, c, g, or t
  misc_feature (3908)..(3909): n is a, c, g, or t
  misc_feature (3911)..(3912): n is a, c, g, or t
  misc_feature (3914)..(3917): n is a, c, g, or t
  misc_feature (3919)..(3922): n is a, c, g, or t
  misc_feature (3931)..(3932): n is a, c, g, or t
  misc_feature (3935)..(3935): n is a, c, g, or t
  misc_feature (3938)..(3938): n is a, c, g, or t
  misc_feature (3943)..(3946): n is a, c, g, or t
  misc_feature (3948)..(3951): n is a, c, g, or t
  misc_feature (3954)..(3956): n is a, c, g, or t
  misc_feature (3958)..(3958): n is a, c, g, or t
  misc_feature (3960)..(3960): n is a, c, g, or t
  misc_feature (3962)..(3963): n is a, c, g, or t
  misc_feature (3966)..(3966): n is a, c, g, or t
  misc_feature (3968)..(3968): n is a, c, g, or t
  misc_feature (3971)..(3973): n is a, c, g, or t
  misc_feature (3975)..(3976): n is a, c, g, or t
  misc_feature (3978)..(3978): n is a, c, g, or t
  misc_feature (3981)..(3981): n is a, c, g, or t
  misc_feature (3983)..(3983): n is a, c, g, or t
  misc_feature (3985)..(3990): n is a, c, g, or t
  misc_feature (3992)..(3993): n is a, c, g, or t
  misc_feature (3995)..(3995): n is a, c, g, or t
  misc_feature (3997)..(3997): n is a, c, g, or t
  misc_feature (3999)..(4000): n is a, c, g, or t
aatgttattctattatcagattcttttagaataatatcttttggaggtgcaggaatatctatacctacaaaagtttcctttacggcagctagtccttttcctacattattataagcaattattgaatattgattaattccttgagtaggagaattatctgtataatggagttgtacatttggactaggattttcgaatgtagttataagctttgcattcctgtatatttctactttggtaagcgattctatacgtgaaccatcataagctttcgtaggagttgtaaaagaaatatctgtagttaaagttccttgttgtcctggctttatatcaattatagaagttgctgcaggagctgcaagaagngctttctctgaaatagaaatatcatcaataaataaatagtattgatctgctttactcatagcatgtacacctattctataatctccatcttcctttacagtaaattctgtttcattattttgaaatgaatctactgcggtttctatacgtggaactattattttatagttttctgtatcaatttctgttcctatcccaacttcaaaagtttcagtataactccaaaatcctgcgcgatatttaaaattgagcatataagcgtgcttattatcgagcttgatattaggcgataaaagccaatcgtcagctgcaagtgttttactattgttatatcgcgctgctttcacacgactatcataagtccaagtacactcatcattatttttattaaccaccataaatgtttcgaatgctgccttatcgtcgaagttctgtacatatcgtgaattattttctgtatctgttttggtcagaactttacgatttgttttaacagacattactgttggcaattttgttttaactgcattctgcatagtaatacgctgttgcgcagatagcaaagaagtctgcaaaatacagagatatactgttgtaaatacaaataacttatattgtttcataacacatctccctataattgtttatttaataaaggtttttcgtataacaccatttggcatcacttctataacaataccagaatagttagctggtgcaatttgtccatcaagcttatatatagctattggttttgttttctctgtcgttacatttatgttcgttggtataccacagaaagatgtaaactctttaaaaacattatctgttttatacttctcaatagatgtttctggaacanaaagtgtacatttcgatttatcaacaccatagaaaggataaatgccacatattggtggattatcagaataacagtataagtttctcattgccttacaagaataaaaggcatagtcgcctatattagttacagtagagggtaatgagactctaactaataatttattgtttgcacaaaaactagcaggtataatggttgttccttctggaattgaaatggctgttagtttaggacaatcagaaaaacttccttctccaaaagttgtaagtgtagttggtaattctatgttttctaaagatttacaacctgcgaaacaccaattgccaagtgatataattccattagacatcactatttttgagagatttgcacaagaaccaaatgcactatttccaattgtttctactttagatggtaaatacaactctgtaagttttgaacaattaaagaaaccacatttctttatatcctttaaagtagatggcaaaacaacttcagtaagtcctgtacttagatgaaaagcatattcgccaacaacaataactgtctgaggtatttcataagctccttttttatacagtgggtaacgtaaaatttctgtcatcgatttgttgaaaagtactccatctaccgatttataatatggattatcatctgccacatttatattttccaaccgtgtacaataattaaaagcacttgcagatattgaagttaccgatgctggaatttctattaangaaatctttttacaannnnngtatttacaaccgattattactcaatattttatagataataagtcagaaatatggttgttatttttaattgcacattctaaaaggtgaagatttaacgcttttattgattattaactcaaaaaggacatcaacttgggtcgtttcttctcttttccttgctattcgtttccgatattccacttttgttttggtctatctcatatgtactgcaaaggtattgatttttgtttgatattgctccttgcttgctccttgtcgtagattaattttcacacaggaatttttgttctctttctataggggcttgaaacaatccatttattggaaacaattaaagacggagctggtttgccccagtgctttttaagaaacagggcaattattttatctccacaaaggctcttgttcccaattatgaggaaagcctaataaacgagttcttactgatgggtatttcgataaaagctgcttgaaatctgcaacaaaagtgttgcccatagaaatggagttaagccaatacaccacatagcagagttgcggataaagtgtttgttcacggaacgagaaatccgtaatccatgtgtttggcatacgcataggcatcattggcttgacaggaaagacccgatttgacagtcttgaatgatgggcgcagcaattacgaagtacgggtctgggtacggattaaaaggctaagtgattatttccagtcatttagcctttttaattatctaatttttccccacattttccccacagctgtctatttatatattttagaaacatatttttccgtaaanttatgtacctttgtcggcaaataaagatattctcgtcaaacaaatataaataatataaacannnannannnnnnnaaannnnaantnntannnnnnannannnnnttnnttnncnnntnnanntnnnnnttnncntnnnnnnannantnnnnnanaaannnnannnnnnannnnnnnntannannnnnnnnnannnanannnntncatttttaaggggggatattgtaaattgttgaaacttctcatccttgtatccaccccacttatccctattaatacaaaatcgacaagtattgattatcaggttattgacattttgatgcggttgccctgatttatatattttannnnnatatnnnnnnntnnnnttntgtaccttagtnnnnaaananagnnatnntcntnanncaaanatnnnnantnntannntgnaanantattnanngnnantnatnnnattnnnantnanagntttgntgcgtnntnntntnnntcannntnnnnnnnnnncnannnancnnatnnnnnannntnnnnntantntnnntcnaanngntngntntnnnnccanannnnttnntnnntcaanttntcngntngnnnntanngangaggaaatnncnnntnacnnnnanaaggntnantcnaannatananntcctnntggtnntncnannttgntgaanngtntnnnnncnnnagntcttatnnatgannnnnannanannnnnattnnnnatnnnntnnaagnanncanaacnngngnnnannnnnnngcanntncanntcntnatanngannnngttnttatagngcatannacannntcnnnttntnnnnatnnnnnnngtnntnttnnanctcanantgatnnnnnnnntatangnctgncnnntaannnnanntntannntagcnnnatnngttangnntttcnannnaantnnatcacnancntnnnnanangtngcncatatannagnngnantatntncttnnntnannnanncttcnnnnaantnttnanctncncttgntntnnnaatnnnnnanaaacnntnnnanannnntnnnntcntnntngnagngnntntannttnctnnncaaattnnttnnannannannnnannnntctactttnnctntcntcctnnnncnnnnctnnngntncnnatntnagnnngnncnatngntnnnnnnannantngnn

SEQ ID NO: 864 - DNA, 4000 bp, Escherichia coli
  misc_feature (773)..(773): n is a, c, g, or t
  misc_feature (1997)..(1997): n is a, c, g, or t
  misc_feature (1999)..(1999): n is a, c, g, or t
  misc_feature (2908)..(2908): n is a, c, g, or t
ctgtattgggcgatttcaacccattttgcataaaatacaatgcagcttcttgaagctgtttgctggctgttttcaagggctcaaggaaatctgctttaaactctgggctttcgctggcgctttcggcgcagaaggttttgatcaactcaaaaaaggccagcgcatgtttgccaccgtcttggccgagttttcgaccaaccagatccaacgcttgaacgccatttgccccctcgtaaatcatcgcaattctggcatcgcgagcaaattgtgacataccccattcttcgatatacccatgcccgccaaaaatctgctgggcttgtacgcaaaattcaaagccgcgatcggttaggaagccttttataactggggttaacaagctgaccaaaccatgcgcgggttcatcccctgcaagattgctttgatcaattaacattgccccccaataggcaaaggcgcgggcgccttccacaaagcttttttgttgcattaagttgcgccgaatatccgggtgtacgatcaggggatctgccgcgtcatctggattttccggtccggtcgccgcgcgcccttgcaggcggtctttggcataagcgagggcattttgataggcggcttctgcttgggcgtagccttgcaccccaacccctaaacgcgcttcattcatcatcgtgaacatcgcgcgcatgcccttatgggcttgccccagcaaaaaccccgtggccccatcaaagttcatcacgcaggttgcattggcatgaatgcccattttntcttcgattttgcctacagagaccttgtttctgggccctaacgcaccctctttttgaaccaaaaattttggcacaataaacaaagagatccccttcaccccagcaggtccccctggaattttggccaaaaccaaatgaatgatattttcggccagatcatgatcgccggccgaaataaagattttttgccccgtgatggcgtagctgccatcttgattgggttctgctttggtgcgcatcagccccagatcggtgccacaatgcggttcggtcaggttcatcgtgcccgtccacttgcagctgaccatttggggcagataagttgctttttgctctgcgctgccatgggtatggatcgctgaataggcaccatgggtgaggccgggatacattccaaaggccatatttgctgaggcgaaaatctccgcgattgctgtcgccacgatataaggcagaccttgcccgccaaattctggattgcaatccagccccgtccagccgccttctttcactttatcgaaggcgtctttaaagccttttggcgtacgaacaacgccgttttctaaatggcagccttcgcggtcaccagaggcattgagaggcgcaagtacctctgatgccagtttgccaccctcttctagaatggcttgcaacagctcgggttcgagcgcgtcataacccggaatattttgctgctgcaatttcagaacgtcgtttaataaaaagcttatgtcttgaatgggcgcgttataaactggcatgaaaacaccttttactgatcaaaatggcggatggctggctttaaaggggcgcgcgtggacaaaagattcttcccccaagcgagctggctgcgaagatcatcaatgatttcttctaattcttgttttttcgcttcaagcgccttgagttggcgctctgcgcgctcatgggcttgtttgatttggatctgcggatcttgatccgatttatacagatcaagcaattggcggatttcttccaatgagaagccaaagcgcttgccttttaaaatcagttttagccttgcgcggtctcttttggtgaacaggcgtttttggccttggcgaattggaaaaagcagctttttcgtttcatagaagcgaagcgttcttgcgctaaccccaaatgtttcacacattctgccaattgtcatgtgggtttcgtccataaatgcggcctgtccgtaacgcgaagtttatacgatananacagcgtagcagaaacttgacgttaacgtaatgtagacgtcacgtcatttatttggaaaacttgttcatctcttgcagggtttgctggcgcaatcctttcaagtcttcaatggtttgcttaagctgctgctcttggtcttgcagctcaagcaatttgctatctgccatatcgacaaacacttttaactgggtttgtgtgccggcttgttcataaatttcaagccattggcgggcttcctcaagttggaagccaaacttacgggcccgcatgataagcgtcatccgcgccaattctcgcgctccataaaaacgagatcgcccctcgcgttctggctgcagaagctcgatatactcgtaatagcgcagggttcttggcgtcacctcaaacttggcgcacatctctttaaaggataacctttgttcggccatcttccccctcctgttatccatcagatagagcgtccctttgcgcagaacaaccattgcccttgcgattttttcacgttctaagtcatatttaaagcaagaagataaaaaacctatgcggagtaagctttggtgatgaataaaatggcacaggcccaacgtttcatggaggcaattccgcatgcaaaagctttggggatgaggtttgaaagcatcggcgaaggtgaggccgagatgcgcatggattataatgaaaatttcattggtgatccacagacgcgggtgatccatggtggggccgtttttgccttgcttgacagttgttgcggggcggcggtgttaagccatcctgatcaacgcggtcttacagcgaccatcgatttgcgggtagattacatgcgcccagcaatgccacatcaaacaatcagagcgattgccacctgttacaacgtgacccgcagcgtggcgtttgtgcgcgctgtngcgcttgatgaaaatgcggaaaagccggttgccatggcctctggggccttcgtgaacggagcatgaaagtgatgagcccgaaaccagagcctgttcaagtgatcaaaaagcgccgtgatgaggctttggcctcattggtcgcctcggtgccctatattcagttcatgggggttcattttgatcgccgcggggatgagcttacggctgtgatgccgtttcaggagatgatgatcggcaatcccgccttgcccgcgcttcacggtggtgcaacagcggcgtttttggaaattgcagcaattattgaattaagctgggcggcggtgtggcaggatatagaaacggcccccgatcgcgatgtcgcaaatctagaaacagccgccatcgccctgcctaaaacaattgatttttcggttgattacttgcgctctggcctgccgcgcgatgcctatgcgcgcgcgcgggtcaatcggtcggggcggcgctatgcctcggtttttgtcgaggcttggcaagataaccgatcgcgcatttttgcgcaggcaacagggcattttctgatgccggactcgcctttgcaggatccttcaggcgccccaaaataatgattatttcgcatgcccgtgttctgaaaattgcctttccgattttactggcaaatataacggttcccttgcttggcgtggttgacacggcggttgttgggcaaattgcatcgccgataccgcttgctgccgtaggtatgggcagtttgatcattaccacgattttttgggtttttggatttttgcgcatgggcacaacggggcttgcagcgcaggcgctgggcgctgaacagcttgacgaggtgggcgcgattttaagccgcgttgtaatgatcggattcgtggccggtttggcgcttatcttattgcaggggccgttattttatggcgcgcttttggtatcgccggcctcgcatgctgtggaaagtgatgcctctgcctatatgcagatccgaattctcagcgcgcccgcggcgattgcaatttttggtattacgggatggttgatcgcgcaggagcgaacccggcatgtgttagcgttgcaaatctg

SEQ ID NO: 865 - DNA, 4000 bp, Escherichia coli
  misc_feature (1977)..(1978): n is a, c, g, or t
  misc_feature (1983)..(1983): n is a, c, g, or t
  misc_feature (1986)..(1988): n is a, c, g, or t
  misc_feature (1992)..(1992): n is a, c, g, or t
  misc_feature (1997)..(1997): n is a, c, g, or t
  misc_feature (2627)..(2627): n is a, c, g, or t
acagcgcgatagtcaatagtccatctgttaattcgacatcatctacttttaagtccgtgtttaacataaacttacgctcaaaagatttaagactgagaccttgatgagagaatctttcactctcacttagtttctgttcttttttccccttgatgagcaactcattatcttcatgaattaactcaagttcttgtttagaccaacctggcaccgcaacctctattcgaaagttgcctgtgtccacattctctacaatgttatatcttggatatgatgtatcagtgttgtgcaacaaccactcattattcataccaagccaaaatttactaatatcaatcgtcatattatttctcctaatttccttttcagtaaaactatgcccaccctttcggtatggacgccattgtgcaagaaacccttcttacacttatgtatattatactaaaattaagaccaaaagtcaacaattattttttgattagtcatcgaagtctatcttgccctgcgctttcatgtagtctaaggtctttccgattccttcttgatgtccgtgcctgtatgcaaggtaaatgcatgataccagtattaataggtatgctatatctatgtccataatttttctccaatgaatatattatactaaaattctcaccataagtcaagtaaaaaattaggggtatctaaaaatagttgttgacacatggatgaagatttgttataataacagtatgatttataaaagaggtaaatggacaactaaggaaagacagacactcaaagacctctacaataaaataccaataaacgagttatccagtagattattaagaagaactactagcataacatcacaagtaaactatcttcgaaaaagaggatgggcgtttcacaggagaaaggatggataatataattgaattccctagaatgaaaaagtcagaagaaataacagataagttagcaactgcacttatcgctgcatgccacgaacaaggactgaatactacagatcctgacttcgtctttgatatggcatgggtacataagtttcttcaagcgacagttgacaatcaacataacattgcgaatgacctgtgtcgcctcacacgagcacaaggattaaatgagaattgaatgtagaacaataccagtagaaaaagccattcgcatactgagaagaaaactagatagagatggcagaaaagaaagaataaaagaactcgaattctacgagaaaccgacagcaagaaagaaaagaatgaaagctgccgcagtcaaaagacaacaaaagataactagcgagtatcgtaaatatactgcaagacgaccaagacatggaagaacttaaaaagaaatctctattgttttacgactttgcaagtgaaactttgtttgctttatgtgtatacttcttactggtagcacactcctttatagagtttttcgaacaaactcgttttggaagagatacaatttctctttataaaaaagttctctcgaaccctcccaaaatcctctcagcattcaagaaataaaatattttactcacaaaaatgactacaattttaaacaattatattcacctacgaaaaaaatatcttgtatttttgataaagttatggtaaaatattattatctaattcaagatagatactacggcaatcattaatttatctctcttgctcatagcgacctcaattaaaggatttcaaactgaattctggagggaagcgaagcgagactggaagaattcatctttgatgtttcttttaactgggagatagagcttacgatattccatgccaatcgtatcacaccaaagaaaagtcaactaattcataacgacttttcaccaatccccaactttcaacacttaactacactttcatactttttttgtgaaattatccccaatcgcaatttatttaaggtcattttactacttattcttttgggttggtatatggaaaattatannggtangcnnncaantttanggaaattatccctagtatgttatacacccgctatagcttttgctggttcgttatacacccgttgcaggtttgaaccaaagtggagcgagatatcagaatcgaactgatatctactggttggaagccagtcataatagcctttatactaatctcgcatatgtggcggtctgacggagaatcgaactccgattactagcgtgacaagctagggtactaaccattatactaccaaaccatgtggtactccgtagcagagtcgaactgctgttgcatggatgaaaaccatgtgtcctaaccactagacgaacggagctttatttagtctctttgaatcattcgtaagtttactacttgtgtcgtgaaggtaatattctcatcacgcaaagttaacgctagttgattctgtaattgtggctcaggttgtggactagatacaacctcaaaatactcgccatgttctgctataatcttacgaagtttgtcatttctaggaaaaatcttagcatatcttttatctcttatccccattactcacctcgccaaaccaattggtagccttcatgaccttcttcaccattactttcgtactctcttagagttaatactagatttttgagatctgcttttggngacttttccaatccgactatagaatctgcacttatgtcaagtataccagctagttcttctactaactctttcttggtaacggggtcttcgccagtctttgttttgtatactgttttcttgtatacgccctctctacttaactttcctattatagattttacactcttgttgagttcatctgccaaagcatctactgttgatctgtcaggcttcgcctgataagcttcaaccatatgttttacttgttcttctgtatagtttacactcatactatttccccttttcctattgttgttaaaaattcttcttgttcttttactatatcttcaacttcgttaggtgatagtaaccatgtttttgatagatttctgataattgcaggatgttccaagccttcttctagttgcatttcataatctatatgtagacatattttagctcctgtactcaacatcttgttcctccctgctcatctgatcaatacaatcttgtactgtcattttactacctactgtagttgatgtccacctaccattttgaagtttctcaaataattgagagtcatcattatatgtggttgtccaaagtttcttatctgcgtgaatatctccacttataagtttaacttttttacgccagttctcggctgctagcatttttctttgtctatctactaagtcgctaaactgccccatcatcatctccgttgtttgcaatgatgtacattagtacagcaaagcctgtgatagcgataacaaatgcccatacaaactcatcgtacgtcatagtctatccccctcttttacgaagatgccgtctatcattttgcctttacgatctttaatatcttcgtaagcaactgctaaacattcttctaagttagtgccttctctttcagcaatgttaattaatataacaagacagtctccgatatcgtctttgacatcttgttttttacatacgctgtcagataattcacctacttcttgtattagttttaatacttgatctttactagttgcaccttcgattaagtttctatcatgatgccactgtgagatcttttcaattagtttttccattttatctccctaaagtttttaaatccatttcggttatatactgataaccacctttgttgtatgtaatacctacttgcttttttcgctgctgtgctatagtttttgcactgctttcgccacaggataagcataacctgtagccaagctcccaccttgctggtggtactctgtttccacatttacacaacatcctgtagatcctgtactaagtctgtagacttcatagttttaccactagctaaagtaacattcatccagcgagggttctttttgataggcatgccatgccat

SEQ ID NO: 866 - DNA, 4000 bp, Escherichia coli
gtcgcaccccaagcagtttgttaaactactgggcgaggagagcctcttccagtcgtcagcgcgccgcctgtcgggcgcgggctttgccgcccctttcgttgtgaccggctccaacttcaggtttatggttgttgagcaactcgcaaccgttgagattgcaccacatcagattttgattgaaccctcagcccgcaacacggcggccgcaatttgtgcagcggcagtggcattagatgccaagaatggtgacagccttatgctggtagccccatctgaccacgtcattcccgacgcagagggcttcaggggcaccgttgaggcggctgcgcccacagcactcgcggggcagatcgtaacctttggcattcgtcctgatcgtgccgagacgggttacggctggctcgagctaacggcacgagccgccgagggctccccccctaccccgctgccgttgaaatcgtttatcgaaaagcccgacgcggaaactgccgaagccctactgagtagcggcatgcacttgtggaatgcgggtattttcctcttctcaacgtcaactattttgcaggcatttgcggaatatgcgccggaaacacttgcgggtgtgcgcggtgcccacagtgcagcggaaaccgacctcgggttcacccgccttgccgcggagccctggtccaagctcgaggacatctcaatcgactacgctgtcatggagcgggcgccaaacttgtctgtgatgccctatagtggggcgtggtcagacctcggcgactggcaagcaatttggcgcgagcgtgaggcgaaccaacacggcgttgtgacaagtggcccctcaactgcgctcgactgcaagaacacgctccttcaggcgaccaacgaggatcaacagctcgtcgcaatcggcctcgaagacgtcattgcggtcgccatgccggacgctgtgctcgtggctcacaaagaccgcacccaagacgtcaagactgccgtcgctgaattgaagttaaagggcgcggcccaggcggaaaccctcccccgcgactaccgtccatggggttggtatgagagcatcgccctaggtccgcgcttccaagtgaaacgcattgttgtaaaccctggcgcagccctgtcgctgcagtcccataaccaccgctccgagcactgggtggtagttgagggcaccgcaaaagtaacgatcgatgatgaagtccaaacgattactgaaaaccagtcagtctacataccactcggtgctgttcatcggatggagaacccagggaaattgaccctgacactcatagaagtacaaactggcagttattttggtgaggatgacatcatcagatacgacgatgtctacgctcgcggacagggtgccaaggggtgatggaactaactgcttccaactccaatacttaggtatccaagtacgggatgcgtcatggcatctgcgcactaagacaaagacttatggggtccgactttgtggtattatcggtgcgctgctgacagtctcatagcgcattcaagtaagttagccttttagggagatacaaaaccttgttgcaaagctggacttggctcagctcgggacccgtgtaaattcatcgcctactgaagcgcgccgccaattgatcgcgcgtcgcgcgacatgccctcaagaactgctcccgctccatttacaagtgaaccagtcccgcttactatccttctgacagtgccacacccgccaacaagggttataagccccacaataagaataaattgtctcatttactgctcgttcctatcattttataaaaaattaacgttttaaatcatacttgtcaagctcaccgcattgcggttgttaactatcctcgcgttaataaagccttaattacagccgggtattattctgtcagaaatgttctattattgctcttcatccgagatgtccgcttgctcaacaaaaataagtcgtctaaggtagatgagggattttggttagaaaaatccttcgggggactttgatgaaatggttattgacgagtgccatcgggacaactctagtactggcatcgtgtggagttacagtagatgacgcggtgcgagattacgacaccgaagctgaggcactggcgattgcgccggcgatagtttcagctggagatcccggcccaattcgcacgggctccacattgtcgagtaatctcaccaacgtaatcttgctaaacccagacgtgcgttcggcgctaagggcgagtgatgcggcgtcggctggcattaattccgctaagagcctattgcagccccaagtaactggctcgctacttgctgggggttaccaagacgacatatctgattcctctacgaaatctggagcgtcaatcgctgcgcaggtcacgcaactactgtttgatggcggcgcggcgcgaggctctatttcaatttcggagttggaggcaaaggaggccgaagtcagggcaagcctggtggccaatggcgtcgcatttcaagctgcagcggtctggcttgccaattggaacgcgcagtcaagccttgcatcgttgaaggcattggaaagcgaactgatgccgcatgcgaaacagatccagcgcatggccaacaccggtatgatagatcggtccgtctctgacatgatagagggtcggatgctggaatttgcgctctctgtctcggaggcgcagtataggtcagatatcgccgcttacgaatttaaaaaatattttggaaaatcgccctggcgacttgattacccaaagccttcgttcaaagtcgcggacttggaggcgagggcgtccagtgcaattacgcccgcattgagacaagcggcgttgcgcgttatgactgcgcgggctcaagaagatgtggcggccgcaaaatattcgccgcgtgtgtcagtggaagctggcgccaattcacccatggatcgtgacgaaaaaacaagcgcccgcatcggtgtgagccttgcgtttaatttctatgatggtggtaagcgcgacgcagatttggacagggcccgagagaatgtagtggctgcggaatatacgctggagagcatacgtgagacatcacggaaaatgttgtctgacttgctcgacaggcgcaggaatgttttggaaacgatccgccttaagtctgataagttagccgtattagaccgacagctaacggttgcagagacccaaattcaaacgggtcaggcagacgttgccaaagtatttgaggtgaaagtgcagcgacaccaattggagagttccataaggcaggctcgtgcagatttacgcgtcacagagtatcaggtggcgtctgagctaggtcttttctcactaccctcagaaaatggaacagaccagtgaatggagaagaccagcaagaacctcatctatatcaatccgatgcaaatgacttaaactttgaaggtttgattacagaagaggcagaaagcgttgggccagatgccctgccgagggctttgcaggctctgcttgcgcgtgatggcaagtcactttcggtgggggcaattctagatttgggtaacccaactgagggatcctacacgccacctgatgcggtcgacgcgcttacggcacttggttacaaatcgaattttggccgcttgcgggtaagatcctatcgcccgacgcactgccctctcatagccttcacaaaatctggcggcgcagttctcgtggaaggcttcgagaacgatggccgcctacgttacacagactttgccgctgcgacgagttcccaacttgcgacccgcaaagaacttgccgagttcgtggacgaatacgtagtcctagcagagcgcgatccagccttcgcgggggatcctactggcgcttcttggttttggggttcactcgcgcagagtaagtggctctattttcaagttttgatcgcggcggcattgactaattttttgggattggcgacgtctctgttcatcatggttgtttacgaccgtgtcgtcccaaatgaggcaatcgagtccctgata

SEQ ID NO: 867 - DNA, 4000 bp, Escherichia coli
  misc_feature (1928)..(1928): n is a, c, g, or t
  misc_feature (1931)..(1931): n is a, c, g, or t
  misc_feature (1940)..(1940): n is a, c, g, or t
  misc_feature (1964)..(1964): n is a, c, g, or t
  misc_feature (3333)..(3333): n is a, c, g, or t
  misc_feature (3392)..(3392): n is a, c, g, or t
  misc_feature (3579)..(3579): n is a, c, g, or t
  misc_feature (3654)..(3654): n is a, c, g, or t
  misc_feature (3657)..(3657): n is a, c, g, or t
  misc_feature (3690)..(3690): n is a, c, g, or t
ttgcccttgtctcccatttcgaccgcagagcaggtcaggcccgcggcgcccatgtcttgaatggaaatcacagcgcctgtggccataagctctaatgtggcttccatgaggcgtttttcggtgaaagggtcgccaacctgcactgttgggcgcttatcttcgatggtgtcgtcaaattcagcgctggccattgtcgcgccgccaaccccatcgcgtccagttttggcgcccaagtaaaccaccggcatgccgacgcccgaagcggcggaataaaagatcttatcggtatctgcgagaccggcagcaaaggcgttcactaggcaattgccgttataggccggatcaaagcgcacttcgccgccaattgtggggacgccaaagcaatttccatagccgccaacgcccgccaccacgccggaaaccaatgacttggttttgggatgatcgggactgccaaaggacaaagagttcatcgccgcaataggccgcgcgcccatcgtaaacacatcacgcaaaatgccgccaacgcccgtggccgcgccctgatagggttcgatatagctggggtgattgtggctttccattttgaaaatcacagcctgcccgtcgccaatatcaacaacaccggcattctcaccggggccgcaaatcacctgtggcccttcggtgggcagggtgcggagccattttttcgaggatttataggagcaatgctcattccacatggcagagaagatgcccatttccgtaaagctcgggtcccggcctatgatttcgagaatgcgatcgtactcgtctgggctcagcccatgggcggcaataaggtcgggcgttatcactggatcttgcaagttgtcatcccttacggtgcaaatttgcaccctgatacgaaagttaacgggcagagggaaggttggaatagctattaaatgccgcatttgcccgaaagactggtggaattggcaaatatcaagctcaaccgcatgggcgcgcgggcaaaaaaaatgccgggcacagggcccggcgtaagtccaacagggaggttatgaggggctaccactggctgccgtcctcatgaggcgtatttaggagcgccaatgcatccctgcaagccctctgggcgcaaagccgctatgcgctcagagcatagctacttttggacctcaaggcttcgctctgcgcgacggcgggcgataatttcatcttgcacaaaatcgcgaaaggccgcgatacggcgcgagtggcgcagctcttctggataggcaagaaacaccgggacttccgtgttctcaagctcgggcaggacacgcacgagatcaggaaaatcatgggtgacgtaatcgggtaaaattccgatcccaaggttgttgatgacgccttgcaacacgccgaaatagttgttgacggttaaagtggattttggactatatcccatcagattttgcaccaaggctgcactgacggccacttgaggtgcgttgggattttggcaaatcaaacgatgatttgcgatatcttctaaagtttgcggcgtgccgcgggatttcagatagtctgcgctggcatagaggcgcatttcgacgctcataaggcgctttcgaatcaaatctgcttggctcggctctttcatgcggatggcaacatcggcctcacgcatcggcagatccaagacccgctcctcaagcatcagctctacattcaagtcggggtatttttcataaagctgtggcaagcggggcgccagccagagcgtgccaaaaccggtggttgtggtaacgcgcagctcaccgaagacttcatcttcactgtctcgaatgcgtgctgacgcggcatcaaggcgtttggtcattgcgcgggtggcttcaaataacagctcgccttgctccgtgagtatcaacccacgcgcgtgtctatgaaacaatgtcgcntcnagggagtcntccaatgcgcggacctgccgcganacggccgattgcgacagatgcagtgtctcccccgcatgggtcagtgatccggcatcggcaaccgcatggaagattcgtaatttatcccagtccaccggcttacctcattgtccgttcctgagactcataacacgcaacttgagactgggtcacggagtttttcattgttaggtcatagtttttgacctaacaattattcgtgcataccgggaggccgcagaccatgcagcaagatgtttcactcgctgatagatatgatttgtcgaaaaaacaggttttgttaaacggcacgcaggccttagtgcggatgatgttgatgcaatcggcgcgcgaccgagcggcgggccataggacagctggctatgtcacgggctatcgcggatctccactgggcgcggtggattttcagatgacccgcgcggcggcagagcttgaaaatgcgcaggtgcggtttcaagaagggctgaatgaggatttggccgcaacggcgctttggggcagccagcaggccgagctgcgcggtgagggaaaatttgagggcgtgtttgggctttggtatggcaaagggccgggcgtggatcgctccggcgatgtctttcgtcatgcgaatatggccggcacctcgcccctgggcggtgttgtggcggcgcttggggatgatcacaccggcgagagctcgaccacattgcaccaatcggaatggacgatgatcgacagcttcatgccggtgctgtctcctgccggcgtccaagaggttatggattacgggctcttcggctttgccctgtcgcgctttgctggggtttgggccgggctgaaatgcatcaaagacacgatagaagtgacctctgtggtgaacggcgatcctctgcggttggactttgtcaccccagagttcgacatgcccgaagggggcttgaatatccgcctcatcgacacgccgcaggcccaagaggcgcgggtcattgatcacaagcgcagagccgtgcaggcctttgcacgcgccaatcggatggataagcgcgttttgggacaggctggcgcaaaaattggctttgtcgcggcgggcaaaaattggctggatttggcccatgccatgcaggtgctcggcatggatcagggggcggcggtgcgccatggggtgacaacctacaaagtcgccatgacgtggccacttgatatgcagtcttttgccgaatgggccgaaggtttggactgcatcgttgttgtcgaagagaaacgcaaactgattgagggacaaatcaaagaagctcttttcaatcaaaaaggcagctggcgggtttttgggtccaaagatgcccaaggcgcattgctctttgccgatagctatgcgctcgatccaatggtnattgcgcaaaaactcggtcaaattttgatggctgagggctgcggatcggcgcggcttanaggcgcgttggagaggattgatgcggcgcaaaccgcaaacaacgcgcccacattggccagccgcgtgccgtatttctgctctggctgcccccacagcagctccacgaaaattcccgagggcagccgcgcctattctggcattggctgtcattacatggtgcaatggatggatcgggagaccttgggnttcacgcaaatgggcggtgagggggccaattggattggcgagtcgttgttctccacccgcgcgcatgtgttccanaanataggcgatggcacctataatcactctggcatncaagccattcgcgcggcgctcgccgctggcacgaccatgacctataaaattctgtttaatgatgccgtggcgatgacaggcgggcaaaacaatgatggggggctggatgctgcgcggatcgtgcaagagatgcgcgggatcggggtgaaacatcttgccgtggtttatgatgaaaaggaagacatctctgcggctgattttccggctggcactccgatgcacccgcgcgcccagctcaatacggtgcaagaggcatttcggcaattgccgggcgtctctgtcattgtctatgtgcagacctgcgcggcgg

SEQ ID NO: 868 - DNA, 4000 bp, Escherichia coli
  misc_feature (1626)..(1626): n is a, c, g, or t
  misc_feature (1993)..(1993): n is a, c, g, or t
  misc_feature (3805)..(3805): n is a, c, g, or t
agtgctctcgaaagacgggactttcttgttcaactttttcaaagggttggcagtcctcctggcttggatggggctccttgctgccatgggactctgggctgccacttttgcttcactcccggtggctacctttctcatcctcactgtgctgatggtgaccagctcagattccctcttccaatccatagtcagtgaaggcacgatttcctcggtcgatgagcatactggaagagcgagctgggattacttggattggttcatggttcccatctttacgttactccatcattttactgaaaccctccgatccatcgcccccatcgatcggctggtcacagggcgaagcattccatttgcagccctgatcacccacatattactggtgatcggtttcctaggaggctccttgatgggactggggatgttgttcctcacacgaaaggaattggatcagagatgagttcacccttggcatcaggaagcatgagaaaattggggttggtttgcctcatcgtgctggcaattgcctcgaaccattgggtgcagggtcgtctgaacctcaaacgcctggagcttgggctgactcgcatggaacccttgcgcaatgcaccccccattctggctttttccagcgtcgccctgggtggattccgcgggctgatagccaatgctctctgggcaagaacctccagactgcaggaagaaggaaggtttttcgaaaccctctctctggcagactggatcaccaagttacagcccacattcccatcggtctggaccttccagtcgtggaacatggtctacaacatctccaagcaattcgaacaacctgaggaacgttggcgctgggttcaaggtgggatcaacctcctgaggcaagaggcgcttggatataacccagaatcagctgagatctatcgagaattagcgtggattttccaagataaaatgggaggcaaccttgatgacacccatctttattacaaggaacgttgggccagagaaatgcggcagattttaggaaatgccccagatctagacgtcatcctcgcctccaaagaccagcaggtgcagcagttacgtcaaagactgctcgatcagtttggcatggatgtcgagaccatgaagcgcattgaagataacctggggaagtttgactggcgcctgcctgaaacccaagcgatttactgggcatgggttgggctggaaaacgcaaagcaaggggagaaaaattttctgcgccgcatcatatggcagagtatggctctggcctttgaaagaggccgactgattgaaaactctatcgaccaaacactcgagtacgcgcccaatctagatcttgctccctacactcatgcgatgtttctcaaggtcagaaaagaggaagagaacagcaattatctcacgacaatcgatagggcacacactgaatttttgcaaaatgcctgctactatttttatctccaccatcagcttcagactgctggtctttggtttgagcaattgcttgagcgctttccggattccatccccgatggcatgagtctggaggcttttgcactcaatcgatttgagcgcaacctggtcaaagccgacatgaaccaagccagggtgatcattgagggnatgcaacgccagttcctttactacctagccttaggggaagaacaacaagcgctgggctattcgaatcttgcgcaggtagcctggcaacgttaccaggaccgagttgaggccgctagtcagcgactttccctacccccttacgacgaactactccaagggctcttagggcgtattttggctggtgaagagggtttcagcgaacccatgatcgccgtattgaaaacccgtgttgcccaaaaccaagacgaggcgacctcccggtaactgacaaaagggcccccaagtaagccctgcctcccggttaactcaacacccataagactcaaaacccattgcaatcagtgaggtttagcgtcacaataccgangtcatgctccttctgtcgccctagcaagccagggctcctcgaggaaaccgtcgaagaaaacatccaggcagccaccaaaccagaggaccctcatgtcaaaccccaccatctccaaggttttggaaccgattctgcggtgctaccggcaacagcaactcaggcgccaaatgtccttattcctgaccgttacgggtctgattggcttggggcttgtcgccttagcaaatgagcttgccctggctaaaagctttctttggaaaagctacgccctcactgtgggattaggattactgtttctttggctgcgctcgctccgaaaaaagcactcagtccaggagcttgcccagcgtatcgaacaagaacatccctccctgcgggctgcgctgatcaccgcactggaccaaacccccgacccagccagcgggcaatatcattacctgcaggaaagggtgattcgtgaggcgcttgagcatcatctcaagcaaccctgggaccactcctttcaccttagattattttattctggcatcataagattttgcagttttctcattgttctagtggcgacttacctgctcgccaacttggccgtggatcatcaagaatctggggcttctgcagccttcagtggcatgttgaaggtggagccgggcaatctagagttggagaagggagatgcggtcgtggtgaccgctcgatttgggaagcatgtgcctcaaaaggtttcgttgatcatcatgccgtcagatgggaacaccaggcgcatggaaatggcgcgaagcatggaggatcctctttttggtgccagccttctttcagttgaaacagatacggcctattacattacctttgacgacgagcagtctgaaacttttaagctgtcggtattcgagttccctaaactcatccaggccgatgcccatatcaattaccccagctacacggggctcgatgagaggtccatcaaagatactttgaggatctctgctgtggagggttcccagctccgctacgaattccaaatcaacaaggcacttcaatcagccatgctcatggatcaagagggagccttattacctctggtccctgacaccctccggagtaacatttttctattggaaacgcccctgcagaccacaggacgctacgaactccatctgactgacctagaaggacgcagtaacaaacaaccaccctctatccatatccgggtcacacccaatgaaccccctaatctcaagtgggtgttcccaaggggtgaccagcgattttctgctcttgaggaggttgagtttgaaggcgaggcttgggatgactacggcctaagaggctatggtatcggctaccaggtttcaggccaagacgctattgaggtaacccttggcatggaggcgggtgccaaggaaaaagcgaacctgaatcacctgctcgaactcgaactgctaaagatgcaacccggcggcctgatttcctactatctttgggctgaggacttaggcccggatggtgcgctccgcaaaaattactcggacatctttttcggagaaatccgcccttttgaggagatttttcgtcagggtcagcctggacagtcctcatcacaacagtcagagcaacaagatggagcctcttctcaacaagacccagccatgcaattggcagagatgcaaaaggagatcatcagtgccacatggaatatcagaaggcgaccgagcggcagtgccctttcagatcaggacagcgaggatctcaatgtcgttttggaatcccaggaagaggccatgaaccaggcccaaaccatgcttgaagaantgaccgatgctgaagccacagaggccatgaatcaggctcgtgaggccatgagtcaagcggccgactccctttacgatggagtccatgaccgctcgctcacagccctttctcaggcgctggtgcatgaacagcaagcctaccagtggcttctcaagtcacgtcccaacgaatccaatgtcacgcagggacagggtg

SEQ ID NO: 869 - DNA, 4000 bp, Escherichia coli
  misc_feature (1922)..(1922): n is a, c, g, or t
agcaaaggtctcctacacgctgaaaaccgaacatcgagtagtagatatagaatggaatcattgggtaattacttacgctgtaggaggtcgctgcggcaagccacgctgaaaatgcgcccgcctcgctgatcccttcctcgagcatctgaccctgcttgtcttcccgataaaacatcacctggttggaatcggcggggtcgtaaagctgacccacagaagagtaaatccccatctgcctaaacattccctccataccgaaggtgcgcgcctcatcaggaacgataggtacaactcgctgacctatctctttatccttagccaaagtagacagcatgcgcacaaatgccattgtcgtcgacacctcacgctcaccgctgctctttaattgcgcatcgaaggcgcttaacgtaggcaccggcagcggtgtcgtaacactacgacgctgcggcacaggcttgccaagagactcgcgcactttacgcatgtattttagctcgaggctgtcctcggcggggcggtaataaggcacctcttcgagcttatcgtcaggaataggaataccaaaacggtcacggaatttcttcagcgattcgatgtcgagtttcttcacagagtgagcgttgttttgcgcctctgcggtatccccgaaagcatagcctttaacagttttggcgagaatcaccgtcggcttgccactcgcgcgtgttgcctcagcgtacgccgcatagaccttataaggatcatgcccgcctcggttgagcgccataatatcgtcgtctgacaagtgttcgaccatcttgagcagttcggggcttttaccgaagaagttttcgcgcgtgtaggcgccgccacgggcaacgtaattttgatactcgccatcgaccacttcgttcattcgcgcctgcaaaattccatctttatctgcttgcaacaacggatcccaatgacgcccccagacaactttgatgacatcccagcctgcgccgcggaaaacaccctcaagctcttggatgattttgccattgccgcgcacggggccatcgagtcgctgaagattacagttgattacaaagatcaggttgtctaacttttcgcggcccgccttgctgatcgcgccaagcgattcaggctcatcggtttcgccatcgccaagaaacgcccaaattttgcgacgactgttatccagaagtccgcggctagtctgatatttcaacagatgagcctgatagatcgcctgaatggggccaagccccatcgagactgtgggaaactgccaataatcaggcattagccacggatggggataggaagaaagcccgttgccatctacctcttggcggaaattatcgagttgtttttcatcgatgcggccttccaaatacgagcgcgcgtaaataccgggggatgaatgcccttggaagtagattagatcgccttcatcgtgttcattaggaccgcggaaaaaatagttaaagccgacatcgtagagggttgccgcggatgagaatgttgagatgtgtccacctatacttggattgcgcatgttcgcgcgcatcaccatcgccattgcgttccaacgcacgatgcctcgaatctcgcgctccatgaacatatcgcctggcatgcggtcttcggtcgtggggcttattgtgttgcgatagtctgtataaaccgccgtggaatcttcgcgtggatcgacgatggaggcgcgagcggacagcgtgttgagcaaataatgcgcgcgatccgaaccttcttcgtcgattaccgaattaagcgcgtccagccattctttggtttcttcggggtttatatcttgatgttcgctcatcgatttcatccttaccctaacatgattagtaaagctattgccttacataatgggtgtaacttaattacaagatgacagaattttagtcttnttcacccatggattccagtttcgttgaaaaaatatgtagttaaactacaaataattacggcgagttgcgtaattactcggtatcggcctctcatcctaaaaaccttagcttaccaaatggctaagcgcctatgagcgtgaccaccgcgacgacgacaagccaaacgatttggctacgctcgagaagcccacttaaagcctctatctccagacgcatcgcagcctcgtcaaagtcaccccccttcacctcacaggcggccgactcggaaagtgcgcaccgagcccaatcggctaacaattgggcgttatcgctcgccacctcaaactcccacagatggcgccgaagacgagagacacagctattaaaatcaccaacgagagagaaggtgattgccagcagcctaagcggcacccactcaataactgcgataatcctctcgagatgcgccgcgagggtacgatccgactcttcgcaaagttcggctctaagttgatagctgacatagccaaagattacgcctacggggcctgcaacaagatacagcgcgtacatcataaacattcgttcgaagcttctataagcgagcaggcgcttaaattgagcgacgattactgcaccgtcttcggtgcgaggaacaccttcgagccggagctctgtttctagatagttgatgcatccctgcctatcacctgcgttccaggatctcaggaaatcgcgaaccaacctcccaggctgagttctatccattgcgaaaagaagaacaaagagatgcaaaagcatcgtcgcgaggccatagaatgttccctcggccaacgagccgagaataagcatgacagcaatcagtacgccgtagatagcgcccaaggcagcggcaattgaatacttgccgccgccgtgggttttatcaaccagcttacggatagctcgttgatagcgcccaaaccatgaatcatcaaagcgctcagcatctcgcagccaagtcgctgtcagcaccaaggcaagtaagataaccaaaaatttcacttagtatcctcgctcgaaaaaatattctgaagcaccaaaggcaaccggcgctcgatttacgaaaattctcgaagtcgcgcgatttcgcagccgagcttttgccaatcaaacccttcacccggatcagtcttgcgtcccggcgctatatcactgtgaccaacgatgcgttcagtcgtcacgccttcgtaataggactccaacgcaatgaccagagctgcgagagcggtatactgcgccgcctcaaaaacatcgtagtcagtaccctcaagctcgattccgatcgaaaaatcattgcactcctcacgcccctcaaagcaggagcgaccggcatgccacgcccggcgatctaggttaacgaactgagttactttcccagagcgctctatcagcacgtgagcagagaccttgagaccagcgatctcctcaaagtaggggtgctcactaacctgaggctgattacaaaaaaagcgctgaactgccccggtaccgtattcacccggcggcaaactaatactgtgaacaacaacaagatctatcggaacgcctttgggccgatcgccgaagttgggcgagaccacctgctccgcgggtgtaatcgtgccgtttgatatataaaatctcatgaaaaggttaataacctgtgtccaatgtcccataagcatacgccagcacagcgcagcacgcataccctctattcctattctatcggccttgcgccatacttctatcacgtcacgtaagatcgacacctaatccgcagtcacgcaggatccgcaatgcaaacaaaccgccctaacagcgaccttccgtcacgagaagacctcatcaatattgttagaacgaccttggaggaagatgtcggcagcggggacattaccgccgcgctcattccggccggccgcgccgccacagcaaaaatcattggtcgtgagcccggaattctttgtggcacacactatgctgaggaagttttctcacaaatcggtctcacgtcgggcagtgtcgctattgattggctggttggcgatggcgatgaggtaaaggacggcactgtc

SEQ ID NO: 870 - DNA, 4000 bp, Escherichia coli
  misc_feature (316)..(316): n is a, c, g, or t
  misc_feature (967)..(967): n is a, c, g, or t
  misc_feature (1513)..(1513): n is a, c, g, or t
  misc_feature (1974)..(1974): n is a, c, g, or t
  misc_feature (1987)..(1987): n is a, c, g, or t
  misc_feature (2011)..(2011): n is a, c, g, or t
  misc_feature (2019)..(2019): n is a, c, g, or t
  misc_feature (2296)..(2296): n is a, c, g, or t
  misc_feature (2305)..(2305): n is a, c, g, or t
  misc_feature (2307)..(2307): n is a, c, g, or t
  misc_feature (2344)..(2344): n is a, c, g, or t
  misc_feature (2425)..(2425): n is a, c, g, or t
  misc_feature (2446)..(2446): n is a, c, g, or t
  misc_feature (2455)..(2455): n is a, c, g, or t
  misc_feature (2458)..(2458): n is a, c, g, or t
  misc_feature (2476)..(2476): n is a, c, g, or t
  misc_feature (2479)..(2479): n is a, c, g, or t
  misc_feature (2647)..(2647): n is a, c, g, or t
  misc_feature (2650)..(2650): n is a, c, g, or t
  misc_feature (2668)..(2668): n is a, c, g, or t
  misc_feature (2695)..(2695): n is a, c, g, or t
  misc_feature (2722)..(2722): n is a, c, g, or t
  misc_feature (2738)..(2738): n is a, c, g, or t
  misc_feature (2749)..(2749): n is a, c, g, or t
  misc_feature (2767)..(2767): n is a, c, g, or t
  misc_feature (2881)..(2881): n is a, c, g, or t
  misc_feature (2992)..(2992): n is a, c, g, or t
  misc_feature (3001)..(3001): n is a, c, g, or t
  misc_feature (3531)..(3531): n is a, c, g, or t
  misc_feature (3661)..(3661): n is a, c, g, or t
tgtgtcgttacacgatactgcaaacagctgcgctttcacgtcatcgtattggtttgcaaaagcagaaacgttaaaccgaacggtgttatcgaataaaaagctcttcaggccaatttcgtaagaaataacttcttcattgtcgtatagcggatcggcaccacgcgctaccaccctcgcgtcgttagcaccaccagtacgataacctgttgctgcactggcatagaccatcatgtcttttgcaacatctagctcgtaagctaatttccacaataccgctgagtcgtcccaatcgggaattgaatcgcctgtaaatgtnttttcgtctttgttgtagcgaaggccaaccaacaagcggttgctgtcgttaagttgataacgagcttggccaaatacggctacagagtcgacttcatgtgggtcgtgatttggatttccccacgaaggaaccgtaatagaatctggctcaccgttaccggttgtatcctcacgccacagccattcccaatccgcttcttgcgagaacaaataaacgcctgctatccaagaaaacgggctatcgctttcaacagatgacaactgtagttcggtagaaaacgctttttgatcgtcctgacgtccaaagcccccaacaaagtctaagccaccatcgctgtagtcgttatcgtagaattgctcgcctgacagttcagaataattggtggtccactttgcgtttgcccagtccatcgcccagtcgagggtcaaggttgccgaccacgcttcttggttatcaaaagacaccgcatttctgtatacatcgtaagggccttcatcatctcgctctgcatcagctggctgataaatgtggccaggtgttaccgtagcaatagggttgtaaacgcccgaccccggtgaggtttcagaaatttgataacccgcaatttgttggtaaccccaaatcgcttctgagtttgcgtctttcttactntaatcaaggcgaagcaatgcagtaacatcgtctgagaattcgtatttagtcgtgttacgtaagtagaattggttcttttcgcgtaaatcgtctgacgagcccggcaagaaatggttttcgatcatgccgtcatgacggtcgtggctcatgacaaagcgcgtagcggccttatcactaagcggcaggtttaaaatagcttcataggccgaacggtcatagctaccatgagtaagtttcacagaaccactggtatagccaagttcaggctgctttgaaataacgttgatactacctgcaaatgtatttcttccatacaatgttccctgcggcccgcgcagtacttcaatgcgctcaatatcaacgtaagcccctaagccaccggtggtcgttggcacataaataccatcctggaaaataccaacaacttgttcagcaatacctgtaccggccacgccgacttcgttggtacgagcaccacgcatagcgggacgaacttcaccacccgagctgcctattcttaatccgggaacaacgttttcaagaccnctaatattttcaatgccgttacgcaaaatatcatctgcacctaacgcgctcacagaagacgatacttcctgcaaatcttgagattgtcggtttgctgttacttcaatacgttcaacacccgctgctttagcttcgctgtcaggggtttcttgttgggcgctagcgcaaaaactaacgctgattagaagtgcactttgaatagcgcgggagaggtatgttgtatggtactttcgttggtcttgcttcatcgtgatagttcccggattaataaaaccttatctgcagtaacctgttagtgccctgcgtttatcaagcctttgatgaccctgcctgtgacaacatcatactaggttgtttaattcttggtctaaacaaacatacaactcaatttacttcgaagtcaataaaaatgttcaaagattgttaattcatgaattttaattttttgtttaaatacattnagaacaaataaangcatgtaataaaaggctttatttntaaacaangagctttaacaatgacagtaaaaataagatttcgaagtataaatatagacttcaagtcaaaaatgactggtaggatctgcatagaaaaatggcactcgaatggatagaaaccgaatgctgatgcatgagttaagcattagtgaaaaaaggtaagaaagtgcacttgagatagcttgggttatcagaaagcccacctagcaaaaacggacgttttgctaggtagctttgagggaaaatgacgtcagtcagtacacctatttcaggtataaagcctttngtattgttngnttaactgtaggtggtagtgcgcgataagatatctaanccttgctgttttaaccaataaggcacatccatcaacacccagttttccagtaatttatcccctttgcgatagtacacatcnaccactcgcatgtcggcacgnatacccgangcnggcatgccgaacaagccnccnccagccgtattcgataggttcggccagccaaagaaacaggcaaaattgccttcactaaagcgcgccacatgaccattaaacactttatctttcaaacctttacgaaaaggaaattgatgttgctgctggtaacgctcgatggtgtatgtagcccctattcccgctggnccntaccacaccatatcttcnctccagcatttggcgagaagctctggnggacagttgtcgttacccgatttattnaaagaatctaggtctnttaccatttcntcaaccagctcaatggtntttttagactcctgaggatcttgctcttcaaacagtaaaccgttgtgatcacatggccctggataaacaaacgtatggcctgtttctacgggcaaaggattaagcccaacttgntgcattagtgcaattaagtcgaagaaaatagcgtggctaactatcttattttcacgtacttcaaaaaactcggcataccgtaaaaaagccagtttccccgtacttctaatnccaagaaanggcttgtcgaacagtccagcaaagtgacccatcgacataacccacttgccttcgccggcgctgttatctcccgccatgaatacgtcctcacggcgcttcatacgcgtaaaactctgttttaacggctcccacaactctttcactaattctgctggagtcgaacatttatcaaacggatagcaggcataaatctttgcattttcatcaacatacgatttcactacgcctttaacatcacttgcctcacctttgtcaaaagcggcttgataggatctgacaacggctttttcgctattaaaactcatgacttacgcctctttgtttaaaaaattgttaatactggcctgaaataattaatgacttcgaagtcattatgtattaggttgaatattattgtaaatagaaagcgcgcttattaagcaggcagagtaaagaatatgactgaaaattttggcgttttaaactggtctatcttaggcgggtacatcattgcgaacctgttgctaggtttggtgattggtaaaaatatnaaaaattccgacgatttttatctcggtcaaaaacaaactccgtggtgggcaataggcatttcggttattgccacttacgttagcgccatgacatttcttggggcaccagcctgggcttattcagaggggntatccgttatagcacttcatttgaactaccctctcgtcatcatggctgtaatcatattctttttcccattcttctataacgcgggtgtcgcgtccatttacgattaccaagaacggcgtttcggcaagcgtgcccgcgccatggtatccagcatttttatgctaagccaaatcatgagctcagcagctattctttatgctacctctcttgtgttgtcgttcattactggcgtacctgtagtgtggtctatcgttatagttactgccatagcgcttatctacaccatgatgggcggcattactgccgtaatttggactgacgttattcagtcagtgatct

SEQ ID NO: 871 - DNA, 4000 bp, Escherichia coli
  misc_feature (121)..(121): n is a, c, g, or t
  misc_feature (158)..(158): n is a, c, g, or t
  misc_feature (230)..(230): n is a, c, g, or t
  misc_feature (381)..(381): n is a, c, g, or t
  misc_feature (435)..(435): n is a, c, g, or t
  misc_feature (438)..(438): n is a, c, g, or t
  misc_feature (513)..(513): n is a, c, g, or t
  misc_feature (540)..(540): n is a, c, g, or t
  misc_feature (621)..(621): n is a, c, g, or t
  misc_feature (690)..(690): n is a, c, g, or t
  misc_feature (692)..(692): n is a, c, g, or t
  misc_feature (702)..(702): n is a, c, g, or t
  misc_feature (765)..(765): n is a, c, g, or t
  misc_feature (801)..(801): n is a, c, g, or t
  misc_feature (840)..(840): n is a, c, g, or t
  misc_feature (875)..(875): n is a, c, g, or t
  misc_feature (1029)..(1029): n is a, c, g, or t
  misc_feature (1044)..(1044): n is a, c, g, or t
  misc_feature (1057)..(1057): n is a, c, g, or t
  misc_feature (1080)..(1080): n is a, c, g, or t
  misc_feature (1428)..(1428): n is a, c, g, or t
  misc_feature (1431)..(1431): n is a, c, g, or t
  misc_feature (1989)..(1989): n is a, c, g, or t
  misc_feature (1997)..(1998): n is a, c, g, or t
  misc_feature (3196)..(3196): n is a, c, g, or t
  misc_feature (3261)..(3261): n is a, c, g, or t
  misc_feature (3838)..(3838): n is a, c, g, or t
cgcgggcaatagctacggtgcttctgtaaaaacccgccacagaaagaccaactgatccggagaaaatgatatcgggatgtccaataaacaccagcgtattggccacaaatgatataagcanaatgaacgctgcaggctttgctacgcgcaaaaactcnggcaagcttacacgagcactccacaaaaggctcacgcaaatcaaggcgaacaccgcaaaggcaagtggctgntgtactgagaagagagcaacaatacccacaaaagtggcaacgatttttgtctgcgctgtcaatgaagcaagcgagaagtgcttaagcagagcacaggggcacttagacatagcaggcctccaaaagctcatgcaatacgcttacaaacagngggcaatcaagctgcgcagcctcgtatatctctggggttgtctgtgcttcttgnacnttgacgtctgcaacaacacagcccttctcgagaaacactactctgtcagcaaaaggaagccattcgcttacatcntgggtgattgcaagaaccgctttgccntcgtttgccagctcacgagcaagatgcagcacctgcgagcgcgcctcgccatcaagtccagacgttgcctcatcaaacacnaccgcgtacgttgcgcaggccagcgttcctgcaagcgctgcgcgacgagcctggccaccagaaagcgtnancggagacgcntccatgacctgctggtcaagccccacacgtgctgccgcatacgcgacaagcgcctcaacatcntctggcgagaaacccttgttagttggaccaaacgcnatatcttcagcaacactttgggcaaagagttgatcctgngggcgctgaaaacacatgccgacatctccagggcncaccagtcgcgcatcgattgttgcgtgcccggtatcagcctctatgaggccagcagctatgcgggcgcaggttgtttttccagagccagaagcgcctaccataacaacaagctctcccgtagaggaaatagttacgtcatgcagaacgggcttntcaaacgcatgaganacgccacaaactnccagctcgtgttcctcgccaagngcttgaattccgtcatagttgtttgctcgcaccacctcaagggcacgctgatacacaagggtatccaaagcatcaaacgcaaggttgttctgaacaagaaacgcaacaaactctgatgcgttaaaaggcacatcaaacttatagccagcctgtgcagctatatgcgctgttgctgtgagtgcatcatcaaaaccagcgtttgcgattgcgtttgcatccaagagaaactctgtgggagttcccgaccaaactagctggcctttctccaaaacaagtacctggtcagccccgggaagagactcaaacgaatgagaaatctcaagcatacccattccgtttgtaacaagngtntttaccaggttagaaaggtgatttctgaatcgagtatcaagctgagcaaatgcctcatcaagcaccagataacgtggatgcactgaaagcgctgctgcaatagaaacaagctgctgttggcctccagaaagcgtatgggtaggcgcatcaatcaaatcggcaatgccacaaagctccagtgtttgagtaacgcgagaaactatctcttcttttggcaaaccaagattagcagggccaaaggcaacttcatcaaagacagttgcacaaacaagctgcgctgttggatcttgacgaaccattcccacaacggaagaaatctgagtagacggcactacggtcactgaattgccgtctactaaaacctctccggatagaggaaaaagtgatgcattacaaagatttgcaagcgttgacttgcctgaaccattgtggccaagcacaaccgttctagagcccggctttagggtaaatgaaacgttatcaagggttagtgccattgggtgcggagattggctctcagtggctcctatggcatcttcagaagcagagtcagtcatngattgtgnngcagctaacgtaccgtatgcgaaagatacgtttttgaactcaatcatgacaaccctccttcatttgaaaaagaggtcccagcaaaaagccaggacctcttcagattcactttgacagaagttactctgcagcctcttcggtctgctcggtctcctctgctggagcctcggtctcctcttcctttacaggagcaggagcaaccttggtagccttagccttcttgttagaagcctttggctgaactggctcggtaacgagctcaaggataacaacctcagaagcatcgcccttacgaggaccaagcttcatgatacgggtgtagccgccgttgcggtcagcccacataccctgagcagccttgtcaaatacctcacggacaagctctgcgttaccaaccttggccatagcaagacgacgagcgtgaaggtcgccgcgctttgcccaagtgatgaccttgtcgacctcgccgcgaactgccttagcgcggacgtcaagagtcttaatacgatcgttagtgaaaagggcttggatcaggctcttcttgatggccttggtgtggctagcatcagtaccaagcttcatgcccctcttcttattgtgcctcataatttacattctcctatgcgtgacaaggcgcgactaagccttaagggacaggcccatgctctcgagcttttccttgacttcttcaatagacttaacaccaaagtttctgatgttgagaagatcgttctcagagaaatcaacgagctgacggacagagtgaattcctgcacgcttgaggcagttgtaagaacggacggaaaggtccaaatcctcaacctgcttctcaagctcggaatcgtcctcgacgtctgccttagcaaaaatcgaagcctcttcctgagtctcgtcaaaatcagtaagtcccatgaatgcgctcatgtgctggttaatgatgtttgcagcctcaacgacagcctcgcgagggctgattgcaccattggtctcaacctcaagcaccagacgatcatagtcggtgtgacggccaacacggcaaggctcaacagccttagcgcagcggcgaactggcgagaagatcgagtcaacgtgaatgaatccaattggatcgctctcacgctcgttatcctcaccggaaacataaccgcgaccattaccaaggcgaagtctcatggaaagatgagctccctcagcaagngtgcaaatgtgctgagctgggttaaccagctcgtagcccataggaacatcaagatcagcaccagngactttgcaaggaccatcaacagagatggaagcctcagcctcatcagagttgttggtgttgcggaaaactaggcccttaacgttcagaacgatgtcagtaacgtcctcatagacgccttcaaccgtagtgaactcatgctgaacgccatcaatctggatggcctcaaccgcagctccctcaagagaggaaagcagtacgcggcggagggagttgccaagcgtgtcaccatagccacgctcaagcggctctacgctcacacgagcgacgtttgcgccgatttcatctaccgacacgtttggtcggataaattcggacattgctacctccaaaacgggtcgggcttacttggagtagagctcgacgatcagctgtgcgtcaatctcaaggtcgatctgatcgcgggttggaagctgaagaacagtgccctgcagcttctcaatgtcaacctcaagccatgcaggaactgccatgtgctcggaggaaatgagagcttccttgattggaagaagatcctttgccttggaagcaacagcgataacatcgccgctctttacgcgataagaaggaatgtcaacncgctgaccgttaacggtgatgtgaccgtgacggacagtctgacgagcctctttacgtgtacgagcaaagccaaggcggaagatgacgttgtcaagacgagtctcaaggatgctcatcaggttgtcaccagtaatgcctgggttcttcttagccatctcatag

SEQ ID NO: 872 - DNA, 4000 bp, Escherichia coli
  misc_feature (1986)..(1986): n is a, c, g, or t
ggaccggagacggggagcgggcgcgggagcggggacgcgagcggggactcgaacgcgaacgcgaacgcgggggggcaggagagcgggtcgatctgggggaacgtgttcggcggtggacgaaaagccgaagaagagtccagcgggtcgcccgcgatgccggatttcggagcggcgacgacggagctaaagtgatcgaggactcgaacgcgcgcggcgggacgcatagaaagacatttaatccagacagaaacgtccgtagtgaaactaaactaaagtctaatcgatcacgagctcgcgaacttcgacgccttcgaagtttgagtcggaggatgtggctaaggtgagcgcgcgcccgttttcgagcgcgaacggtgtccggtcgcccgtgaggtggaaatcgtcgagcgtcgcgtagtctccatctaaaacttgttcgagaacgcgatactttttcaattgctgacgcgcgcggaacgggaggtcgagctcgaacgaggtcaacgcccgcccccacgccgaatgcggtcgacgagacgtcaagaagacgtcgacgtcgcgacacatcggacaccctttcgccgctgagagcgcgacgtacgacgcgagacagtcttcgcagaaagacgccccgcagcacggcgcgcgagcggcttcgcccgataacacatcaaggcaaatcgtgcacgactcatcgcgcgtcacgagttcgtcgtctaaatcaatcaacggggtcgtctccgtcgtcgtctcggacggcttggcgctgcgaaaaccggtgggaatcgcgaagactttgcaatgtatatcctcctcgcgcggcgtcggtgcgtatttctgcggcatcggcgcatcgcgtgtgaccacaatgacgtacgcatcgccgtcgtacgtggtgacgtctaaaaccgttctcgacgtcttcgcgtcgggattcgcgaggcacgcctccacgttgacgcgcaacgcctcgagcaagccccgtcgcgagtctgtcgacccctcagccctggagtcgatcacgtgcaccgggcgctcgccgtcgagccaaacgacgacgatgaattgactcgaaatcgcgcacgacggcacggtaggcatcgctcgagccgccagctcgagcgctcgacctcgcaccgcgccgaatcgcggcatccatcccaaatccaccctcaacgacgtcgcctcgatcgcgcgcacgcgcgtccgcccacgctcatccaacgtgaacgcgcacgcctttcgctccagcaccgcgtactcttcgtcgaaattaatcgcaatcgtcacgtactccaatccttcgccgccgtcgagcgcgcgcacgcgagcgaacggcgcgagcgtcttctcctcctccatccctccccgcgcgcttcgcctgtccgcgttcgccgtgaacaccgcacacgccgtcgcttcatccccacgcagccgccatatcgccaagcacgacccgtttcccgcgaactcgtcgcccgagtggttccacttcgtcgccgcgcgcgcccacgcgtactcccccgccgtcccgcacccgccgaccgcgcaccgtcccgtcgccggccacgccgtcggcatcgtcagcgtcttcacgacgtctccggtcgccccgtccaggacgtcgaccgcgcacgtcggatcgccgcggcaccgcgcgacgcgtcccgccgccgccgccgtcccgacgcagcacgcgtccaccgccccgcctccgccgtcgcgcgcgtcgtccgcccgcgcgcgcgcgtcgcgcgggatcgacgtccacgtcgcgcgcgcgcgatcgccgtcgcgcgcgccgtcgcgccgcgacgccgcgtcgaagcgcgccaacgacccgtcgtcgaacccgacgacgacgacgtcgccgcgcgccgcgaacgccgtcgcgcgcggcgcgcgcgacgccccgcgcgacgtcgccgcgtcgtccgcgtcgcgcgcgagcgccgcggcgcgcgcggcgacgcgcatcggcgacgcgangtggcgccagcctgtcggtcgcgtcgcagactcgcgcgcgatgtcgctcgcgcgcgcgcgcgtcgcgacggcgcgcgcgacggcgcgcgcgacggcgtcgaccgcgcgcgggggggcgcgacgcgcgacgacgcgcgtcgcgcgcgcgagaagggcgcaagatgcgatgggcgatggttcgaaaccgttgcgacgcgcggcggcgacgacgcgcgcgctgcgcgaggacgacgtcgacgggctcaaggttgacgaactgaaggacgtgctgcggacgatggcgctgccggtgagcgggcggaaggcggatctcgcggcgcgggtgaaggaggcgctggcggcgcgcggcgaaggcgaaggcgaagacgaagacgaagacgcgacggcgacgatcgaggcggtcgtggaggcgacggtcgagggacgcgcggtggaagaagcggaggcgacgttcgcggaggcgcgcgaggagggtggtgtcgcggagacggtgatggagacgcgcgcggacgccgcgccggcggaaacggcggcgccggtcgaacggcgcgcgagcgtcgtcgagggatgggacgaggcgcgcgcgccgacgccgggcacggcgttttggaacgcgatgccgcgggcgacgagagcggacgctcgagaagcggaagtgacgaagacgacgtcgccgttgcgcgtggtgcacatcaccgccgagttggcgcccatcgccaaggttggcggtttgggcgacgtcgtcgaaggactggcgcgcgcgcacgggaagatgggacacgcggtgactgtgattcttccgttttactcgtgtttaccgacggacaagatcgacggcttgacgcacgtgatggattacgacgtcaccaagggtcgttatcaagacggcgagacgcgatatttcaactttcgcacgacggcgatgcgagggcgagtgaacggcatcgacgtgatacttctcaagccacacgacgacgagcgctcgaatatatttcaaggttcgaagatttacggcggatcgtacgatgaacgtgaggcgtacttgtacttttgtcgcgcggcgcgcgaatttttaatcgcctctggtgagaatccaaacatcattcactgtcacgagtggcaagcgtgcggatttcctatgatcttttggggacttcgcgatgcgtacgggcaagactgcgacggtatgtccaacgcgaaaatcatgctgacgattcataacttggactccaacggcgaagcgagacaggaagagttctgcgccacgggcgtggacgcctccatgttcgccaccgtcgacaaggctttggacgaacgcaccatcgggcacaacccagaaaggctttgcttgctcaaggggggcatcgtgtattcgaatcacgtcaccacggtgtctccgacgtacgcgacggaaattctcgccggcggtggcggattcacggggaagaatctcgttggaaacaagcacaagtttagcgggattctcaacggaatcgatccggagagttggaccccgagcgacgatccgttcataccgtacggctatgactctaccaacgtcaagtcgcaaaaggcgttgtgcaaaaagtatctgcagcgcggattaggtatgaaggaagaccccgacgcgccgctggtcgtgtgcgtgtcgcgcctcgtgccgcaaaagggagtaaatctcatcgagcaagcgattcgcacgacgcgctcgaacggcggtcaattcgtgcttctcggcaccggccattcagacggcgttttccgcaaaatggctgaaacggaagagttcggagaaaattccgactcgacgcggcttatgctcatgtacagcgacgcattgagccatttactctacgccgcagcggacattgtcatcgtgccctcgatgttcgagccgtgcggacttacgcaaatgatcgcgttgcgctacgccgcacttccgctcgtccgtcgcacgggcggtctcgcggataccgtattcgacatcgatgacgcttcgatcgacgaaaacgaa

SEQ ID NO: 873 - DNA, 4000 bp, Escherichia coli
  misc_feature (21)..(21): n is a, c, g, or t
  misc_feature (341)..(341): n is a, c, g, or t
  misc_feature (861)..(861): n is a, c, g, or t
  misc_feature (2941)..(2941): n is a, c, g, or t
  misc_feature (3831)..(3831): n is a, c, g, or t
  misc_feature (3978)..(3978): n is a, c, g, or t
gctgttcactttcttgatccntttctggagtaaaatgttgttgtatctcaactaaatatcccaactcctcttgaatatcaggcaggacaaagtcagtcaatttttcaagttctgcaattgcagatactgcattgccgtccgcaatttctatttttgcgtttgctgcagcaagattataactcgcgtttttaaaattaggatcatgcttcagacaaagtttgtacatgttttttgcatgattccaatcatgttttttacgatatgtgttacccagcagattagccaattctacgtttttaggatccattttcaggacattaacacctaaacttattataccntcaggattacctccgccctgcatttcctgaaatagtttagtaacagtttcagcagcaagtttagggtcaagctccaaggctttgttaaactcaactgctgcccagtcgtaaaagtttttttccagtaaacttttaccgcgttcaagaattgaatttaactctttgtttggatcgtccgtgctgaaaaatttttcaagtattttcatggatctgctgctaaccgactattcatgtgacttggactgctgactttggatgtgctgacaagttcaaacatcatcataactgatggtgatcttattgtaaattcgagtttttagaaaaagttcatcttaaacaatgatttgatcattttgaaaaaagtagtaaattaggtagtcatgaatgatttttagtgttttggttctgaatattaaattgctgattaattcattgtttatcagaaaagacttgctaaaatcaggcctgatgtggcatctattgtgcagaatattgtgcagaaatatgttaatctggtaanttctgaagtatttttccttttgggtacggtactttaaagctaaaatgaaactgtttcaagtgaattgaaacatcaaaactgaggaataatggcagaagtatctgatgattttgaaatcaaactgtcagcagaagacagtccggatgacattttaaatgatcaaggagatatagaattgtttgaagaagatcacagcagtgatgagcctttagctgggctggatgatacagatttggatgatgtcctcgccgatcctgatgatctggatgaaggtgagatagacctgggcatggatgagattggtgatcttgtggaagacttaaagctggacgttgctgaggatgatgctgatgctgatgcttcaattgaagtagaagcggatatggtttttgatgaggaagaaacagaagatgagactaatgattcagtagaaagtttgctcgatgaacttggagatgacgatagcggagaactgagtcttactgatgattctgcagatttagaagaaattgatgaacttgatttagcagaaagtttagagtcagacgcagaaccagtttctgctgaactggaatctgcagaagaagctgaggaaagttccggagatgactcagtagactccgattcttcagatgttttggatatgctgcatgatcctgaaatttcggatgaaagtaccgatgaagatgctgaagatatggaacttggcatggatactcttgacgacaccaaggatgacgatttaactgatcttgggcttgatgatgtagagactgcggaatccggcgatgaagaaattgctgttgaagatgctgctgatgaaacagaggaagtggatgttcaggaagcaacaacagaagatgaaataactgatcttggtcttgatgatgttgagacggcggaatccagcgatgaagaaattgctgttgaagatgctgttgatgaaacagaggaagtggatgttacggaagcaacaactgaagatgaaataactgatcttgggcttgatgatgttgagactgctgaggcagaacctgaggcggacgagttagtaacagaaacagctgaggtagaacttgaagcggatgagtctgcagttgaaacagctgagctagagcccgaagcagaggtaattcctgcattggaaacaacaaccgatactcaagatgagcttgaggaaacaagtgatgagatagaagaaattgaaatcgatgaaccagaaattgaagttcaagaaacacctgcaattgatatagtggagagtgaaatgccaattgaatcagaggcagcagagaaaatagcggcccctttaggctcagacatgctgttaaatttcaaccatgaagtggtggtcgaaatagcgaggacaagtcttaccggcgaagaaatcacacagatcacttacggcagcattattgaacttgataaagttgcaggagaaccggtgaatttggtccttgatggtaaaacaattgctcttggggaagtagttcaaattaataatgaaaaactgggcatacgtatagtaggcgttattcaggactaattgaaattatgctgcaccaaacagacatccccgtaaaaccttatgagctggctgaagctcaatttaatacaggacgattccacataatggacattgtctttcgcagatgggcaactctcttacaagagacgctttatgcgaaaatgggcatgatgttagaagtctccactgaaaatgtggtaaagctgcgttttgaaaaatttttagattctgttgagaaacaaccaatctatatttttgaaactctcaaccatagtcgtggacttttacttgtagataagtctttttttgatttagcacttaacagtaaagcagagccgactgcagaaaaattgtcactggttcagatgatgaaagaaaaccagcagacgctgcttaaattggtaagtactctgattgatgattttgaaaaaagctggctcaatattgcagaaattgaactaaatctgaatcgtgttaccatctatccccgccgggcaaatgtgatgttgccttacgaatattgtttggcaggaagtgttcagcttagtcttnacggtgttcaaacaagtatccagttatgcctgccttatgctgctcttgtatctgtgcttagaccgcttgaaaagaagaaaattattgaacctgaatctatggcttattactttcctcaagtgaaagaacatttcaagtctttgctggaaaagactgagtattcggttgttgctgaacttggtaaagctgatttgagagaagtaaaaggaaagttggaaaaaggtcaggtgctgcctttattgaataaagacggcctcgttacaatccggattaacggtactccagcattacaaggttctacaggggaatcctcagggaattattctgttcaggttatacgaggtactgaagacaaaaaaccctcagcaattcaaccaaaaagagaattcaaacaagtaacgtggccaactcagtaagtatcgttttttaatactgtagtaagccatttgtccggattctctccgcactcgcggaaaagctccaaagtctcatctgcaggagtaagcccccccttcgtgtactgctcaaaataaggcaacagccaattctcatctgctgatccaagtgcctctaaggctttttctacaatgagtctaccagtctttgcaaagtttgttcgattgacttcagagtgtagagcatcctttgctacagcttttttataaatcttgaactcttctttcggcaaatccatcaagattgattgtacagcagcaaaagcagtttcattataaagtaatgcaccaatcaatgccggaactgcgagtgaatattgcggagccacgctgtcaataactctcacttccagaatgttttttattctgatgtccggaaaaagcatgcccagatgttcttcccagtcatccatgtccattattaagtccggatgnttagcatctaacaattgttgaaagctaaaatccgtcgtcaggatcccctctccatcacgttttaaatgataaggcgccgcctttaaggcccattctatgtagtcctccagacgaaaaccagtatttaaaaaagcttccggtagtccngaacgtgaattatcggtatgct

SEQ ID NO: 874 - DNA, 4000 bp, Escherichia coli
  misc_feature (3119)..(3119): n is a, c, g, or t
  misc_feature (3132)..(3133): n is a, c, g, or t
  misc_feature (3135)..(3137): n is a, c, g, or t
  misc_feature (3139)..(3140): n is a, c, g, or t
  misc_feature (3142)..(3142): n is a, c, g, or t
  misc_feature (3145)..(3150): n is a, c, g, or t
  misc_feature (3157)..(3162): n is a, c, g, or t
  misc_feature (3164)..(3164): n is a, c, g, or t
  misc_feature (3166)..(3167): n is a, c, g, or t
  misc_feature (3169)..(3170): n is a, c, g, or t
  misc_feature (3172)..(3177): n is a, c, g, or t
  misc_feature (3180)..(3183): n is a, c, g, or t
  misc_feature (3185)..(3188): n is a, c, g, or t
  misc_feature (3191)..(3195): n is a, c, g, or t
  misc_feature (3197)..(3203): n is a, c, g, or t
  misc_feature (3205)..(3205): n is a, c, g, or t
  misc_feature (3207)..(3217): n is a, c, g, or t
  misc_feature (3219)..(3220): n is a, c, g, or t
  misc_feature (3223)..(3223): n is a, c, g, or t
  misc_feature (3226)..(3226): n is a, c, g, or t
  misc_feature (3228)..(3234): n is a, c, g, or t
  misc_feature (3236)..(3239): n is a, c, g, or t
tcaccgtactttactggcaacggtagcaaataccctcgattgtctagaaaagacaatactgcagcatcattcatgcgaaaattcccttgggttttcgccattttttctaaattgggatagagattagtaagaaaaaatactacaaaagttaggcacaaggacgtaaacagcattattgctatccgtcggattatgaacaatgccatttaagtacctgtttcgttgtttttaatatttatgtttatagataaaaaaaggccgcgcaggttagcagcgcggccaaaattttagtaagtattaagctttaaaaccccacttgtatacgtgcggatgataagcaatatgctgttcgcactgtaggtttggtctatgacttctatacaggtttctccaatatggctgtatagtcacgccttcatctctgatcagagcctgacattttcctgcaaccttacggcgttcatcagcatctgctatcgagtttgcttctgctaaaagtgcatcaaactcagcattgctccaagcaaattcgttccatgcttctcccgatctgtaagccaacccccacacttgcgttgcaaacggacggtggttccagttggttgagctgaaaggatactttgtccaatcattccagaatgttgatccaggtaaaatggttctttttactttgaaaccagcatcacgaagttgcgcagcgactgagtcagtcgtattcttgcgccagtcatcatcgattgaatgtagttcgtgttcatagtcttccataccagcttctttcataagctccattgccttcactggatcgaagggaagtctcactacactcgggtcatgttctggatgcatggaaccagcatgatgattgtccgccggagaaccttttccagcataacccaattcaagacaaactgacccatcaactgccatggcaagtgcttggcgtacgcgtttgtctttgtaagcgtctgcatcttggtttggacgaacaacaatagttgatccagtagaaattgttgaattttcccatccaattgatggcataaggtcaacgtactcgccaacggtttcataaaaaacgtctacttcgtcaccttccgcagcggcaacataagcagatggatccgtaccataatcaataaattcaattcgatccaatggtacagtgcgtcctacagaataaccccaccagtcatgcccctcatttcttactactgtacctgccacaccaacttcataactttcaggaatgaatgggccggttcctatagacgcacttgtccccatattatccgggttaaagcttgagtgaacgactgctgctgggtaatctgccataccagcaattaccgtaatatcggatgcaacacatgttaactcaacagtgtggctgtctgtgaccttaatagcccccgccgctgcttttccagtatccgcatcaatcaatgaagccatgcgacccgccatggagttaccttctactgatttgtcgcaccacccctcaatgtttctggcaacgtcctctgctgtgaaatcttccccattgttccatttcacacctttgcgaacgttcaaagtatactttgtagcgtccgcgttggcattccaaccctctaataaatttggcgtaattgagccgtcattgttgtattctacgagatattccaatgtaccggctgtgaaatgggcaagctgtgtccaatcaaaagttcttggatcttttaatgcaatgcattccattgccatacgcattgttccgccttgttgaagatgtcctcctgcaagtgctggctgggcaactccaatcagcccataagctccagcagcagtgacaccgagagctgttgaccgagagataaactctcgtctgtccatatctccgtttttatgttctcgggcatacatttctgctaccggatgtacacttttatttttcatcttttgcgtcatcattttctccctatttgagacacttttaaaccagaagatttgtagtaacttattactaagtgaaattcaacctatagttgagtgttaaaagctggagaacctcagcatttggtgccgtcactctatcattaatgtgtgttaagttcatattttgttttacaccctcgattctctcagttttcgaactttctgataataattccctaactatcagattttaattttttctgataataaccggttatgtcttcccagtctgccattttggattttatccaagttttttgcctttttgcatactgacgcgttgcaattgttgccttttcgatggcggtttcaagtgggatttctccgttcaaatgcattatcaattccttagcgcctattgctttgtttgcggccatatttttctcccatgttggaagattttgcttggcttcttggattgctccttgttctatcatgcgtttaaagcgatcttttatctgttggttaagaatttgcttgtcgggattgatcaccagcgccttgcagctttccttctccaaaatcggcggggctatattttcatgccattctaataatgactttcccgtggcttgtgccacctcccaagctctcgcaacccgcattgggtttttaatgtcgattttactcaatgtagcatcatccaaatctgctaaaagagcatggataccctctgatgaaagtctctgccttgcttcctcttttaaatcatctgaaatttctgggatgtcagataaaccactggttaatgcagaaaaatataaaccggttcccccgacaataattggtgtgggattattttctagaatatctttaatttcccgaagccagtgtccgactgagtaaaccgtttttgcctgcttgtgcccatagagataatgtttgaccatctgctcatcctccaacgatgggcgagcagtcaaaattctccaattttcgtaaatttggatagcatctgcattgatgataacacgtcccagtttctttgctaaaaatagagctaatttggatttcccagaggcagtcggaccaaccataagaattggtttattttcaacttgatgcaaaaaagcgttggttaaaagctggtccatgctgttgtgctttataaattattctgaaataaaccaagtgatattttncagcaaaaaaaannannntnngnttnnnnnnttttttnnnnnnantnntnnannnnnnaannnngnnnnaannnnngnnnnnnncnannnnnnnnnnncnnaanttnannnnnnnannnntaaaaatttctggtgaagcattgatgggtgacaaagggtttggtttaaatcctccgacggtggagagaatagcccgtgagataaagtccgttcatgctatcggtgttgaaatctgtatggtgattgggggaggtaatatcttcaggggtttacagggtagtgctcaaggtatggagcgcacaacggctgactatatggggatgcttgccacagtaatgaacgcactcgcaatgcaaagtgcgctggagagtgttggagttaatacgcgggttttaagtgctattccaatggatcaggtgagtgagccgtatattcgtagaagagcagtcagacatcttgaaaaaaagcgcgtttgtatttttgcagcaggaactggaaatccatactttaccactgatacagcagccacactgagggccagtgaaatggcctgtgatgcaatattcaaaggcaccaaagtagacggtgtatatgacaaggatccgtcaaagtttcatgatgctgaaaaattcgagtcaatttcgtacgacgatgttctttcaaaacacctaaaggtcatggacgcttccgctattgcactggcgcgggacaacaaattaccaataattgttttttctcttgatgaaccacttggtttcagagccgttctggcaggtgaaggtgcttacaccaaagtagttgaaaatccctaggatagtttcctggaatatgtaataagttacttaaattttgataagagcagaataatatgtcagatgatt

SEQ ID NO: 875 - DNA, 4000 bp, Escherichia coli
  misc_feature (1)..(1): n is a, c, g, or t
  misc_feature (3)..(4): n is a, c, g, or t
  misc_feature (6)..(6): n is a, c, g, or t
  misc_feature (12)..(12): n is a, c, g, or t
  misc_feature (14)..(17): n is a, c, g, or t
  misc_feature (21)..(22): n is a, c, g, or t
  misc_feature (24)..(25): n is a, c, g, or t
  misc_feature (32)..(33): n is a, c, g, or t
  misc_feature (35)..(35): n is a, c, g, or t
  misc_feature (45)..(45): n is a, c, g, or t
  misc_feature (53)..(54): n is a, c, g, or t
  misc_feature (57)..(57): n is a, c, g, or t
  misc_feature (62)..(63): n is a, c, g, or t
  misc_feature (68)..(68): n is a, c, g, or t
  misc_feature (71)..(71): n is a, c, g, or t
  misc_feature (73)..(74): n is a, c, g, or t
  misc_feature (76)..(78): n is a, c, g, or t
  misc_feature (85)..(85): n is a, c, g, or t
  misc_feature (87)..(87): n is a, c, g, or t
  misc_feature (91)..(91): n is a, c, g, or t
  misc_feature (93)..(93): n is a, c, g, or t
  misc_feature (95)..(95): n is a, c, g, or t
  misc_feature (98)..(98): n is a, c, g, or t
  misc_feature (100)..(102): n is a, c, g, or t
  misc_feature (104)..(106): n is a, c, g, or t
  misc_feature (114)..(114): n is a, c, g, or t
  misc_feature (117)..(119): n is a, c, g, or t
  misc_feature (122)..(123): n is a, c, g, or t
  misc_feature (139)..(140): n is a, c, g, or t
  misc_feature (147)..(148): n is a, c, g, or t
  misc_feature (150)..(150): n is a, c, g, or t
  misc_feature (152)..(152): n is a, c, g, or t
  misc_feature (162)..(164): n is a, c, g, or t
  misc_feature (170)..(171): n is a, c, g, or t
  misc_feature (176)..(176): n is a, c, g, or t
  misc_feature (184)..(184): n is a, c, g, or t
  misc_feature (186)..(186): n is a, c, g, or t
  misc_feature (203)..(204): n is a, c, g, or t
  misc_feature (212)..(213): n is a, c, g, or t
  misc_feature (220)..(220): n is a, c, g, or t
  misc_feature (223)..(224): n is a, c, g, or t
  misc_feature (226)..(228): n is a, c, g, or t
  misc_feature (230)..(230): n is a, c, g, or t
  misc_feature (234)..(234): n is a, c, g, or t
  misc_feature (240)..(242): n is a, c, g, or t
  misc_feature (244)..(245): n is a, c, g, or t
  misc_feature (248)..(248): n is a, c, g, or t
  misc_feature (250)..(251): n is a, c, g, or t
  misc_feature (254)..(256): n is a, c, g, or t
  misc_feature (261)..(261): n is a, c, g, or t
  misc_feature (264)..(264): n is a, c, g, or t
  misc_feature (269)..(270): n is a, c, g, or t
  misc_feature (277)..(278): n is a, c, g, or t
  misc_feature (281)..(282): n is a, c, g, or t
  misc_feature (286)..(286): n is a, c, g, or t
  misc_feature (291)..(293): n is a, c, g, or t
  misc_feature (296)..(297): n is a, c, g, or t
  misc_feature (301)..(301): n is a, c, g, or t
  misc_feature (307)..(308): n is a, c, g, or t
  misc_feature (310)..(310): n is a, c, g, or t
  misc_feature (313)..(313): n is a, c, g, or t
  misc_feature (320)..(321): n is a, c, g, or t
  misc_feature (323)..(323): n is a, c, g, or t
  misc_feature (325)..(325): n is a, c, g, or t
  misc_feature (329)..(330): n is a, c, g, or t
  misc_feature (336)..(336): n is a, c, g, or t
  misc_feature (340)..(341): n is a, c, g, or t
  misc_feature (343)..(343): n is a, c, g, or t
  misc_feature (346)..(346): n is a, c, g, or t
  misc_feature (348)..(348): n is a, c, g, or t
  misc_feature (350)..(351): n is a, c, g, or t
  misc_feature (353)..(354): n is a, c, g, or t
  misc_feature (357)..(359): n is a, c, g, or t
  misc_feature (363)..(364): n is a, c, g, or t
  misc_feature (366)..(366): n is a, c, g, or t
  misc_feature (369)..(369): n is a, c, g, or t
  misc_feature (371)..(372): n is a, c, g, or t
  misc_feature (375)..(375): n is a, c, g, or t
  misc_feature (381)..(381): n is a, c, g, or t
  misc_feature (383)..(383): n is a, c, g, or t
  misc_feature (390)..(392): n is a, c, g, or t
  misc_feature (397)..(397): n is a, c, g, or t
  misc_feature (400)..(400): n is a, c, g, or t
  misc_feature (402)..(404): n is a, c, g, or t
  misc_feature (412)..(414): n is a, c, g, or t
  misc_feature (416)..(417): n is a, c, g, or t
  misc_feature (423)..(427): n is a, c, g, or t
  misc_feature (429)..(430): n is a, c, g, or t
  misc_feature (432)..(432): n is a, c, g, or t
  misc_feature (443)..(443): n is a, c, g, or t
  misc_feature (446)..(446): n is a, c, g, or t
  misc_feature (450)..(450): n is a, c, g, or t
  misc_feature (455)..(455): n is a, c, g, or t
  misc_feature (458)..(458): n is a, c, g, or t
  misc_feature (465)..(466): n is a, c, g, or t
  misc_feature (468)..(469): n is a, c, g, or t
  misc_feature (473)..(474): n is a, c, g, or t
  misc_feature (491)..(491): n is a, c, g, or t
  misc_feature (493)..(494): n is a, c, g, or t
  misc_feature (502)..(503): n is a, c, g, or t
  misc_feature (506)..(506): n is a, c, g, or t
  misc_feature (508)..(508): n is a, c, g, or t
  misc_feature (520)..(520): n is a, c, g, or t
  misc_feature (522)..(522): n is a, c, g, or t
  misc_feature (527)..(527): n is a, c, g, or t
  misc_feature (535)..(535): n is a, c, g, or t
  misc_feature (537)..(537): n is a, c, g, or t
  misc_feature (539)..(539): n is a, c, g, or t
  misc_feature (541)..(543): n is a, c, g, or t
  misc_feature (547)..(547): n is a, c, g, or t
  misc_feature (550)..(550): n is a, c, g, or t
  misc_feature (561)..(562): n is a, c, g, or t
  misc_feature (564)..(564): n is a, c, g, or t
  misc_feature (566)..(566): n is a, c, g, or t
  misc_feature (568)..(569): n is a, c, g, or t
  misc_feature (572)..(573): n is a, c, g, or t
  misc_feature (576)..(576): n is a, c, g, or t
  misc_feature (582)..(582): n is a, c, g, or t
  misc_feature (585)..(585): n is a, c, g, or t
  misc_feature (590)..(590): n is a, c, g, or t
  misc_feature (593)..(593): n is a, c, g, or t
  misc_feature (602)..(602): n is a, c, g, or t
  misc_feature (604)..(605): n is a, c, g, or t
  misc_feature (607)..(608): n is a, c, g, or t
  misc_feature (610)..(610): n is a, c, g, or t
  misc_feature (618)..(618): n is a, c, g, or t
  misc_feature (620)..(620): n is a, c, g, or t
  misc_feature (626)..(626): n is a, c, g, or t
  misc_feature (632)..(632): n is a, c, g, or t
  misc_feature (641)..(642): n is a, c, g, or t
  misc_feature (645)..(648): n is a, c, g, or t
  misc_feature (650)..(651): n is a, c, g, or t
  misc_feature (654)..(654): n is a, c, g, or t
  misc_feature (657)..(658): n is a, c, g, or t
  misc_feature (660)..(660): n is a, c, g, or t
  misc_feature (670)..(670): n is a, c, g, or t
  misc_feature (672)..(672): n is a, c, g, or t
  misc_feature (679)..(679): n is a, c, g, or t
  misc_feature (684)..(685): n is a, c, g, or t
  misc_feature (690)..(691): n is a, c, g, or t
  misc_feature (704)..(705): n is a, c, g, or t
  misc_feature (709)..(709): n is a, c, g, or t
  misc_feature (714)..(715): n is a, c, g, or t
  misc_feature (718)..(718): n is a, c, g, or t
  misc_feature (720)..(720): n is a, c, g, or t
  misc_feature (723)..(723): n is a, c, g, or t
  misc_feature (731)..(731): n is a, c, g, or t
  misc_feature (733)..(733): n is a, c, g, or t
  misc_feature (739)..(739): n is a, c, g, or t
  misc_feature (741)..(742): n is a, c, g, or t
  misc_feature (744)..(744): n is a, c, g, or t
  misc_feature (747)..(749): n is a, c, g, or t
  misc_feature (764)..(764): n is a, c, g, or t
  misc_feature (767)..(767): n is a, c, g, or t
  misc_feature (771)..(771): n is a, c, g, or t
  misc_feature (775)..(775): n is a, c, g, or t
  misc_feature (777)..(777): n is a, c, g, or t
  misc_feature (782)..(783): n is a, c, g, or t
  misc_feature (785)..(785): n is a, c, g, or t
  misc_feature (792)..(792): n is a, c, g, or t
  misc_feature (795)..(795): n is a, c, g, or t
  misc_feature (798)..(798): n is a, c, g, or t
  misc_feature (804)..(804): n is a, c, g, or t
  misc_feature (806)..(806): n is a, c, g, or t
  misc_feature (809)..(811): n is a, c, g, or t
  misc_feature (820)..(820): n is a, c, g, or t
  misc_feature (823)..(824): n is a, c, g, or t
  misc_feature (828)..(828): n is a, c, g, or t
  misc_feature (831)..(832): n is a, c, g, or t
  misc_feature (837)..(837): n is a, c, g, or t
  misc_feature (842)..(843): n is a, c, g, or t
  misc_feature (845)..(845): n is a, c, g, or t
  misc_feature (847)..(847): n is a, c, g, or t
  misc_feature (849)..(849): n is a, c, g, or t
  misc_feature (851)..(851): n is a, c, g, or t
  misc_feature (854)..(854): n is a, c, g, or t
  misc_feature (863)..(863): n is a, c, g, or t
  misc_feature (867)..(867): n is a, c, g, or t
  misc_feature (871)..(871): n is a, c, g, or t
  misc_feature (874)..(874): n is a, c, g, or t
  misc_feature (880)..(884): n is a, c, g, or t
  misc_feature (887)..(887): n is a, c, g, or t
  misc_feature (891)..(891): n is a, c, g, or t
  misc_feature (897)..(901): n is a, c, g, or t
  misc_feature (903)..(905): n is a, c, g, or t
  misc_feature (909)..(915): n is a, c, g, or t
  misc_feature (918)..(925): n is a, c, g, or t
  misc_feature (927)..(933): n is a, c, g, or t
  misc_feature (935)..(942): n is a, c, g, or t
  misc_feature (944)..(946): n is a, c, g, or t
  misc_feature (948)..(948): n is a, c, g, or t
  misc_feature (950)..(953): n is a, c, g, or t
  misc_feature (955)..(957): n is a, c, g, or t
  misc_feature (960)..(967): n is a, c, g, or t
  misc_feature (969)..(970): n is a, c, g, or t
  misc_feature (972)..(986): n is a, c, g, or t
  misc_feature (988)..(989): n is a, c, g, or t
  misc_feature (991)..(991): n is a, c, g, or t
  misc_feature (993)..(993): n is a, c, g, or t
  misc_feature (995)..(1006): n is a, c, g, or t
  misc_feature (1008)..(1009): n is a, c, g, or t
  misc_feature (1011)..(1012): n is a, c, g, or t
  misc_feature (1015)..(1017): n is a, c, g, or t
  misc_feature (1019)..(1028): n is a, c, g, or t
  misc_feature (1030)..(1041): n is a, c, g, or t
  misc_feature (1043)..(1043): n is a, c, g, or t
  misc_feature (1045)..(1046): n is a, c, g, or t
  misc_feature (1048)..(1048): n is a, c, g, or t
  misc_feature (1051)..(1060): n is a, c, g, or t
  misc_feature (1062)..(1063): n is a, c, g, or t
  misc_feature (1065)..(1065): n is a, c, g, or t
  misc_feature (1068)..(1077): n is a, c, g, or t
  misc_feature (1079)..(1082): n is a, c, g, or t
  misc_feature (1084)..(1085): n is a, c, g, or t
  misc_feature (1088)..(1102): n is a, c, g, or t
  misc_feature (1104)..(1121): n is a, c, g, or t
  misc_feature (1123)..(1123): n is a, c, g, or t
  misc_feature (1125)..(1133): n is a, c, g, or t
  misc_feature (1135)..(1142): n is a, c, g, or t
  misc_feature (1144)..(1145): n is a, c, g, or t
  misc_feature (1147)..(1147): n is a, c, g, or t
  misc_feature (1149)..(1150): n is a, c, g, or t
  misc_feature (1152)..(1164): n is a, c, g, or t
  misc_feature (1167)..(1171): n is a, c, g, or t
  misc_feature (1173)..(1184): n is a, c, g, or t
  misc_feature (1186)..(1186): n is a, c, g, or t
  misc_feature (1189)..(1200): n is a, c, g, or t
  misc_feature (1202)..(1203): n is a, c, g, or t
  misc_feature (1206)..(1206): n is a, c, g, or t
  misc_feature (1208)..(1220): n is a, c, g, or t
  misc_feature (1222)..(1236): n is a, c, g, or t
  misc_feature (1238)..(1242): n is a, c, g, or t
  misc_feature (1244)..(1245): n is a, c, g, or t
  misc_feature (1247)..(1250): n is a, c, g, or t
  misc_feature (1252)..(1263): n is a, c, g, or t
  misc_feature (1265)..(1266): n is a, c, g, or t
  misc_feature (1268)..(1270): n is a, c, g, or t
  misc_feature (1273)..(1274): n is a, c, g, or t
  misc_feature (1277)..(1277): n is a, c, g, or t
  misc_feature (1280)..(1283): n is a, c, g, or t
  misc_feature (1314)..(1314): n is a, c, g, or t
  misc_feature (1396)..(1396): n is a, c, g, or t
  misc_feature (1985)..(1985): n is a, c, g, or t
  misc_feature (1992)..(1992): n is a, c, g, or t
  misc_feature (1997)..(1997): n is a, c, g, or t
  misc_feature (2403)..(2403): n is a, c, g, or t
  misc_feature (2456)..(2457): n is a, c, g, or t
  misc_feature (2459)..(2459): n is a, c, g, or t
  misc_feature (2468)..(2468): n is a, c, g, or t
  misc_feature (2470)..(2470): n is a, c, g, or t
  misc_feature (2480)..(2480): n is a, c, g, or t
  misc_feature (2484)..(2484): n is a, c, g, or t
  misc_feature (2490)..(2493): n is a, c, g, or t
  misc_feature (2596)..(2596): n is a, c, g, or t
  misc_feature (2611)..(2611): n is a, c, g, or t
  misc_feature (2630)..(2630): n is a, c, g, or t
  misc_feature (2662)..(2663): n is a, c, g, or t
  misc_feature (2672)..(2673): n is a, c, g, or t
  misc_feature (2694)..(2694): n is a, c, g, or t
  misc_feature (2697)..(2701): n is a, c, g, or t
  misc_feature (2717)..(2717): n is a, c, g, or t
  misc_feature (2719)..(2719): n is a, c, g, or t
  misc_feature (2741)..(2741): n is a, c, g, or t
  misc_feature (2750)..(2750): n is a, c, g, or t
  misc_feature (2754)..(2755): n is a, c, g, or t
  misc_feature (2759)..(2759): n is a, c, g, or t
  misc_feature (2792)..(2793): n is a, c, g, or t
  misc_feature (2821)..(2821): n is a, c, g, or t
  misc_feature (2862)..(2862): n is a, c, g, or t
  misc_feature (2979)..(2984): n is a, c, g, or t
  misc_feature (2987)..(2989): n is a, c, g, or t
  misc_feature (2993)..(2995): n is a, c, g, or t
  misc_feature (2997)..(2997): n is a, c, g, or t
  misc_feature (2999)..(2999): n is a, c, g, or t
  misc_feature (3001)..(3004): n is a, c, g, or t
  misc_feature (3006)..(3006): n is a, c, g, or t
  misc_feature (3008)..(3008): n is a, c, g, or t
  misc_feature (3010)..(3012): n is a, c, g, or t
  misc_feature (3014)..(3015): n is a, c, g, or t
  misc_feature (3019)..(3019): n is a, c, g, or t
  misc_feature (3022)..(3022): n is a, c, g, or t
  misc_feature (3027)..(3027): n is a, c, g, or t
  misc_feature (3029)..(3030): n is a, c, g, or t
  misc_feature (3032)..(3036): n is a, c, g, or t
  misc_feature (3038)..(3039): n is a, c, g, or t
  misc_feature (3041)..(3041): n is a, c, g, or t
  misc_feature (3043)..(3043): n is a, c, g, or t
  misc_feature (3046)..(3048): n is a, c, g, or t
  misc_feature (3050)..(3054): n is a, c, g, or t
  misc_feature (3057)..(3058): n is a, c, g, or t
  misc_feature (3060)..(3060): n is a, c, g, or t
  misc_feature (3062)..(3068): n is a, c, g, or t
  misc_feature (3070)..(3073): n is a, c, g, or t
  misc_feature (3077)..(3078): n is a, c, g, or t
  misc_feature (3080)..(3083): n is a, c, g, or t
  misc_feature (3085)..(3088): n is a, c, g, or t
  misc_feature (3090)..(3093): n is a, c, g, or t
  misc_feature (3095)..(3097): n is a, c, g, or t
  misc_feature (3099)..(3101): n is a, c, g, or t
  misc_feature (3103)..(3105): n is a, c, g, or t
  misc_feature (3107)..(3116): n is a, c, g, or t
  misc_feature (3118)..(3121): n is a, c, g, or t
  misc_feature (3124)..(3126): n is a, c, g, or t
  misc_feature (3132)..(3132): n is a, c, g, or t
  misc_feature (3134)..(3136): n is a, c, g, or t
  misc_feature (3139)..(3142): n is a, c, g, or t
  misc_feature (3145)..(3146): n is a, c, g, or t
  misc_feature (3148)..(3149): n is a, c, g, or t
  misc_feature (3151)..(3151): n is a, c, g, or t
  misc_feature (3153)..(3153): n is a, c, g, or t
  misc_feature (3156)..(3156): n is a, c, g, or t
  misc_feature (3159)..(3159): n is a, c, g, or t
  misc_feature (3161)..(3173): n is a, c, g, or t
  misc_feature (3175)..(3175): n is a, c, g, or t
  misc_feature (3177)..(3181): n is a, c, g, or t
  misc_feature (3189)..(3191): n is a, c, g, or t
  misc_feature (3193)..(3201): n is a, c, g, or t
  misc_feature (3204)..(3204): n is a, c, g, or t
  misc_feature (3208)..(3209): n is a, c, g, or t
  misc_feature (3211)..(3211): n is a, c, g, or t
  misc_feature (3213)..(3213): n is a, c, g, or t
  misc_feature (3215)..(3215): n is a, c, g, or t
  misc_feature (3217)..(3217): n is a, c, g, or t
  misc_feature (3219)..(3220): n is a, c, g, or t
  misc_feature (3222)..(3223): n is a, c, g, or t
  misc_feature (3225)..(3225): n is a, c, g, or t
  misc_feature (3228)..(3228): n is a, c, g, or t
  misc_feature (3230)..(3230): n is a, c, g, or t
  misc_feature (3233)..(3234): n is a, c, g, or t
  misc_feature (3237)..(3239): n is a, c, g, or t
  misc_feature (3242)..(3248): n is a, c, g, or t
  misc_feature (3251)..(3252): n is a, c, g, or t
  misc_feature (3255)..(3256): n is a, c, g, or t
  misc_feature (3258)..(3258): n is a, c, g, or t
  misc_feature (3261)..(3261): n is a, c, g, or t
  misc_feature (3265)..(3273): n is a, c, g, or t
  misc_feature (3275)..(3283): n is a, c, g, or t
  misc_feature (3287)..(3290): n is a, c, g, or t
  misc_feature (3292)..(3294): n is a, c, g, or t
  misc_feature (3296)..(3298): n is a, c, g, or t
  misc_feature (3300)..(3300): n is a, c, g, or t
  misc_feature (3304)..(3304): n is a, c, g, or t
  misc_feature (3306)..(3306): n is a, c, g, or t
  misc_feature (3308)..(3308): n is a, c, g, or t
  misc_feature (3313)..(3316): n is a, c, g, or t
  misc_feature (3322)..(3322): n is a, c, g, or t
  misc_feature (3324)..(3327): n is a, c, g, or t
  misc_feature (3329)..(3329): n is a, c, g, or t
  misc_feature (3333)..(3336): n is a, c, g, or t
  misc_feature (3339)..(3341): n is a, c, g, or t
  misc_feature (3343)..(3346): n is a, c, g, or t
  misc_feature (3348)..(3351): n is a, c, g, or t
  misc_feature (3354)..(3355): n is a, c, g, or t
  misc_feature (3357)..(3362): n is a, c, g, or t
  misc_feature (3364)..(3367): n is a, c, g, or t
  misc_feature (3370)..(3379): n is a, c, g, or t
  misc_feature (3383)..(3383): n is a, c, g, or t
  misc_feature (3386)..(3388): n is a, c, g, or t
  misc_feature (3390)..(3390): n is a, c, g, or t
  misc_feature (3393)..(3394): n is a, c, g, or t
  misc_feature (3396)..(3400): n is a, c, g, or t
  misc_feature (3402)..(3413): n is a, c, g, or t
  misc_feature (3415)..(3415): n is a, c, g, or t
  misc_feature (3417)..(3417): n is a, c, g, or t
  misc_feature (3422)..(3422): n is a, c, g, or t
  misc_feature (3426)..(3426): n is a, c, g, or t
  misc_feature (3431)..(3433): n is a, c, g, or t
  misc_feature (3437)..(3439): n is a, c, g, or t
  misc_feature (3442)..(3444): n is a, c, g, or t
  misc_feature (3446)..(3451): n is a, c, g, or t
  misc_feature (3453)..(3453): n is a, c, g, or t
  misc_feature (3455)..(3455): n is a, c, g, or t
  misc_feature (3457)..(3459): n is a, c, g, or t
  misc_feature (3463)..(3464): n is a, c, g, or t
  misc_feature (3466)..(3466): n is a, c, g, or t
  misc_feature (3468)..(3468): n is a, c, g, or t
  misc_feature (3470)..(3471): n is a, c, g, or t
  misc_feature (3474)..(3474): n is a, c, g, or t
  misc_feature (3476)..(3476): n is a, c, g, or t
  misc_feature (3478)..(3479): n is a, c, g, or t
  misc_feature (3481)..(3482): n is a, c, g, or t
  misc_feature (3484)..(3485): n is a, c, g, or t
  misc_feature (3487)..(3487): n is a, c, g, or t
  misc_feature (3491)..(3491): n is a, c, g, or t
  misc_feature (3493)..(3495): n is a, c, g, or t
  misc_feature (3497)..(3498): n is a, c, g, or t
  misc_feature (3501)..(3502): n is a, c, g, or t
  misc_feature (3504)..(3510): n is a, c, g, or t
  misc_feature (3512)..(3513): n is a, c, g, or t
  misc_feature (3515)..(3515): n is a, c, g, or t
  misc_feature (3517)..(3520): n is a, c, g, or t
  misc_feature (3522)..(3531): n is a, c, g, or t
  misc_feature (3533)..(3548): n is a, c, g, or t
  misc_feature (3550)..(3560): n is a, c, g, or t
  misc_feature (3563)..(3571): n is a, c, g, or t
  misc_feature (3573)..(3574): n is a, c, g, or t
  misc_feature (3576)..(3581): n is a, c, g, or t
  misc_feature (3583)..(3583): n is a, c, g, or t
  misc_feature (3585)..(3585): n is a, c, g, or t
  misc_feature (3588)..(3588): n is a, c, g, or t
  misc_feature (3591)..(3592): n is a, c, g, or t
  misc_feature (3595)..(3595): n is a, c, g, or t
  misc_feature (3597)..(3600): n is a, c, g, or t
  misc_feature (3603)..(3604): n is a, c, g, or t
  misc_feature (3606)..(3608): n is a, c, g, or t
  misc_feature (3612)..(3613): n is a, c, g, or t
  misc_feature (3617)..(3624): n is a, c, g, or t
  misc_feature (3626)..(3630): n is a, c, g, or t
  misc_feature (3633)..(3636): n is a, c, g, or t
  misc_feature (3638)..(3638): n is a, c, g, or t
  misc_feature (3640)..(3645): n is a, c, g, or t
  misc_feature (3648)..(3648): n is a, c, g, or t
  misc_feature (3650)..(3651): n is a, c, g, or t
  misc_feature (3653)..(3655): n is a, c, g, or t
  misc_feature (3657)..(3658): n is a, c, g, or t
  misc_feature (3660)..(3661): n is a, c, g, or t
  misc_feature (3663)..(3664): n is a, c, g, or t
  misc_feature (3666)..(3667): n is a, c, g, or t
  misc_feature (3669)..(3671): n is a, c, g, or t
  misc_feature (3673)..(3675): n is a, c, g, or t
  misc_feature (3677)..(3688): n is a, c, g, or t
  misc_feature (3690)..(3691): n is a, c, g, or t
  misc_feature (3693)..(3704): n is a, c, g, or t
  misc_feature (3706)..(3711): n is a, c, g, or t
  misc_feature (3713)..(3723): n is a, c, g, or t
  misc_feature (3726)..(3729): n is a, c, g, or t
  misc_feature (3732)..(3732): n is a, c, g, or t
  misc_feature (3734)..(3737): n is a, c, g, or t
  misc_feature (3739)..(3747): n is a, c, g, or t
  misc_feature (3749)..(3754): n is a, c, g, or t
  misc_feature (3760)..(3760): n is a, c, g, or t
  misc_feature (3762)..(3763): n is a, c, g, or t
  misc_feature (3765)..(3783): n is a, c, g, or t
  misc_feature (3785)..(3789): n is a, c, g, or t
  misc_feature (3791)..(3812): n is a, c, g, or t
  misc_feature (3814)..(3819): n is a, c, g, or t
  misc_feature (3821)..(3826): n is a, c, g, or t
  misc_feature (3828)..(3869): n is a, c, g, or t
  misc_feature (3871)..(3873): n is a, c, g, or t
  misc_feature (3876)..(3880): n is a, c, g, or t
  misc_feature (3882)..(3882): n is a, c, g, or t
  misc_feature (3884)..(3887): n is a, c, g, or t
  misc_feature (3891)..(3891): n is a, c, g, or t
  misc_feature (3893)..(3902): n is a, c, g, or t
  misc_feature (3904)..(3906): n is a, c, g, or t
  misc_feature (3908)..(3908): n is a, c, g, or t
  misc_feature (3910)..(3919): n is a, c, g, or t
  misc_feature (3921)..(3924): n is a, c, g, or t
  misc_feature (3926)..(3928): n is a, c, g, or t
  misc_feature (3930)..(3946): n is a, c, g, or t
  misc_feature (3948)..(3954): n is a, c, g, or t
  misc_feature (3956)..(3963): n is a, c, g, or t
  misc_feature (3965)..(3968): n is a, c, g, or t
  misc_feature (3970)..(3977): n is a, c, g, or t
  misc_feature (3979)..(3979): n is a, c, g, or t
  misc_feature (3981)..(3982): n is a, c, g, or t
  misc_feature (3984)..(3987): n is a, c, g, or t
  misc_feature (3989)..(3993): n is a, c, g, or t
  misc_feature (3995)..(4000): n is a, c, g, or t
ngnngngtcggncnnnnaggnngnngtcgaanngncgccggagcncacgcgcnncgncggtnncccgnggnanngnnncgaggtncngcancncnccntnnngnnnagggaggnctnnngcnncaaccgcgtgcgcggnntcgccanngncntggtgccggnnngcgatnngtacngtgcgatngncgtggcgtcgaagcacnncaagcagnngggcgcngcnngnnncntgtnacgcgnnntnnggngnncgnnngaggngcnggcgnntcgctgnncgnncggngcggnnngcnncccnccgacnntncgngcggcgnncncnggtnnaggcgnccanncngancngnncnncgnnncggnncngcncnnggnagggcngncggcggnnngggcngcncnnntcggagannngnnccgccnnnnngnngncgtcgggcagnacntggncgganggnaggcggnngnnccgnngccgccccgggcgcccngnncgaccgcnncgngngctccgccgctncngatcncgcatggngngncnnncgancgncggcagcgctnncngngnnagnncangccccncgnccagngcngggcggcgntnngnncngccgagcncntcccgnagccgncgcgacgcnncgnnnngnnggngtnncncggcggcggngnacggacngccgnngcgcnnatcggcgcgcggnntcangaggnngancncgncgggcggnangtcgtnanngnggnnnacggggagccggcgnagntganggcngnggggnncnacggcanggncgnggcggncncgnnncgcgacgangcnnctcngcnncgcgnccgcnngnangncncgncggggaggnaggnaagntanccgcgnnnnncanagcngcgggnnnnngnnncgcnnnnnnngcnnnnnnnngnnnnnnngnnnnnnnncnnngnannnncnnncgnnnnnnnngnngnnnnnnnnnnnnnnnanngncngnnnnnnnnnnnncnngnngcnnntnnnnnnnnnntnnnnnnnnnnnncnanntnctnnnnnnnnnngnngnccnnnnnnnnnnannnncnncgnnnnnnnnnnnnnnntnnnnnnnnnnnnnnnnnngngnnnnnnnnncnnnnnnnngnncncnngnnnnnnnnnnnnnggnnnnngnnnnnnnnnnnntngtnnnnnnnnnnnngnngtngnnnnnnnnnnnnnannnnnnnnnnnnnnngnnnnncnncnnnntnnnnnnnnnnnngnntnnnganngangcnnnngaacatgcagacaacatgaaatcaaggcaantatggtcaagtcaaacgaccgattagtactggtcagctgagagcatcgctgctcgtacacatccagcctatcaacgtggtgntctaccacgggtcttcagggagaactcatcttgaggttggcttctcgcttatatgctttcagcgattatcctttcccgacttagctaccgagcgatgccgctggcgcgacaactcgtacactagaggtcagtgcttcccggtcctctcgtactaaggaaacctcctctcaattctcctccgcccacaacagatagggaccgaactgtctcgcgacgttctgaacccagctcacgtaccgctttaaccggcgaacagccggacccttgggacctgctccagccccaggatgcgatgagccgacatcgaggtgccaaaccctgacgtcgatgtgaactcttggtcaggatcagcctgttatccccggcgtaccttttatcctttgagcgatggcccttccatacagaaccaccggatcactaaggcctgctttcgcatctgctcgacttgtaggtcttgcagttaagctcccttctgcctttgcactcgacggctgatttccaaacagcctgagggaaccttcgcgagcctccgttacactttgggaggcgaccgccccagtcaaactgcccgcctggcaatgtcccgganccggatnacggncctcggttagaacttcggtactgtaagggtggtatttcaccggcctctccaccgaacctagcggcccggcttcaaagagtcccacctatcctacacatacagcaccaaagttcactgccagggtgcagtaaaggtgcacagggtctttccgtctagttgcgggtagctggcatcttcaccagcgctacagattcgctgagcccctcgtggagacagtccccaaatcgttactccattcgtgcaggtcggaacttacccgacaaggaatttcgctaccttaggaccgttatagttacggccgccgtttaccggggcttcggttcgcagcttcgccttgcggctaaccgctccccttaaccttccggcaccgggcaggagtcagaccctatacgtcgttttcgacttngcagagccctgtgtttttgataaacagtcgcttggggcatttcactgcgactnncngtcgcttcntntcgcgaggangctnacgacnnnnagcacaccttcttccgaagttacggtgctaatttgccgagttccttcacgagggatcactcacgcgccttggaattctcttcccgtctacctgtgtcggtttncggtacggtcgtccngtgcctgaagcttagaggnttttcttggcagcctggaatcagtgacttcgnncaaaagagnnctcgtactcgcttctcggatntannnnnacggatttacctatcnanccatcctaccagcttcaacccncacttccgntcgnnggcncacctatcctcctgcgtcaccccatcgcagcanngtccggtacaggaatgttgacctgtttnccatcgactacgcctttcggcctcgccttagggaccgactnaccctgagcggacgaaccttcctcaggaaaccttagacttacggcgagtgtgattctcacacactttatcgctacttgtgccggcagagtctcttctgaacggtccaccagtccttnnnnnnttnnnttcnnncngntnnnnantncnnncnncccnccnaccgntnncnnnnnannananttnnncnnnnnctnngntnnnnnnntnnnncccnntnnnntnnnngnnnngnnncnnntnnncnnnnnnnnnntnnnnttnnntttaangnnnggnnnnttnnanncnanccnccngnnnnnnnnnnnnntncnnnnncctttccnnntnnnnnnnnnttngggnncntnancngnngnncnggntngtnnccnnnccnnnnnnnaanntanncnccncccnnnnnnnnncnnnnnnnnncttnnnngnnntnnnantttngntnggttnnnntacccngnnnngncccnnnnccnnncnnnncnnnnccnncnnnnnngnnnncgnnnnnnnnnncctnaannnanttnngnnnnnannnnnnnnnnnngnanttganttgnctttnnncccnnngcnnngnnnnnncnancnnntttnnancnannccngntnngnncnncncccngnnntnnccnngnnnnnnncnngncnnnncnnnnnnnnnncnnnnnnnnnnnnnnnncnnnnnnnnnnnttnnnnnnnnncnnannnnnntncnctncgnntcngnnnnttnntnnncctnncccnnnnnnnnannnnnccnnnncntnnnnnnaangnnannngnncnngnntnncnnntnnngnnnnnnnnnnnntnncnnnnnnnnnnnntnnnnnntnnnnnnnnnnnttnnnntcncnnnncnnnnnnnnntnnnnnnttcccntnncnnnnnnnnnnnnnnnnnnntnnnnnannnnnnnnnnnnnnnnnnnnnngnnnnnncnnnnnncnnnnnnnnnnnnnnnnnnnnnnnnnnnnnnnnnnnnnnnnnngnnnccnnnnncntnnnncttncnnnnnnnnnncnnncntnnnnnnnnnntnnnngnnncnnnnnnnnnnnnnnnnntnnnnnnntnnnnnnnnannnncnnnnnnnncncnncnnnncnnnnncnnnnnn

SEQ ID NO: 876 - DNA, 4000 bp, Escherichia coli
  misc_feature (1988)..(1989): n is a, c, g, or t
gttaaacaataccaagtatggaagatcttcataaagaattgcttccatttgatttgataatgcaatagcttcatctactgttttagcagcttcaaaagcatcagcaacagcatcaaattctggattgttataacctggtgtattaaaaccaccaccacaagaatcgtttcttgagtggaagaatgttactgctgagtctggatatattccaacactccaacctaacatataaaagttccaatttttacaattgtcagcaccgaatactgtgtcaacaataacactgaaaccagtaggtcttgcagttacatcaaatcctaattgtcttatataatccgcaataaatagtgagaatgtatttctcaacggatcatacccaggacctggtgcataaatcaacatatctgaatctggtacttcaccattaggacctttaattcctacaggtgggttagctcttgtatcattaccttcatgacttccccagtcatcagctgtccatccagcttcttgtaatatagaaatagctttttcccattttccaacagtatcaagactttcacactcagcaagtgttccggttaatggagccgcccaagctgttaatgcacctgagatagttccatccattctcttaactgttccctgaagaacactattgataataaagtctctgtcaactatacatgcaacagcatttctgaaagctttgtcgcttcctgggaaaagtcttgtattatgtgcaaaatatctcattcctaatggatcattttgtactaattcaatacctggtacttgagctaattgattaaatgtgtttctcttaactccaagagggttaagaacgaaatcaacttcaccattttgaaaagctaggtaagcagcatcttgatcactataaagtgtaaattctactgtacctacaaatggaccgtattcataagaaaaactatctccagttgtgtttccaaagtcaccgctaaatgcaggtgccttaccattgtcccaggcaaaacttgtaccaccagcatcataaatggtagcagatcctccgtaccacatggtatttggatcatacttccatgtatagaatgctccttgctcaagcttgtcatagacaaaagctccagctacaggtgcatctattgcatcatgagctaatagtgaatctcgatctgttgcaatgctttcccaataggctttacttaatgctggtccttgagcagcaccatattgccatgtagaaagacctggatcatagttgaatgtaacactaacagtgtaatcgtcagtagctacaatgcttacaatacagttcttagcattgccttcatcatcttcacacaaataaggataggagtttaaccagtttccaactagatttaatccagttactgtatcccatgtaaactgccagtcatgtgcagttataggatttccatcactccatgtataaccttctctcacaggaacattatatgtatatgttccatcaccattatcagtagaagtttcaacaagttcccctgccatagctacaactaattgatagtttggtattgatagtgtataaagactcgttgcctggtcagacattacgtactgtgtccaaacatcggtatcagtgtcgagataaccccagtaattgtttgtttgtggatctgaataaattgccaccttatatactccttcaggacctgaaggagcagcttcttcagctgcagctgctgtagtagctggtgcttctgttgtttcaggtgtttcctcaacaacttcttcatcagcagtatcgccaccacaggcgactactacaagagcaaaaactgaaaaaagtaatataagacgccaagatttggatcctttaaaattactcaatttctctcctttttttgtatacaaaaaatccacataaatgtggatgtattaatactagaaaatttgtatatatttacaacgtattattgaattaattttataatttatttgannagttttttaatttatgaaataaatgaaaacctgaaatattcttataattatataaaatccagccgcaaaaactactaatttgaatccaaaactatgcatttatttttactttaaaacatatatttttcatattgaaattgtgtcttatactgttttctataaacacctgatagttttttggaattctagagcttagattaaaagaaaattcgggtggataagatgaatattgagttacatatttaagctttgctcttttgcccctaaaaggatgtggcggatttttaatccacaattctctaaatttaatatttaattctgaagtgctaattcttgtatgtaattgatcttctacgtctttaatactcttactaatttgtgtaatattttttttgtttaaagcagaaatacgtaatacatttacccactggtattgctttaactcatttttaatatttttatttatttcttccttttcataagtatttaatgtatcccatttattaaaaactactaaaggagttactttttgctctattgcttcttttaatattcttttatcttcaaaggaaagaccaacttcactgtctataacaattaatgctaaagttgcactttcaagtgatcttatagctacagtcgatgagtacatatcaatttgattcttttgtttttttcttggaatcccagctgtatcagtaatttgataggaaacagtatttaaattaatatcttcatttattttatccctagttgtgcctggtacattcgaaacggtcgatctgttactatttaaaagagcattaaacaaagttgattttccagcattgggacgaccaacaatcactattgaagatttcttataatttacattagaacttttcttagaaagttttttaagaatgttttctaaaatgtctaacccttttttgtgatatgcagagataaataattcagtattgaatatatatttatacattctcttgtctaaattttcaatttcaaagttttctgccttattaaatactgtggtagttttattttgcagattgttattgtttattaatttaaaaatagaatctaagccagaataattttttgattgtacatctattaaaaacaatatatggtctgctttgtttatgtatcttaaaatattatcttgaaatttaaggttaatgtcatctggatcttctaaaaaaccaggtaagtctgaaattaatagctttttttcttcttcaaactctaaagttgtagttactttatctcttgttgtattcggtgtagaaccaataatagatgtttttcttttagataaagcgtttactaatgttgatttaccagcattaggtaatccgagtattaaaacctctgggattttatttttagtcatattataaatatagctattctatttatatggtaaacaaactatatttagttactcctagaggcttctgtgctggtgttgaaatggctataaaagctttacactggttattaaaaatctatgatgaaacaatctattgttatcacgaaatagtacacaataaatggatagttaaagagtttgaaaaaaataatgttgtttttgtagaagaccctaatgaaattcctaaaggtgcaattgttatgttatctgcacatggaactgcacctgaaattgaactccaatttaacaatatatcttcattaactattaattctgtatgtccattagttacaaaagttcatcatgaggcaaaaaaatttagtaaagaaaacacacaaattatttatgtgggtcataaaaatcatgatgaagcaaaaggtgcaattggcgtttcacctgaaaacatgcacttagttgaaagtattgaagacgttaaagcattagaaattggaaatgatgttgctctacttgcacagaccactttagctttatcagagtgggagccaattatgaaatattctcaagaaagatttaatggtttaaaaatgccgaggaaaagtgacttatgttatgcaacta

SEQ ID NO: 877 - DNA, 4000 bp, Escherichia coli
  misc_feature (849)..(849): n is a, c, g, or t
  misc_feature (1491)..(1491): n is a, c, g, or t
  misc_feature (1540)..(1540): n is a, c, g, or t
  misc_feature (1575)..(1575): n is a, c, g, or t
  misc_feature (1581)..(1581): n is a, c, g, or t
  misc_feature (1591)..(1591): n is a, c, g, or t
  misc_feature (1651)..(1651): n is a, c, g, or t
  misc_feature (1987)..(1987): n is a, c, g, or t
  misc_feature (2245)..(2245): n is a, c, g, or t
  misc_feature (2980)..(2980): n is a, c, g, or t
  misc_feature (3443)..(3443): n is a, c, g, or t
  misc_feature (3635)..(3635): n is a, c, g, or t
  misc_feature (3980)..(3980): n is a, c, g, or t
gggttgtggaagttgggcaccacgtatatgaacttgggcttagcgcccttccgccggtcgagctcctgctcgagaacgtccacgggcatcccctcctggtccaggtgcaccgtcaggatgtctggaccgttggggacaaacgcggtgagagccccgagatacgaagggccttcgagcgcgatggtatcaccgcggtcgatgaagatgcgcccgaggaggtcgagggcctgctggctccctgtcgtgaccaggatgtgctcggggttggctcgcaccccttcctctgccatgacttccaccagcgctgacttcagttcttcgcggccctcggtctccccgtactgaaatgcctcgttcagccctttctcgagcacggaggacatgacaccgcggatgtcctctggcggcaggccgccgatgaacgggagcccgcccccgaacgatattacgtcggcgcgcccgatgacgctcatcaggtcccggaccgccgaggacctcatgagaccgctcgcctcagagtaaaggcttgtataggggtcgaagattatctcgggtgacatggttgctctccttcagcccgctcgcgcaggcgggccgggatttcaaatgaaggtaacgcagggctgttgtgatgtcaattgacacggggcgcgcccgtgaggcgcgacgcccggaccacgataggatagtggccgggttttgaaatataatttagcgtcggatgttcaacgagcgggggagcgtttgttcagcgaagatcaggcctttgcacttttgaagcggaggattttcctcgacaggggtctcgactgcgagcagtacaaggaaaactacctcaagcggcggatngccgtgcggttgcgcgtcaccgaggcgcgggactacctcgactacctgcgcatcctgcgcagcgaccccgacgagtacacaaggctgatgaacgagctgacgataaacgtcacgcagttcttccgcgacccggacgtctacgccaggctgcgcgagtcggtcctgccggagctggtggagacgaagacgcgtatgggatcgcgcacgctccggatatggagcgcgggctgcgcgagcggggaggagccgtactcgatggccctgctcatcgatgaggtgctggccggcaactccaaggcgtggaacgtgcgggtcctcggctcggacttcgacgagaagagcctggccgtggcccggctggggacataccaggacctcgagatgctgccgggggtgcaggccgaccgctatttcgagatagtgaagaagccggaggggacggagtatcgcgtcaaggacgagatcaagcgcaaggtgaggttcgagaagatcaatctccttgccgagagcgaggcgcggcacttcgacatggtgctttgccgcaacgtcctcatctacttcggcaggaaggtccagacgcggataatcgagaccctgtcgagaagcatcctcagggacgggtacctggtcctcggcaagtcngagaccctggggcaggaagcgtcgcaggctttcaagccggtgttccccngggagaggatctaccagatgctcgtcgatgaccgntcggcnggcgggagantgaggcgagttgggagctccagtgactgaactctttaaaagggcatggcgcgctctcacngtcccgacgttcaagatgaggatagcgcagacgttcgtggtcgtggtgtgcatcgtcctgtccctcatcatcgtcggagggatcgtgctgctgcggagctcgaacgcgcggagcctgactcagcaggggcaggcgctcaaggccggctccgagcagctcgatcaggcgtcggagagcttcggcgaggcggttctggccgagctgggcggaaacaccgggcgcgcccgggccctcactgacgacggcctccggaggctggcaaaggccgaaatcgagttcaagagatttgaaagcccggtgtcatcggatctcgcgcgtaagaccgcggctctcgcngccagtatcgatggggtcgcaagctctgcgaaatacgtcgaggcgcgcgccctcgctgccgcctccgacagctccgcgcaagcgacacttgcccacgctgtccaggaaggcaagggactggtcaggttcggcatcatcgcctacatcatcatcttgatcatcactgtcatcgcggggatggtgacgatgatcgtcgcttacaaagggctctcgggcatactgaaaaaggtcatcgccgaggtgagcgacatcgccagngggaagggcgacctcaccgcgactgtgacggttcccaccagggacgtgatgggggacctcgctgatgcgataaacgagatggtctcttccttgagggaatccatgatcgagatcagaaccatcgcggtcgagctcgccaactccgccgactctcttgcgggttctatcgaagggatgtcctcctcgatcggggaggtgacatcagccgccgagcagatctccaccggcagcgaggaccaggcgcgcaaggtcgaggacacgtcgcacgcgatgggcgaggtcagcagggtcgtagagggcatcgccgacaaggggcaggtctcggcgcgtcagagtgagctcaccgccgagctcgcggagcgcggtggcgaagcgtcgcaggaagccgcgcgcgtcatgagcgagatatacgaatcggtgaagcgttcggagaacctcgtggaggggctgggggagagatttacccaaattgggattataatcgacgtgataaccgatatcgccgaccagacgaacctgctggccctcaatgccgctatcgaggcggccagggccggggagcacgggaagggcttcgcggtcgtcgccggcgaggtgcggaagctcgcagagaactccaagcgctcagccgagcagatctcccacctcatcagggagataatgtcggaaaccagacgggttagcgcatcgatggctgagagcacaggctgtgtggacacggggcaggaagtcgcncataagaccggggaggcgctcgagggcatcatgaattcatccagcacggctgcccacgccgcctccgagatatctgatgcaatacagggcatcgcggccaacacggatcgagtgttcggggccataaacgacattgccgcgatcgcccaggagacggccgcgagcacccaggaggtcgccgcgaccatcaacgagcagagggtttcgacggaagacgtcgccgatcagtcgctggcgctggcgaggctggcatccaagttgcatgagctgaccgacggcttcaaggtctgacaggaagtcgtgggtccggcgcactcgaaagggagaagcgtaattggataatgaagaggccacgcaaacaagcgtcaaggccaggtggggcaacctctctatgacgcagaggtttgtcttgaggaccggctttgtcgcgcttcccgcggcaacggccgccgggctggttttngtcgcagtgctcgtcaagaacaagacggtaggcgtctggatagccggaggcgcgctcggccttgcggcgggcatcatcgcgatggctttcgcggggtacgccgcggtgtcgatgtacgtgcgcccgctcgagaagctcgagttattctcgcgcgagctggtcaagcacgacttctccaccgatgtcgagatnggcatgcggtcggagctgcgccccatatccgtcgccctgaaccagatgctcttctcgcttcgccggatcgtcgacgagatgcacacggtctcggacgaggtcgccgggtccagcaacctgatggcatctgtggcgaaagagacgtctgacgccgtacaggctacggcgtccaccgtgtcgggccttgcccgcggggccgaggaccaggtcaactcgatgatgctggcttcgaccaccatcagccagatggctgaagagatcgaccgggtcgccgaagccgcccgcgaggttgccaagtacagcctcgaggccagggtgaccgtcgaggacggcggggaggcggtnggccgggcgacggactcaat

SEQ ID NO: 878 - DNA, 4000 bp, Escherichia coli
  misc_feature (219)..(219): n is a, c, g, or t
  misc_feature (232)..(232): n is a, c, g, or t
  misc_feature (409)..(409): n is a, c, g, or t
  misc_feature (421)..(421): n is a, c, g, or t
  misc_feature (469)..(469): n is a, c, g, or t
  misc_feature (502)..(504): n is a, c, g, or t
  misc_feature (823)..(823): n is a, c, g, or t
  misc_feature (827)..(827): n is a, c, g, or t
  misc_feature (1363)..(1363): n is a, c, g, or t
  misc_feature (1956)..(1956): n is a, c, g, or t
  misc_feature (2076)..(2076): n is a, c, g, or t
  misc_feature (2136)..(2136): n is a, c, g, or t
  misc_feature (3030)..(3030): n is a, c, g, or t
cttttcagaaaataccagtactgtacttcaaattttagcagtagttgttcttgctgttggcggattaagctattataaccacactggcaatataaaaatggaaagcgcttcccatttagccggaagagctcaaaatatctttattaatggaaatttagatgaagctattgtaaaatttgagagagtattggcagattaccccaacacacctggagctgntcaatcgttagtntatttattgaatgatgccatgacaaaaaatgatattgaagaagcaaaaagacttttaaatgaaaatgatggttctattaatgatcctcatgttttagctgctatatataaacttcagggagatatctcacttactgaagctgacttttctactgcattaaaatatttccagaaagcngaaaatattgcngaagggaatccagttcaggccggatttcagcttgacattgctgctacnttattggcacagaataattatgaaaacgccctnnnaacattagaagaaataattgataatgaagatgttgggtttaatgaaaaaaatattgctgaagaactgatagcttacacgaagcaaaaaatggggatataattcttgtaaaaaacaagaatattgccataaattttaagtagcggaaagtggggcatgaacccactttctctttttatagacaaatcaaagctaaaattaagacagaggtatatattgattaataaggatattattgaagccttttccatgctggcgaaggaaaaaaatattgatcgtaccaatttaagtacgattattgaagatatcttcatggctctnatcnataaaaaatatggtgaggaaagagaaaatttcagcgtaattgtaaacatggaaaaaggtgaaattgaaatttaccaggaaatgaccgttgtaaacaccgtaatggatccggtaatagaaatccatattgatgaagcaattaaagagtatgatgatcttgaagttggagacgcttatgtaaatattttaagtcctgagagtttcggcagacgattaattaatactgctaagcaatatatggtacaaaaaattagagatattgagcggcaaactgtctttgatgaattctcaagtaaaattggtgaaattgttgttggtaatgtgcatcaaatacagcgtgaccagatttttgtacatgctgcaaatggtgcggaattcattatgcctaaaaatgagcaacttccaaatgaccgatttcgcaggggagaaactattcgggggattattaccaatgttgaaatatccagcagaggacctgaaattatcatttcccgaagtgatgactttttcttaaaacgattatttgaaaaagagatncctgaaattgaggatgaaattatagaagtaaaagctgtgaagcgtgctcctggagatagaagtaaaattgtggtgtactcttctgaccgccgtgtagatgctgtcggtgcgtgtgttggaatgcggggaagtagaattcagtccattgtacgagaattaaatggtgagaaaattgatattattaattggagcgataaaccagaaattcttatttcccgagctttagcgcctgcaaagcctattaatctttatattgatgaagaaagaccttatgtggttgccgtgtttgaagatgaagaattgcctatcgccatcggcagaaatggccaaaatataaaattggcttccagtgtcaccgaatatacaattgatgcagttaaaaaatctgagtatgaaggcgaacaggaagaggctctttatctggatgagattgagggaattgcaaaaaaccatattgaagtattggctaaaagtgaaatatataccagcgaagactttcttagtacaacgaaggcagatatattaacgctgaaaggatttggagaaaaaactgtggataagattacagcaataattttagaagctgtagcaantcatgaggcaaaaagtgttgagaaagaagaggggaaaacagaggtatctgactcagaagaatcgatattagaggaggttaataacgattaattatgcctgaggttgctaagaaaaaacgnatttttcaaattgcaaaagagctgaatatttcccatttggaaataatccagtttctaaanaatcatggtactgaagtcgatagccatatggctcccgtaacacctgaaacatacgatgaaattttgcttgaattttctaaagataaactgcaaattgagcgccatcgaaaagaacaggcacgaaaggtagttgtatcaaaaattcataaaaaagaaattgaagatccagcattcgccggtactcttgctaagccacctgttcgaaaactgaaaacctcacttaatgaagaaaaattggcattatccgctaaattgaaagatgcctcagataaacttacaaaagaaaagaaggctgttgccgataaagaaaaagctgaagcaaaaataaaaactgtaaagcctgaaataaatggttctaccgatgcaaagacgaaattagatacagctaaatcagaaaaaaacgacaatgatactattaagttgaccagagtatctgcaaccgaacatgctcctcctccacacagaaaattgaagaaaatcagcatccaggatatagctgataaaataaatcaaaccaaaaggcgttctccaaaagggaaaggtgatgcaagtaaaccgcaaataaagcagccattaccccaatttggaaaaagtgtttcaaaaaagaaaagtaagaaaaaagaaaaaaatattgatgttgaaacttctgatattgtaaaatccataaaggtacctgaatttactacggttgacgaactggcacaatccatggatgtaacggttcaagaagtgataatggcctgtatggggctggggctgatggtgaccattaatcagcgaatggatatggataatatcatcatgattgcagatgaatttgggtttgatgtagaaacggttactgaatttgaagaagagaaaaccagtcatgaagaagatactgaagaagatatnaagaatgctatggagcgtgctcctgttgtaacaataatggggcatgttgatcatggaaaaacatcacttttagattttattagagatgccaatgtagttgctggagaatctggtggaatcacccagcatattggtgcgtatgaggtaatattagatagtgggaaaaaaataacatttttggatactcccggacatgctgcttttactgccatgcgggcgagaggggctcaagttactgatttggtaattgtaataattgctgctgacgatgatgttatgccgcaaactaaagaagctattgatcatgcaaaggcggcagaagttcctattattattgcaatcaataaaattgatgtgccaaatgcaaatcctgataaaatccgcaaatctttaggtgaacttaatattttagttgaagaatggggtggtaaatatcaatgtcaggagatatctgctaaaaatggacaaggcgttgaagaattattagataaaatattacttgaagcagaagtattagaactgaaagcgaatcagaaaactgaagcaaaagggatcgtgattgaatctcgccttgataaagggcttggggcagttgccactgtcttaattaataaagggactcttttcaaaggcgatggatttgtttgcggcaatcaatttggaaaagtgcgggcattgatgaatgagcgaagtcaaaaactgacacaagcttatccctcggatcctgtacaaatattaggatttgatgaagtgcctaaagccggagatactttcaccgtatttaaagatgaacgagaagctaaaagaatagcaactgaacgggcacagctaacccgagaggctgaacatcgccgatttagaaaaataacccttgaccaaatcggtaaaaagatatcaagtggtgaagtccgagaattggatattattatcaaaggtgatgttgatggatcaattgaggcagttagcggtt

SEQ ID NO: 879 - DNA, 4000 bp, Escherichia coli
  misc_feature (1)..(8): n is a, c, g, or t
  misc_feature (10)..(11): n is a, c, g, or t
  misc_feature (13)..(16): n is a, c, g, or t
  misc_feature (18)..(21): n is a, c, g, or t
  misc_feature (24)..(25): n is a, c, g, or t
  misc_feature (27)..(27): n is a, c, g, or t
  misc_feature (29)..(29): n is a, c, g, or t
  misc_feature (32)..(34): n is a, c, g, or t
  misc_feature (36)..(36): n is a, c, g, or t
  misc_feature (38)..(41): n is a, c, g, or t
  misc_feature (43)..(46): n is a, c, g, or t
  misc_feature (48)..(48): n is a, c, g, or t
  misc_feature (50)..(51): n is a, c, g, or t
  misc_feature (53)..(55): n is a, c, g, or t
  misc_feature (57)..(58): n is a, c, g, or t
  misc_feature (60)..(67): n is a, c, g, or t
  misc_feature (69)..(70): n is a, c, g, or t
  misc_feature (73)..(86): n is a, c, g, or t
  misc_feature (88)..(89): n is a, c, g, or t
  misc_feature (91)..(92): n is a, c, g, or t
  misc_feature (94)..(99): n is a, c, g, or t
  misc_feature (101)..(105): n is a, c, g, or t
  misc_feature (107)..(111): n is a, c, g, or t
  misc_feature (113)..(117): n is a, c, g, or t
  misc_feature (119)..(129): n is a, c, g, or t
  misc_feature (132)..(136): n is a, c, g, or t
  misc_feature (138)..(138): n is a, c, g, or t
  misc_feature (140)..(140): n is a, c, g, or t
  misc_feature (142)..(142): n is a, c, g, or t
  misc_feature (144)..(145): n is a, c, g, or t
  misc_feature (148)..(153): n is a, c, g, or t
  misc_feature (155)..(156): n is a, c, g, or t
  misc_feature (158)..(164): n is a, c, g, or t
  misc_feature (168)..(178): n is a, c, g, or t
  misc_feature (181)..(186): n is a, c, g, or t
  misc_feature (188)..(188): n is a, c, g, or t
  misc_feature (195)..(201): n is a, c, g, or t
  misc_feature (206)..(206): n is a, c, g, or t
  misc_feature (209)..(210): n is a, c, g, or t
  misc_feature (212)..(214): n is a, c, g, or t
  misc_feature (256)..(257): n is a, c, g, or t
  misc_feature (259)..(260): n is a, c, g, or t
  misc_feature (274)..(274): n is a, c, g, or t
  misc_feature (281)..(281): n is a, c, g, or t
  misc_feature (289)..(289): n is a, c, g, or t
  misc_feature (309)..(309): n is a, c, g, or t
  misc_feature (331)..(331): n is a, c, g, or t
  misc_feature (348)..(348): n is a, c, g, or t
  misc_feature (358)..(358): n is a, c, g, or t
  misc_feature (369)..(369): n is a, c, g, or t
  misc_feature (713)..(713): n is a, c, g, or t
  misc_feature (1986)..(1986): n is a, c, g, or t
  misc_feature (1988)..(1988): n is a, c, g, or t
  misc_feature (3249)..(3249): n is a, c, g, or t
nnnnnnnnanngnnnngnnnncanngngngannngngnnnnannnnananntnnncnntnnnnnnnntnngcnnnnnnnnnnnnnnanncnncnnnnnntnnnnngnnnnngnnnnntnnnnnnnnnnncgnnnnngngngngnnttnnnnnnanntnnnnnnntctnnnnnnnnnnnttnnnnnnanaaaaaannnnnnnttttnttnnannnggggggggggcagtttgtcgcaccttatgtgacatccagatnngnncctggctgcgtagntaactgngtgaaggnttttgctttcctcccctagnccgattatcagaattggtcctncttgcctcctgactatnggtcaggggncttttttctgnccggggcgacagggggggcatgatcttgaggccgggactaccttaccccgccagccggtcgtcccgttcttctgaataatcggaaaggccgacatagagcttgccgagcaattgccggagcatcgccagttcggcctccgaaaaatcgccggtcacttttgcttccagcgctgcggcctggggcaggatggtctcggtcacgcttttgccgttagctgttagttcgacggtgaaggagcgtgcatcttcggcatcgcggacgcggcggacgagatctttcttctccatccggcccaggacgcgcgacaaggtcgagaaattgatgctggtcaggtcggacagtncgccgacggtttgagcgccccgctggtatagtgcgatcagaacccgccacgactggatatcgacgccggcctcgctgaggaccggcgtgatatcgctgatgaaccgctgcccgacgcggttgacgagatagggcaggtaagtgccgagttccaagacaggttactccgcggcgatactgtagttctcgaagttcggcgcgacttcttccatgaacttgtgcatctggtccttgaccatgccgtgcggctttttaccgacgttgaaatacaggatgcattcatcgataccggcggcctcgacggctttgagctgctcggtgatctcggcggagttgccgagcaggacggaattcgacgatagcgtgttcttcgtcatgttccggaggatctcgttgatcttcatgaagtaatgcatggtcggcggcatcgtggtcggatcatcggggaacgcgcgcagcacgcagtgctggaagtaatccatcattgcctggcgtccgatatcgtcctcttccggcgtgtccgagatatggatgaaatagctgcacatggcacggcccggcttgttgccggccttcacgcagttctcgcgatagctgtcgaccgccttatccaggctgccatagaccatcgccgcggcaaacggtgcatagatgatgttgtgacctttgttccctgccatcttggaggatgtttccgagaacgacgcgacatagaaggggatcgggtcctggatcggcttcggcgtgatatccatatcctggatatcgtaatatttgcccttgtgcgaccacgggcctttttcggtccatgccttccagacgatatccatgccttcctcgaagacttcggccgacgtcatgaagtcggcgccgaacgggtggtattcatcggcatcgtagccgcgcccgcaggcgtaatcgacgcgaccgcccgatagcaggtccaatgtcgcccacatttcggcaacatggataggatgatgaattggcaacacgttgaccgcgggggcgaggcgaatattggttgtctccggaatgatgctcgccagcaggatgtccgggcgtgaattgacgccgagccggtcaaaatgatgttcgccgatccaggcagagctgtagccgagcttgtctgccagaattgcctgttcgcggatctccagcacgaagtcgttcgcagaacgcggattgtccggataatagttgtcggagagtgtgaaatacccgaaatcgatcgccatgttgtatctccctatgctgacgttttgcttgttgangnatttgtaattgcaaataaatatatttgcaagtgcaaattatggggtggtcggaggtgactcgacaagctgcgcgccgcggtgtttttctatgcgaaataaaataatgagcccgctgatatgaaggtgatgcgcgaaacggcactcgcaacggcggaagagcggcaggcattgatcgcctcgctgccgacgcggttaaacgatgtactgcatatgcgggtccgggaaacaccagacctgccggtgatctatgcagggccggatatctttagctatgccgacctcggaagaggtgtcgaggcagcgacggccatcttgcgggatgccggtctgagggcgggcgaccgggcgttgctgatcatggagaacagctttgccggggtgtgctgcctgtatgcgatcatggcgctcgatgcatgggctgttcttgccaattcacggcttacggtgcgtgaacgcgatgtaatgatcgacaaggctcaaccgcgcctgatcgtatgcgtcatcggagacaagccggagacccatgaccttgcgccggtcggttcatcaggccatcggggaaccgcctgcggcacctttgctgtgagcacagcagacccaagtgtcataccggagccggtaccggaccggaccgatgaacaggttgcggtcatgctattcacatcggggacaacgggcgtgccgaaagcggcaatgctcgggcacaaatcgcttatgtatcagagttccatattatcggaacgtcgtgggttcggccccggtgattgaccgtatctggtggcgccgatcgttcacgtgctggggctcgccgggatattcctgcctgccgtctatagtggcagcgccgtggagctcgccacccgttttgatgccgattttgtcatggagggtttgcggcagaacaaactgactcacctttacggtgcaccgccgatgatctcgatgcttgtcgaccgggcccgtcaggaaggcgccgcgcttgatgtgggcaagctcagggagttgttcagtggcggggcgctggtcgatcgtgagctgtgcgaccgggtcgaacagaccttcggaatgaaactgagcattggctacgcggcgaccgaatgcacgccgattgccgccagctcacctgcattgccggcgaatcccggcgcggtcgggctgccgtttccgggcatggatgtccgcgtggtcggcccggacggcacgccgctgcccaccggcgagaccggggaaattcaatgtaacgggcccaacatcatgctnggctattaccgggacccggaagcgaccgcgttggcgattgacgatgcgggctggttgtcgatgggtgacctcggttttttcgacgatgatggacaaattcatctggtcgggcggctcaaggatctgataacccgctcagggttcaacgtctatccggcggagatcgaaggcgttctgaacagctatcccgacgttctgcaatctgctgttgtcgggcgagtggttccgggaaatgaagaagtgatagccttcgtcgaggcgatttcgggcgcagagattaacgtggctgaactcgccgcctatgccgccgagatgctcgcgccttacaagaaaccggcacatatcgaggtactgtcaaagctgccggtcggcgcaaccggcaagctgctgaaaaccgagctgcgtgaaattgccgacaggctggacctggcgtgatcgaagccgcatttgccgagcgccgcgaacacgctacgataggcgttcaacaaggggataaccgatgtcagaagccgtctatcgcgaatacgattcagaagcgctctttgcgcagtacgataaccgcgcgcagctttccgaagaagcgctgaacgccatcaaggcagaccagagcgcacggtccgaggcctatatcgccagcaccgagcgcaagcatatcaatgttgcttacggaccgcacgagcgcgagaagctcgatatctttctgccgcaaaatgacggcgcgccgatgttcgcattcatccatggcggttac

SEQ ID NO: 880 - DNA, 4000 bp, Escherichia coli
  misc_feature (488)..(488): n is a, c, g, or t
  misc_feature (591)..(591): n is a, c, g, or t
  misc_feature (1146)..(1146): n is a, c, g, or t
  misc_feature (1215)..(1215): n is a, c, g, or t
  misc_feature (1746)..(1746): n is a, c, g, or t
  misc_feature (1947)..(1947): n is a, c, g, or t
  misc_feature (1985)..(1985): n is a, c, g, or t
  misc_feature (3239)..(3239): n is a, c, g, or t
  misc_feature (3511)..(3511): n is a, c, g, or t
  misc_feature (3519)..(3519): n is a, c, g, or t
  misc_feature (3558)..(3558): n is a, c, g, or t
  misc_feature (3594)..(3594): n is a, c, g, or t
  misc_feature (3881)..(3882): n is a, c, g, or t
  misc_feature (3884)..(3884): n is a, c, g, or t
  misc_feature (3888)..(3889): n is a, c, g, or t
  misc_feature (3891)..(3892): n is a, c, g, or t
  misc_feature (3894)..(3895): n is a, c, g, or t
  misc_feature (3897)..(3900): n is a, c, g, or t
  misc_feature (3902)..(3902): n is a, c, g, or t
  misc_feature (3904)..(3905): n is a, c, g, or t
  misc_feature (3907)..(3919): n is a, c, g, or t
  misc_feature (3921)..(3923): n is a, c, g, or t
  misc_feature (3927)..(3930): n is a, c, g, or t
  misc_feature (3932)..(3932): n is a, c, g, or t
  misc_feature (3934)..(3940): n is a, c, g, or t
  misc_feature (3942)..(3947): n is a, c, g, or t
  misc_feature (3950)..(3954): n is a, c, g, or t
  misc_feature (3956)..(3956): n is a, c, g, or t
  misc_feature (3958)..(3959): n is a, c, g, or t
  misc_feature (3961)..(3978): n is a, c, g, or t
  misc_feature (3980)..(3982): n is a, c, g, or t
  misc_feature (3984)..(3992): n is a, c, g, or t
  misc_feature (3994)..(3994): n is a, c, g, or t
  misc_feature (3997)..(4000): n is a, c, g, or t
gggttagtggcgccgatcccggcctataccttgctcacgggcaaccagttggacgctgtgccgatgatcgcgtgggtgttctcggtcagtttcctgggcatttggatcgcctggtatctacggccctccctgctgaatgaccacgcgttgaaattccccgaaggcatggccaccctggaaaccctgttgcacatttacaaccacggtcgcgaagccgcgacgcgtttgaaggtgctgctcagcgccgcgctgctctccggtttggtcaagtgggtcgatacctttatgtgggcgttcccgcgctggtcgcccagcgcgcacttggagcgcctgacgttcactgccgacccttcgctgttgctggtgggctttggcggcatcatcggcattcgcgtgggcctgaccctgctgctcggcgccctgctcgcctggggcgggctgggcccctggttgttggcacaacacctggtgacattgcctgcggacancagcggcccacagttcgccgcgctggtggagtggttgctgtggccgggcgtgagcctgatggtgtgttccaccctggcctcgttgacgatacgtttgtggggnttgtaccgatcgacccagtccagcggcggctcgacgtggaccctgcccaagcccgggcccgccgctgggtttgcgctgtcgatcgggctggtggtgagtctgcaggcgctgctgttcggcatcgacctgggaatggcgttgctcaccattccgctggcgatctgcctggctgccgtcgccgcgcgcgtggtgggggccaccggcatcccgcccatcggtgccatcggccaactgtcccaattgagctttggcatcgttgcgccggggcaggtgccgatcaacctgatgagcgccaataccgctggcggttcagccgggcaatgcacggacctgatgaacgatttcaaggtgggcaaggccattggcgccacaccgcacaaacaagtgatcgcgcagatcctgggggttttcatcggcagtatcgtcggtgtattcgcctacctggcactgatccccgacccgcaatccatgttgctcaccgaagagtggccggcaccggcggtcgccacctggaaagcggtggcacaaaccctcacccatgggctcgactcgctntcgaccagcatccgctgggcgattgccatcggcggcttggttggcgtgctgctcggcgtgctggacagnaccttgcctgcccatcgcgcccgcttcctgccgagtgccgcggcattgggcctggccttcgtgctgccggcttcggtttcgctgatgatggccctgggcgccatactgacctggctggtgagctgccgctggccgagcctcaccgagcgttttgcgattaccgccgctgccggcttgatcgcgggggagagcatcaccggcgtcggtgcttcattgtggtcgatggtgaggtgacgcatggctcggcaaacgccgagcctgccgtcccggcctcaggcgatcttcacattcatggtgatcttcgccgtaaacaccttcaccccgccctcatcgaaaatatccaccggcacgatcttgtcgccagccgttgaccagtcaatgccactgccatccgccaccgcacggatgttcgacttggccttcgccaggtactccacggtcatgcccttgggaatccatctggcgccttgggcaatcgacacatccgtcatcgtcccaccggccaattccgccgcgttgcacaacgcaatngcatgcaccgaggccaggtggttggtgatttccttgcgaaacggcacgttgaccaccgcgtggcctgggcgcagttcggcgatttcagggttgatggtgctgaagtagggcgccacctggcaggccatctggctgaacgcggctgggcctacgctgttgaacatgctgagaaactgactcatggatttcctcctgataggnttacagaataatattctgtgacggaacaatattctgtnaattccaagggtgtcaagccatgccttctctagcggctgctgtacctttagactccgcacatttggcgagcgacttcatgcacgcacctgatctgatcgagcgcaccttcccgggccgacgcagcgacctcaagcgcagcatcctgcgcgaggcgctggcctgctttaacgaagtgggtattgaagccacgaacatcgaaaccatccgcgcgcggtgcgacaccagcgtgggtgccatctaccaccatttcggcagcaaggaaggcatcgtcgccgcgctgttttttgccgcgctggaggaccaggccgccctgcgtgagcactacctgacgcaggcgcaaaccgcccaggcaggtgtgcaagcgttggtgtgcagctatgtggagtgggtggacgcacaacccgactgggcgcgctttgtgttccagagccgtttcgccgtggccaacggcccgttcaaggatgaattgctcacccgcaacaaacagcgcaatcggcaattgaccgagtggatgagcgaggagggccgcgctgaagcgttcagccacattcccgccgagcttttgctctcgctgatcattggcgcggcagaaaactacgcccgggcgtggttgtccgggcgggtcaagaaaagcccgaatgcctatgcgtcgttgttggcccaggcggcgtgggcgtcgatcagccaaacgcctcctcaataaacgcctcgagtgtcttctcttccaggatctccatggagaagtgcccgaagcgcttgggcagccagataatgcgcccgccagaaggtgactgcaggttctcgcgggccaggggcacgccgttttcattctcgggttgcacaccggcggcgatcagctcgtcataggcgacctcgatgtccggcgtggtgtagcagtggcggtaaatcatgccttcgccgtgggcgtccaacagctcgcgcagattcccgacaatcggctggaccagcatgaaccgctcttgccccatcagcaccacggcatagcgcacatgcagaccgccgcgttcccacacgaaagtctttgagatgcgtgcgttgaggatgtgcgcgtaataggcgcaagcctcctcgaggttttcaaccagtatgtcgacgtgactgaacttcaggtccatggaggaactcctgtgaaatcgatccccatggtaaccacgcgtgtttgtcgcgttgaaatttaattgtcggcactcccggacgctggcgtagtctgtttccaagacatcctttcgctncgcggagtactcaatgatcatcgtccaccacctcaacaactcacgttcgcaacgcatcctgtggctgctcgaagaactcggcctgccttacgagatcaagcgctaccagcgtgacccaaagaccaacctggcgccgccggaactcaaggccatccacccgctgggcaaatccccggtgatcgaagacggtggccaggtgttgatcgagtccgccgcgatcatcgactaccttatccgccatcacggccagggccgcctgcaaccggacccgnccagcgcngcctatgacacctacgtgcaatggctgcacttcgccganggctcggccatgttgccgttgatgctcaacctctangttggccgcctgggtgaagccggcgcgccgttgcatccgcgtattgaatcggaagtggccaactacctgggttatctgaacgacgcgctggcggataaagcgtacttgctgggcgacgagctgagcggtgcggatatccagatgagctttatcggcgaagtcgccggggcccagggcaaattgcaggcctacccgcacctggcggcttgggtagaaaaattccaggcccgacctgcgtatcgcaaggcagtggagcagggtggggagtatgcgtttgccaagtgacnngngctnngnnanncnnnncngnntnnnnnnnnnnnnngnnngccnnnntngnnnnnnnannnnnngcnnnnncncnncnnnnnnnnnnnnnnnnnngnnnannnnnnnnnanagnnnn

SEQ ID NO: 881 - DNA, 4000 bp, Escherichia coli
atctctgcagccaatgcttgattctcaatgatcagcagcctgcttctcagaattatttgctcgttatgagactttcttccacaacttttattttatttttcaacgttttgctcgcaggcactgtctcatttatggcaggctcgctgctcagtacgtggcttcatcatcaagtcttgtctattcctgttttgtcacccagaacattccaaatcgaaactgctaaactgccggtcgattccggaaaagcacaaaaagaatttgcagtaattttggaacgcaatatctttaatgcgcaaaaaacggaaatcgaattgccgccaactcttcctgaagaggaaattattattgaggaaaccacggatggtgaaacagttgaacacacacgtttagcaatcgcacttgcaggtaccatgatttacggagagcagaattcatttgcttttatcagtaaaaaagatagtttaaacaaatatttgatttatggaataggtgaatgttttcacgcaaaaacaattaagcgtgacgaagaatgtgcagaagaaagcgtaaaagtgttgaaaatcaaggatcgctgggttttgattctttatcaaggtgaaaaacaagctttgtggatggtcagcggggatacttcaggaaagtcagcgctaactgctactcaaccaaaaaaggcaaaaggccaaactgcttctgtacagcaaactgctgcgatcgttgtaccgccacagaaaaatgttgttgcagaaaaagccattattcctgcttctactactgacacaggaaatacttatcattttcagcgggtgtgggttgatgaacaactggcaaatttccagcaactgctgaatgatgcgagggttgttccgaccacaaaagatgacaaaccttatttcatgtttcagtacattaaagaagaaagtatctatgaaaaattgggactgaaaaaaaatgacatcattttagaaataaacggatttgttgttgattcagttggaaaagcactcaagttattggaagtacttcaatcagaacgtgagatttccctcaaggtggaaagggagggtaatgcggtacaattccattactacattgattgagcgtgctaactgctaatcgctaacaaataggtatcttgcagaatgttgttcaaatggtacaaaaccggtttactcgaatttgcaacactgctggctgcactgctttggattttctcccgttatcaacacacccttaatcagcttcaccctgaatggatcttgctggcagttgtcttagctgttttttggtgcctgcggcataacttatatcttcccttttttttacttcttttgattgcagcaattctcctgcaccaatggttagttgtgcttccttcaagtgtgaactggctgaagcaggaaatttcagcggaatcaacaattatgctcaacggcaggattcagcaacgaatcctcaaagaagatactgtccgtctgcaactgagttcagtggaactgagcaaaggcgaaaaaaagctgcatcttccggaagcagttttatactttccaaaaaaacgtcgcagaatttataatttttatcgtggacgtcatttacaggtcatcggccaattgagtgaagtcagcattgataagaatcgtttgaatttaggttttgcagattttcgttatcgtaacgccatttatccgcaatccgaactcttccgcaaaagaaacagttgggtacggcaattaacagacagggcggagtttcacctttccagtcaagcactcgcgctgtatttaccactgacattggcgaagcgttcttatggttctcgttctactgcaaaggtttttcaggaaaccggaatggcacatcttctcgctatcagcggtctgcacattggtttaatctatggaattatcctcggacttgtacgcggaataggacgtctctcaatccgttttttggagcacccccgcttttacgcaatctctcagttgatttctctatccggaatttggctttatctgttcttaattggtatgcctactccggcatttcgtgcagtatttatgttgagcttactggttgccggacgtttgctcggtcaagttcatcaacctctttacgccttgtttgcaacagcattttacttcattttcctaaatcccgcagtgatttacgaagtttcatttcaactctcatttctcgcggttttatttattctgtggttcctcccactttatccacgccctggacaaaatgatagtttctggaaacgtctcattaaatacggattaatcagcgtcgccatcacgtcagcagtaatgcttggtacatggcctgttgtggccagtattttcggacgcctgtcactggaaacattctggttgaatattattatggtcttcttgcttgggctgctggttttaccaagctgtctgttgacgctttttgtcagcgctatttctttgggaaatccgcctttcggattgctggaaaacgtcgtattttcgctgaccgagctgattgtacagggttggtttgcagtacttgagtttctacatcactgggggaactgggcttcgtttacactgactcttgactggggccctccgcaatttattctgtattactcagtcatcctgctcctcggaaaactgcttacaaggcgattccgaaaaacagtctaagtatttaatattttaaagtaaaatgcatatttatgctaaaaaataagctgctgctcactgtcccaaacgattcagcaattcagtcagttttatgttataattaaagacaaaattgaaagtagaaaacggatttataccgttaatagtttatcaacacttaaaaatattattatcctgaaatagcttaaagattgataattgacatggaaaagatccagcacaaattagtagtatttcagtcaaaagacatccggagaaaatggcatgaagaagaatggttttattctgtggtggatgtttgtggtgccttaacgaacagcaataatccgcgggactactggtataggataaaaaagagggtaagtgatgaggaaaaagctgagttgtcgacaatttgtcgacaacttaaattatccgcatctgatggcaaaaaatacaatacagactgcgctaattcagaaggtatttttagaattattcaatcaattccatcacccaaagcggaaccatttaaaaggtggttggcaaaagtcggtaaagagcgtttagatgaaatagaaaatccagaactggcacaagccagaatgaaagaaatatacgagcaaaagggttatccaaaagactggattgataaacgcttacgcgggatcgccatacgacagaatttgacagatgagtggaaagaacgtggcataaaggatgatctggattatgcaattttaactgcagaaatttcaaaagctactttcggaatgacacctggagaatacaaaaaatttaaaaacctgcctgtaaaatcaaaagcaaatcttagagataacatggatgatttggaactgatttttactatgcttggtgaaagaatgacaaccgaaatttccaaagaggaagaaccggacacttttgatgaaaacaaaaatgttgcgaaacgaggcggaaatgttgcaggaaatgccagaaaaaatgctgaaaaagaacttggcaggagtgtgatctcaaaaaagaactatcttggcaaagttgataaaaaagaacttgaacaataaattatgaatgaagcagtacactactcaaacaccagcttcgattataactcaacaaacctccgtcagtatattattcagaacttattggacagtatcatagagggttcaaaaatactgaaatgcgtgcaaaataaagctgaggcatctcttcatgaaataaagtccatgttaactttctgtattcgtggtgaacgattttgtgatggacatgttgcgtcggtgattgagtcaggaaaaatgaaatcaattctcatgcgtctcaaagtaatgatggaagaa

SEQ ID NO: 882 - DNA, 4000 bp, Escherichia coli
  misc_feature (320)..(320): n is a, c, g, or t
  misc_feature (1203)..(1203): n is a, c, g, or t
  misc_feature (1205)..(1205): n is a, c, g, or t
  misc_feature (1239)..(1239): n is a, c, g, or t
  misc_feature (1401)..(1401): n is a, c, g, or t
  misc_feature (1441)..(1441): n is a, c, g, or t
  misc_feature (1605)..(1605): n is a, c, g, or t
  misc_feature (1635)..(1635): n is a, c, g, or t
  misc_feature (1984)..(1985): n is a, c, g, or t
  misc_feature (2324)..(2324): n is a, c, g, or t
  misc_feature (2582)..(2582): n is a, c, g, or t
  misc_feature (2723)..(2723): n is a, c, g, or t
  misc_feature (2957)..(2957): n is a, c, g, or t
cacagcaaggtgcgaccattcggcgcagattatatcgtaatcctgacgataagatactgggtggtgtaatcagcgggttggcagcttatcttaattgggatgtcacggtgctccggcttatcatgtttgtggtacttatctgcggatatggcgtgttgattcctatctatattatttgttggttagttattcccgaagctcgtacggcagccgagaagctgaacatgcggggagaggatatcactatcgagaacattggcaggacggtgaccgatggctttgagaggatggccaacggtgtaaacaactacgtaaactcnggtaaaccccgtagctttctgcagaaagtaggagacgcattggtgtccattgccggattcttcctgaaagcttgcctggtggttcttgccattatttgcagccctgttctttttgttcttgccatcgttttcgttgctctggtgattgctgccattgcagtagccatcggaggtggagccgctctttatcagatgttgccttcggtcgactggtcaccattgatctctacttctccgatgatgactatcgccgggagcattgcaggagttgtcttggcaggtattcctttagccgccatcattttcgtgattctccggcaaatcttcaattggtctcctatgtcatccggactgaaatggtcactgttgattatatggatactggctgtcgttatttttgtcatcaacctctcttacctgggatggccttatcctttcctttgggtcggatgacgtgaaatgccaattagttgatgatcatagaaatgcttcccgtagtgtgtccgggaggcattttttttgtaagaaaaatacggttttgtgcaacgaaccgcaaatcttttgttatttttgtttgttactcatcgaaaagaatacgtatcatatgggcgagcatatatgtttcagaagaaatgaaagactggcaacggtcaatcctcactggcggggcaatcctgtagtaagaggaaagtttgtcaatcgccagcatcgttttcgtcccggaatggggagtgtgttgaagtggcgtctttcgcccaatccgcagcggaaagagaaaaagagtgtgaagtggagtcccaagttgaattatctgcgttcgctggatggcgtggtaggcaattcactgatttggctcgggcataattctttcttcctgcagttngntaggaagcggatcatgttcgaccccgttttcggngatattcctttcgttaagcggcaaagtgattttccggccaatcccgatatatttaccgatatcgattatctgctgatcagtcacgatcattttgatcacctcgataagcaaagtgtggcacggttggtaaaaaacaatccggggatgaaactcttttgtggnctgggcaccggggagctgatcaaaggatggtttcctgagnttgaggtgacagaggctggctggtatcagcagatagaagatgacgggctgaaaataacgtttcttcccgcacaacattggagcaaacgttccgttcgcgatggagggcgcaggctgtggggggcatttatggtacaggccgatggtatttccctctactacagnggtgataccggttactccaggcatttccgngaaatacccgatcttttcggagctcccgattatgctttggtgggtatcggggcctataaaccgcgctggtttatgcaacccaatcatatatcgccttatgatgctctgactgcatcgaccgatatgaaggctgctctcacaattccgatgcattacggaactttcgatttgtccgatgaacctctgcatgaccctcctctggtttttgctgccgaagccaagaagcgaaagatagatgtatatatccccgtactgggagaggtggtgaagttgaagcggatgtagactttgggtacttcttaccttccaaatagagcttctgttgtcaacaaataaaggctctgtccgnnagggacagagcctttatttgttgacaacacagcctttatttctgtgccgtttcgtttggtttcagccattgatccagccattcgaagaaagtccgttgccacagtacaccgttctgtggtttcagtacccagtggttttcatccggataaatcagtaattcggcaggtacaccacgcatcacggcagcatcgaatgcagccattgcctggttggcaaggatgcggtagtctttctcaccgtggatacagagaattggagtatcccatttttcgacaaacaaatggggagaattggcaaatgtacgttgggctgtcggattctgtttttcccagtaagcnccgcccatatcccagttggcaaaccatttttcttctgtctccagatattgcatttccatattgaagataccgtcgtgggcaatgaatgccttgaagcgcttgtcgtgatgtccggccaaccaatacacagaaaatcctccgaagctggcacctacacaacccagacgatcactatccacaaacggctctttggccatttcgtcgatagccgtgaaataatccttcatacattgaccaccgtaatcaccgctgatagcntcgttccattccaatccgaagcccggaagtccgcgacgattcggagctacgacgatataaccgttggcggccataatctgcatgttccaacgataactccagaactggcttaccggactctgaggaccaccttcgcagaanagcagtgtcgggtacttcttattcggatcgaattgaggcggatagatgacccatgtcagcatctctttgctgtcagttgttttcatccagcggccttctactttacccatttcgatctggtcatagatttgcttgttctcttgggtcagttgcgtggtttgtccgtccaaagctattgcgtaaatttcgtcacccatactcattgaatggcgtttggcaatcagtttgtctccnaagagggcaacgccttcgtagtcgtacatacccgaagtgacggggcgtacggaatcgttagccagatcgagtgaataaatttgtgtctcgccatgccatacaccggtgaagtagatcgtcttggcatcccggctccatacgaatgcatctacattcgaatcgaaagctttacttacaaaacgtttctcgcccgtttccaggttcatgacgaagaggcggttctggtcagcttcgtaaccgtcgcgctccatgctttgccaggcaatgctttttccatccggagaatattgcgggtttgtatcataacccatcataccttcggtgatgtttactgttttcttggtattcaggtcatatacatagatatccgagttggtagatatggcataagccagtcccgtttttttgcggcaggtataagccaccttgtccgaagtcgtattccaagccagttgttcgatacctccccaaggtttcatcgggctttcgtaaggttctccttccagcacatctatgatgttggagattgatttgccatcaaagtcggcgatgaaaggatgtggagcggtggtcacccattcgtcccaatgtttatacatcaggtcggtgatgatgattccggtcgctttatccaggtcggggtatttatcagccgtgctctttactgttttcacttgagcgatgaagagtatctttttaccgtccggtgagatggaatatccctcgatgtctccgtcatacttggagatctgcttgcgtccgctaccgtccggattcatttcatacagttggctgctgccgttgtcattgctcaggaagagcagcttgcttccgtctgccgcccaagtcacttcattttcctgataaggagtgtgggtaatctgtcgattatccgttccatccgcgttcatcacaaaaacttcccggttgctcttgttctcggggacactgtaataagccacagtataggctatttgctttccgtcaggcgatacggccagtccgccgatacgtcccatcgcccaaagcgcttcgggagtcat

SEQ ID NO: 883 - DNA, 4000 bp, Escherichia coli
  misc_feature (577)..(577): n is a, c, g, or t
  misc_feature (592)..(592): n is a, c, g, or t
  misc_feature (739)..(739): n is a, c, g, or t
  misc_feature (895)..(895): n is a, c, g, or t
  misc_feature (980)..(980): n is a, c, g, or t
  misc_feature (1123)..(1123): n is a, c, g, or t
  misc_feature (1522)..(1522): n is a, c, g, or t
  misc_feature (2612)..(2612): n is a, c, g, or t
  misc_feature (2667)..(2667): n is a, c, g, or t
  misc_feature (2696)..(2696): n is a, c, g, or t
  misc_feature (2739)..(2739): n is a, c, g, or t
  misc_feature (2772)..(2772): n is a, c, g, or t
  misc_feature (3200)..(3200): n is a, c, g, or t
  misc_feature (3203)..(3203): n is a, c, g, or t
  misc_feature (3326)..(3326): n is a, c, g, or t
acggagtctttagaccaattcactcaggctctaagaactattggtgagcctatttttgggcagtcttctaagaatatttctgcgggcaaattactagctagactttttgaagtaacagaaaaatttaatatggtcactcaaccacaattattattgttacaaaaaacaatggtggtggtcgaaggagttgcaagatcattagatgaagacgcaaatatttgggaaatttcaaaaccagtattgcaaggttggttgaacaacgagattggtcctaaaaatagaatagataaaatattaaaaacgacaaccgaacttttagataaacttcctgaattacccgagatgattaatcgggctaacaaagctatggaacttttaagttcatatgaatttataaaaaatcaaaaccaaagtaacgaatatgaaattaaacaaaagtcttcaaaattaaaaaagacttatctaattataggtttattaattattgtaattatattgttaatagtattcaaatagcgcgatgctaaattcaattgagaataagaaaattttaatcgttattggtggcggaatagcngcttataaggttctngatgttattagagagcttagaaaaaataactgtgaagttaaaactattctaactaattctggaaaagaatttgtaacgccattatcaatttctgctctttctaaaaataaagtttttgaaaacctattcgatcccaataatgaaggngaaatggatcatatcgcgctatctagatggtgtgatttaatactcgttgctccaacgacagctaatctaatggcaaattttgcacacggtgaagctaaagattttgcaacaacggttatcatggcctctaacaagcctattttccttgctccagcnatgaatgttgaaatgtggaataaccaagctacccaagaaaattttcaaaagcttattcaatttaaatataaatttattggacctnctgttggtgaaatggcgtgtggagaagtaggggtaggtaaaatgtcatctcctgaggaaattattctaactatcaaaaattattttctttcaaagaatttattcaataataaaaatttaaaagcattagtcacagcaggatcnactagagagtatattgatccggtaagatttttatcgaatgagtcttctggaaaacaaggatttgagattgcaaagtcattaaatgatatcggctttaaaacaaaattagttattggtccaaattctttagatattaaaaatcaggacaatcttgaagtaatcagtgtgacaactgcaaaacaaatgtttgaagcttgcaaagataatttaccagtagatgttgcggtttgcacggctgcggtttctgattttaaagtcaaaaattacaatgaagaaaaaataaaaaaagaaggattagaagattttaatttagagcttgaaaaaaatattgatattttatctttcatcgctagccaaaatattaatcggccaagattagtagttggttttgctgcaganactaaaaacatcatcgaaaatgcacaaaagaaaatccaaaataaacactgcgattggattgtagctaataatgtagccgataaatctattggttttaattcagattataatgaggtttttttaatttctaaaaacaaagaagttgaaaaatttaataaaacgacaaaatcagaaatcgcaaaaaaactatctaataaaattcttcacgctcttattcaataatggttaaaattttagttaaaaaaattaattataaacataaagatctgcctaaatatgaaactgtgggctcttctggtttagatttaatcgctaatattgataaggaaataattttaaagcctaatgaaagaactttggtgccgacgggcctatccgttgcaatccctgaaaattacgaaatacaagtaagaccaagatcaggacttgcagcaaaaaatggtattagcgttttaaatacgcctggaactgtggacgctgattatagaggagaaattaaagtcatcttgataaacttaagtttagaaaattttaaaattgaaccgggacaaagaattgcacagatggtgctttgccctgttgtaaaagctgaattagttgaagttgatacacttcctgaatcagttcgtggaagcggtggatttggttcaacgggccgataaatattcatgaaacttagctatgacgatgtcaaaagatacattgctcatatcaatttaaaaaaaattggcagctttggtcaaaagaaaatcattgatacaaaagttctcattattggtgttggtggattaggctcgcctgttgcactctatcttgcatcatctggaattaataacatcggaatcgttgatcatgacaaaattgatatttcaaatttacacagacaaattttatttaatgaagaagatgttaataaatttaaagttgatattgctgaaaaaagattaaaaaaaattaattctaaaataaaaattaataaatttaaaactaaaatcgatagtaaaaatataaataaaattgcaaaaggttatgatctcatcattgatgggactgacagttttaaatcaaaattattaattaacgattattnttataaaaataaaaaaatcttaatttgtggagccataagtaagtttgatggtcangtttttgtttttaattttaaaaagaaaanctctccttgtcttagatgttttatgccagaaattccaagtacngacatgatggattgtcaaagtgagggggttttntctacccttgcaggaatgattggaacaatcatggctaatgaggctattcgtgaaatattaaattttgaaaactctttatgtgggaatattttaataattaatgctgagaatcttttaattaaaaaaattaaattaaataaaaacaaaaactgcattaagaagattaaatgaagtttaaaaaaattattgttattttatcttttattatttttacaggtgcagatttactagcacaaaaagttatcactaaaaaatatctgagcattagaaccagtgttgcaaatcttagaatcggaccctcgcctgctcatcctattgcattcgtttatgaaaaaaagaatatgccagttgaagtaattgatgagtttgaagtatggagaaaagttaaagattatcaaggcgatatcggttggattcatttaagtcanctntctagaaaaagaactctattaactacaaaggatggaattgttctttttaaaaatgcgacgatctattcaaaaccaattattaagattggaaatctagaagccgctgttattaaaaaatgcatnccaaattggtgtttggttgaaattcaaaaatataaaggttggatacaaaccgatcacgtttggggcttagaaaataaagagattatcaattaaatttgtcaaatcctgtattaaactgtaaattaacaactaattatcaataattttaattctctaacgatttcatgaaacaacaaaatcaatacagttaccaagatctacttgattgcgctgaaggaaaaatgtttggacctggtaatgcaaaattacctgcgccgccgatgttgatgtttgatcgaattacttcgatcacggctgaaggtggattatttaataaaggtgaaattttagcagaattagacatcaaagataatttgtggtttttcgaatgtcattttaaaggggatcctgtgatgcctggatgtttaggattagatgcgatgtggcaactgttaggattttatcttggttggttaggaaatcctggtcatggtcgagcactgggtgtgaatgaagtaaaatttacaggcgaagttgtaaaacaagtaaaacttgtaaaatatgtcattaatatcaaaagattattaagaaaaggcgaaacttgtgttggcttggctgatggtttagtctttgcggacaataaagaaatatataacgctaaaaatcttaaagttggtttatttaaaagctaagga

SEQ ID NO: 884 - DNA, 4000 bp, Escherichia coli
  misc_feature (13)..(13): n is a, c, g, or t
  misc_feature (1991)..(1991): n is a, c, g, or t
  misc_feature (2013)..(2013): n is a, c, g, or t
  misc_feature (2021)..(2021): n is a, c, g, or t
  misc_feature (2486)..(2486): n is a, c, g, or t
  misc_feature (3650)..(3650): n is a, c, g, or t
  misc_feature (3764)..(3764): n is a, c, g, or t
  misc_feature (3767)..(3767): n is a, c, g, or t
  misc_feature (3773)..(3773): n is a, c, g, or t
  misc_feature (3794)..(3794): n is a, c, g, or t
  misc_feature (3959)..(3959): n is a, c, g, or t
ttccggtacctcngctggcctgctggagcgggcccggctcggttccgatagaacagagaccgccgcggctggaaggcacgaggagatgtgggatgaggtggctcatggagttctacaacgagaggcgggggatcttggcgcgttacggcattgaggcgccgttaccagcggcggcggtcctgttgggccggaatgcggttctcgcggagtatccatcgactccgcgaagaagccggctcagcttgttcgagcgggccgagcgcgtcgggggtcaagacgcaagcgggtgggttctctaccggatcgtgaaggataacgggcacggatcaactggcgtcgcgccagcgcacgcgacataggtgccccgtgttcatgttcctctctaaaaagagaaagcgagaacaaagctcgcctctgaatgaagcccggcgagcgctagtcgagaagaagtttgagatcctccggcaggcgagcttcggattcactcacgaccgactcttacacattcaggaggaggacttgaaggggtggaccgatgcgtgtacggctgagcttcgtcggaaaatagcatcggccgcaccgtcgcatatcaagattgcgctgatcgatttccgcaagctaaggtgtgtttctctccagtgtcttcctctgtggatgcacgctgacggagccaggctcgtggacggcccggagccggcaccggcgccgtcgatttccaaggaaggggtggtcaaggcggagggtttcatctcttccccgccgagttccccgatccccgttcaggtacgcggcggagaggctgtcacgacctacaacgtggtggcgaccagatgatccaggaccatatgagcgacctccatcgcctcggctacgggcagcaggagcacgagcgatgagccgccgcgatctcacctcttaatgcaaagggaggccgtccccatgtcgagtcaggtgcttgcccgcatagctaccacaggcatctatccacaggcagatgagaaatccaggccttcatgaattggatggacgaccgcaacgcccctgccatccctctacggtctgctccggctcaccacaatgatcctcggtcagctgcacgagcgctcccatgtcggtctacgtagtgcgaaaatggagacggtctctgaggttctgcagctcccggtaataatagaggggagccggccgctttcggccgaatctcagtttcttcagaaacgcgatttcctcctcggtcgcatccccgctgagggacggatcttgaaggaagtctttgagccccggctcttcatcgaacggttgttcgggttcccgttccacaaacccaaacttcttcgggggtcccggagccagtcggcggtttaagacaacttccatgtcaaaagtcgcgaggtcgatgccccaggattcaatgagcggatccaagaaggcgacgcagtgttcaatcgacaggttgaagatatccgtatccagaaactcgagcaccgtgacccgcatctgttcgtagcttcgatcgctgagtcgagccaccgtgcggagccagtgctcactctccaattcctctttggcaactcttttgaccacgtcgagaagcttttgtgtgacgaggcgttcgagttcgccgaaggactgcttttcaaaaataacgcgtatttccgttcggttgtcggggttggatttgtgaagaatcaattctcgaacttccttaaacaagggtgtgagtgggtcccccaatcttcgcttcagttcctcctcgcgctgaagcgtggccagcttcgagagctcaccgcgctggagcttcaaaaaggtttccatcttgtcgtaaatgtccgtccggttcggtgcagggggcgcttttttgcgcgtcagcaactgtgaaatgtaggactccgtcacttgggcggcggttgccagagctctctgctccgcccccaattcttctagccgctgcctgatcactaacgggacgtccatcctgagcctcctcagtnattaactttatttgcttaagtntttaccgntttagtatccatatcgtatcttgcttgacaactaaagttaatagacttacggtagtgaacggctcgggcgattctgctcctgcctccaggtagcctgaactaagtccggttatctgaatagcgctcctcttagtccaccgagggggtcgacatgtttgctcgtaccgttcgcatgcagctgaagcccaatagcgtcccggagttcacccagttgattgagcgggaagtcattcccgtccttcggaaacagcaaggcttcaaggacgagatcaccttcgtcccctcggaaggaagggaagcggtcggaatcagtctgtgggagcagaaggagaacgcggaagcctatcaccgcggagcctatccagaagtgctgaaggccatggcgaaggtggttgaaggaactcctcaggtccaagcctctgaggtttccaactcgacctggcacaagatcgccgctcggtaacnagtccgaagccgacaggtctttggtggggacggacaagcccgtccccaccatcgcctgagaatgcgaacccgtggcggccaccgcttgagccaggcgcacccacggagggcggcgatcgcgatcggaggaggcaagtaagcctcgggagcgggagaacacgatgcgacagatgacgggcctcaatgagcttcgcgagcgaggcctgatgacgtggatcgaacaggagcacggatgggtcgcggcgccggaggagatcgtgaaggcattctcaagggatggcttcgaagaatgcaaccgcgagacaacgacgagccggcgtgattggcagccgcccggcggcgtgtggcagggggtcgatacgcgcacgggatcggtggcttcggcgacctgggtgaatcggccgccttggcatcaagccataatggcgggcggcgtgtggcaagaagcgcacacgaaatccgtagcatcgcccgtctgggtggaccgacccgcatgggatcaagccatcgtgttcatcgctgtcgatggggagtcttttaggggcgtctagggccatgatgaagggggctcgtcgaattccgaaatccgaaggagggacccggccgatgaagattcgtccgttgcacgatcgccttctggtggagcggctcgaggagaaggaagtcaaaaagggcgggatcatcatcccggacacggccaaggagaagccccaggagggcaaggtcgtcgccgtgggcaacggcaaggtcaccgacgagggcaagaaggttcccctcgacgtcaaggccggggacaagatcctcttcgggaagtattccggctccgaggtgaagctcgacgacaaggagtacctgatcatgcgcgaggaagacgtcctcgccattctcgagtaaggagggacacgagcgatgccgaagcagctgaagttcgacgaggaggcccggtcgagcctgctcaagggcatcaacattatggccgcggccgtcacggcgacgctgggccccaagggccgcaacgtcgtcatcgacaagaagttcgggagccccacgatcaccaaggacggcgtgacggtcgccaaggagatcgagctgaaggatccgtacgaggacatgggcgcccagatgctgaaggaggtcgcctcgaagacctcggacatcgcgggngacggcacgaccaccgcgatcgtgctcgcgcaggcgatctatcgggaagggctcaggaacgtcacggccggcgccaacccgatggggctcaaacgggggatcgaggcggcggtngangcggtnacccaggagctcaagaaggtntcgaagtcgaccaaggacaagaaggagatcgcccaggtcgcgacggtcgcctcgaacaacgacaagacgatcggcaacctgatcgccgaggcgatggagaaggtcggcaaggacggggtcatcacggtcgaggagtcgaagtcggccgacacggtcctggacgtngtcgaagggatgcagttcgaccgcggctacctctcgccgta

SEQ ID NO: 885 - DNA, 4000 bp, Escherichia coli
  misc_feature (1963)..(1964): n is a, c, g, or t
  misc_feature (1966)..(1966): n is a, c, g, or t
  misc_feature (1968)..(1984): n is a, c, g, or t
  misc_feature (1988)..(1989): n is a, c, g, or t
  misc_feature (1992)..(1992): n is a, c, g, or t
  misc_feature (2039)..(2039): n is a, c, g, or t
  misc_feature (2046)..(2046): n is a, c, g, or t
  misc_feature (2048)..(2051): n is a, c, g, or t
  misc_feature (2053)..(2053): n is a, c, g, or t
  misc_feature (2055)..(2056): n is a, c, g, or t
  misc_feature (2058)..(2058): n is a, c, g, or t
  misc_feature (2060)..(2061): n is a, c, g, or t
  misc_feature (2063)..(2063): n is a, c, g, or t
  misc_feature (2065)..(2065): n is a, c, g, or t
  misc_feature (2067)..(2068): n is a, c, g, or t
  misc_feature (2115)..(2116): n is a, c, g, or t
  misc_feature (2118)..(2118): n is a, c, g, or t
  misc_feature (2120)..(2121): n is a, c, g, or t
  misc_feature (2123)..(2125): n is a, c, g, or t
  misc_feature (2130)..(2130): n is a, c, g, or t
  misc_feature (2132)..(2132): n is a, c, g, or t
  misc_feature (2134)..(2137): n is a, c, g, or t
  misc_feature (2139)..(2140): n is a, c, g, or t
  misc_feature (2142)..(2143): n is a, c, g, or t
  misc_feature (2145)..(2145): n is a, c, g, or t
  misc_feature (2147)..(2148): n is a, c, g, or t
  misc_feature (2151)..(2151): n is a, c, g, or t
  misc_feature (2154)..(2154): n is a, c, g, or t
  misc_feature (2156)..(2158): n is a, c, g, or t
  misc_feature (2160)..(2160): n is a, c, g, or t
  misc_feature (2164)..(2166): n is a, c, g, or t
  misc_feature (2171)..(2171): n is a, c, g, or t
  misc_feature (2174)..(2174): n is a, c, g, or t
  misc_feature (2178)..(2179): n is a, c, g, or t
  misc_feature (2183)..(2186): n is a, c, g, or t
  misc_feature (2189)..(2192): n is a, c, g, or t
  misc_feature (2194)..(2196): n is a, c, g, or t
  misc_feature (2199)..(2199): n is a, c, g, or t
  misc_feature (2201)..(2202): n is a, c, g, or t
  misc_feature (2204)..(2205): n is a, c, g, or t
  misc_feature (2209)..(2210): n is a, c, g, or t
  misc_feature (2212)..(2212): n is a, c, g, or t
  misc_feature (2214)..(2215): n is a, c, g, or t
  misc_feature (2217)..(2219): n is a, c, g, or t
  misc_feature (2266)..(2266): n is a, c, g, or t
  misc_feature (2269)..(2269): n is a, c, g, or t
  misc_feature (2271)..(2275): n is a, c, g, or t
  misc_feature (2278)..(2278): n is a, c, g, or t
  misc_feature (2281)..(2285): n is a, c, g, or t
  misc_feature (2288)..(2288): n is a, c, g, or t
  misc_feature (2291)..(2292): n is a, c, g, or t
  misc_feature (2343)..(2343): n is a, c, g, or t
  misc_feature (2345)..(2346): n is a, c, g, or t
  misc_feature (2348)..(2348): n is a, c, g, or t
  misc_feature (2351)..(2351): n is a, c, g, or t
  misc_feature (2353)..(2353): n is a, c, g, or t
  misc_feature (2355)..(2357): n is a, c, g, or t
  misc_feature (2361)..(2361): n is a, c, g, or t
  misc_feature (2364)..(2370): n is a, c, g, or t
  misc_feature (2418)..(2418): n is a, c, g, or t
  misc_feature (2420)..(2421): n is a, c, g, or t
  misc_feature (2423)..(2424): n is a, c, g, or t
  misc_feature (2430)..(2431): n is a, c, g, or t
  misc_feature (2433)..(2433): n is a, c, g, or t
  misc_feature (2435)..(2435): n is a, c, g, or t
  misc_feature (2438)..(2438): n is a, c, g, or t
  misc_feature (2441)..(2441): n is a, c, g, or t
  misc_feature (2443)..(2443): n is a, c, g, or t
  misc_feature (2445)..(2445): n is a, c, g, or t
  misc_feature (2448)..(2448): n is a, c, g, or t
  misc_feature (2450)..(2451): n is a, c, g, or t
  misc_feature (2454)..(2455): n is a, c, g, or t
  misc_feature (2457)..(2463): n is a, c, g, or t
  misc_feature (2467)..(2470): n is a, c, g, or t
  misc_feature (2474)..(2475): n is a, c, g, or t
  misc_feature (2477)..(2477): n is a, c, g, or t
  misc_feature (2481)..(2482): n is a, c, g, or t
  misc_feature (2487)..(2488): n is a, c, g, or t
  misc_feature (2490)..(2490): n is a, c, g, or t
  misc_feature (2494)..(2497): n is a, c, g, or t
  misc_feature (2500)..(2501): n is a, c, g, or t
  misc_feature (2503)..(2509): n is a, c, g, or t
  misc_feature (2511)..(2513): n is a, c, g, or t
  misc_feature (2515)..(2516): n is a, c, g, or t
  misc_feature (2518)..(2522): n is a, c, g, or t
  misc_feature (2524)..(2524): n is a, c, g, or t
  misc_feature (2527)..(2527): n is a, c, g, or t
  misc_feature (2530)..(2531): n is a, c, g, or t
  misc_feature (2533)..(2534): n is a, c, g, or t
  misc_feature (2536)..(2537): n is a, c, g, or t
  misc_feature (2539)..(2540): n is a, c, g, or t
  misc_feature (2543)..(2544): n is a, c, g, or t
  misc_feature (2546)..(2546): n is a, c, g, or t
  misc_feature (2550)..(2551): n is a, c, g, or t
  misc_feature (2553)..(2554): n is a, c, g, or t
  misc_feature (2557)..(2558): n is a, c, g, or t
  misc_feature (2562)..(2565): n is a, c, g, or t
  misc_feature (2568)..(2569): n is a, c, g, or t
  misc_feature (2573)..(2575): n is a, c, g, or t
  misc_feature (2577)..(2582): n is a, c, g, or t
  misc_feature (2585)..(2586): n is a, c, g, or t
  misc_feature (2588)..(2589): n is a, c, g, or t
  misc_feature (2592)..(2593): n is a, c, g, or t
  misc_feature (2597)..(2597): n is a, c, g, or t
  misc_feature (2599)..(2599): n is a, c, g, or t
  misc_feature (2602)..(2603): n is a, c, g, or t
  misc_feature (2607)..(2607): n is a, c, g, or t
  misc_feature (2609)..(2613): n is a, c, g, or t
  misc_feature (2615)..(2616): n is a, c, g, or t
  misc_feature (2619)..(2622): n is a, c, g, or t
  misc_feature (2626)..(2627): n is a, c, g, or t
  misc_feature (2630)..(2630): n is a, c, g, or t
  misc_feature (2633)..(2635): n is a, c, g, or t
  misc_feature (2638)..(2642): n is a, c, g, or t
  misc_feature (2645)..(2645): n is a, c, g, or t
  misc_feature (2647)..(2649): n is a, c, g, or t
  misc_feature (2651)..(2652): n is a, c, g, or t
  misc_feature (2655)..(2655): n is a, c, g, or t
  misc_feature (2657)..(2660): n is a, c, g, or t
  misc_feature (2662)..(2662): n is a, c, g, or t
  misc_feature (2664)..(2665): n is a, c, g, or t
  misc_feature (2667)..(2671): n is a, c, g, or t
  misc_feature (2723)..(2724): n is a, c, g, or t
  misc_feature (2726)..(2729): n is a, c, g, or t
  misc_feature (2731)..(2733): n is a, c, g, or t
  misc_feature (2735)..(2737): n is a, c, g, or t
  misc_feature (2740)..(2742): n is a, c, g, or t
  misc_feature (2745)..(2747): n is a, c, g, or t
  misc_feature (2797)..(2797): n is a, c, g, or t
  misc_feature (2803)..(2804): n is a, c, g, or t
  misc_feature (2807)..(2807): n is a, c, g, or t
  misc_feature (2809)..(2809): n is a, c, g, or t
  misc_feature (2811)..(2811): n is a, c, g, or t
  misc_feature (2816)..(2819): n is a, c, g, or t
  misc_feature (2821)..(2822): n is a, c, g, or t
  misc_feature (2824)..(2824): n is a, c, g, or t
  misc_feature (2876)..(2876): n is a, c, g, or t
  misc_feature (2884)..(2884): n is a, c, g, or t
  misc_feature (2887)..(2888): n is a, c, g, or t
  misc_feature (2890)..(2895): n is a, c, g, or t
  misc_feature (2897)..(2898): n is a, c, g, or t
  misc_feature (2900)..(2902): n is a, c, g, or t
  misc_feature (2906)..(2906): n is a, c, g, or t
  misc_feature (2912)..(2913): n is a, c, g, or t
  misc_feature (2915)..(2916): n is a, c, g, or t
  misc_feature (2919)..(2919): n is a, c, g, or t
  misc_feature (2922)..(2922): n is a, c, g, or t
  misc_feature (2929)..(2929): n is a, c, g, or t
  misc_feature (2933)..(2933): n is a, c, g, or t
  misc_feature (2936)..(2938): n is a, c, g, or t
  misc_feature (2941)..(2941): n is a, c, g, or t
  misc_feature (2943)..(2943): n is a, c, g, or t
  misc_feature (2945)..(2945): n is a, c, g, or t
  misc_feature (2947)..(2947): n is a, c, g, or t
  misc_feature (2949)..(2952): n is a, c, g, or t
  misc_feature (2955)..(2956): n is a, c, g, or t
  misc_feature (2958)..(2958): n is a, c, g, or t
  misc_feature (2961)..(2964): n is a, c, g, or t
  misc_feature (2970)..(2971): n is a, c, g, or t
  misc_feature (2974)..(2976): n is a, c, g, or t
  misc_feature (2979)..(2984): n is a, c, g, or t
  misc_feature (2988)..(2988): n is a, c, g, or t
  misc_feature (2990)..(2992): n is a, c, g, or t
  misc_feature (2996)..(2997): n is a, c, g, or t
  misc_feature (2999)..(3000): n is a, c, g, or t
  misc_feature (3004)..(3004): n is a, c, g, or t
  misc_feature (3007)..(3008): n is a, c, g, or t
  misc_feature (3011)..(3013): n is a, c, g, or t
  misc_feature (3015)..(3017): n is a, c, g, or t
  misc_feature (3019)..(3020): n is a, c, g, or t
  misc_feature (3022)..(3023): n is a, c, g, or t
  misc_feature (3026)..(3026): n is a, c, g, or t
  misc_feature (3031)..(3032): n is a, c, g, or t
  misc_feature (3035)..(3036): n is a, c, g, or t
  misc_feature (3038)..(3039): n is a, c, g, or t
  misc_feature (3041)..(3042): n is a, c, g, or t
  misc_feature (3044)..(3045): n is a, c, g, or t
  misc_feature (3048)..(3048): n is a, c, g, or t
  misc_feature (3052)..(3052): n is a, c, g, or t
  misc_feature (3054)..(3055): n is a, c, g, or t
  misc_feature (3058)..(3059): n is a, c, g, or t
  misc_feature (3061)..(3062): n is a, c, g, or t
  misc_feature (3064)..(3068): n is a, c, g, or t
  misc_feature (3071)..(3074): n is a, c, g, or t
  misc_feature (3076)..(3077): n is a, c, g, or t
  misc_feature (3080)..(3083): n is a, c, g, or t
  misc_feature (3085)..(3089): n is a, c, g, or t
  misc_feature (3092)..(3094): n is a, c, g, or t
  misc_feature (3096)..(3096): n is a, c, g, or t
  misc_feature (3099)..(3104): n is a, c, g, or t
  misc_feature (3106)..(3106): n is a, c, g, or t
  misc_feature (3108)..(3108): n is a, c, g, or t
  misc_feature (3111)..(3112): n is a, c, g, or t
  misc_feature (3114)..(3117): n is a, c, g, or t
  misc_feature (3119)..(3121): n is a, c, g, or t
  misc_feature (3124)..(3129): n is a, c, g, or t
  misc_feature (3131)..(3136): n is a, c, g, or t
  misc_feature (3140)..(3142): n is a, c, g, or t
  misc_feature (3149)..(3150): n is a, c, g, or t
  misc_feature (3152)..(3153): n is a, c, g, or t
  misc_feature (3156)..(3156): n is a, c, g, or t
  misc_feature (3158)..(3159): n is a, c, g, or t
  misc_feature (3162)..(3162): n is a, c, g, or t
  misc_feature (3164)..(3166): n is a, c, g, or t
  misc_feature (3168)..(3176): n is a, c, g, or t
  misc_feature (3178)..(3179): n is a, c, g, or t
  misc_feature (3183)..(3188): n is a, c, g, or t
  misc_feature (3191)..(3197): n is a, c, g, or t
  misc_feature (3199)..(3199): n is a, c, g, or t
  misc_feature (3201)..(3203): n is a, c, g, or t
  misc_feature (3206)..(3210): n is a, c, g, or t
  misc_feature (3212)..(3212): n is a, c, g, or t
  misc_feature (3215)..(3216): n is a, c, g, or t
  misc_feature (3218)..(3222): n is a, c, g, or t
  misc_feature (3224)..(3224): n is a, c, g, or t
  misc_feature (3226)..(3226): n is a, c, g, or t
  misc_feature (3228)..(3228): n is a, c, g, or t
  misc_feature (3231)..(3236): n is a, c, g, or t
  misc_feature (3238)..(3241): n is a, c, g, or t
  misc_feature (3243)..(3264): n is a, c, g, or t
  misc_feature (3268)..(3270): n is a, c, g, or t
  misc_feature (3272)..(3273): n is a, c, g, or t
  misc_feature (3276)..(3284): n is a, c, g, or t
  misc_feature (3286)..(3288): n is a, c, g, or t
  misc_feature (3290)..(3291): n is a, c, g, or t
  misc_feature (3293)..(3295): n is a, c, g, or t
  misc_feature (3297)..(3304): n is a, c, g, or t
  misc_feature (3306)..(3310): n is a, c, g, or t
  misc_feature (3312)..(3324): n is a, c, g, or t
  misc_feature (3326)..(3326): n is a, c, g, or t
  misc_feature (3328)..(3331): n is a, c, g, or t
  misc_feature (3334)..(3340): n is a, c, g, or t
  misc_feature (3342)..(3355): n is a, c, g, or t
  misc_feature (3357)..(3373): n is a, c, g, or t
  misc_feature (3375)..(3375): n is a, c, g, or t
  misc_feature (3377)..(3383): n is a, c, g, or t
  misc_feature (3386)..(3402): n is a, c, g, or t
  misc_feature (3404)..(3408): n is a, c, g, or t
  misc_feature (3410)..(3414): n is a, c, g, or t
  misc_feature (3417)..(3417): n is a, c, g, or t
  misc_feature (3419)..(3423): n is a, c, g, or t
  misc_feature (3426)..(3430): n is a, c, g, or t
  misc_feature (3432)..(3434): n is a, c, g, or t
  misc_feature (3436)..(3436): n is a, c, g, or t
  misc_feature (3438)..(3441): n is a, c, g, or t
  misc_feature (3444)..(3444): n is a, c, g, or t
  misc_feature (3448)..(3450): n is a, c, g, or t
  misc_feature (3452)..(3458): n is a, c, g, or t
  misc_feature (3461)..(3461): n is a, c, g, or t
  misc_feature (3463)..(3469): n is a, c, g, or t
  misc_feature (3471)..(3472): n is a, c, g, or t
  misc_feature (3474)..(3475): n is a, c, g, or t
  misc_feature (3478)..(3478): n is a, c, g, or t
  misc_feature (3481)..(3481): n is a, c, g, or t
  misc_feature (3484)..(3484): n is a, c, g, or t
  misc_feature (3486)..(3486): n is a, c, g, or t
  misc_feature (3490)..(3492): n is a, c, g, or t
  misc_feature (3494)..(3494): n is a, c, g, or t
  misc_feature (3496)..(3500): n is a, c, g, or t
  misc_feature (3503)..(3504): n is a, c, g, or t
  misc_feature (3507)..(3507): n is a, c, g, or t
  misc_feature (3509)..(3509): n is a, c, g, or t
  misc_feature (3512)..(3523): n is a, c, g, or t
  misc_feature (3525)..(3530): n is a, c, g, or t
  misc_feature (3533)..(3534): n is a, c, g, or t
  misc_feature (3537)..(3542): n is a, c, g, or t
  misc_feature (3544)..(3547): n is a, c, g, or t
  misc_feature (3549)..(3550): n is a, c, g, or t
  misc_feature (3552)..(3553): n is a, c, g, or t
  misc_feature (3555)..(3555): n is a, c, g, or t
  misc_feature (3557)..(3559): n is a, c, g, or t
  misc_feature (3561)..(3561): n is a, c, g, or t
  misc_feature (3563)..(3563): n is a, c, g, or t
  misc_feature (3566)..(3566): n is a, c, g, or t
  misc_feature (3568)..(3568): n is a, c, g, or t
  misc_feature (3570)..(3570): n is a, c, g, or t
  misc_feature (3572)..(3573): n is a, c, g, or t
  misc_feature (3575)..(3576): n is a, c, g, or t
  misc_feature (3578)..(3578): n is a, c, g, or t
  misc_feature (3580)..(3580): n is a, c, g, or t
  misc_feature (3582)..(3582): n is a, c, g, or t
  misc_feature (3587)..(3590): n is a, c, g, or t
  misc_feature (3592)..(3595): n is a, c, g, or t
  misc_feature (3597)..(3598): n is a, c, g, or t
  misc_feature (3600)..(3601): n is a, c, g, or t
  misc_feature (3603)..(3607): n is a, c, g, or t
  misc_feature (3610)..(3611): n is a, c, g, or t
  misc_feature (3615)..(3615): n is a, c, g, or t
  misc_feature (3617)..(3617): n is a, c, g, or t
  misc_feature (3620)..(3620): n is a, c, g, or t
  misc_feature (3622)..(3623): n is a, c, g, or t
  misc_feature (3625)..(3629): n is a, c, g, or t
  misc_feature (3633)..(3634): n is a, c, g, or t
  misc_feature (3638)..(3654): n is a, c, g, or t
  misc_feature (3657)..(3668): n is a, c, g, or t
  misc_feature (3671)..(3676): n is a, c, g, or t
  misc_feature (3678)..(3679): n is a, c, g, or t
  misc_feature (3681)..(3684): n is a, c, g, or t
  misc_feature (3686)..(3687): n is a, c, g, or t
  misc_feature (3689)..(3694): n is a, c, g, or t
  misc_feature (3696)..(3701): n is a, c, g, or t
  misc_feature (3703)..(3705): n is a, c, g, or t
  misc_feature (3707)..(3710): n is a, c, g, or t
  misc_feature (3713)..(3718): n is a, c, g, or t
  misc_feature (3720)..(3723): n is a, c, g, or t
  misc_feature (3725)..(3727): n is a, c, g, or t
  misc_feature (3729)..(3739): n is a, c, g, or t
  misc_feature (3741)..(3749): n is a, c, g, or t
  misc_feature (3751)..(3753): n is a, c, g, or t
  misc_feature (3755)..(3757): n is a, c, g, or t
  misc_feature (3760)..(3762): n is a, c, g, or t
  misc_feature (3767)..(3786): n is a, c, g, or t
  misc_feature (3788)..(3789): n is a, c, g, or t
  misc_feature (3791)..(3794): n is a, c, g, or t
  misc_feature (3796)..(3805): n is a, c, g, or t
  misc_feature (3808)..(3811): n is a, c, g, or t
  misc_feature (3813)..(3832): n is a, c, g, or t
  misc_feature (3834)..(3834): n is a, c, g, or t
  misc_feature (3836)..(3839): n is a, c, g, or t
  misc_feature (3842)..(3843): n is a, c, g, or t
  misc_feature (3845)..(3850): n is a, c, g, or t
  misc_feature (3852)..(3858): n is a, c, g, or t
  misc_feature (3860)..(3862): n is a, c, g, or t
  misc_feature (3864)..(3872): n is a, c, g, or t
  misc_feature (3874)..(3874): n is a, c, g, or t
  misc_feature (3877)..(3887): n is a, c, g, or t
  misc_feature (3889)..(3890): n is a, c, g, or t
  misc_feature (3893)..(3896): n is a, c, g, or t
  misc_feature (3898)..(3916): n is a, c, g, or t
  misc_feature (3918)..(3964): n is a, c, g, or t
  misc_feature (3967)..(3982): n is a, c, g, or t
  misc_feature (3984)..(3987): n is a, c, g, or t
  misc_feature (3989)..(3989): n is a, c, g, or t
  misc_feature (3991)..(3997): n is a, c, g, or t
  misc_feature (3999)..(3999): n is a, c, g, or t
atataaataaattaaaacaagaaagtttgaaaattaactaccctattcaaaatgaaattggtgtaggatcacaaggctcaaaaaatgaaagagctatatctggtgagcagattaaaagtatttgtattaaactcaacatagaccgcttaggcaacattactccttcaaaaaaaactaatcagaaatcaacatcaagttttgtaaatgaagaacattctatttactacaataaagttacattcaacaaccttcaacaatccgatgaaaaaatgtttatgcatacagccaacatgaatcctgaagagcgtatggcgtatttgcaaaaactgcgtgagacaacacaagaaaatatttctgaagcagaaaagagagccattttaaatcagataaaaataaatccgccagatgaaaatacttgatttggaacaattgcaacaaattcatcgtttaaaaaacaagaaatcgtgatgagataaaaaacaaatgattaaacgtacgctctattttggcaaccctgcatacctgagcttaaagaacagtcagctaatggtgcgtttgcccgaggtggagaaaaaccaacaacttgatgttgcgtttaaacaacaggcacatgctaccattcctgttgaagatattggtattgtattgctcgaccatcaacaaattaccataacgcatggattactcgatgcattaatggagaacaatgttgccgttataacatgcaacaatacccggcatcctgcaggactgttgctgccactgcaagggcacactttacagcacgaacgatacagtgatcagctttcggccagcgagcctttacggaaacaactttggcagcaaaccattattcaaaaaattaaaaatcaggcagcaggattacaattacaaaatattgattccacacgcctctaccctatctacaacaatgtaaaaagtggcgatagtgagaatgccgaaggtgttgcagcagccttctactggtcaaatatttttacaaaaattcctgctacaatagaacatgcaccgggtaatttattcaaacgacaacgtgatggtttgccacccaacaattatctgaattatggttatgcaattcttagagcaactatggcaagaagtattgttgctgcagggctcttaccaacaaaaggtattcatcatcataaccgttacaatgcctactgccttgcagatgacctgatggagcccttcagaccttttgttgacagaattgttattgacattatcttaaaacatggtataattgatgacttgacaaaagctattaaagcagatttattgacaattcctgtaatagatgtaatgatggatggagaaaacagtccattaacaattgctacacagcgaacagctacttcattagtaaaatgttttgccggtgaacaacgcaaactaatttacccggagttgttatgaattttgaacgcctcaatgcctatcgcactatgtggactattgttatgtacgacctgcctactgaaactaaaaagcaaagaaaattagctgctaaattcagaaaagatttattgcaggatgggtttcaaatgttccaattcagtatgtacttgcggcatagcagcagtagcgaaaatgctgatgtgcatcgaaacagagtaaaaaaatcattgcctactgaaggtaaggttggaattttgcaaattacggataaacaattcggtcagatggaaattttttatggcaaaaaggcgcatgacaaaccacaaacatcgcaacaacttgagctattttaaagggtgatttaagtcaatccgttaaatttcaggaataaaaaatcccgctgtttgggcgggacttcaagttcttaaactcatttttactatcctgaaactgttcttttaagttgaatatctgttgtttagccaatagatattgaaagaactctgacaaagataaaagttgaaagcaaatcacaacnngnannnnnnnnnnnnnnnnntttnntanattgaaagaactctgacaaagataaaagttgaaagcaaatcacaacnatagtanannnncngnntntnntnantnnattgaaagaactctgacaaagataaaagttgaaagcaaatcacaacnngntnngnnnaaagntntnnnngnntnnantnnaanaantnnnanaaannnaaaanttnaaannaaannnnaannnnannngtngnntnntttnnantnncnnnattgaaagaactctgacaaagataaaagttgaaagcaaatcacaacnatngnnnnnctnctnnnnnttnttnntaaattgaaagaactctgacaaagataaaagttgaaagcaaatcacaacgngnntntgncngnnntttnatnnnnnnnaattgaaagaactctgacaaagataaaagttgaaagcaaatcacaacntnntnngattanngntntanatncntntantnnaannannnnnnncaannnnaaanntngaanncaaannanaacnnnnttnntnnnnnnnannntnnannnnnanttnaannanntnnannaannanaaanntnnaannaaannnnaanntggnnntnnnnnnagnnannttnncaananttnnaaanannnnnannaannnnaaanntgnaannnaannnnnaangnnntnnttntnnnnantnnannnnnttaattgaaagaactctgacaaagataaaagttgaaagcaaatcacaactanntnnnntnnncnnnatnnnttnnnaatattgaaagaactctgacaaagataaaagttgaaagcaaatcacaacntgcagnnagnantngattnnnnannanaaattgaaagaactctgacaaagataaaagttgaaagcaaatcacaacgttnaatctctncannannnnnntnnannnattnaaaganntnnganaangataaangttnaannnaantnanancnnnnganntntgnnnnttacanngtnnnaannnnnnaaantnnnacanngnnaaanttnnaannnannnannannttnatganngcnntnnannanntanaaananntgnnannannnnnaannnnannaannnngnnnnnaannntnaannnnnngnangtnngnnnntnnnaannnnnnannnnnnaaannntgaaacnnannaangnngancnnnannnnnnnnnannaaannnnnnatnnnnnnnanannnaannnnnanganntnnnnnanananaannnnnnannnngnnnnnnnnnnnnnnnnnnnnnnaaannnannaannnnnnnnntnnnannannnannnnnnnnannnnngnnnnnnnnnnnnnanannnnaannnnnnnannnnnnnnnnnnnnannnnnnnnnnnnnnnnnanannnnnnntgnnnnnnnnnnnnnnnnnannnnnannnnnganannnnnaannnnnannnantnnnnatnaaannntnnnnnnnttnannnnnnnannannaanaanatnanaggnnngnannnnnaanntananaannnnnnnnnnnnannnnnnttnntgnnnnnncnnnngnnannanannnananatnanancnnannanangntttannnntnnnnannannannnnnaannaaananaanannannnnnaaannaaannnnnnnnnnnnnnnnnaannnnnnnnnnnnatnnnnnnanntnnnnannannnnnncnnnnnntnnnannnnaannnnnntnnnnannnannnnnnnnnnntnnnnnnnnnannntnnnaannnaaatnnnnnnnnnnnnnnnnnnnnanntnnnnannnnnnnnnnaannnntnnnnnnnnnnnnnnnnnnnncnannnnaanngnnnnnnannnnnnntnnnannnnnnnnnangannnnnnnnnnntnntgnnnntnnnnnnnnnnnnnnnnnnnannnnnnnnnnnnnnnnnnnnnnnnnnnnnnnnnnnnnnnnnnnnnnnaannnnnnnnnnnnnnnntnnnnanannnnnnngnt

SEQ ID NO: 886 - DNA, 4000 bp, Escherichia coli
  misc_feature (90)..(90): n is a, c, g, or t
  misc_feature (107)..(107): n is a, c, g, or t
  misc_feature (2554)..(2554): n is a, c, g, or t
cggtgaaagtctttcggaaaggctcggataggggatttccggtggcatctttccacttttgtgacacttccaaaatataagccttacctncttccaaagagggcccnacttcgatcaatggcttgactccagtcttgatgcgtcctggatccatgaacaatgtcagccgggtcatctccgggttccaaagcgcttcacccagttcaagaaacggccattgaacttcacaccgatccgagaggttgaacagccgcaagtgcttgtagatggcgcccccactcatgggggcgctaaaatgaatgtagaacttgagcaggttctctggaaggacctctgcctgagggtctatttgattgacttgggtggggttggattccttttcatcagggatccaagttgaagtcatgctttcatggattgcaagatagcctatccgctcagaaaaagggaatcttggtgtgaagaggatacctttttcatcgaaaaggtaggagccgatgatggggggatctatcgaaggatcaatgcttctttccatcacataaaccctgagcaaccttgccataagctcgggattgggatggcctttggcttcatgatgccagtttagtagccgtacccccaaaggaaccgtccccccagatgccggataaacccactgaattttagtttgagccagaatggggcgatcagccagcaggatggctgccagaccccaaaggaaagcctccctgcccagtgcacgagaaaatggagtcatcatcctgcgcatgcaatgaatccagctcaggaggtgggccttaaaaaaacaacggcggccccgcacaaggccgccgttgagtgattcctctccggtttgcatcaggggagaggtcgggactccaaatggagaggcccattgtcagcacgcaccaacaaaacggcatgacggctatcgatcagatcgagctgatcgacaccttgccaggattcaacagtctggtagtcgagaccttttgtagccccgtccacgacggcttcctggatgccggaggcttcttcaatgccttcggcagggattttcatgatgccccggctactgtttgccatgagcaagaaagttttctcgtccttgtggtagacgaccatatccaagggacggttgcgattgccaagttccgccacggtcttgccaacgatcgccgccccaggctgaagggcactcaccggaaactgaaccaagggagtgcaggtgtaggctgcgagcaggtggggttgatcaccgatactgaacggcacgaaagtccgaaccggggaccgtgtctcaaagcgtccatgggctccatggtaaatttcaactttggtccccgcgctgacttgcttgaaagggaaggggattgctctaagggtggaggcaaactcctcgttcaccaatcctgcaaccaacacccgtccgtccaagaaggcgatatctgtgatggattcgagtcttggattgctgcgacgtcttccttccccaacttctttatccacaggtgcatcgggcagtagggcggtgctgtgctggagcgtcgtcatctcgaggggcgaaatcttgccagcgggggtcaccatcacaatgactggggctgcttgaggacctctccctcgagatagtgagagatagatattatgggagatggggttgacggccatatcatgaaccatcacttcctcggtaggcactccgagcatagaagccagttggcgatccagcgcctccagcttcaggggcttagaaaacgctactggcgttgtgtcagccgtggcgatggcatggatggctgcagatctggagtccgctacaaagaggataccctcagggccaaaggccagacttcctgctgagcgtaagtccagctcacccgattgcatgtcgcgggtccactcagatccattgaggtcatcttgaatcaatatgaggcttgctaagagtgaccacaatagggtgatggagtaggatctcatgctcattttgacactcttggacttcgtttcgttacagaaaacttcaatgaatcatggcttttaccgtgcgccggggagtggctgatatttctggtgtttgtaacgggtgtgtacccagacaaaatccggattgttttcgtttcctcccgcccagtagaagctgctcgtgccattggatgagtcggttgcagcttttactgtggcctcctctcgccaggtatgtgtctctccatgtccatcagcaaaggagatggtgctgttgttgccatgaaaaactgcaaatggatcgacccatcccaaagaaggttgcacgttgataacccaagtgccgcggttatgttccctggggtcagcctcctcgagaaataccatggcttgggaaggaccattgactgtcgataatttgacgtagggaggctgcgggccagaagagctgccgttggtgcctgagccctgccaacccccaccattcatgccgttggctttggagtaactatcccatgcccaaccgcttcctggcttgttacgtttggtacgtatatcaccaggacaatggtaggctccgggnccgtctacatatttgaagagtgggccgttgcgaagacctatctcgaccaaatcttgagcctcgtctttacccatgcgagaagtgatgctggtgtaattaaagcggccattgttcatggtgcctggtcccggccagaagcctcctccagggtttccatcggttgggatcatgcggtcatcgtggtcatctgcatacatgacaaatccaagggcgagttgtttctgattactcaggcacacagcccctgtggccttgagcttggccttactgagcgctgggagtaacatgccagctagaatggcgatgatggcgatgaccacaagaagctcgatgagcgtgaaccccttggttgaatggatgcaaggtttgcgtgaggctagattcaccatacagttcattttctagctcgttttgccattgaaagccagtgaaaactgactttaacgataccgataatcacttagggtcgcgcttttgtccccgtatcctgtccagcgagtcctgcatggatgtgacgattcctgggtagtcttctttgagatcccgcgattcgcctaaatcatcacccaagtaaaacaaccagccgtcgggatgattgcccaattcgatttgggtctgtcgattgaaagcctgggcacgcgagggctcgatccatttccattgacctcgcctgaggcttaaggatcgtgcttggaggaccagctcttttcttcctattgggtctttacccaatagcgccatcatcatgttctgaccatccggtgaagactcatcatcaagtcgctgccccagaagatcagcaaaactcgcaatcaagtccacttgagaaaccaaggctgcactcctgccatgggcgatacctgcgggccagtgcatgatccaaggaaccctggtgccagcttcaaaagcactgtatttgccacccctgaaagggcctgatgggtgatgctcacccagttgctctacggcttgatctttgtagccgtcgtcaatgactgggccgttatcgctggtgaaaatcaccaaggtattttcagcgagacctttctctcccaacttatccatgatttgtccgacgcaccaatcggtttgtgcgatggcgtctcccctgggtcccatggcggtctgtccccgaaaacgaggatggggcacacgcggcacatggatatcgtgtagggaaaaaaataggaagaaaggcttcttactttggcgttcaataaattctagggccttatcggtgatatcatcggccatattctcatcgttccacctcgcggcagtcccaccgctcatataaccgatgcggctgataccattgatgatggttcgatcatgaccgtgactcggatgcatggtcagtaaatctgggcgttctgcgccaataggttcggatccaacacgttctttgaagctgacttggatagggtcttcaggatcaagtccgac

SEQ ID NO: 887 - DNA, 4000 bp, Escherichia coli
cttgacacgcaagatggtgggtcactgacggtaaccaatatagggaaaacgtacaccttggatatctatggctcaggtaatggtataaatccttataaatcatccagtttcagccttggttctgcagcctctatccaaacagcattgaccgtgaccctgacaccggtcttgcagtcaccaactctttttgctggtgtaactgtcgataacctgacgacaacaggggggactattacgagcataggtctggtatccaatgccgcaacttctgccaatactattaacacggatcacggatcagataaccagactttgacgatcaccggtaatggagctctttccattcttggcgttacacctaacgccacaaaaggtgatacgatcaatgcttcagggtttgcccaggccttgactttgggtactattggtggcactcatgcagttgcaactgcagctggtgatacaggtaaaggcgatgtgattaagttggggtctggtacaagctatattactgtatcatcttttgataaaggtgacctcattacgttactggcgagccataccgcggctgacactcttgacacaacgctgatagcatcacatattgctggcgttggaggccagtatgcgagtgcggcggctcagaaagctgatataacgcaaatcaccaacttccatacaaacagtgatattctaaaagtggggattggcggagctatagctcctcaaaatggtatagcatctgaccttactggtcatgcatggacagtaacgaatggttttgttacgaaggccggtttaactggtgcaaccggtcttacagccttccttgctgatgtcgcggcatcaacaacctttgccgcaaatgatatgcttgcgtacaacgatggtgtgaatacctatattgctatcggtgaccatgtggccggaacagctcgtggtgagcatattgtagagttggtaggtcttcatactgccacagccttgggtattgctggtggagtaaacaccattcatattgcataatgaacactatcaatgccaataatcttttataaaacaagtggtttaagagaagaagaacgatgaaaaaaaacattttattagtcttgggtattgcagggatgatgatcggttgctccgaaaaaagtcattctcctgaagtcaaagtgcaaaccagcacagaaagcaccccatcttttgttatcgattcacctccgaattttatttatctgaaaaatcaaggcttttcagtatccaaggacagcccttacgatatcatctcttttgatggcaattattacatcaacaataacgctcactggtaccgttcatctgattaccatggaccgtggattcttattcaggatagttggctgccctcgaagataggcaggtacagcatggaggatataaggaggtatcgcgatattgaaaaccgcaagcctgataaaggtaatcgccagtatcagcacaacaacgtcaacacgaggcgaattcttgatcagcgtaaccagcgtaacgatgccaacgacaggaatgttcgggatcaacaatacgaagctgccgacaacaggaactacgagccagtcagtagagaaagttctccatcttttgttatcgattcaccgccacgttttatttatctgagagatcaaggtttttcagtatccaacggaagttctgttgacatcgtttactatggcgacagttattacacccgtcatcatgaccactggtaccgatcatctgattaccatggaccatggatttatgtccaggatgagaggttgccctcaaagctgagaaggcatagctccgaagaaataaagaggtatcgtgatattgaatatcgcaggcaggatagtcagaataaccagtatcagcgtgaggatgacaacaaaaggcgagtccttgatcagcgtaacgaagccaacagtaggacaactcagcctcaacaaaacaaagctcctgaaaacgtcaaggctcaggttgaccagcacaaaggccctgatcatataaaggccgcggatcagccgcacaaagtacctgaaaacgtcaaggttcaggttgaccagcacaaaggccctgatcatataaaggccgcggatcagccgcacaaagcacctgaaaacgtcaaggttcaggtcgatcagcacaagacccctaatcaaaagaagactcaggatcagccacacaaagctattgataatagcaaaaatcaggatcacagagataaggtctctgataataaaaaggagaataaatgattttccctgacagcattggcggggaagtacacaggtataaatgttataaaatttaatccactcgccccatggcaactatcgaagaaaaaatcatcaatgcaggctttgcacttccacagcctcccgcagctgcaggtctttattctcctgcaattcgcagtggcaaccttgtttttacctctgggcagctacctcttcgggatggtcaactggtagaacctggaggaaaaggtaaggtcaatgatctcagaaaggatgatgcttttcatgcatccagagtcgctcttctcaatgcactggcagccattaaatctgtgactggtacactggatagtattgaaagaatcgtaaagctcaccctctatgtttcgagtgaaacctgcttttccagccaacatctggttgctaacggtgcatcttcattgctgcatgaaatctttggagagaggggagcccatgcaagaagtgctgtgggcgttgcggagttaccccttgatgcaagtcttgaacttgagcttattgtgcagtttaaaccaaccattttgtaatcatattacctgcgattacatcatccttcatcgatgttgattcttcaatatcctcaattaaaatcaactattactacactataaaatcacttgcattatcattgatataagcacatatatctttaatgctgcaagtgttttatgcttattatagataattttaagatatgatttaaagcaagtatatctcgacaagttatagtgctttaattcataaaaatacttctctatagtttgatttaaaaatcatataacttattaaaaaatactttaagtaaaaaatgttaaaatattgtattaaaataactaatatagtttaatatgaatattaatttaaataattattaatgttatatacatttatcggtttaatgatttgtagttgaatattttgttcattccttagtgttaataattttatcaatagttatttttattgttgtttatgatatttgtaacatattttatgtattcattttaaaacatttctatgcagttttttctcttgtttttgattgattatgtcttttattcagattgatttcgctatagcagtacgttgtgatttgatgtcattagtagctgctgtattggttgttacttttgtggttatttttgattttatgaaggaccttattttgctgatgatgctggcggatgtgatcttcggcaggtaatcggttgatagatcaatgattttttgtgattttgatctgcgataggtaaactgtatttcaggaaccaaatattcactctctcatacccggtaactaaaccactcctcatgtcccgtacactgactattgtaatgatgcttgttgtgcttgttttcggcatttttctcggaaccaggctcaacggaggcggggagagccgggttgaacagcagaaaaaaatgcttgaggcttatagtttgatgaaagagctctatgtagataaggttgacagcgacagtcttgccggtgcagggattcagggaatggctgagtatctcgatcctcatacggtttatctggagccggaaaaggtctcatattctcaggcggaatttgatgggaattttgatggcataggtattgaatttgaagttataagagatacgcttcttgttgtcactcccctctcgggcggaccgagtgctgctgtcggtatttctccgggtgaccgtattgtcgggattga

SEQ ID NO: 888 - DNA, 4000 bp, Escherichia coli
  misc_feature (1)..(2): n is a, c, g, or t
  misc_feature (4)..(4): n is a, c, g, or t
  misc_feature (6)..(6): n is a, c, g, or t
  misc_feature (14)..(16): n is a, c, g, or t
  misc_feature (22)..(22): n is a, c, g, or t
  misc_feature (28)..(29): n is a, c, g, or t
  misc_feature (33)..(33): n is a, c, g, or t
  misc_feature (46)..(46): n is a, c, g, or t
  misc_feature (50)..(50): n is a, c, g, or t
  misc_feature (54)..(54): n is a, c, g, or t
  misc_feature (59)..(59): n is a, c, g, or t
  misc_feature (61)..(61): n is a, c, g, or t
  misc_feature (66)..(66): n is a, c, g, or t
  misc_feature (2757)..(2758): n is a, c, g, or t
  misc_feature (2762)..(2763): n is a, c, g, or t
  misc_feature (2767)..(2768): n is a, c, g, or t
  misc_feature (2773)..(2773): n is a, c, g, or t
  misc_feature (2777)..(2777): n is a, c, g, or t
  misc_feature (2788)..(2790): n is a, c, g, or t
  misc_feature (2792)..(2795): n is a, c, g, or t
  misc_feature (2797)..(2799): n is a, c, g, or t
  misc_feature (2801)..(2807): n is a, c, g, or t
  misc_feature (2811)..(2812): n is a, c, g, or t
  misc_feature (2814)..(2815): n is a, c, g, or t
  misc_feature (2818)..(2819): n is a, c, g, or t
  misc_feature (2821)..(2821): n is a, c, g, or t
  misc_feature (2823)..(2823): n is a, c, g, or t
  misc_feature (2825)..(2829): n is a, c, g, or t
  misc_feature (2831)..(2833): n is a, c, g, or t
  misc_feature (2835)..(2837): n is a, c, g, or t
  misc_feature (2839)..(2846): n is a, c, g, or t
  misc_feature (2848)..(2852): n is a, c, g, or t
  misc_feature (2856)..(2863): n is a, c, g, or t
  misc_feature (2865)..(2865): n is a, c, g, or t
  misc_feature (2867)..(2868): n is a, c, g, or t
  misc_feature (2872)..(2873): n is a, c, g, or t
  misc_feature (2876)..(2878): n is a, c, g, or t
  misc_feature (2881)..(2881): n is a, c, g, or t
  misc_feature (2883)..(2886): n is a, c, g, or t
  misc_feature (2888)..(2889): n is a, c, g, or t
  misc_feature (2891)..(2903): n is a, c, g, or t
  misc_feature (2905)..(2915): n is a, c, g, or t
  misc_feature (2919)..(2920): n is a, c, g, or t
  misc_feature (2923)..(2932): n is a, c, g, or t
  misc_feature (2935)..(2935): n is a, c, g, or t
  misc_feature (2938)..(2940): n is a, c, g, or t
  misc_feature (2942)..(2948): n is a, c, g, or t
  misc_feature (2950)..(2952): n is a, c, g, or t
  misc_feature (2957)..(2960): n is a, c, g, or t
  misc_feature (2962)..(2969): n is a, c, g, or t
  misc_feature (2971)..(2986): n is a, c, g, or t
  misc_feature (2991)..(3000): n is a, c, g, or t
  misc_feature (3002)..(3008): n is a, c, g, or t
  misc_feature (3010)..(3013): n is a, c, g, or t
  misc_feature (3016)..(3017): n is a, c, g, or t
  misc_feature (3021)..(3024): n is a, c, g, or t
  misc_feature (3027)..(3030): n is a, c, g, or t
  misc_feature (3032)..(3040): n is a, c, g, or t
  misc_feature (3042)..(3042): n is a, c, g, or t
  misc_feature (3044)..(3044): n is a, c, g, or t
  misc_feature (3047)..(3047): n is a, c, g, or t
  misc_feature (3049)..(3054): n is a, c, g, or t
  misc_feature (3056)..(3064): n is a, c, g, or t
  misc_feature (3066)..(3089): n is a, c, g, or t
  misc_feature (3091)..(3093): n is a, c, g, or t
  misc_feature (3096)..(3099): n is a, c, g, or t
  misc_feature (3101)..(3105): n is a, c, g, or t
  misc_feature (3107)..(3114): n is a, c, g, or t
  misc_feature (3116)..(3131): n is a, c, g, or t
  misc_feature (3133)..(3133): n is a, c, g, or t
  misc_feature (3135)..(3135): n is a, c, g, or t
  misc_feature (3139)..(3143): n is a, c, g, or t
  misc_feature (3145)..(3147): n is a, c, g, or t
  misc_feature (3149)..(3151): n is a, c, g, or t
  misc_feature (3153)..(3169): n is a, c, g, or t
  misc_feature (3171)..(3172): n is a, c, g, or t
  misc_feature (3174)..(3174): n is a, c, g, or t
  misc_feature (3176)..(3179): n is a, c, g, or t
  misc_feature (3181)..(3183): n is a, c, g, or t
  misc_feature (3186)..(3188): n is a, c, g, or t
  misc_feature (3190)..(3191): n is a, c, g, or t
  misc_feature (3193)..(3198): n is a, c, g, or t
  misc_feature (3200)..(3216): n is a, c, g, or t
  misc_feature (3218)..(3238): n is a, c, g, or t
  misc_feature (3241)..(3241): n is a, c, g, or t
  misc_feature (3243)..(3244): n is a, c, g, or t
  misc_feature (3246)..(3260): n is a, c, g, or t
  misc_feature (3262)..(3267): n is a, c, g, or t
  misc_feature (3270)..(3274): n is a, c, g, or t
  misc_feature (3276)..(3279): n is a, c, g, or t
  misc_feature (3281)..(3293): n is a, c, g, or t
  misc_feature (3295)..(3302): n is a, c, g, or t
  misc_feature (3304)..(3312): n is a, c, g, or t
  misc_feature (3314)..(3325): n is a, c, g, or t
  misc_feature (3327)..(3338): n is a, c, g, or t
  misc_feature (3341)..(3362): n is a, c, g, or t
  misc_feature (3364)..(3365): n is a, c, g, or t
  misc_feature (3368)..(3368): n is a, c, g, or t
  misc_feature (3370)..(3376): n is a, c, g, or t
  misc_feature (3378)..(3381): n is a, c, g, or t
  misc_feature (3384)..(3387): n is a, c, g, or t
  misc_feature (3389)..(3400): n is a, c, g, or t
  misc_feature (3402)..(3403): n is a, c, g, or t
  misc_feature (3405)..(3419): n is a, c, g, or t
  misc_feature (3421)..(3435): n is a, c, g, or t
  misc_feature (3439)..(3444): n is a, c, g, or t
  misc_feature (3446)..(3448): n is a, c, g, or t
  misc_feature (3450)..(3450): n is a, c, g, or t
  misc_feature (3453)..(3468): n is a, c, g, or t
  misc_feature (3471)..(3484): n is a, c, g, or t
  misc_feature (3487)..(3489): n is a, c, g, or t
  misc_feature (3492)..(3493): n is a, c, g, or t
  misc_feature (3496)..(3516): n is a, c, g, or t
  misc_feature (3518)..(3522): n is a, c, g, or t
  misc_feature (3525)..(3536): n is a, c, g, or t
  misc_feature (3538)..(3540): n is a, c, g, or t
  misc_feature (3542)..(3545): n is a, c, g, or t
  misc_feature (3547)..(3550): n is a, c, g, or t
  misc_feature (3552)..(3554): n is a, c, g, or t
  misc_feature (3558)..(3561): n is a, c, g, or t
  misc_feature (3563)..(3565): n is a, c, g, or t
  misc_feature (3567)..(3568): n is a, c, g, or t
  misc_feature (3570)..(3571): n is a, c, g, or t
  misc_feature (3573)..(3574): n is a, c, g, or t
  misc_feature (3577)..(3577): n is a, c, g, or t
  misc_feature (3579)..(3579): n is a, c, g, or t
  misc_feature (3581)..(3585): n is a, c, g, or t
  misc_feature (3587)..(3587): n is a, c, g, or t
  misc_feature (3589)..(3591): n is a, c, g, or t
  misc_feature (3593)..(3598): n is a, c, g, or t
  misc_feature (3600)..(3602): n is a, c, g, or t
  misc_feature (3608)..(3608): n is a, c, g, or t
  misc_feature (3610)..(3612): n is a, c, g, or t
  misc_feature (3615)..(3616): n is a, c, g, or t
  misc_feature (3618)..(3623): n is a, c, g, or t
  misc_feature (3625)..(3627): n is a, c, g, or t
  misc_feature (3630)..(3631): n is a, c, g, or t
  misc_feature (3633)..(3634): n is a, c, g, or t
  misc_feature (3636)..(3644): n is a, c, g, or t
  misc_feature (3646)..(3646): n is a, c, g, or t
  misc_feature (3649)..(3649): n is a, c, g, or t
  misc_feature (3654)..(3655): n is a, c, g, or t
  misc_feature (3657)..(3657): n is a, c, g, or t
  misc_feature (3661)..(3661): n is a, c, g, or t
  misc_feature (3670)..(3670): n is a, c, g, or t
  misc_feature (3676)..(3679): n is a, c, g, or t
  misc_feature (3698)..(3698): n is a, c, g, or t
  misc_feature (3700)..(3700): n is a, c, g, or t
  misc_feature (3706)..(3708): n is a, c, g, or t
  misc_feature (3711)..(3711): n is a, c, g, or t
  misc_feature (3713)..(3714): n is a, c, g, or t
  misc_feature (3716)..(3716): n is a, c, g, or t
  misc_feature (3721)..(3724): n is a, c, g, or t
  misc_feature (3727)..(3727): n is a, c, g, or t
  misc_feature (3731)..(3731): n is a, c, g, or t
  misc_feature (3738)..(3738): n is a, c, g, or t
  misc_feature (3759)..(3761): n is a, c, g, or t
  misc_feature (3763)..(3764): n is a, c, g, or t
  misc_feature (3777)..(3777): n is a, c, g, or t
  misc_feature (3784)..(3784): n is a, c, g, or t
  misc_feature (3788)..(3788): n is a, c, g, or t
  misc_feature (3808)..(3808): n is a, c, g, or t
  misc_feature (3810)..(3811): n is a, c, g, or t
  misc_feature (3813)..(3818): n is a, c, g, or t
  misc_feature (3820)..(3825): n is a, c, g, or t
  misc_feature (3827)..(3831): n is a, c, g, or t
  misc_feature (3833)..(3833): n is a, c, g, or t
  misc_feature (3835)..(3835): n is a, c, g, or t
  misc_feature (3839)..(3844): n is a, c, g, or t
  misc_feature (3848)..(3848): n is a, c, g, or t
  misc_feature (3852)..(3852): n is a, c, g, or t
  misc_feature (3854)..(3854): n is a, c, g, or t
  misc_feature (3856)..(3856): n is a, c, g, or t
  misc_feature (3859)..(3859): n is a, c, g, or t
  misc_feature (3862)..(3862): n is a, c, g, or t
  misc_feature (3865)..(3867): n is a, c, g, or t
  misc_feature (3869)..(3869): n is a, c, g, or t
  misc_feature (3871)..(3873): n is a, c, g, or t
  misc_feature (3988)..(4000): n is a, c, g, or t
nntntntttttttnnntatttnaataanntttnttttttttttttnattnattnaatananttttntttttttttttttttttcatatttagtatcattatttttttttattacaaaagatacaataaataatagaatagaaggaatataataaatataaggaaaggtatgtgaatataaaataatgtttttataatttttttaattgttatgtttaaattttatataatatataatatttaaaataataatagtaataagagaaactatagtccatttaaattatttaaaacaatattggaaatttataaaattatacatattaaataatatatatattattattaaaaaaacattaatatataataactaaaataaatatacacttatgtaccattcatcatatttaaatgatagaaattatattaataatattttgatatattgctcttatctttttgatgataataattttaataatagtaatattaacttttggaaataaataaactttatattataaattggttaaatttctaaaagtaaattttaataaatgaatttatgaaaatcattaatatgtctttattttttttagtttgttttcttcctataaagatttataataattaattttataaatacctttaatatgacaataatataatttacaatagataattatattttatttatggttttaatatttagaaaaaaaaaataataataaaattatatgaacgaattaaaatattataaaataatcactaaccaaaataatttaaattttatatacatatataattgggtaatatatatgacatcttggaaataaattaataatttataaagaataaaaaaagatgacttctgtcataaaaatcgattttcctgaaaattcagtaactgtagtattatttttgctcacagcttttgttattttattcagttacatatcatatttcgttaaagagcgacttttcttatctgagcctttagtagcaacattagttggtatcttattaggaccaaaagttttgggttggattaatccattatcttggactgatgaaattcatcatttaacatttgaaatttctcaagtaataaaattagtttatttttattaataatatttatttattaaataaaaatttattttattaactattattattaatatatatatatatataaaaggctattattcttatacaaatcatatgtgctgttatacagacaccaaaaaatttctttaagcaccattggaaaggattagcaacattatggggaccagtatctatttacatgtgggttattacgggactgatttttaaatttggactcaatattgattatgtaagaattaataaaaaatttacctcaaatttatgaatatataaatatataaataatgattattatttttatctattattataattatggtattgtaattaaaataaaatattattgttattatttttaaaaacgtattatagtggccagcttttattctttcatcatgtacaacaccaactgatccagtaattataaaatataatataaaaattttgaaaaatgataaacaatattaatagagataagaattataataataaattataattattattaaaactttagtaatacaataaattaatttattaaattgattattaaaaaattaaataatatttattattaaaggtattagctaattcaattgttagtggtcgtttcgcgacattacatattccaattaatattagatatgttttatctgctgaaaggtaatacaaaataaaatataatatactaataatttaatattaacaataataaatcactatatatttcataaaaattagtgctggaaatgatggtatggttgaagtttttaaatttttttttttctttattaaaaaataacatcaaaatataatattaaaaaattctttttttttttttttttttttaaaatattttttgaataaataataatatataaaaattgaatataaaattattaattattattgataaatgataaataatacgtaaatatatataattttattttataattaaaggggttgcttatccacttttcctattagcctttttattccatacacaatctgataaatctatttttttgaatattcttcaatggcttggtgaagttatatgttattctgtaattttagctgttattgttggttgcgctattggatattgctcaaagtttatatttaaactttgtttacaaaagaaattaatggataaacctagttttatggcatttcttgtttgtttagctgtaagtaaaaataaaatataattttaatatatatatatatatcattaaattattaaactaatataactaaataataattatatattatttttaaattaaaatatttatatatatatatatgtaataaaagatatgtactggtgcaatttgtgatttctttactatttcaaactatattgctgtatgttgtgctggtgtggttattgcatgggtaaatatattttctattatcaataaattttaatattattagattataatagatcaaaatattttcatttttaataattgaatctttcatattaaatatttatatttaatatatatgatcttcataatttttaattttattgtaaataaaatcaaatataataacaaaattttattaaattaaattaaattaaattaaattaaaaaaaaaaaaaaaaaaaaannaaannaaannaaaanaaanaaaaaaaaaannnannnntnnntnnnnnnnaaannannaannananannnnnannnannntnnnnnnnntnnnnnaatnnnnnnnntntnntttnnttnnnttntnnnntnnannnnnnnnnnnnnannnnnnnnnnnttannttnnnnnnnnnnttnttnnntnnnnnnntnnnttttnnnntnnnnnnnntnnnnnnnnnnnnnnnnttttnnnnnnnnnntnnnnnnnannnnttnntttnnnnaannnntnnnnnnnnntngnttngnnnnnntnnnnnnnnntnnnnnnnnnnnnnnnnnnnnnnnnannnaannnntnnnnntnnnnnnnntnnnnnnnnnnnnnnnnananaaannnnnannnannnannnnnnnnnnnnnnnnntnnantnnnntnnnttnnntnntnnnnnntnnnnnnnnnnnnnnnnnannnnnnnnnnnnnnnnnnnnnttnanntnnnnnnnnnnnnnnntnnnnnnaannnnnannnnannnnnnnnnnnnnannnnnnnncnnnnnnnnngnnnnnnnnnnnntnnnnnnnnnnnnaannnnnnnnnnnnnnnnnnnnnnannaanannnnnnnannnnaannnngnnnnnnnnnnnnannannnnnnnnnnnnnnnannnnnnnnnnnnnnnaaannnnnnannnanaannnnnnnnnnnnnnnnaannnnnnnnnnnnnnaannnaannaannnnnnnnnnnnnnnnnnnnnannnnnaannnnnnnnnnnnannnannnnannnnannnaaannnnannnannannannaananannnnnanannnannnnnntnnntttttnannnaanntnnnnnnannnaannannannnnnnnnnanttnttttnntntttnttttttttntttttnnnnttttttttttttttttttntntttttnnntantnnanttttnnnnttntttnttttttnttttttttttttttttttttnnnannttttttttttttnttttttntttnttttttttttttaatatttntnntnnnnnnannnnnntnnnnntnantaannnnnnaatnattnananttnaanaannnanannnaatttttttttattcatattttattaatatttaatatttaatattatattttattttatttctttttattttgaatttatattatttaatttttttttttttttttttttttttnnnnnnnnnnnnn

SEQ ID NO: 889 - DNA, 4000 bp, Escherichia coli
  misc_feature (4)..(8): n is a, c, g, or t
  misc_feature (10)..(13): n is a, c, g, or t
  misc_feature (15)..(17): n is a, c, g, or t
  misc_feature (20)..(21): n is a, c, g, or t
  misc_feature (23)..(29): n is a, c, g, or t
  misc_feature (31)..(31): n is a, c, g, or t
  misc_feature (33)..(34): n is a, c, g, or t
  misc_feature (37)..(39): n is a, c, g, or t
  misc_feature (41)..(43): n is a, c, g, or t
  misc_feature (45)..(52): n is a, c, g, or t
  misc_feature (54)..(54): n is a, c, g, or t
  misc_feature (57)..(62): n is a, c, g, or t
  misc_feature (64)..(64): n is a, c, g, or t
  misc_feature (66)..(67): n is a, c, g, or t
  misc_feature (71)..(74): n is a, c, g, or t
  misc_feature (76)..(79): n is a, c, g, or t
  misc_feature (82)..(88): n is a, c, g, or t
  misc_feature (91)..(95): n is a, c, g, or t
  misc_feature (97)..(98): n is a, c, g, or t
  misc_feature (100)..(100): n is a, c, g, or t
  misc_feature (102)..(102): n is a, c, g, or t
  misc_feature (104)..(107): n is a, c, g, or t
  misc_feature (109)..(109): n is a, c, g, or t
  misc_feature (111)..(116): n is a, c, g, or t
  misc_feature (118)..(121): n is a, c, g, or t
  misc_feature (123)..(127): n is a, c, g, or t
  misc_feature (129)..(134): n is a, c, g, or t
  misc_feature (136)..(136): n is a, c, g, or t
  misc_feature (138)..(143): n is a, c, g, or t
  misc_feature (146)..(147): n is a, c, g, or t
  misc_feature (149)..(151): n is a, c, g, or t
  misc_feature (153)..(154): n is a, c, g, or t
  misc_feature (159)..(160): n is a, c, g, or t
  misc_feature (163)..(165): n is a, c, g, or t
  misc_feature (173)..(173): n is a, c, g, or t
  misc_feature (175)..(175): n is a, c, g, or t
  misc_feature (177)..(178): n is a, c, g, or t
  misc_feature (180)..(180): n is a, c, g, or t
  misc_feature (182)..(183): n is a, c, g, or t
  misc_feature (186)..(187): n is a, c, g, or t
  misc_feature (190)..(192): n is a, c, g, or t
  misc_feature (194)..(196): n is a, c, g, or t
  misc_feature (199)..(200): n is a, c, g, or t
  misc_feature (202)..(204): n is a, c, g, or t
  misc_feature (208)..(218): n is a, c, g, or t
  misc_feature (220)..(220): n is a, c, g, or t
  misc_feature (222)..(222): n is a, c, g, or t
  misc_feature (224)..(227): n is a, c, g, or t
  misc_feature (229)..(229): n is a, c, g, or t
  misc_feature (231)..(231): n is a, c, g, or t
  misc_feature (233)..(233): n is a, c, g, or t
  misc_feature (235)..(235): n is a, c, g, or t
  misc_feature (237)..(242): n is a, c, g, or t
  misc_feature (246)..(246): n is a, c, g, or t
  misc_feature (248)..(252): n is a, c, g, or t
  misc_feature (256)..(260): n is a, c, g, or t
  misc_feature (263)..(264): n is a, c, g, or t
  misc_feature (266)..(266): n is a, c, g, or t
  misc_feature (270)..(270): n is a, c, g, or t
  misc_feature (273)..(283): n is a, c, g, or t
  misc_feature (285)..(288): n is a, c, g, or t
  misc_feature (290)..(293): n is a, c, g, or t
  misc_feature (296)..(304): n is a, c, g, or t
  misc_feature (306)..(306): n is a, c, g, or t
  misc_feature (309)..(309): n is a, c, g, or t
  misc_feature (311)..(314): n is a, c, g, or t
  misc_feature (316)..(317): n is a, c, g, or t
  misc_feature (319)..(328): n is a, c, g, or t
  misc_feature (330)..(330): n is a, c, g, or t
  misc_feature (332)..(335): n is a, c, g, or t
  misc_feature (337)..(339): n is a, c, g, or t
  misc_feature (341)..(342): n is a, c, g, or t
  misc_feature (344)..(348): n is a, c, g, or t
  misc_feature (350)..(355): n is a, c, g, or t
  misc_feature (357)..(360): n is a, c, g, or t
  misc_feature (362)..(363): n is a, c, g, or t
  misc_feature (365)..(369): n is a, c, g, or t
  misc_feature (371)..(381): n is a, c, g, or t
  misc_feature (383)..(383): n is a, c, g, or t
  misc_feature (385)..(392): n is a, c, g, or t
  misc_feature (394)..(397): n is a, c, g, or t
  misc_feature (399)..(399): n is a, c, g, or t
  misc_feature (403)..(403): n is a, c, g, or t
  misc_feature (405)..(405): n is a, c, g, or t
  misc_feature (409)..(410): n is a, c, g, or t
  misc_feature (412)..(432): n is a, c, g, or t
  misc_feature (436)..(440): n is a, c, g, or t
  misc_feature (442)..(443): n is a, c, g, or t
  misc_feature (446)..(447): n is a, c, g, or t
  misc_feature (449)..(450): n is a, c, g, or t
  misc_feature (454)..(465): n is a, c, g, or t
  misc_feature (468)..(468): n is a, c, g, or t
  misc_feature (470)..(472): n is a, c, g, or t
  misc_feature (474)..(477): n is a, c, g, or t
  misc_feature (483)..(484): n is a, c, g, or t
  misc_feature (486)..(486): n is a, c, g, or t
  misc_feature (488)..(488): n is a, c, g, or t
  misc_feature (490)..(490): n is a, c, g, or t
  misc_feature (493)..(494): n is a, c, g, or t
  misc_feature (496)..(498): n is a, c, g, or t
  misc_feature (500)..(506): n is a, c, g, or t
  misc_feature (509)..(510): n is a, c, g, or t
  misc_feature (512)..(516): n is a, c, g, or t
  misc_feature (518)..(521): n is a, c, g, or t
  misc_feature (523)..(523): n is a, c, g, or t
  misc_feature (525)..(525): n is a, c, g, or t
  misc_feature (531)..(533): n is a, c, g, or t
  misc_feature (536)..(543): n is a, c, g, or t
  misc_feature (545)..(545): n is a, c, g, or t
  misc_feature (547)..(547): n is a, c, g, or t
  misc_feature (549)..(558): n is a, c, g, or t
  misc_feature (561)..(562): n is a, c, g, or t
  misc_feature (565)..(565): n is a, c, g, or t
  misc_feature (567)..(571): n is a, c, g, or t
  misc_feature (573)..(573): n is a, c, g, or t
  misc_feature (575)..(577): n is a, c, g, or t
  misc_feature (579)..(580): n is a, c, g, or t
  misc_feature (584)..(587): n is a, c, g, or t
  misc_feature (589)..(589): n is a, c, g, or t
  misc_feature (591)..(597): n is a, c, g, or t
  misc_feature (600)..(600): n is a, c, g, or t
  misc_feature (603)..(608): n is a, c, g, or t
  misc_feature (610)..(611): n is a, c, g, or t
  misc_feature (614)..(618): n is a, c, g, or t
  misc_feature (624)..(626): n is a, c, g, or t
  misc_feature (629)..(630): n is a, c, g, or t
  misc_feature (632)..(633): n is a, c, g, or t
  misc_feature (635)..(636): n is a, c, g, or t
  misc_feature (638)..(639): n is a, c, g, or t
  misc_feature (641)..(642): n is a, c, g, or t
  misc_feature (644)..(644): n is a, c, g, or t
  misc_feature (646)..(647): n is a, c, g, or t
  misc_feature (649)..(652): n is a, c, g, or t
  misc_feature (654)..(654): n is a, c, g, or t
  misc_feature (656)..(657): n is a, c, g, or t
  misc_feature (659)..(661): n is a, c, g, or t
  misc_feature (665)..(665): n is a, c, g, or t
  misc_feature (668)..(668): n is a, c, g, or t
  misc_feature (672)..(674): n is a, c, g, or t
  misc_feature (676)..(679): n is a, c, g, or t
  misc_feature (681)..(682): n is a, c, g, or t
  misc_feature (684)..(685): n is a, c, g, or t
  misc_feature (687)..(687): n is a, c, g, or t
  misc_feature (689)..(690): n is a, c, g, or t
  misc_feature (692)..(700): n is a, c, g, or t
  misc_feature (702)..(703): n is a, c, g, or t
  misc_feature (707)..(711): n is a, c, g, or t
  misc_feature (714)..(714): n is a, c, g, or t
  misc_feature (716)..(717): n is a, c, g, or t
  misc_feature (720)..(723): n is a, c, g, or t
  misc_feature (725)..(726): n is a, c, g, or t
  misc_feature (728)..(728): n is a, c, g, or t
  misc_feature (730)..(731): n is a, c, g, or t
  misc_feature (733)..(735): n is a, c, g, or t
  misc_feature (737)..(737): n is a, c, g, or t
  misc_feature (740)..(750): n is a, c, g, or t
  misc_feature (752)..(752): n is a, c, g, or t
  misc_feature (1316)..(1316): n is a, c, g, or t
tttnnnnntnnnncnnnttnnannnnnnncnannaannngnnntnnnnnnnntnaannnnnntncnntttnnnntnnnnaannnnnnnccnnnnnanncntnannnncntnnnnnngnnnntnnnnntnnnnnnancnnnnnnaanngnnnannaaaannaannnaaaaaaangnanncnannttnnaannnannnttnntnnntttnnnnnnnnnnntncntnnnntncngnangnnnnnntttnannnnntttnnnnnccnncntttnaannnnnnnnnnntnnnngnnnnccnnnnnnnnnanccntnnnnannannnnnnnnnntncnnnntnnnanncnnnnnannnnnntnnnncnncnnnnntnnnnnnnnnnngntnnnnnnnntnnnncnaaangntttnnannnnnnnnnnnnnnnnnnnnngggnnnnntnnttnntnngggnnnnnnnnnnnnggntnnntnnnntttttnnangnanggnnannnannnnnnnttnncnnnnncnnnncnantttttnnnaannnnnnnnantncnnnnnnnnnnaannccnannnnngntnnncnntttnnnnantnnnnnnnaanttnnnnnnannaannnnncccttnnnaanngnnanntnnannantnntnnnncnanngnnnaaanccntttnnntnnnncnntnnantnnannnnnnnnnanncccnnnnnccnannaannnntnntngnnannnanttnnnnnnnnnnngnatttggtgtcatctctgcatataccgttacgggaactttcatagtctcaattttgtcgtaaaattaatgtaaacaatccaagaataagaaagaaatgtgctttattctttagtaaaaatgttttatttttgaaagttatgaaacaaattaagtcttttgtgctcgcatcttcagctatgctcctcatgataggaagtattggtgttgtggcactctcgtgcttttgtaatgacgatcaagtctctttgtcttttttcgctacaacgaccactccgtgtgacgatcataccaaaaccgtgcaacacggtagaacatgttgcgctcatgaaactgaaactgccgaaaaagaaaaaaactgttgcaccaacactacagaaaaaaaaggctgctgtgaagatgagttccaacacataaaagtcaaacttgacttcttcagtaaatatgccatccatcccttactccacatccaattcactgaagaacgattcattggatccctcgatagcgagctgaatcgagatgttgttgagtaccacaccaactcccctcctcccatagcaggangggaacgactcctaaaaaaacagcattggctcatttgattcctgactgactattcgaaagagtaattaatcaaaatcaatccaatgaagtacataattttaacagcgctcttccttatttccctgagcgcaacagcacaagtaaaaggagtcatctatggctcaaaaggtgaaaaaacaaaaaaaacaaaactttacggggcaaaagcacgccttctaaaaggtaaaatcggtgacattacagatgaagaaggaaacttcgagttggtattgccaaaagcactgccagacaccctcattttttctgcgatggggtattatccggacacaattgttgtcacaaaagcagaccggtacaaatcctttgtcgtgaccttgtattccgatttgattctccccgaaattgttgtcgcatacaagaaaggatcgacctcaatttcaagattaaaaacactcgccacagagacactctctgcgggagaattgcgcaaagccgcatgctgtaatttgtccgaatcatttgaaacaaatgcctcggtagatgtgaacattacagatgccgtttcgggcgctaaaaaaattcagatgatgggcttggatggtgtttacacacagatccaaatggaaaatattccctacctacgtgggctcgaaacctcatttggattgcactccatccctggaacatggatcgaatccattcaaatcaccaaaggaacaggaaacgtagtgaatggttatgaatcgatggcaggacttgtcaacctcgagctcaaaaaacccgaagaaatggaggcactttacctcaatgtctataccaacgcaatgggacgcactgagttgaattttaactctggattccgcatgggggaaaaatggtcctccggatggttcgctcatgcagctgcgcacccaattgagatggactacaacatcgacggctttagagacatgccaaacggcacgaacttcgctgtactcaaccgctacaattatgagggtgaaaaaatggaggcccaatttggagtgaatgcctattgggacaataaaattggtggacaagtcgatgcacttcgtactgctggaaacgacttctacaacgtcaccattgactcaagacacattgatgcctttggtaaaacagggtttttctttaaaaaacctggacattcaattggaattgtgtacaatgcaaaataccagaccgtcgacacccattttggaccacgtgtttttaatggaacggagcgacgcggatacatcaatgccatctatgacggaatcataaaaacaacagaccacaagtacaaacttggtctcaatggcgtatactccgacatcacgcaacgcatggactcattgcgttccgaccgtatcgaaattgtaccgggtgcctttggagaatatacgctcacgacatcccgtttgtcactggtgcttggagggcgtgccgattaccacaatatatatgggtttcaaggcgccccgcgtgttcatgccaaattcaaactcacagaatatacagacctgcgatttacatccggcaaaggatggcgtgttccgaattatatgattgacaacatctctttgctcgccacatctcaggcttgggttgcccccgattcattgacacctgagatttcatggaacatgggcggaagtatcgcacaagaattcaaattgttcaaacgaaaagcaacagcagttgtggatttctatcatacccagtttgaaaaccaaatgcttgtcgatcgtgatgtgaatgcttcccaaattgtatttggcaaccttgacggaaaatcattctcgaacagtttgcaagtggaaacaatgattacaccttggaagacgattgacttgcgttttgcctacaaataccttgatgtccgtgccacttatggcggtaaattacaacaacaagtgatggttccaaaacaccgcggatttttcaatcttgggtacaaatcacgcagcaaacggtgggaatttgacctgacttgttcggtatttggaacagcgcgactgcctcaagttgaactcccagatggaagcgagacagtgaacaattcgagtgccgtctaccccttgttgagtgcccaaatcacacatgtaaaaaaagcatgggagttttacctcggaggggaaaacctcctcaattaccgacagaccaacccgatcatcgatgcagaaaacccgtttagcgaaacattcaatgcgacgcgcatatgggctcctgtttttggtcctaatgtgtacttcggtgtgcgcttttccattcagcaagaagaggaaaaagagaattaaaattgaatcgaattgcgagtgcaactgaaggaaaaatttattcaatcgataaatcgttcctatcttgcacacatattcgcaccaatttaatgttgattcgttacataaaaccacttctttcgattttcatcttattgacgatcaaattgagttatggacaaacttcaactgaaaaaattcggtttatttcgaatgggagcgttggatttgatgcatttgcagcagcagaatggaaaaacgaatacgaggtacttgaagactcaataccctattttgttgcacacaaatcggttgcaaaaggaacgagagactcggtgcaattcatttccccctataccatcgattccctggattttatcatccaagattcgagtcatcagc

SEQ ID NO: 890 - DNA, 4000 bp, Escherichia coli
  misc_feature (759)..(759): n is a, c, g, or t
  misc_feature (999)..(999): n is a, c, g, or t
  misc_feature (1991)..(1991): n is a, c, g, or t
  misc_feature (2588)..(2588): n is a, c, g, or t
  misc_feature (3036)..(3036): n is a, c, g, or t
  misc_feature (3607)..(3607): n is a, c, g, or t
  misc_feature (3653)..(3653): n is a, c, g, or t
  misc_feature (3790)..(3790): n is a, c, g, or t
  misc_feature (3841)..(3841): n is a, c, g, or t
gccgcgacggtatcaaacgtatcgccaatctctttcaccaccgccttgcacgcaccgcagcgtatgccgtagacgagtgagcgatagttgtcggagtgttcgtccaccatgtcgatcgcggggtcgacttcaccggcgtcgacgtgcgcgatgaacgctcggcgagtcgtcaatgcgaggcctacggtgagcgcgatcgcggtgcgtcggcgcgagcgctcggatcgagacgatcgcgggttgagcatcgtgagcgaggtcgattgtgaggtaacatccaccaccacgactgcgagtcgcgctcgcgcgaaagaatagtgcaatgtgctaaagacagtgttggtacaaaccttcaaataataaatattacgacgacgccgtggcgtcttcgggcgaggacgctcgcgtggagggcgcgcggtcggatatcgccggcgtctcggtggcgtcgacatccggtctcgagacgcgaatgaatatgaagcgtccttcgaaggaagtcatgaattcccgcaagacgtcgacgtcagcgagcatggcgatagacgcttcttcgtcggcgacgatggtggacgcgccaaacttgacgagctctttcgcgctcgccgtccaccaggcgtcggcttgcggcggcagggcgcggtgcaaatgaccgccttggtattccttgacgtcgtcctcgccgtcgaaacgttcgatggcggatatttgcaaccgcatccctcgagacagcagagcgtgcgtaaagtcggcgagaangcctccgtggcgacacgcgttgagaatgtagccgcatcctcccggccgaattcgtcgcgtgagactcgcggcgagcggcgcagcgtgttcgtcggaatacaaaacatccgtcgccaagacaacgtcgaagacgtcgtcgacgggaagtttacacgactcaatcattgatttgtgcgctgcggagcgcgcgtgcacccagtgcctcgcctcattcgatgcgcgggcttgctcgagcgagangacgcccgctaagatgtcgtcgtcgtcgcgaaagtctagaaacatcgcctttgtggtcgccgcacactcgggcggcagctcgctcacgctccgcgcgatcgcatctatcgcccccggcgcaccgtcggtgatgcgcacgcgcttcgcgcccacacgcgccgccgtcaaccccgcgagcccgcacccggcgccgatttccaacacgtcgagcgctcgcacaagctcgggcgccgcatctaaacacctcgacatgatctgcgacgacccccagacgcgccaggccaacccagcgtcgcgccattcgctctcgtgcactcgaacgactatatcagacaccggaagccgcacctcgagcgtcgacggcttcgcccccgcgcgttcgcccacctgactccccgccaccgaccgcaactccaccgaactctccctcttcgccatctccgacgccttccccagcgcgctcccgatcgcgtccatcatcatctcgtcgtcatcccgcaccgcgcgatcgagcgccttgatcagcaccggcctcgcgccgagcgcctccgccagcgacgcccggctcgccccagccgtcatctccgcgcacagcctcgccaccccctcccgcctcgccgccgcccccgtcatcacctccagcgcctcgatcgctcgtcgcacgcgttcgtgcccctatcgcgcgcgccattcgcgccgtcagtcgccgcgcgtcgtcctcgcgcgcgcaagatgactcgccgcgtcgccgccgccgtcgccatctttcgcgcgcatcgcgcgtctcgcgcgtcgcgcgcgcgctcgaaccgcgctcgcgcgatcgcgcgcgcaccgcgtcctcgcactcgtcgccgtcgacgtcgagcatggcgtcgcgcctccgcgcgcgcggcgcgccgtcgcgatgtgtcgccgccgacgcggcgcgcgatatacgaagcgtcgcgccgtcggtcgcggatgacgcgtatgcgcaaacagtcagcggntatcggtcggtcgcgggcgctcgacgcgacgacgtcacggcgcgacgcgcgacgcgcgcgaggcaccggcgcgcgcgcgagatggcggacgacgcgccgaggcgcgcgtacccgcgcgtcggcgacggcgacgcggcggcgcggcgcgacccctggcggaacgtcgacctcacgccgccgatcgaagggtacgacgccgacgtctggcgcgcgcgcgtcgagctcgcggcgtgctatcagctgtgcgataagcttggattcaacgagggcgtgtgcaatcacctgacgtgcgcggcgccggggcgagaggatgcgtttctgtgcgcgccgtacgggttggcgtggagcgaggtctcggcgagtaatctggtgatgatcgatgggcgcgggaagttgctcgaggggtcgggagaggtggacgcgacggcgttttttatacatctcgcgatacaccgcgcgggagtggcgtgcgtgctgcacacgcacatgccgcgcgcgagcgcgctgtgttgcgtggagtcgttcgagttggcgatgtgtcatcaaaactcgttgcgattcgccgaagacgtggcgtacgacccgacttttaacggnttggtgttggataacaccgagggcgagcgattggtgaaggtgatggatgggaaacgggtgttgatgcacaagcatcacggcgtcatcgtgtgcggcgcctccgtcgccgaggcgttcgatgatttgtactacctcgagcgcgcggcggaggtgcaaatcttagccatgtccaccggttcacccctgagcatcatcggcgacgacgtggcgcgacagtttaggcgggatatggaatcggacggcggcaaggcgcgctgggcgcagttgcactacgacgcgcgcatgcgcgaactcgccagagacccgcttcggcgcatcttcatcgactagcgcgttcggcgcgaaggctcaccgaacgctcgcgcgcatttcgcccgagaaccgttcgcgagcagctcaatcacacacatttcattgttattgtaaactgaatccgttttgtcgcttnggcgcgacggcgaggcgaagccacagactccgtcgcgtcggccctcgcgcgcgacgcgcgcgcgacgcatggatgtcgccgccctcgaccgcgcgctcgacgatgtctccacgtccctcgaagccttcgccgaggtgcgtttcgcgtcgtctttcgaaccaactcgaaccaacgaactttgtcgagacgacgcgcggtgactgactcgcatcgacgcgcgcagcacggcgcgaggcgcgcgcgcgacgtcgcggtgtcactctgcgccgaagccgcgcgcggaggggtggaggacgcgatcgcgggcgcgcagaaggtggttgacgcgctggagcgacgaagggcggagagcgcggcgcgcgccgagcttcggcgagcgagcgcggagggcgcggcgcgcacactgcgggagacggtgaagaaacacgcggtagaacgcgaaagtgtgtgcgaggacatggcgagggcgtcgttaatgacggaacgcgtgttggaacggttggagtcgccggcgaacgcggaagctgcgagcgcgagtcgacgcgccgacgcgttggggacgttggctgangttttggagtgcgtgtgtgcgttttctaagggtggcgaagcggtcncgaaggcgtgcgatggactgtttgcggacgcggcgcgacgaggcgaagcgggacgcttggcgaaaagatcactctccgtcgtcgaacgcgcgcagtcgtgtcgcatcgcggacgaggacgcgggcgcggagcgaatngcgctcaaggacgcctcgacggcgttgcaaaggtactgtgaagacgttganaacgcacttttggacaaatttgccgcggcgtgcgcgaataagtcgtacgcagcagcgcgagccgacgctgaggcgttatttgagttcaacggcggacacagcgtcgtctcgcggtacgtcgcgagccgtgaaatgttcatctctgcgaacgcgatggaa

SEQ ID NO: 891 - DNA, 4000 bp, Escherichia coli
  misc_feature (87)..(87): n is a, c, g, or t
  misc_feature (1823)..(1823): n is a, c, g, or t
  misc_feature (1970)..(1970): n is a, c, g, or t
  misc_feature (1987)..(1988): n is a, c, g, or t
  misc_feature (1991)..(1991): n is a, c, g, or t
  misc_feature (2563)..(2563): n is a, c, g, or t
  misc_feature (2678)..(2678): n is a, c, g, or t
  misc_feature (3111)..(3111): n is a, c, g, or t
  misc_feature (3142)..(3142): n is a, c, g, or t
aacagctcgttcttcccgatagtgcggttggtggcgcgggtgacgcggtaatgcacgatcgccccgttcggccccgacccggcgatngtcgggaacgaaatatccttcaatagaccgctatcgcggcggaagctttccagcgcctccaccgcgtcgatctcggtcagcttgccggccggcgcctcgcgctcgagccaggccaggaagcgcgccatcgccacgccgtcgcgcttgtgggcggcgcgcgagccggcgatctcggcgtggtttttcaccgccttcatcagcgcgatcggatcggcgccgcgcaccggcttgccgccgtacccggaaaccaggcgcgtgagcgcatcggccgcgctcgcctggtcgagccgcacggtcttgtccttgagttgcgcaaggtcgcgggcaagctcggcggtcgcgcgcaccgccgcgatctcctccagcgctggacgcgttttgttgtcgagcttggccgtttccacatagagcgcgggcttgccctcgcgcgggataaccgcgaaggcgagcgccagcggcgtatgcgcgatgtccgagccgcggatgttgaacgcccaggcgacgttctgcgggtccgacaccaccagcacatcggcgcgcagctttttaagttcggcctggatgcgcttgaacttgtcggccgcgctttcgccggcgagcttgatatcgcgcaagctcacggggccggcgggcggcgccgggcggtcgctccacagcgcgtcgatcggattattatcgaccgccaccaattcggcgccggcggtggcgcaggccttgcgcagcctgtcggcgctctccgatgtgtgcagccacggatcgtaaccgagcttcgccccgcttttgagattctgttcgagccattgctcaggcggcgagtccaccagatgctcgatggcgaagagtttggcatcgatctgcgccgccgcctgcacggtgtagcggccgtccacgaatagcgccgcgcgctcggccagcacggcggcggcgcccgccgagccggtgaagccggtgagccaggccagccgttcctcactggccggcaaatattcgttctgctggcggtcggcgcgcggcaccaccaagccgtcgagcccgcgccgcttgagctcgtcgcgcaaggcagcaatgcgcgccggtgctgtcgcgcgctcgtgcgaatcgtcgaatgtctgaaagcgggcctcgaacataggcggcactctagcgcgctccccggtgagggcaacgcaggcatacgccaggcgtcagccgaggcatgtctgtcatgccagcaggcacgaacgcgaaaaattcgcgtcgtgctggcgctcaattcggcaacgaatcacctgtttgactcaaaattgtgcactgcattaaaattgtcgtaataatgccaccgatctcaccgattgattaagcaattcatgcggtgtttacagggcttctatgcattgttatgactttctcgcaattgcgagatagtttatgttgcgtcgcaatagtcaagagtgtaagtcgggacattcgctgacgcttcgttttcgaaaaggagagacactatggttgccattacatatggcgttgctacccgtgccgttgccgacaccgccacggccaacaagagcaagggctttttcacgatcgtattcgaggcgctcgccgcctcgcagatgaagcgggccgagcgcgaactcacacgctatcggcatttgctgccgcacgcgggcgacggcaacgaggatgagccgttcggcggctggtaatcgtaagcatttcaccagcaaagccgccccgctcatcgccgcccggggcgnttttgttttccgcttcgcagcaccagcgtgacccagccgtcgagcgggatgcgccgctcgagcgccaagccctgcgcgcggtagatcgccagcacggcattggcgtggcccggcagcaggccggataacacgatgcgcgcgcccggngcagcgagccggcgcannggnaccgccagccgcagcagcggccccagcagaatattggcgaagatcagatcgtagggcgcctgcgccgtgatggcgcgggcgttcgcgccggcggcgcgcacgaaggtgatcgccgcggctgcgcgattgagccgcgcattggcgcgcgcggcctcgaccgcgaccgggtcgatgtcgctggcggtgacgcgggcgcgcagaattttcgccgccgcgatcgccagcacgcccgacccggtgccgacgtcgagaatctttttatccatcctcctgcaagggggagggtggcgagcgaagcgagccgggtgggggtcattccttctttgtttgaccccaccccgatcctcgctccgccatagccgatgctttgcatcggcgttcttgcttccaaggacggcggccaaaggccgcctatgtcgaccctcccctttcaggggagggatagaaaaattacgctgccgcttggccaattcatccagcgccagcaggcagccgcgcgtggtgccgtggtggccggttccaaacgcaagcgccgcctcgatctcgatgccgatgtcgttgggcttgacgcnggcgcggtcgtgcgcgccatgcacgatgcagcggccggcgcgcaccggtttgagaccggcgaggctttgcttgacccaatcggccggcgcgaccggctcgatggtgagcgcggcngccgccgcttcgccggcggcgatcgcgaccagcgtgcgcagcacggcttcgtccggcttgtcgcggaaatgaaccgccacctgccattgcccgccatcgtcctcgaaagcggcgcaggcagtgccttcggagtcgaggctttcgccgagataggccgccagccggcgggcggtcggctggtcgcaggccaggcgggcgacggtggtggtcattccctgtcattgccgggcttgacccggcaatccatgaggccgcgccgcaacggcaatcttgcggtaggtcccccgaatgcggctactcatcatggatgcgcgggtcaagcccgcgcacgactgaggttggtgaaagccccggccatggttatgtagggccaatcatgaccatcgaaacgcccaacgctaccgacaccgaggcgctcgcgctggcccgccgnagcggctggccggaggatttgcgcgtgctgntcgcgcgctttccgcgcgagcaatggcagggtcatgccaatctcggcgagatggcgcggttctggctatcgcgccacgatatgtttcgcgagctcgccaccatgatccaagcgatcgaggcgcaattccgcgatggcgcgctgtcgccggcggaattcccgcgccagttcgtgccgcggctgcagttcctgctgtcgcagctcggcgtgcatcaccagatcgaggatctgcattattttccgatcttccgcgccgccgataagcggctggcgcgcggctttgatgtgctggagggcgatcaccatgccatccacgaggacatggcggcgaccgccgacaccgccaacgcgctgttgcgcgcgctatcgggcgatgccgacgtgctgcgccgttgcggcgatgcctatgcggcggcgagcggcgcgctgctcaaggggctgatccgccatctcgacgacgaggaagacctgatcgtgccgctcattctcgagcgcggcgaggccgcgctcggcgtcgcacatcacggatagagtggacaagggcgcagtcgcgcaatcaggatgtccaggtcgcgtcggtattatctcaagtcgcgcagctgccggtaaattcaacttaaccaagcaattattttgacgccggatcaccgggagttgtagtccgccaccaccttttgaatcacattttgaccgatgctgcgccgcgaggacggggctctcagggagtcttgcaatgaaaaaactactgattgctttcgtgatggctacgttcgtggcgtcgccggcgtttgcccagaaacgccacgcgatctcgccggaagcggcagcggcgcaagcttacgcgccaagtgatcctggc

SEQ ID NO: 892 - DNA, 4000 bp, Escherichia coli
  misc_feature (45)..(45): n is a, c, g, or t
  misc_feature (1988)..(1988): n is a, c, g, or t
  misc_feature (3333)..(3333): n is a, c, g, or t
ttgaaaaactccatcgcgttacaggttaacgtcccggttttatcngataaaacggtgtgtaccatcccgagttcctcgttcaagttactcgttcgtgcgctcatcggcgtgtccgtttcttcgtgatacatctttcggtcccgatttaacaaaaccatcgcttggaaaactttcacgaattccaacgagacgtataaagaaataggaatcaaatatccgtacaacacgtaggaggtaaagaatgcaaacacaccgacaatgtcggttttattcacgtcgaagggttcgtccgaattcgcggtatccaagtaccaatgctttggactttcgtttttcacccaccaggaacaataaattgcggaaatcgtggacatggagagcaacaaaatgagcatacctaaaacgacataatccatctgtttctccacgtgcgaccgtttcgatggcgtttccgacgcgttcatcataacttttgaatcgtgtccggtgtaaatgacaataccgtaaacgtattccgtgtttcttaactgcgaccctctcaacaaaacgttcgtcggcgtcacggctattttctttttttccgacacaaaaggcggtttcaactccaagttcccgctgaacgtgtataaagagttattcgggtgttcgcactcgaccgtgcataaattgccactcaagtgatcctctgcattcgccatcacgtcgtctcgttgagagttgcgacacaaattcgccagctttgcgtttgaaatcaccttgaccccatcgcccatatctacgctccttttcaacttcaagttcgtctcgccgtctaaattcttcgtttccacgtaacacgttctctcctcgttgctcgatccaatcatgatcaaatcgcacggaaaaaacgcatctcgtaccaccctcacgacgtcgccacacaccaaatctcgccactccttattctccatgcactctccgttaaaccgttcaatcggcgttcgattttgctcgttatcttgcttgtgcctcttataatcctccacggcttctttcgtcatgctcaacgtgatgataaacgtcagcggcacccacatcgtgtacggcttaatcggcgaaatgctctcgaaacacgaaatcgtcgccacggataaaaagtacaagttcgcgactctccgaaactgttcgtataaacctttgggaagaaacgtcaccacgttatacttcgacgtcgatatcgagttgctcttgaactttaacggcgcgttcgtctctcggtcagagctgattgaaaacacccgcgatatcggtttttcctgttcttttttaaacatcgacgtcgctcgttcgagaaccgaaggtgatttcgtcaaggatttgttccttttttgcagcttcgaattcgacgaagacgacgagaccgacggtctcgattccaacgcatttgccgggtcgacatccgtcgtcgtttgcgtcgttttatctctcgctttctctgcatcaccgctgctcattcttagtatcagatatcaaactctaaaaccaaagcgcgcttcgtttacgcgcgcgtgtgtgtatatccttcctccgaaatgcgttcgatttctgttgacctcgtcccgggacgatgatgacgatccgaaatcgcgaacggttttcgttcttcacgaacaaaaacactcggcaaagtttctcccgaaaatcctccctcgatgtatccttttcgtcggggtcgttctctcgcaaagaagacaaagaagacaaagagaacgtctccttctcctctttaatcaacacgagaggaagaatagaattttgacgttttttggactgcaggctggcaatttacgtgaaatttgtgagatttcaaatgtgtgttgagatatataatacgctttcgcgcgcggacgagacgtgtctgtcgttttatgcatcacaacggtttgcctatatgtatatatacgcttacggcttactgtagtgattacaactttttttttttaaatatntagatttttatctcctcacgcggtgggtgcgttttgaaacggcaaaccttcggcgtcgacgcactcgtacgccttgtcgtcgacggggactttgtcttcgctgccgacgatacacaccgtcatcggtttgttcaggaggtactcctgcgcgactctggtcatgtcttccgctgtgcaatcgagcagacgcgtgcggaagttttgacgttgggcgtcggtcattctctgcgcgtataaggattggccgcgagaggctggggcgatcggcgagtcgatggatttgaacgcgcgcaaatgcgcctcttcgaccatggttttcgtgattgagctcggttgagcggcccattcgcaggctttttggaacgtttcgatagtttcgagcgtgttcgggtcgcggtaggaggaaaaatagaagatgccggcagacgggacgaacgaggaaccgccgccgtaagcgccgcctttctcgcgaatctctcggtggaggaattccgtgctcatggcttgcgagaggaggaagagcgccggggcgtccggatgttcgtacccgacggtttcgatcgcgccggtgcagtagttggtttgacctttgatggcgacgtaggttttcgacgcggattgcggggtaaacgcggccaatttcgcgttcaacgacgatccatccgaggaagaaggtttacttcccgtggacggcaacgccgacaaccatttcgccaactgcgctttgccagcttccacgtcttgcgcttgagacgcgacgcggcatctcttcacgttctctggcgtcaagagtaaactttgaatttcagagcacgcggctttgacttcttccacgcctgcttgttcggctttcgctaagcgttgcgccaatgcaacctgtggaagaccgccggtgcggttttcgagttcacccgcggcggacattttggacgcacacacggctttaccgtaccccatgccgttttgcgcgacggacgcgcctagctgcgcggaccgacgtttgatcaagaacttcaatcgttcgtcgtcgccgaaccatttcgcatccgtgcagacgtccaacaagatgtcgcccatagcgtcggcgttacgcgctaaacagtgagatccgatgttcatggcaacttcgccgttctcggtccatttcaacggcatattcgtgtcattgttactgagaacatcgatggatacgccaccgctgacgcctttgattttctccgcgaagtctttgtacccaactttcgatgtgccgatttggtccacgtaatccgcgaaatagtccaagtacggcgtcaatctgtccggtaattgagagcaatcaaacatggcgccgacgtagaccacnccattcgtcggttgctcgtccacttgtaacttcaagtcgatgttgttcgagttcaatcgtaacttttcctctttcgatccccactttttgatcgatcggtccaccgcttcagcgacttttaacgtcggcaacagctcggcgttttgttcgccgtcttgcgcggctttcaatttaacgccgtcctcgacaattttcttcttttcgtcttcggaaagtttagattctaattctttcaacaacgcgttctcggcttcttccaatttggcgtcgtacttttcgtccgatcgcgcacgaacgataactttgtgttggttattcaaaaagtacttcgagattaagttttgccaatactgaggatcggaatccaatttctcttgcaattgcctcgcgagcgagagtgttctcagcggtctcaaagcgtcgccgtcgtgcacccacgtggacatggtcccgatgccaaccattaaaccaaagtttggcttcacagctgcggcgtctaattcgatttggtgcaacgtcgagtcgacccggtttctcggaaacccggatttcgcgacactttccaacgtttcttgaatcttttgttcgacgattggaatctcctcttccccgacgcctttcacgccaaccgagaaggaggtttctcttctcgagttgccgtagccgc

SEQ ID NO: 893 - DNA, 4000 bp, Escherichia coli
  misc_feature (463)..(463): n is a, c, g, or t
  misc_feature (1228)..(1228): n is a, c, g, or t
  misc_feature (3433)..(3433): n is a, c, g, or t
  misc_feature (3690)..(3690): n is a, c, g, or t
atatatagccctgatgaccattcttggtatttccgccattgaccttgtattagcagtaagtgttgtggcccttggtgctgccattcaggcagctgtaggtttcggtctggcattgatcgccgcaccagcgctgctgctcataaacagggatctggtgcctggaccactgatagcggcagcactgtacctggtctgctgggttgcatggaaagaacgccagtccattgattacagtcacctcaaagcggccctgatggggcgattgattggatcgcccccagcagcttatttaatggggactgtttccgcggttacctttgatttgctttttggtgggcttgtcctgatagctgttattctgagcctgattcataccaatatcacagccagttcccgtaatgtattcctggccacgattgcatcagggttcatgagtaccatttcatccataggtgggcctccngtggcacttgtgtaccaaaatgccagtggaccagctctgagagctaacctgtcagtactgttcattatgggctgtgttgtgtctttatctgccttgataatagtggaccgtttccatcttgaggacctgctgtacagttttttactttttattggtgtttttgtgggaatgtcctgttcaggtccattgacaagaattatggataaacgcagcgccagaccatggcttttgggcttgtgcactttctcctcactgctggttctggggcgggcggtatatcagctaatttaggattcagacttcttccgttgattcctcaacaactggtacagggatgtcataaggcatctccatactcaataaacctagctttcctgccctgaggtcatttaacagggcttcgccggtcttgttaaaatctataccaccacgcttgagacagcctcgtttacggcctatttcttcaagcagaaatactggatcctgattcaaatcatcaagctggtaacgctttaccagtgcagcggggtaggcacggcaaagaaagttaacggcatagagggcaatatcctcaaattctatggccgtgttcctgattgccccggtcatggccaggcggtaagcagagtcctgattttcaattttcggccaaagtattccgggtgtatcgagcaaacagagatccgtatcaagtctgatttcctgctgccccttggtgacagcgggttcattgcctgttttggcgattttgcgaccggccagganattgatcaatgtagacttgccgacgttcgggatacccgcaaccatgatcctgaatggtggctttacggacgatttgagtttgttgaaatgctgtactacctgctgctgtatatggcctggattcttaccgcaggcagtgatcgcgggtctgttttctgccgtaaaataatcaagccaatggctggttttgtcgggatcagccaggtctgatttgttgagaataagcagtgaaggtttatctccggccagttcctgcagtagcggattctgactcgaatagggaaggcgggcatccacaatttccaggatggcatgtaccttctttaaagactgtataatctctttccgggccttgttcatgtgacccgggtaccaaccgatctgcatagtggtctccatgtgtgcagaccgcatattgtcgcagaatatgagccaaaaaggagcctacacaccccgtgagtacagaaaataccatacacagcaagctgaatgcttcatgccatcccgaccatttggaacttgttaatgaaagtcacatgcatgcagggccggccacagattcccatttcaaactggtgatggtatccacggattttgaagggcttaacagagtgaaaaggcatcaactggtatataggatattgtctgaggaactggcaggaaacgttcatgcactggcgctgcatctgtataccccgcaggagtgggcagaaagacactctgtgcctgactcccctcaatgtgcaggaaaaaatgtttaaaaacaataagatagggttaatcggaaagtttcctggggcacgtttaagctctgtaaagttacagaatatgactgaaatactgtgctaccattttaacaaaacaggaaaaactgcttgaacatgaatatatcctggacaccacgcaaggctgcaacagcctattgccttatcattcttggcttcttccttggcttcttcatacccctgatttttttggtcgaggaggagaaagattctgatcttactcaggatgatctcgttacgcttcccgaggaggtccctgattttgccagtatcgaagatgtaaggctcaagaagcagatgttctttgattacattgaaccctatgttgatgcggtgaataaagacatcattcgacaaagggagcgtgtgcttatgataagaagtgccttgcgtgccggggaagcattgactgacagtgatcaccggtatatttccactcttgctgaacagtacgaactggaggccgaggattacaccagtagtgagtttatcaatgtactcctaaggcgcgttgataaaattcctgcgtcactggctcttgcccaggctgcaaatgagtcagcctggggaacttcccgatttgcccaggacggtaataatttctttggtcagtggtgttacaccgatggatgcggcatcgtgccaagtcggcgcagggaaggcaccagtcatgaagtcaggcggtatgaaaatgtcagggattccgttgaggcctacattcacaacctcaatacttttcccagttaccagatgttgagaagaatcaggcagcaattacgccgtcaggaacgcccggtggatggcatatcccttgctgatggactcgaaagttattcttcccgtgggcatgactacatcgatgaagttcagcgcatgatcttctcaaacaatcttctgacccgcgataaccacgcgctctagactttactcgggtatatccggattcacccagggaattgaataccagaaataccggccttcctgacccggtgcagtacagttataacgaaagcgcctggaacggttattaatatgagtgcttaccttatatctattctcagcattgttaagtacttctatctcgatcctttcattgttgttaaaacaggataatccacgcagtcccgcttgatcagcgacaaaatctagttcagccgttggactcgattcacgggtaacaggtgtgacaggcaggacttcatccagtgaaaaggcaaggctcatgaccttggtgggaaaagagttcatggacgcatagatcccggaaaagggaaagcggggcaaggctgtgaaatccgaagttgcattgaccggacctgaatgctgtccaatccctgtgaagcctagttcactgacaagttgttgaatagccgggttatattcaccatagggataggccactattttgtgtccctggccngttttttccagaattgtggcctctgcctgcagtatttcaatcctcacaccctccagccactgctgctctgattggccatctggatgctcaaggagataggggtgtgaaaccgtgtgattggcgatcgtagcgccattgctggccatgatctgtatctcttcccatgttgagtagagcgaatcgttggtgctcacaaggcccgtagtgacaaaaacggtgaacggccagcctttttcctgtaacagggggtaggcganctcatatacggaggtatagccatcatcgaaggtgatcacggccgttttgtccggcagtaatggcccgtttttcaggcgatgcaggacagtctcaaggggtaaaatggtgaatccgttttcgtcaagataatccatgtgtgccgtaaaagattccttgctcagactcgttacagggggactgtctgtgctgacgtgatgatactggaggattactgcctggttatctgactgggtataccccacaactgtggtggacagcaggataaacatggtcaggattcgggttcgtatcaagggtcccatggaagct

SEQ ID NO: 894 - DNA, 4000 bp, Escherichia coli
ttgacggaggaaatgaaaggtacggcaaccaatcacaaaatacttctcatgtcctcgcctgggtaagaaccgtggggtcaacagttgccgattctcgattctatctcgatggattcgaacaggcatcgacctcggacagcaacggggcaagcttcccctcaagtgtcacaagcctctatgtcctcggagccaactccgcaggaacgggcaactttttccatggatctattggggaacttattgttctcaactctgattcctccacggaccgaaccgctctcgaagaataccttaccagtaaatggggcttgggtgatcgccactacgcagacctatccggtgggaaccgtaggctcgtttacagcggggaggaaaacaccggggacgccaagtttggcccttctctgaaatttaatggtcttggtgatttcgctcgtataccggtggttgcacccgattccgctccttttgaattggaggacataacgcgcccagaacttcttcatggctggtggccaatggacgggaacgggactgaccgatcaggctacgagagagacggttctctctccgcaaatgccaatttcactacgggtcgttttggcaaggctctggatctgtcttcgggcggcagcttcatcgtcccacaagtctctggtggtggaatcctcggaaaccaagcacgcacggtgtcatgctgggtaaagacaaactccctgaatgtccccatagtacagtggggtttgtccaacacagatggaaaactttggaagataatgctcgacttcaacgaaggcccaggagggactttggcacttaacctaggcggatcatctgtcaccggcggactttaccccgtcaacgacggcaagtggagacatattgccgtcagcttgtcggataggatcgaaaatactcaggtcgcgactctctatgtggacggttacgaagataaccttttttacaccaattttaactccaacaccctaaacatagactcttcaccctctgacctcgttgtagggggtgaagactttgtcggatgggtggatgatctacgaatttattcaggggaactcaatgcaggcgaaatccttcgaatccaccaggagggctcccttgatgacctcaatctggttggtgctgacttcactctttcggtatggatcaagccagatgccctaccagatagtgaccagtttgaattcgctaccggtcgagcatactggagaaattggggtggggatgtgcgctttcaaaaatggccacaagacaaggttcacaacgatgttcccctgttcgatccaggaggggaaatgtttgatgaaattatacctgaacctgctgagctctatctttttgagggagcacttggcgacatgaccaaggttgtcggagcagacaactggggaagctggtccataggttcatcaggtggtttcctcgaagacgaagacccctctgatcatgccaaaattatgcgaatccctgcgggggacccagatggcgaacctgcctatgcaacagactaccaggattccttgagcaaagatccgctttatttcgcctcatcacttaacaccgaatattctggaagatggccccaaggtgctttcatggccagaggcatgttcaacatagacaaccaagtgcagccaggcttgtattacctctacgctggaggcggcggatggtcgactttctggatcgatcgcaatcaagatcaagaatgggaccgtaaggctgaaagatttgttcataatatcggaggctggggatgggacaggagtaaccaccgaagcttcgttttccttggtcatcaagtaccccttatcacccagcccggcatcgcagccgaccaaggtctcgccattggcccaaaccagtctatatcaacttggaaaagctacactcaggaaacagttcaatctttccgggaaaaagcttggaaactcgggcaatggcatcacattgcagccactttcgatcatgcgaaacataaactttcgacctttttggacgggcgactggtaggctccattaatttagattctgaagagattggtgatcaccgttggggagactggtacctcggaggccctggacctctgggaagtatgcagttttttgcgggaagtatggatgatctgcgaatttacgatgcagcactttctcctgttgaaatttacaaaattcacaacggaggtgaaggcgatcttggggtagctggttaccttgaagcccctgaggtcacctctctttcagaaatagatctaaccctctcgttctccaaatacggccaatcaactccggtttcaggacttactgctgccgaaataaacgccagcttaataaatgctgaacttatccctgaaacatttcaatcctcggatcagaatcacactttcaatttcagaattatttctgcctccggcaaaaaagtttctttcaaccttggtgcaggagctgccgaatggatgggtgaacctacccttgcggtcaatcgtgagattatgatcatgcccgaggtggcacacgctgaacaaatccttcactggtggtggctagatgaggggttgggtgccgagacttcagacagtattgatggatcggtggggaatttaaaaggagatgcatcttggtgggctgactccctctacggaactagcctaggcttcagatcggccggagaccttgcccttatcggctccctcgatgaaaatttcactgaggaccaattcagcttatctttttggttcaaacgggaagcagataccctctttcgctctcctcagcaggtagggaatgtaatgttgtccttgggcggtgcagatttggccagtctacaggtaggaactggcccttcaagtgtggaggtattcctcaattctgaaatttacactggtaaagtacagcttggaacaaatgtcaaagatggagagtggactcacctccttctttcctatgatgcagattcctctgacggttatgaattgaagctttaccttaacggcacctttgctgccgagtcaggagactttggcaactctttgatcaccactaacgattcttcatggattttaggtgcagactctaccttaggattggataccggaaggttttttgggctactcgatgatctcagaatctattctacagtactcaaggaaaatgatgctgaaaatctctataatcttggagtcagtgacctccaactaaccctcgaaccatacgaattggatgccactcaagaccctttgaagtcaaacgaagtggtggtcgacttcaggtttaaaaaatacggcgactttcttgacctcaatgaagtctcaatacccgatctcgacttttcgcttcctgcaccagatgattaccctgaagttttactttggctggatgggtctgatccttcgaatatggatcaatctaccaccttcggggcgtctggatctccttcggatggagatcctgttaagttttgggccgataaaagcggaatggaacaccatgctgttcatgttagcggtactgattccccgatttttcgctcaaacacatttgatggtgagctagcatgtgtcgagaccgataatgcccagttccagttatctaacagttccgaggacttcgatgccttaaataacctttctctttttctggtttatcggtggactggctccggtgacacatggaagagcatgatttggaagggctcaggttacggtcacaactttgttggtactttctgcgttgggaaaatgaatctcggtgcaaaccagggattaggagtttggtactacaatggtagcagcggcaaggtaaagcagcatggcaaccgacccagctatgctgatacctctgctcgaattttctctttggtatatgacagctcaacgggaattagttcgatttgggcagatggtatcctcgcatccactcacagcgttggctacaatcctctaccttccagttcaggtacgccggtgaagcttggtgacta

SEQ ID NO: 895 - DNA, 4000 bp, Escherichia coli
  misc_feature (73)..(73): n is a, c, g, or t
  misc_feature (1983)..(1983): n is a, c, g, or t
  misc_feature (1986)..(1986): n is a, c, g, or t
  misc_feature (2025)..(2025): n is a, c, g, or t
  misc_feature (2028)..(2028): n is a, c, g, or t
  misc_feature (2031)..(2031): n is a, c, g, or t
  misc_feature (2040)..(2040): n is a, c, g, or t
  misc_feature (2124)..(2124): n is a, c, g, or t
  misc_feature (2631)..(2631): n is a, c, g, or t
  misc_feature (2757)..(2757): n is a, c, g, or t
  misc_feature (2961)..(2961): n is a, c, g, or t
  misc_feature (2967)..(2967): n is a, c, g, or t
  misc_feature (3150)..(3151): n is a, c, g, or t
  misc_feature (3263)..(3263): n is a, c, g, or t
  misc_feature (3357)..(3357): n is a, c, g, or t
  misc_feature (3362)..(3362): n is a, c, g, or t
  misc_feature (3366)..(3366): n is a, c, g, or t
  misc_feature (3368)..(3368): n is a, c, g, or t
  misc_feature (3370)..(3370): n is a, c, g, or t
  misc_feature (3373)..(3374): n is a, c, g, or t
  misc_feature (3380)..(3380): n is a, c, g, or t
  misc_feature (3384)..(3385): n is a, c, g, or t
  misc_feature (3387)..(3387): n is a, c, g, or t
  misc_feature (3557)..(3557): n is a, c, g, or t
  misc_feature (3559)..(3559): n is a, c, g, or t
  misc_feature (3561)..(3563): n is a, c, g, or t
  misc_feature (3566)..(3568): n is a, c, g, or t
  misc_feature (3570)..(3570): n is a, c, g, or t
  misc_feature (3572)..(3572): n is a, c, g, or t
  misc_feature (3576)..(3576): n is a, c, g, or t
  misc_feature (3579)..(3581): n is a, c, g, or t
  misc_feature (3585)..(3586): n is a, c, g, or t
  misc_feature (3588)..(3590): n is a, c, g, or t
  misc_feature (3592)..(3592): n is a, c, g, or t
  misc_feature (3594)..(3595): n is a, c, g, or t
  misc_feature (3598)..(3598): n is a, c, g, or t
  misc_feature (3600)..(3603): n is a, c, g, or t
  misc_feature (3608)..(3608): n is a, c, g, or t
  misc_feature (3610)..(3618): n is a, c, g, or t
  misc_feature (3622)..(3622): n is a, c, g, or t
  misc_feature (3624)..(3625): n is a, c, g, or t
  misc_feature (3627)..(3628): n is a, c, g, or t
  misc_feature (3633)..(3634): n is a, c, g, or t
  misc_feature (3639)..(3640): n is a, c, g, or t
  misc_feature (3642)..(3642): n is a, c, g, or t
  misc_feature (3644)..(3644): n is a, c, g, or t
  misc_feature (3646)..(3651): n is a, c, g, or t
  misc_feature (3654)..(3655): n is a, c, g, or t
  misc_feature (3657)..(3658): n is a, c, g, or t
  misc_feature (3660)..(3661): n is a, c, g, or t
  misc_feature (3663)..(3665): n is a, c, g, or t
  misc_feature (3667)..(3667): n is a, c, g, or t
  misc_feature (3669)..(3669): n is a, c, g, or t
  misc_feature (3672)..(3676): n is a, c, g, or t
  misc_feature (3678)..(3683): n is a, c, g, or t
  misc_feature (3688)..(3688): n is a, c, g, or t
  misc_feature (3691)..(3695): n is a, c, g, or t
  misc_feature (3697)..(3699): n is a, c, g, or t
  misc_feature (3705)..(3705): n is a, c, g, or t
  misc_feature (3709)..(3718): n is a, c, g, or t
  misc_feature (3721)..(3721): n is a, c, g, or t
  misc_feature (3723)..(3727): n is a, c, g, or t
  misc_feature (3729)..(3731): n is a, c, g, or t
  misc_feature (3733)..(3733): n is a, c, g, or t
  misc_feature (3736)..(3737): n is a, c, g, or t
  misc_feature (3739)..(3739): n is a, c, g, or t
  misc_feature (3743)..(3745): n is a, c, g, or t
  misc_feature (3747)..(3748): n is a, c, g, or t
  misc_feature (3750)..(3750): n is a, c, g, or t
  misc_feature (3755)..(3755): n is a, c, g, or t
  misc_feature (3757)..(3762): n is a, c, g, or t
  misc_feature (3765)..(3765): n is a, c, g, or t
  misc_feature (3767)..(3769): n is a, c, g, or t
  misc_feature (3771)..(3772): n is a, c, g, or t
  misc_feature (3775)..(3781): n is a, c, g, or t
  misc_feature (3783)..(3783): n is a, c, g, or t
  misc_feature (3790)..(3794): n is a, c, g, or t
  misc_feature (3797)..(3797): n is a, c, g, or t
  misc_feature (3799)..(3799): n is a, c, g, or t
  misc_feature (3803)..(3803): n is a, c, g, or t
  misc_feature (3805)..(3805): n is a, c, g, or t
  misc_feature (3807)..(3807): n is a, c, g, or t
  misc_feature (3813)..(3814): n is a, c, g, or t
  misc_feature (3816)..(3817): n is a, c, g, or t
  misc_feature (3819)..(3823): n is a, c, g, or t
  misc_feature (3826)..(3827): n is a, c, g, or t
  misc_feature (3829)..(3835): n is a, c, g, or t
  misc_feature (3837)..(3839): n is a, c, g, or t
  misc_feature (3842)..(3844): n is a, c, g, or t
  misc_feature (3846)..(3854): n is a, c, g, or t
  misc_feature (3856)..(3856): n is a, c, g, or t
  misc_feature (3859)..(3859): n is a, c, g, or t
  misc_feature (3861)..(3863): n is a, c, g, or t
  misc_feature (3865)..(3865): n is a, c, g, or t
  misc_feature (3867)..(3871): n is a, c, g, or t
  misc_feature (3876)..(3876): n is a, c, g, or t
  misc_feature (3881)..(3881): n is a, c, g, or t
  misc_feature (3883)..(3885): n is a, c, g, or t
  misc_feature (3890)..(3890): n is a, c, g, or t
  misc_feature (3892)..(3892): n is a, c, g, or t
  misc_feature (3894)..(3895): n is a, c, g, or t
  misc_feature (3899)..(3899): n is a, c, g, or t
  misc_feature (3903)..(3903): n is a, c, g, or t
  misc_feature (3909)..(3910): n is a, c, g, or t
  misc_feature (3914)..(3917): n is a, c, g, or t
  misc_feature (3923)..(3925): n is a, c, g, or t
  misc_feature (3929)..(3938): n is a, c, g, or t
  misc_feature (3941)..(3944): n is a, c, g, or t
  misc_feature (3946)..(3946): n is a, c, g, or t
  misc_feature (3949)..(3950): n is a, c, g, or t
  misc_feature (3952)..(3953): n is a, c, g, or t
  misc_feature (3955)..(3957): n is a, c, g, or t
  misc_feature (3960)..(3961): n is a, c, g, or t
  misc_feature (3964)..(3979): n is a, c, g, or t
  misc_feature (3981)..(3989): n is a, c, g, or t
  misc_feature (3992)..(4000): n is a, c, g, or t
gtacgaaaaaattgatcttttaggtgaagttctagaaaaagtgcaagacgaatatgtcgatgaaatagatcangcagaagtaatggactttgcaattaatgggattctgcaatctttagatccgtactcagcttacatgaacccaaaaatttatgaagagatgcagactgaaacaagcggtgaattcggaggtttaggaatagaagtaagtatggaaggtggagttgttaaagtcatttcgccaatagatgatacgccagcagcaagagttggtgtaaaagctggagattatattgttagaataaatggtgaacaggttcaaggaaaaacacttatggaggctgtgaatttaatgagaggaccggtaggttcacctattgaaataacgataagaaggaaaggtttaaaaaaagcaaaaatttttacaatcattagagaaattattgaaataaaatcagtaatttctaagttaattgataatgaaataggctaccttagattaagagcctttaatgaaaacagtagcaatcaattaaaaggggaaatttcaaaattagaaaaaaacaataaattagtgggatatattcttgatttaagaaataatcccggaggtcttttgtcccaagctgttagaatttctgacttcttcctcgatgatggagaaattgtttctactagaggaagaaaaagtagagaaaatagaaaattttttgctaaaaaaggagaccgaattaagggtaaacctttaattgttttaatcaataatggatcagcgtcagctgctgaaattgtggcgggagccttacaagatcaaaaaagagcagtattattgggtgaagctacatatggtaaaggatcagttcaatccattattcctctaagaaataagggggcaatacgattaacaatatccaaatactatttaccatctggaaaatctatttcagaagtgggagtaactcctgatatcagagttgaggaggaagatgaagaattttcaatcaacactattacagataatcaattaaattacgcagttaaacttttcagtggctaaagtttaatgaagaatagaaaagaattaccattaagaattggtgtgggcatagctttattgaatcatgaaaataaggtttttgtaggaaaaagaatagataatcctacaaattcatggcaaatgccacaaggtggaattgatcaaaatgaaaattttttagacgcagctaaaagagaacttgaggaagaaactgggataaaatcagtaaaattaataaaagaattagatggatggtttaaatatgatttaccgaaatatcttctaggtaaactctggaaaggtaaatataggggacaaaaacaaaaatggttggttatgaaatttctaggaaaacccgatgaaataaatgtcaaaacgaaaaatccagaattctttgattggaaatggattgaactatcaaaattacctaacgtcgctgtgcactttaaagtagatatttataagaaaataaaagaagagttaacttctttaagtttgaattagactcgtatttctttgagcgcatcaagtttgtgattaagaacataacgatcatgatctgtaatattcttatctgtgagtttatcttgagtatcttcgtttagattatccacaaactctttagataaatcttttacatttattgcggaagctgaaagtaccactaaactatcattaaagaattccacagcaccatcctggacaaaaaattctttaaaatttccatcattttgcacctttattattccgggtcttaaaagagttattattgaaatatgattttttaatatgctcatatcaccctcatacgagggaagtgtaaccatttttgtttcatccgaaaaaataattttttctggactaatgatttcaagtttaaaactatcttccattaagctgctgcgtccttcgccattttttcagctttttcaactacctcttcaatngtncccaccatataaaaagcggcttcgggtaaatgatcatantcnccnttacatatngcatcaaaccctttgatggttgcttctaaatctacaagtttacctggagaacctgtaaaaacttctgcaacaaaaaatggttgngataaaaatctttgaatttttcttgctctcatcactgttagtttatcctcttcagaaagctcatccatacccaaaattgcaattatgtcttgtaaagatttataagtttgtaatattttttgaacttctcttgcaacgctataatgttcttcaccaactattctgggatctaaaattctagaagtagaatccaaagggtcaactgcaggatatatccctaactctgcaatttgccttgataaaactgtagtagcatccaaatgcgcgaatgaggtagctggagcagggtcagttaaatcatccgctggaacataaatagcttggacagaagtaattgaacccttatctgtagttgtgattctttcttgtaaatttcccatatcagtagctaaggttggttgataacctacggccgatggaattcttcctagtaaagccgacacctctgatcctgcttgagtaaatctaaatatattatcaataaaaaataaaacatcctgaccttcnttgtctctaaaatattcagcaactgttaaaccgctcaatccaactctaacacgtgctccgggtggctcgttcatttgtccataaaccaaagcaactttcgagccttttccatttaatttaataacnccagactcaatcatttcgtgatataaatcatttccttctctcgttctttcaccaacaccagcaaatactgaaaaaccaccgtgtgcctttgcaatattattaattaattccataataattacagttttgcccacacccgctcctccaaaaagacctatttttcctcccttagcgtaaggagccagtagatcgacaacttttatncccgtnactaatatttcagtttctgtcgattgctcagtgaattttggtgcaggtctatgtataggccatctttcttttgtagatatttttcctttttgatcaataggctctccaataacgtttattattctacccagtgtttctggcccaactggtactttaattggagaaccagtatcggtaactttnnttcctctctttaaaccctctgtactatccatagcaatagttctaacagtagcttctcccaaatgttgggcaacttctagtacaagtctatttccagagttatcacattctancgctgtcaaaatttccggcaactgaccttcaaattgaacatcaaccaccgctcctataacctgtgtaatttttcctaatcctttactcattttntaaantttncncnccnnatattntttnnanaagttctttggtaattgctgcttgtctacttctgttataattaattgtcaatttgtccactaaatcttcagcatttcgtgttgcattatccatagctgtcatcctagaaccttgttcacttgcagcattttcaagaaacgctttaaagatttgagtagaaatattttttngnannnaannntntnaaanttnnntttnntnnngntnnaantnnnnaaaantnnnnnnnnntttnanntnnttttnnttttnnantngnnnnnnttnntnntnntnnngnanttnnnnnannnnnnttttnaannnnntnnnaaaaantttnnnnnnnnnnaantnnnnntnnntnaannantttnnnannanttttncnnnnnnttncnnntnnttnnnnnnnanttttttnnnnnccntnaaantnantttttnnannannnnnttnncnnnnnnncnnnttnnntnnnnnnnnncnttngnnncnannnnnaaaanttttnannnttttncntnntttnaaantttttnnaaannnntttttnnntttnnnnnnnnnnttnnnntnaanncnncnnnaannccnnnnnnnnnnnnnnnnannnnnnnnnaannnnnnnnn

SEQ ID NO: 896 - DNA, 4000 bp, Escherichia coli
  misc_feature (443)..(443): n is a, c, g, or t
  misc_feature (446)..(446): n is a, c, g, or t
  misc_feature (1988)..(1988): n is a, c, g, or t
  misc_feature (1990)..(1990): n is a, c, g, or t
  misc_feature (2019)..(2019): n is a, c, g, or t
  misc_feature (2023)..(2023): n is a, c, g, or t
  misc_feature (2025)..(2025): n is a, c, g, or t
  misc_feature (2031)..(2033): n is a, c, g, or t
  misc_feature (2035)..(2040): n is a, c, g, or t
  misc_feature (2385)..(2387): n is a, c, g, or t
  misc_feature (2389)..(2391): n is a, c, g, or t
  misc_feature (2393)..(2401): n is a, c, g, or t
  misc_feature (2404)..(2406): n is a, c, g, or t
  misc_feature (2408)..(2409): n is a, c, g, or t
  misc_feature (2411)..(2411): n is a, c, g, or t
  misc_feature (2413)..(2417): n is a, c, g, or t
  misc_feature (2419)..(2419): n is a, c, g, or t
  misc_feature (2421)..(2421): n is a, c, g, or t
  misc_feature (2423)..(2424): n is a, c, g, or t
  misc_feature (2426)..(2428): n is a, c, g, or t
  misc_feature (2431)..(2432): n is a, c, g, or t
  misc_feature (2434)..(2435): n is a, c, g, or t
  misc_feature (2437)..(2448): n is a, c, g, or t
  misc_feature (2451)..(2455): n is a, c, g, or t
  misc_feature (2458)..(2459): n is a, c, g, or t
  misc_feature (2461)..(2462): n is a, c, g, or t
  misc_feature (2464)..(2468): n is a, c, g, or t
  misc_feature (2470)..(2476): n is a, c, g, or t
  misc_feature (2480)..(2481): n is a, c, g, or t
  misc_feature (2483)..(2483): n is a, c, g, or t
  misc_feature (2485)..(2485): n is a, c, g, or t
  misc_feature (2487)..(2490): n is a, c, g, or t
  misc_feature (2494)..(2497): n is a, c, g, or t
  misc_feature (2500)..(2503): n is a, c, g, or t
  misc_feature (2506)..(2506): n is a, c, g, or t
  misc_feature (2508)..(2508): n is a, c, g, or t
  misc_feature (2511)..(2514): n is a, c, g, or t
  misc_feature (2516)..(2536): n is a, c, g, or t
  misc_feature (2538)..(2541): n is a, c, g, or t
  misc_feature (2543)..(2545): n is a, c, g, or t
  misc_feature (2547)..(2549): n is a, c, g, or t
  misc_feature (2551)..(2559): n is a, c, g, or t
  misc_feature (2561)..(2561): n is a, c, g, or t
  misc_feature (2563)..(2575): n is a, c, g, or t
  misc_feature (2577)..(2581): n is a, c, g, or t
  misc_feature (2584)..(2584): n is a, c, g, or t
  misc_feature (2587)..(2591): n is a, c, g, or t
  misc_feature (2594)..(2597): n is a, c, g, or t
  misc_feature (2599)..(2604): n is a, c, g, or t
  misc_feature (2606)..(2609): n is a, c, g, or t
  misc_feature (2611)..(2614): n is a, c, g, or t
  misc_feature (2616)..(2619): n is a, c, g, or t
  misc_feature (2621)..(2627): n is a, c, g, or t
  misc_feature (2629)..(2637): n is a, c, g, or t
  misc_feature (2640)..(2641): n is a, c, g, or t
  misc_feature (2643)..(2645): n is a, c, g, or t
  misc_feature (2648)..(2649): n is a, c, g, or t
  misc_feature (2651)..(2652): n is a, c, g, or t
  misc_feature (2654)..(2655): n is a, c, g, or t
  misc_feature (2658)..(2660): n is a, c, g, or t
  misc_feature (2662)..(2663): n is a, c, g, or t
  misc_feature (2667)..(2667): n is a, c, g, or t
  misc_feature (2669)..(2671): n is a, c, g, or t
  misc_feature (2673)..(2673): n is a, c, g, or t
  misc_feature (2675)..(2679): n is a, c, g, or t
  misc_feature (2681)..(2683): n is a, c, g, or t
  misc_feature (2685)..(2688): n is a, c, g, or t
  misc_feature (2690)..(2690): n is a, c, g, or t
  misc_feature (2693)..(2696): n is a, c, g, or t
  misc_feature (2700)..(2702): n is a, c, g, or t
  misc_feature (2704)..(2704): n is a, c, g, or t
  misc_feature (2706)..(2709): n is a, c, g, or t
  misc_feature (2711)..(2716): n is a, c, g, or t
  misc_feature (2718)..(2718): n is a, c, g, or t
  misc_feature (2720)..(2732): n is a, c, g, or t
  misc_feature (2734)..(2738): n is a, c, g, or t
  misc_feature (2741)..(2746): n is a, c, g, or t
  misc_feature (2748)..(2748): n is a, c, g, or t
  misc_feature (2753)..(2756): n is a, c, g, or t
  misc_feature (2758)..(2758): n is a, c, g, or t
  misc_feature (2763)..(2763): n is a, c, g, or t
  misc_feature (2766)..(2771): n is a, c, g, or t
cccacatatctgaccctgctaattcctcttcttcgccaactcttaaaccaatcgttagtttaaggatgtaccagataattagcgatgatacgaatacaaatccgaagattgctccagtaccaactaactgtccattaagcgtggctgaagtatttaagataggaactaacattaatcctaaaatacctgctacgccgtgaacagagattgctcctactggatcatcgataccccatttctctaatagagacatggatactggaacgatcaatccaccgatagcaccatataaggctgccatttcgggagaaggagtaaaaggatcagcagtaataactactagtcccgctaatgcaccatttaatgtaacatttaatatagtcttctttaaccaaagcttggagagcaccattgcacttaataaacctgcagcggccgcagtnttngtattaacgaagatttgagcaactgcgttagcgttgtcaatacctaagatacttaactgagaaccaccgttaaatccaaaccaacccatccaaagaataagagtacctagtgcaacctgagttgaactagaaccatggataggcgtaggattgccctccatgtcgtacttacccttacgtgggccaatgagtagtacagctgctaaagctgcggcagctcctgccatgtgtacgattcctgaacctgcaaagtcaaagaaccctacctccgataaccatcctccgccccaagaccacgagccttggattgggtaaatcactgcagtaaagactgcggcgaaaactaagaatgaccatagtttcttacgttcagcaacagcacccgatacaactgacattgcagttgctacgaatactacttgaaagaagaagtctgacattaatgcgtggtcttctggagcgttccatccaccgtacattaactcataccctacaaacaagaaggtgagcgatgcaacactgtaaagtgctacgttttttataaggatctctgttacgttcttcgaacgaactgatccagcttctaacattgtaaaacctgctgccatccacattactaaaactgcggataccaggaagtacaatgtatttaaggcatagcctaattccatattattttcctattgtgccggctacactgatacctaaaaacccgcaattaagcggggtatttcagttactctaatccgttacttccttccattcggggttcccctatatactccgtccttggaaaaccatttgcggtagaacttagacatcctcttttgatattcttcttttgtcatataagtattataccataaaagatagatttgtcaaccactaaaactcttaggtgcctaggtatagatactctgtggaatctaaatatatcatcttctcctttgtgctatactctactgactcaatattattgtacacttcatactttatacacatcttaatagcaaatacccctgcgttcttaatcctagtagcatacttcgacaagtccccttgccttgctccttccatattgcagcttatcttacttacatggagctgcatatccgtaactagtttatccatcttctcgtactctttatccgttaggtcgtcccatacagcatctataaaagactctgctagtatgttttgaatgtctccaagtctgctccacctctcattccaacgttcagttgctgaattagacatgtttctatacccggcatcttggttactcctcctaatccagtatataggattagtttttccttttacccctccgccaggaactgctccccatcttgacataatagttccttattgtagttatatgagtatattatacctgattttgaaaatttgtcaataataatttttttgaagttgtgaaaagttgtgggaaattggggtagtctatctctgggctgggtacgttgataccgttatatacgcctttacggttcttggtttatttctaattgtttacgtgcgggngngcccagaggaaacgccactatttcggtcnaatnancccccnnntnnnnnnggggggtggggtagcctacccccgattatttccacatggtgaagccatctgaaatccaatatgccatagcgaaagcaagaacaacacaacctaataaaactaaaactgggactgggataaaaaccattttcttttccttttcttatttaatatatacatattataccacgaaaaacacacgatgcaacactttattttatttaatttaatttcacaaataggcttgacttctaagattatatctgtataatggtattcagaggttaagcaaagggcgaaacccaaaacaatataaggaaatactaatatgaatactactgttaagaactacacgaaagaacaagnnncnnnannnnnnnnngannncnnantnnnnncnananncnnnacnntnnannnnnnnnnnnntgnnnnnggnnanngnnnnnannnnnnnatcnntnancnnnnaacnnnnaannnntangntannnntnnnnnnnnnnnnnnnnnnnnnannnngnnngnnngnnnnnnnnnantnnnnnnnnnnnnnannnnncanttnnnnnttnnnntnnnnnntnnnntnnnngnnnnannnnnnnannnnnnnnntanngnnnatnntnnannatnnngnntaangnnnancnnnnncnnntnnnncntannnnatannnantnnnncnnnnnngnannnnnnnnnnnnncnnnnnccnnnnnncnaatgnnnntnattcncannnnnnaagcgccaaaatctatattagaatattataatataatgatattctaatatgcgccgattataccagaaagcaacagcgatgtcaaatttatttcgaaaataaatctatattagaatattattatattataatatgaaaaaactaatttcaatttaattgcaattaatgcttgactcggtggcttaatctgatataatagactcatacaaagaaagaaaggaattaaccctttttattgtatcaaggaatgaaaatgaaaaaagactattacttaattattgatactgaaactactatgagcgacaaggtggcggattttggtgcggttgttattgacagacaaggcaacatacagacacaatgtggcgtacttgtaaatggcgtatttggtattgacccactattttatattgctaatgagaaagaaaaatctctttggtcaaagcaaggcaaagacagaagatttaccaaatacaatgaaatgctagaaaatggctcaagaatgttagcctctgtaaacgctattaatttatggttggctaaggttgcggggcaatatgacccaattcttacagcgtataatttaccttttgaccttgacaaatgcaataagacgggaattgatttaacaatgtttactaattctttttgtatgtggcgtgtagcatttaataaatatgctatgacaaaatcatataagaatttcgcaatgcaatgccatgcgattaatcccccgacaaaattcggtaattgctcatttcaaaccaatgcggaaattatgaccaaatttgtaactaataatcctgaattggttgatgagcctcataccgctttggaagatattgtatattatgaacttctaatattgaaaaatatgctcaagaatatgacaaaatcagaattgctggaaaatgaccttggatttgattggcgaaaggtgcaattaaaagaccacttcaaagcggtttaaaataacaacaaatgggaatgataatgattctcatttggggcgccgattttaccacataatgcgggataatgcaaggaaaatatcatttatttattttcatttatttatgcaaattaacttgatttatgcttgacaaatcccccaattatgatataatactaccatacaaagaaagaaattaatctttctcaaatataaggaaatactaatatgactactattacagataaaaaaccaacatttactttaaacaaaaaat

SEQ ID NO: 897 - DNA, 4000 bp, Escherichia coli
  misc_feature (845)..(845): n is a, c, g, or t
  misc_feature (854)..(854): n is a, c, g, or t
  misc_feature (875)..(875): n is a, c, g, or t
  misc_feature (887)..(887): n is a, c, g, or t
  misc_feature (901)..(902): n is a, c, g, or t
aaagaatttttataagtaagtgatttgatcatggaaagcaaacacaaactatccatcaaccagtgggcgctggaagaccgtccccgggagaagatgatggagaaaggagcagccgcattgagtgatgccgaactactcgccatattaatcggctccggaaatacggaagaaagtgctgtcgaactgatgaggcgtttgcttctctcttgtgataacaatctgaactccttggcaaagtgggaagtctgcgactattcccgttttaaaggaatgggaccggcaaagagcatcactgtaatggctgccctggaactcggcaagcgacggaaactgcaaaatatccaagaacgcccccgcatctcttgttcaagagatatttatgacatcttccagcctgtcatgtgcgaccttgaacaggaagaattctgggtattattattgaatcaggcgacgagactgatcgataaggtacgtatcagcaccggcggaatagacggaacgtatacggatgtacgtaccattcttcgggaagcattgctgcagagagccacgcaaatagccgtagtgcataaccatccttcgggaaatatccaacccagccaaccggaccggacgctgacggaacacatccgccgggcagccgacacaatgaacattcgcctgatagaccacgttattgtttgtgaggataagttttacagttttgccgacgaagggctgctctgaataaatttattcttatctttgcaatacatattaataaggaaagccctatggaaaaatttaaaatagaagaaaagatcgtagccatgctaaagacggtgtacgatcctgagattccggtnaatgtatangatcttggactgatttataanatagacgtctcngacaatggggaagnngcgcttgatatgactctgactgctcccaactgtccggcagccgatttcatcatggaagatatccgccagaaagtagaatcggtggaaggagtgacatctgccactatcaaccttgtgttcgaaccggaatgggataaagatatgatgagtgaggaagcaaaactggaactcggattcctgtaaattcatagctcaaaatataaaactgataactctaaactcaaaactcatgaagaacgtttatttcctttccgatgcgcatcttggttcccgtgccatagaacatggacgtacacaggaacggcgcttggtgaacttcctcgacagtatcaagcataaagcttctgccgtttacctgttgggagatatgttcgatttttggtatgaattccggttagtggttcccaaaggatacacccgctttttaggaaagctctccgaactcacggatatgggagtggaggtacatttctttaccggcaaccatgatatctggtgtggggattatctttctaaagaatgcggagtgattattcatcgtgaagcattgactaccgaaatatacggaaaagagttttatctggctcacggtgacggactgggtgacccggacaagaagtttaagttgctgcgctggatgtttcacagtacaacacttcagacactgttttctgccatccatccccgttggagtgtggaattgggcttgacgtgggcaaaacatagccgcgaaaagcgggtggacggcaaagaaccggattacatgggggagaataaggaacatctggtactttatacaaaagaatatctgaagagtcatcctaatatcaacttcttcatttatggccatcgtcacattgaactggatttaatgttgagtgctacttcccgtgtgctgattcttggagactggattaactatttctcctatgcggtattcgatggggagaatctatttttggaagagtatatagaaggagaaacacaagtttgattcttattccattaaaaagtggaaattccgattgatataaggtttcttgaagatagatagaaaccggaaaaagtcaagaccacgtcttcagatttattctattcttatgaaatgaatctgaagacgtggtcttgatgtatttagttgcccaacttgaatactacagaggcgtatcctcccagtttcaaggtgtaactgtcgctgtctgtattttgttgagcttcgccattcacaaacaatactttctcaatcttgtctgtcagcggaagtagcatggccgttccgccgaaattatggatgacaagcagtttctcgttgtccttggtcatataccaggcggcaatcggcttatagtctttctcctgtgattcgttgtagacggaatgtttggtcatatttccttctgccagtgccggataggtgttgcgcaatcgggtgagggagaaatatatgttcagaagtgaatgggtatcggcttgttggtccgctaccgttttcacatttttcgaaacggtggcatccgtcttgtctgtgtagttggtagtgtagctatctccccatagcatcgggctgcgcacatattcgtctccgttatcctttgttccgtaaagtcccagttcttcaccgtaatagatgtaaggatgtccggcggaagtgagtaagacggcggcggccagtttgcatttgtcggcggatttacccaacttggacgatgtacggtcttcgtcatggttactcagtttcgttgcttcgatgtaatcgcttcgatagttggcgtatttctgttggtaagaaaggatgtctttggcaaaataacatccggtactattattgattccccattccagacgataccagaaggaaaattcaaaaagggcgggcagacctttataataaggagctactttatcgtattccgataacacttcgcctaccatatagaagtcgtccgtatgtcctttttgtttgtaataggcgttcatatcttcatagaacattttcaggaaacgaggattttcttcgctggtctcactgtggtagatgtgcttcacggcgtcgaggcggaggccgtccacaccacgggcgatccatcctttggcggcgtctgctattgcctgatatgccggtgattcgcctgcctggtctacagggccgtagttaaggtcggcaaaccagtcggtgcagaaatgagaatggaaataggtgatctgctggctgtcgaacatgatgttggcagggttgccggcgttggtcagtttgaaatccttgttcagcgcgagtttctcggacgaggaagaggcgccgtattttgttccggatggccaggaagaagcattgctggtacggatcagaagcccccaagtggactcaaagtcgacggtgagttcatagatgttgtttcctttgtcataaaactttttacagatgtcttctccgtagtataagtatttggcgttgtcggtacctgtgtctggattatcctcgtctgctttggtgcctgtggaaacgacaaggatgggggaagatgcgttgctccagtccagtgtaaatttcagcagtcctttcacggcagcggtctcgtcagaaacctgaaaccattctgcggcattgtatccggctgctccttcttgggtgatcatggcgattttgcctgctgcgatatctgttttcgggtcttcagagaaagaataataattgcgatacgggctttcggatgatgaactagcttcggtgaaccacgggtgggcagtgccggtgtggttcattacgtagtccagataaatcttgatgcctcggttgtgggcttctgtaaccagacggtcgaagtcgctttctgtgccgagctgcggattgactttggtgtagtctgtgacgtcatatccgtgataagacatacaggggtggatgggagagagccagagggctttcacgcctagttggttgagatagtccagcttttgggtgacgccattcaggtctccatatccgtctccgtcgctgtcggcgaaggaatagaccagtaactggtaggagatatctgcccgtttggtctcgtcccatgtgtcgggagaggcggtaagtgcggtccattgcccttcgatgg

SEQ ID NO: 898 - DNA, 4000 bp, Escherichia coli
  misc_feature (235)..(235): n is a, c, g, or t
  misc_feature (463)..(463): n is a, c, g, or t
  misc_feature (1985)..(1985): n is a, c, g, or t
  misc_feature (2153)..(2153): n is a, c, g, or t
  misc_feature (2476)..(2477): n is a, c, g, or t
  misc_feature (2504)..(2504): n is a, c, g, or t
  misc_feature (2600)..(2600): n is a, c, g, or t
  misc_feature (2604)..(2604): n is a, c, g, or t
  misc_feature (2610)..(2610): n is a, c, g, or t
  misc_feature (2612)..(2612): n is a, c, g, or t
  misc_feature (2627)..(2627): n is a, c, g, or t
  misc_feature (2641)..(2641): n is a, c, g, or t
  misc_feature (2643)..(2643): n is a, c, g, or t
  misc_feature (2645)..(2646): n is a, c, g, or t
  misc_feature (2652)..(2658): n is a, c, g, or t
  misc_feature (2660)..(2665): n is a, c, g, or t
  misc_feature (2667)..(2667): n is a, c, g, or t
  misc_feature (2675)..(2675): n is a, c, g, or t
  misc_feature (2677)..(2679): n is a, c, g, or t
  misc_feature (2681)..(2681): n is a, c, g, or t
  misc_feature (2683)..(2685): n is a, c, g, or t
  misc_feature (2687)..(2687): n is a, c, g, or t
  misc_feature (2689)..(2689): n is a, c, g, or t
  misc_feature (2692)..(2692): n is a, c, g, or t
  misc_feature (2694)..(2694): n is a, c, g, or t
  misc_feature (2697)..(2698): n is a, c, g, or t
  misc_feature (2700)..(2709): n is a, c, g, or t
  misc_feature (2712)..(2718): n is a, c, g, or t
  misc_feature (2720)..(2720): n is a, c, g, or t
  misc_feature (2722)..(2724): n is a, c, g, or t
  misc_feature (2727)..(2729): n is a, c, g, or t
  misc_feature (2732)..(2737): n is a, c, g, or t
  misc_feature (2741)..(2742): n is a, c, g, or t
  misc_feature (2748)..(2750): n is a, c, g, or t
  misc_feature (2752)..(2752): n is a, c, g, or t
  misc_feature (2757)..(2760): n is a, c, g, or t
  misc_feature (2762)..(2762): n is a, c, g, or t
  misc_feature (2764)..(2764): n is a, c, g, or t
  misc_feature (2766)..(2766): n is a, c, g, or t
  misc_feature (2768)..(2769): n is a, c, g, or t
  misc_feature (2771)..(2775): n is a, c, g, or t
  misc_feature (2777)..(2781): n is a, c, g, or t
  misc_feature (2785)..(2786): n is a, c, g, or t
  misc_feature (2789)..(2789): n is a, c, g, or t
  misc_feature (2791)..(2794): n is a, c, g, or t
  misc_feature (2796)..(2796): n is a, c, g, or t
  misc_feature (2798)..(2799): n is a, c, g, or t
  misc_feature (2802)..(2805): n is a, c, g, or t
  misc_feature (2807)..(2809): n is a, c, g, or t
  misc_feature (2812)..(2818): n is a, c, g, or t
  misc_feature (2822)..(2830): n is a, c, g, or t
  misc_feature (2838)..(2842): n is a, c, g, or t
  misc_feature (2844)..(2844): n is a, c, g, or t
  misc_feature (2846)..(2849): n is a, c, g, or t
  misc_feature (2852)..(2861): n is a, c, g, or t
  misc_feature (2867)..(2874): n is a, c, g, or t
  misc_feature (2876)..(2877): n is a, c, g, or t
  misc_feature (2882)..(2888): n is a, c, g, or t
  misc_feature (2890)..(2891): n is a, c, g, or t
  misc_feature (2893)..(2893): n is a, c, g, or t
  misc_feature (2895)..(2896): n is a, c, g, or t
  misc_feature (2899)..(2900): n is a, c, g, or t
  misc_feature (2902)..(2905): n is a, c, g, or t
  misc_feature (2909)..(2916): n is a, c, g, or t
  misc_feature (2918)..(2921): n is a, c, g, or t
  misc_feature (2923)..(2925): n is a, c, g, or t
  misc_feature (2927)..(2934): n is a, c, g, or t
  misc_feature (2936)..(2938): n is a, c, g, or t
  misc_feature (2940)..(2940): n is a, c, g, or t
  misc_feature (2942)..(2948): n is a, c, g, or t
  misc_feature (2951)..(2952): n is a, c, g, or t
  misc_feature (2954)..(2954): n is a, c, g, or t
  misc_feature (2956)..(2957): n is a, c, g, or t
  misc_feature (2959)..(2960): n is a, c, g, or t
  misc_feature (2962)..(2962): n is a, c, g, or t
  misc_feature (2966)..(2966): n is a, c, g, or t
  misc_feature (2968)..(2973): n is a, c, g, or t
  misc_feature (2976)..(2979): n is a, c, g, or t
  misc_feature (2981)..(2982): n is a, c, g, or t
  misc_feature (2985)..(2985): n is a, c, g, or t
  misc_feature (2987)..(2991): n is a, c, g, or t
  misc_feature (2993)..(2993): n is a, c, g, or t
  misc_feature (2995)..(2995): n is a, c, g, or t
  misc_feature (2999)..(3001): n is a, c, g, or t
  misc_feature (3004)..(3004): n is a, c, g, or t
  misc_feature (3006)..(3010): n is a, c, g, or t
  misc_feature (3012)..(3012): n is a, c, g, or t
  misc_feature (3016)..(3019): n is a, c, g, or t
  misc_feature (3021)..(3024): n is a, c, g, or t
  misc_feature (3026)..(3027): n is a, c, g, or t
  misc_feature (3029)..(3040): n is a, c, g, or t
  misc_feature (3044)..(3045): n is a, c, g, or t
  misc_feature (3048)..(3049): n is a, c, g, or t
  misc_feature (3052)..(3054): n is a, c, g, or t
  misc_feature (3056)..(3058): n is a, c, g, or t
  misc_feature (3061)..(3065): n is a, c, g, or t
  misc_feature (3067)..(3068): n is a, c, g, or t
  misc_feature (3070)..(3072): n is a, c, g, or t
  misc_feature (3074)..(3074): n is a, c, g, or t
  misc_feature (3076)..(3076): n is a, c, g, or t
  misc_feature (3080)..(3086): n is a, c, g, or t
  misc_feature (3088)..(3090): n is a, c, g, or t
  misc_feature (3093)..(3096): n is a, c, g, or t
  misc_feature (3098)..(3100): n is a, c, g, or t
  misc_feature (3104)..(3106): n is a, c, g, or t
  misc_feature (3110)..(3119): n is a, c, g, or t
  misc_feature (3121)..(3122): n is a, c, g, or t
  misc_feature (3124)..(3127): n is a, c, g, or t
  misc_feature (3129)..(3129): n is a, c, g, or t
  misc_feature (3131)..(3133): n is a, c, g, or t
  misc_feature (3135)..(3137): n is a, c, g, or t
  misc_feature (3139)..(3141): n is a, c, g, or t
  misc_feature (3146)..(3151): n is a, c, g, or t
  misc_feature (3153)..(3155): n is a, c, g, or t
  misc_feature (3158)..(3165): n is a, c, g, or t
  misc_feature (3167)..(3169): n is a, c, g, or t
  misc_feature (3172)..(3172): n is a, c, g, or t
  misc_feature (3174)..(3174): n is a, c, g, or t
  misc_feature (3176)..(3176): n is a, c, g, or t
  misc_feature (3178)..(3179): n is a, c, g, or t
  misc_feature (3182)..(3182): n is a, c, g, or t
  misc_feature (3184)..(3184): n is a, c, g, or t
  misc_feature (3186)..(3195): n is a, c, g, or t
  misc_feature (3197)..(3199): n is a, c, g, or t
  misc_feature (3201)..(3202): n is a, c, g, or t
  misc_feature (3204)..(3207): n is a, c, g, or t
  misc_feature (3209)..(3210): n is a, c, g, or t
  misc_feature (3212)..(3212): n is a, c, g, or t
  misc_feature (3215)..(3218): n is a, c, g, or t
  misc_feature (3221)..(3222): n is a, c, g, or t
  misc_feature (3224)..(3224): n is a, c, g, or t
  misc_feature (3226)..(3226): n is a, c, g, or t
  misc_feature (3229)..(3230): n is a, c, g, or t
  misc_feature (3233)..(3239): n is a, c, g, or t
  misc_feature (3241)..(3242): n is a, c, g, or t
  misc_feature (3280)..(3280): n is a, c, g, or t
  misc_feature (3285)..(3285): n is a, c, g, or t
  misc_feature (3345)..(3345): n is a, c, g, or t
  misc_feature (3421)..(3421): n is a, c, g, or t
  misc_feature (3495)..(3495): n is a, c, g, or t
  misc_feature (3507)..(3507): n is a, c, g, or t
  misc_feature (3529)..(3532): n is a, c, g, or t
  misc_feature (3534)..(3534): n is a, c, g, or t
  misc_feature (3537)..(3549): n is a, c, g, or t
  misc_feature (3556)..(3559): n is a, c, g, or t
  misc_feature (3561)..(3564): n is a, c, g, or t
  misc_feature (3566)..(3566): n is a, c, g, or t
  misc_feature (3569)..(3569): n is a, c, g, or t
  misc_feature (3571)..(3572): n is a, c, g, or t
  misc_feature (3574)..(3574): n is a, c, g, or t
  misc_feature (3576)..(3577): n is a, c, g, or t
  misc_feature (3581)..(3585): n is a, c, g, or t
  misc_feature (3587)..(3592): n is a, c, g, or t
  misc_feature (3594)..(3596): n is a, c, g, or t
  misc_feature (3599)..(3603): n is a, c, g, or t
  misc_feature (3605)..(3609): n is a, c, g, or t
  misc_feature (3611)..(3612): n is a, c, g, or t
  misc_feature (3614)..(3617): n is a, c, g, or t
  misc_feature (3619)..(3620): n is a, c, g, or t
  misc_feature (3622)..(3622): n is a, c, g, or t
  misc_feature (3624)..(3630): n is a, c, g, or t
  misc_feature (3632)..(3632): n is a, c, g, or t
  misc_feature (3639)..(3640): n is a, c, g, or t
  misc_feature (3643)..(3644): n is a, c, g, or t
  misc_feature (3648)..(3648): n is a, c, g, or t
  misc_feature (3653)..(3654): n is a, c, g, or t
  misc_feature (3656)..(3658): n is a, c, g, or t
  misc_feature (3660)..(3664): n is a, c, g, or t
  misc_feature (3666)..(3667): n is a, c, g, or t
  misc_feature (3669)..(3683): n is a, c, g, or t
  misc_feature (3685)..(3686): n is a, c, g, or t
  misc_feature (3688)..(3689): n is a, c, g, or t
  misc_feature (3691)..(3691): n is a, c, g, or t
  misc_feature (3693)..(3693): n is a, c, g, or t
  misc_feature (3695)..(3695): n is a, c, g, or t
  misc_feature (3698)..(3700): n is a, c, g, or t
  misc_feature (3702)..(3703): n is a, c, g, or t
  misc_feature (3705)..(3705): n is a, c, g, or t
  misc_feature (3707)..(3712): n is a, c, g, or t
  misc_feature (3714)..(3714): n is a, c, g, or t
  misc_feature (3717)..(3720): n is a, c, g, or t
  misc_feature (3722)..(3723): n is a, c, g, or t
  misc_feature (3725)..(3726): n is a, c, g, or t
  misc_feature (3728)..(3729): n is a, c, g, or t
  misc_feature (3738)..(3740): n is a, c, g, or t
  misc_feature (3742)..(3745): n is a, c, g, or t
  misc_feature (3747)..(3753): n is a, c, g, or t
  misc_feature (3755)..(3761): n is a, c, g, or t
  misc_feature (3766)..(3766): n is a, c, g, or t
  misc_feature (3768)..(3768): n is a, c, g, or t
  misc_feature (3770)..(3771): n is a, c, g, or t
  misc_feature (3773)..(3775): n is a, c, g, or t
  misc_feature (3778)..(3780): n is a, c, g, or t
  misc_feature (3782)..(3782): n is a, c, g, or t
  misc_feature (3785)..(3787): n is a, c, g, or t
  misc_feature (3790)..(3790): n is a, c, g, or t
  misc_feature (3792)..(3796): n is a, c, g, or t
  misc_feature (3798)..(3798): n is a, c, g, or t
  misc_feature (3800)..(3800): n is a, c, g, or t
  misc_feature (3802)..(3806): n is a, c, g, or t
  misc_feature (3808)..(3809): n is a, c, g, or t
  misc_feature (3812)..(3813): n is a, c, g, or t
  misc_feature (3816)..(3818): n is a, c, g, or t
  misc_feature (3823)..(3825): n is a, c, g, or t
  misc_feature (3827)..(3827): n is a, c, g, or t
  misc_feature (3829)..(3832): n is a, c, g, or t
  misc_feature (3835)..(3851): n is a, c, g, or t
  misc_feature (3853)..(3859): n is a, c, g, or t
  misc_feature (3861)..(3866): n is a, c, g, or t
  misc_feature (3868)..(3869): n is a, c, g, or t
  misc_feature (3872)..(3873): n is a, c, g, or t
  misc_feature (3876)..(3886): n is a, c, g, or t
  misc_feature (3888)..(3888): n is a, c, g, or t
  misc_feature (3890)..(3894): n is a, c, g, or t
  misc_feature (3896)..(3896): n is a, c, g, or t
  misc_feature (3898)..(3898): n is a, c, g, or t
  misc_feature (3900)..(3900): n is a, c, g, or t
  misc_feature (3903)..(3909): n is a, c, g, or t
  misc_feature (3912)..(3914): n is a, c, g, or t
  misc_feature (3920)..(3923): n is a, c, g, or t
  misc_feature (3926)..(3926): n is a, c, g, or t
  misc_feature (3928)..(3929): n is a, c, g, or t
  misc_feature (3931)..(3931): n is a, c, g, or t
  misc_feature (3933)..(3942): n is a, c, g, or t
  misc_feature (3944)..(3944): n is a, c, g, or t
  misc_feature (3946)..(3947): n is a, c, g, or t
  misc_feature (3949)..(3949): n is a, c, g, or t
  misc_feature (3955)..(3956): n is a, c, g, or t
  misc_feature (3961)..(3964): n is a, c, g, or t
  misc_feature (3967)..(3982): n is a, c, g, or t
  misc_feature (3984)..(3985): n is a, c, g, or t
  misc_feature (3987)..(3998): n is a, c, g, or t
  misc_feature (4000)..(4000): n is a, c, g, or t
atcaactagaattgagcccgtgtattttgaactattttggtaggtatcattagcgattaagcgaatatttttataaatatcttttaagttacccgcaatcgtaatttcctcgaccggatgaacaatctttccattttcaacccaaaaacctgatgcaccgcgggaataatcaccagtaaccatattggtgccatgccctaaaatatcagtaacgagaagaccggttcccattttnatcaataaatctttaaaattaatattagaagatttaatgagtaaattatgtgctcctcctgcattgccagttgagaccaggttgagtttattcgccgtatacgttgataaaaaataaccattcaatatgccttgatcaacaactactcgctctttcacttttacaccatcatcatcaaaatacgtacttgcattacctctctttaaaaaaggattctcaatgatcgtnaattgcggagaagcaataactttgccaattgcgttgagcaaaaaagaattttggcgatacaagttgccgcctgatacagctgataccaaagtagctatcagtgatgttgcaattggtgcttcaaaaatgacagggtaacgtcccgtttttattttttttggatgtaatttactcacagcacgctgagcagtctctttccccagatctaaatgattttttaaatcagaaaaatttcttgccgtcgtgtagatactgtctcgttgcatttgctcatcgtcatttgcaatcactgagcaacttaatgttacccgcgaggatgggaagcctccgataaaatcatggctgtttgcataaataaaatttgcctcagaatttgaaaactgcacaccctctgaattctttatcttagcattaaactgtaaggcttcagcttcggtcgctaaagcatggtcaatcataaatctttcggtaagatcaaatggaaagtaaacttccaattcatgactctcattcgctaaaagttttttatcagcaagcccataacctttgtcttcttgcgtatatttagcaatttgacatgcggataaaacacaatcttcaatggcttttagactaaaatctgagcttgttaccaatcctcttttttttccaaaatagaccgacagcgtaagacttttatcattgttcacttcaattgtttccagttcagaaagtcttactgtaatgctctttccttgagcaatactgacttctacttcagcttccgttgctccattagcctgggctttttcaagcgcaaaagaagctaaatcgataaggttttgatttttctgtctcgttattttcaattgatgaaagtttaaattgtaaaactgatatgatacaggtgaattaaaaataaaaattgtctatgagtaacaatcagcaagaagaaataagcaagacccagctaaaaaaacaatccaaagatattaccagctttggccaagcgataacgctactcaatcaaaaccaattagagcagcttaatttacccagtgatatcaataatgccattgaagactacaaaaaaataaaatctttaagtgcaaaaaaaaggcaattactttttataggcaggttattaaggtcaacagatttgcatgaggcatttattcaatacgaagcgataaaaaaccattcacaacttgcaaatcagcagtttcatttagtcgagcaatggcgcgataaattaattcaatcccccgatgccattactgaatttattaatcaatttccaaaaactgacgtgcagcagttacgttcgctaataaagaactcaatcaatgaaattgaaaaaaataaaccattaaaatcatcacggagcttatttaaaattattcaatccattttaaataattaaatatccaccattactgttttttcttcacctgcgcgcaaaaatgaaacttttattttttttcctttgtttttttggataattttaataaactcactggggtcatttaccttctcatcgttnactgcagtaatactgtccttccgcataattccagccactgctgcaggcgagtctttaatgactgcaataatttgaatgccaggattttgttcatcagtattttgattggtaagtttaatgaagtgtgtaccaaaagtaggttttggtaatttcacccaatagcttgcntaaaattcgtacatggcattgggatcagccaaatctttttcatcgataatgatttcggtggtgttgccatctttatccaattgttgggttaaaatactttcacgcgctctttttattgcggtggcacgagtattttcattaagctgtctatcataaatcagtaccatatctgcctgaatggcttgaccatgagtcaaggccaactctggaggaagatttttactggtaaatccagtaaagcccattaaatcatatccatcctctagcatttttatgttatcagtttcttttgcccagccccgcataatttttgtatcaggcgnntctgcaaaagacttaaaacctttaggnctttgtgtttggtaatttttttcaaacagattttcttctgcgaaaattgatagtgaaaataaacaaaaaaacaaaaaactgagggcgcgaagatanttantcatgngnatgccttttaagaantgataatatagttnantnnttaaannnnnnntnnnnnngnaaaaaaantnnntnannntngnttnanttnnannnnnnnnnnggnnnnnnnangnnnttnnnaannnnnngggnntccctnnntnaaaannnngntngncnnannnnntnnnnncccnnttnannnngnannaannnntnnnccnnnnnnntttnnnnnnnnnaaaaaaannnnngntnnnnttnnnnnnnnnnaaaaannnnnnnntnnttttnnnnnnngnngnannggnncnnnnaaannnnnnnntnnnncnnnannnnnnnntnnnantnnnnnnnaannantnncnngntttngnnnnnnaannnngnnaantnnnnntnantttnnnccnannnnnantttnnnnannnnanntnnnnnnnnnnnnaaannaannttnnntnnnaannnnncnngnnnancnaaannnnnnnannnaannnntnnngggnnnaaannnnnnnnnnannannnnancnnngnnngnnnttttnnnnnnannnccnnnnnnnntnnnttnantngnnggncntnnnnnnnnnncnnngnngnnnntnntnaannnnttnngncnaannaannnnnnntnnagccgacatcatcaatcgattctttaagaaaaaaacgngtgcnccattaggtattggtgatgacgcagcattaatcaataaaaatacaaaagaatattgggcnctttctcaagatacactaaatgtaaatactcattttctcccctcaactcctgcacttgatttaggttggaaagcantggctgtgaatgtttcagatatttatgccatgggcggtcagccaaagtatgcgttagtatcgattgctatcaanaaacacaatatnccgtggcttgaagacttttcannnngnttnnnnnnnnnnnnnaaaaaannnngnnnngnaantnntngnngggnnnnnannnnnngnnnaannnnnannnnnannannnntnntngnnnnnnngnaaaaaannaanntttnaaaannannngnnnnnanntnnnnnnnnnnnnnnngnntnncngncnaannngnntngnnnnnntnggnnnngnntnncnnaaaaaaaannntnnnntnnnnnnngnnnnnnnaaaantngnnannnaannncnttnnnaancnnnnncnancnnnnntnnaannttnnnaaaannncnannnnttnnnnnnnnnnnnnnnnntnnnnnnngnnnnnntnncgnnttnnnnnnnnnnntnannnnntncnanttnnnnnnnaannntttttnnnnccnanntncnnnnnnnnnntngnntnaaaaannaaaannnnttnnnnnnnnnnnnnnnngnngnnnnnnnnnnnnan

SEQ ID NO: 899 - DNA, 4000 bp, Escherichia coli
  misc_feature (362)..(362): n is a, c, g, or t
  misc_feature (1992)..(1992): n is a, c, g, or t
  misc_feature (2015)..(2015): n is a, c, g, or t
  misc_feature (2260)..(2262): n is a, c, g, or t
  misc_feature (2264)..(2269): n is a, c, g, or t
  misc_feature (2271)..(2273): n is a, c, g, or t
  misc_feature (2278)..(2280): n is a, c, g, or t
  misc_feature (2282)..(2283): n is a, c, g, or t
  misc_feature (2285)..(2287): n is a, c, g, or t
  misc_feature (2290)..(2290): n is a, c, g, or t
  misc_feature (2292)..(2292): n is a, c, g, or t
  misc_feature (2294)..(2297): n is a, c, g, or t
  misc_feature (2299)..(2300): n is a, c, g, or t
  misc_feature (2304)..(2305): n is a, c, g, or t
  misc_feature (2307)..(2308): n is a, c, g, or t
  misc_feature (2310)..(2310): n is a, c, g, or t
  misc_feature (2316)..(2318): n is a, c, g, or t
  misc_feature (2321)..(2328): n is a, c, g, or t
  misc_feature (2330)..(2331): n is a, c, g, or t
  misc_feature (2334)..(2334): n is a, c, g, or t
  misc_feature (2337)..(2337): n is a, c, g, or t
  misc_feature (2340)..(2340): n is a, c, g, or t
  misc_feature (2343)..(2343): n is a, c, g, or t
  misc_feature (2346)..(2346): n is a, c, g, or t
  misc_feature (2349)..(2349): n is a, c, g, or t
  misc_feature (2352)..(2353): n is a, c, g, or t
  misc_feature (2355)..(2357): n is a, c, g, or t
  misc_feature (2359)..(2360): n is a, c, g, or t
  misc_feature (2363)..(2363): n is a, c, g, or t
  misc_feature (2367)..(2368): n is a, c, g, or t
  misc_feature (2370)..(2370): n is a, c, g, or t
  misc_feature (2373)..(2373): n is a, c, g, or t
  misc_feature (2376)..(2376): n is a, c, g, or t
  misc_feature (2378)..(2382): n is a, c, g, or t
  misc_feature (2384)..(2384): n is a, c, g, or t
  misc_feature (2392)..(2392): n is a, c, g, or t
  misc_feature (2394)..(2394): n is a, c, g, or t
  misc_feature (2397)..(2397): n is a, c, g, or t
  misc_feature (2400)..(2401): n is a, c, g, or t
  misc_feature (2405)..(2407): n is a, c, g, or t
  misc_feature (2409)..(2409): n is a, c, g, or t
  misc_feature (2413)..(2413): n is a, c, g, or t
  misc_feature (2415)..(2415): n is a, c, g, or t
  misc_feature (2418)..(2421): n is a, c, g, or t
  misc_feature (2423)..(2423): n is a, c, g, or t
  misc_feature (2426)..(2426): n is a, c, g, or t
  misc_feature (2434)..(2434): n is a, c, g, or t
  misc_feature (2436)..(2436): n is a, c, g, or t
  misc_feature (2438)..(2440): n is a, c, g, or t
  misc_feature (2445)..(2446): n is a, c, g, or t
  misc_feature (2448)..(2450): n is a, c, g, or t
  misc_feature (2452)..(2452): n is a, c, g, or t
  misc_feature (2454)..(2454): n is a, c, g, or t
  misc_feature (2460)..(2460): n is a, c, g, or t
  misc_feature (2462)..(2462): n is a, c, g, or t
  misc_feature (2465)..(2466): n is a, c, g, or t
  misc_feature (2468)..(2469): n is a, c, g, or t
  misc_feature (2475)..(2479): n is a, c, g, or t
  misc_feature (2483)..(2484): n is a, c, g, or t
  misc_feature (2488)..(2488): n is a, c, g, or t
  misc_feature (2491)..(2491): n is a, c, g, or t
  misc_feature (2497)..(2499): n is a, c, g, or t
  misc_feature (2503)..(2504): n is a, c, g, or t
  misc_feature (2514)..(2518): n is a, c, g, or t
  misc_feature (2532)..(2532): n is a, c, g, or t
  misc_feature (2534)..(2534): n is a, c, g, or t
  misc_feature (2544)..(2544): n is a, c, g, or t
  misc_feature (2546)..(2547): n is a, c, g, or t
  misc_feature (2553)..(2554): n is a, c, g, or t
  misc_feature (2557)..(2565): n is a, c, g, or t
  misc_feature (2567)..(2570): n is a, c, g, or t
  misc_feature (2574)..(2574): n is a, c, g, or t
  misc_feature (2578)..(2579): n is a, c, g, or t
  misc_feature (2583)..(2584): n is a, c, g, or t
  misc_feature (2589)..(2590): n is a, c, g, or t
  misc_feature (2595)..(2595): n is a, c, g, or t
  misc_feature (2597)..(2602): n is a, c, g, or t
  misc_feature (2604)..(2608): n is a, c, g, or t
  misc_feature (2612)..(2612): n is a, c, g, or t
  misc_feature (2614)..(2616): n is a, c, g, or t
  misc_feature (2618)..(2621): n is a, c, g, or t
  misc_feature (2625)..(2627): n is a, c, g, or t
  misc_feature (2629)..(2631): n is a, c, g, or t
  misc_feature (2634)..(2635): n is a, c, g, or t
  misc_feature (2637)..(2642): n is a, c, g, or t
  misc_feature (2644)..(2646): n is a, c, g, or t
  misc_feature (2649)..(2650): n is a, c, g, or t
  misc_feature (2655)..(2656): n is a, c, g, or t
  misc_feature (2659)..(2661): n is a, c, g, or t
  misc_feature (2663)..(2663): n is a, c, g, or t
  misc_feature (2667)..(2668): n is a, c, g, or t
  misc_feature (2671)..(2671): n is a, c, g, or t
  misc_feature (2674)..(2674): n is a, c, g, or t
  misc_feature (2677)..(2678): n is a, c, g, or t
  misc_feature (2680)..(2681): n is a, c, g, or t
  misc_feature (2686)..(2689): n is a, c, g, or t
  misc_feature (2694)..(2698): n is a, c, g, or t
  misc_feature (2700)..(2700): n is a, c, g, or t
  misc_feature (2703)..(2705): n is a, c, g, or t
  misc_feature (2709)..(2709): n is a, c, g, or t
  misc_feature (2711)..(2711): n is a, c, g, or t
  misc_feature (2714)..(2714): n is a, c, g, or t
  misc_feature (2718)..(2720): n is a, c, g, or t
  misc_feature (2723)..(2723): n is a, c, g, or t
  misc_feature (2727)..(2727): n is a, c, g, or t
  misc_feature (2734)..(2737): n is a, c, g, or t
  misc_feature (2739)..(2740): n is a, c, g, or t
  misc_feature (2745)..(2745): n is a, c, g, or t
  misc_feature (2747)..(2747): n is a, c, g, or t
  misc_feature (2749)..(2750): n is a, c, g, or t
  misc_feature (2755)..(2759): n is a, c, g, or t
  misc_feature (2761)..(2761): n is a, c, g, or t
  misc_feature (2763)..(2766): n is a, c, g, or t
  misc_feature (2770)..(2770): n is a, c, g, or t
  misc_feature (2772)..(2772): n is a, c, g, or t
  misc_feature (2774)..(2775): n is a, c, g, or t
  misc_feature (2778)..(2781): n is a, c, g, or t
  misc_feature (2783)..(2783): n is a, c, g, or t
  misc_feature (2785)..(2786): n is a, c, g, or t
  misc_feature (2788)..(2789): n is a, c, g, or t
  misc_feature (2792)..(2792): n is a, c, g, or t
  misc_feature (2797)..(2798): n is a, c, g, or t
  misc_feature (2800)..(2801): n is a, c, g, or t
  misc_feature (2805)..(2805): n is a, c, g, or t
  misc_feature (2807)..(2810): n is a, c, g, or t
  misc_feature (2813)..(2813): n is a, c, g, or t
  misc_feature (2816)..(2818): n is a, c, g, or t
  misc_feature (2821)..(2824): n is a, c, g, or t
  misc_feature (2826)..(2832): n is a, c, g, or t
  misc_feature (2834)..(2835): n is a, c, g, or t
  misc_feature (2837)..(2837): n is a, c, g, or t
  misc_feature (2842)..(2842): n is a, c, g, or t
  misc_feature (2846)..(2847): n is a, c, g, or t
  misc_feature (2849)..(2849): n is a, c, g, or t
  misc_feature (2851)..(2854): n is a, c, g, or t
  misc_feature (2856)..(2856): n is a, c, g, or t
  misc_feature (2858)..(2862): n is a, c, g, or t
  misc_feature (2867)..(2867): n is a, c, g, or t
  misc_feature (2871)..(2872): n is a, c, g, or t
  misc_feature (2875)..(2875): n is a, c, g, or t
  misc_feature (2877)..(2878): n is a, c, g, or t
  misc_feature (2881)..(2881): n is a, c, g, or t
  misc_feature (2883)..(2886): n is a, c, g, or t
  misc_feature (2891)..(2891): n is a, c, g, or t
  misc_feature (2893)..(2893): n is a, c, g, or t
  misc_feature (2898)..(2898): n is a, c, g, or t
  misc_feature (2902)..(2905): n is a, c, g, or t
  misc_feature (2907)..(2908): n is a, c, g, or t
  misc_feature (2912)..(2912): n is a, c, g, or t
  misc_feature (2914)..(2918): n is a, c, g, or t
  misc_feature (2921)..(2924): n is a, c, g, or t
  misc_feature (2926)..(2926): n is a, c, g, or t
  misc_feature (2931)..(2931): n is a, c, g, or t
  misc_feature (2934)..(2936): n is a, c, g, or t
  misc_feature (2939)..(2939): n is a, c, g, or t
  misc_feature (2944)..(2944): n is a, c, g, or t
  misc_feature (2946)..(2946): n is a, c, g, or t
  misc_feature (2948)..(2949): n is a, c, g, or t
  misc_feature (2951)..(2954): n is a, c, g, or t
  misc_feature (2957)..(2957): n is a, c, g, or t
  misc_feature (2959)..(2960): n is a, c, g, or t
  misc_feature (2962)..(2963): n is a, c, g, or t
  misc_feature (2965)..(2967): n is a, c, g, or t
  misc_feature (2969)..(2975): n is a, c, g, or t
  misc_feature (2978)..(2979): n is a, c, g, or t
  misc_feature (2981)..(2981): n is a, c, g, or t
  misc_feature (2983)..(2983): n is a, c, g, or t
  misc_feature (2985)..(2985): n is a, c, g, or t
  misc_feature (2988)..(2988): n is a, c, g, or t
  misc_feature (2990)..(2990): n is a, c, g, or t
  misc_feature (2992)..(2992): n is a, c, g, or t
  misc_feature (2994)..(2996): n is a, c, g, or t
  misc_feature (2998)..(3000): n is a, c, g, or t
  misc_feature (3002)..(3004): n is a, c, g, or t
  misc_feature (3009)..(3010): n is a, c, g, or t
  misc_feature (3012)..(3015): n is a, c, g, or t
  misc_feature (3017)..(3017): n is a, c, g, or t
  misc_feature (3020)..(3022): n is a, c, g, or t
  misc_feature (3025)..(3028): n is a, c, g, or t
  misc_feature (3030)..(3030): n is a, c, g, or t
  misc_feature (3033)..(3033): n is a, c, g, or t
  misc_feature (3035)..(3036): n is a, c, g, or t
  misc_feature (3038)..(3038): n is a, c, g, or t
  misc_feature (3041)..(3041): n is a, c, g, or t
  misc_feature (3043)..(3044): n is a, c, g, or t
  misc_feature (3046)..(3048): n is a, c, g, or t
  misc_feature (3051)..(3051): n is a, c, g, or t
  misc_feature (3062)..(3062): n is a, c, g, or t
  misc_feature (3064)..(3068): n is a, c, g, or t
  misc_feature (3070)..(3075): n is a, c, g, or t
  misc_feature (3078)..(3079): n is a, c, g, or t
  misc_feature (3081)..(3081): n is a, c, g, or t
  misc_feature (3083)..(3084): n is a, c, g, or t
  misc_feature (3086)..(3087): n is a, c, g, or t
  misc_feature (3093)..(3095): n is a, c, g, or t
  misc_feature (3098)..(3102): n is a, c, g, or t
  misc_feature (3106)..(3106): n is a, c, g, or t
  misc_feature (3109)..(3109): n is a, c, g, or t
  misc_feature (3111)..(3111): n is a, c, g, or t
  misc_feature (3114)..(3114): n is a, c, g, or t
  misc_feature (3121)..(3121): n is a, c, g, or t
  misc_feature (3123)..(3124): n is a, c, g, or t
  misc_feature (3126)..(3129): n is a, c, g, or t
  misc_feature (3131)..(3131): n is a, c, g, or t
  misc_feature (3133)..(3133): n is a, c, g, or t
  misc_feature (3137)..(3138): n is a, c, g, or t
  misc_feature (3142)..(3142): n is a, c, g, or t
  misc_feature (3145)..(3148): n is a, c, g, or t
  misc_feature (3152)..(3153): n is a, c, g, or t
  misc_feature (3155)..(3158): n is a, c, g, or t
  misc_feature (3160)..(3161): n is a, c, g, or t
  misc_feature (3163)..(3164): n is a, c, g, or t
  misc_feature (3167)..(3167): n is a, c, g, or t
  misc_feature (3171)..(3173): n is a, c, g, or t
  misc_feature (3181)..(3182): n is a, c, g, or t
  misc_feature (3184)..(3184): n is a, c, g, or t
  misc_feature (3189)..(3189): n is a, c, g, or t
  misc_feature (3193)..(3193): n is a, c, g, or t
  misc_feature (3196)..(3196): n is a, c, g, or t
  misc_feature (3199)..(3199): n is a, c, g, or t
  misc_feature (3201)..(3201): n is a, c, g, or t
  misc_feature (3203)..(3203): n is a, c, g, or t
  misc_feature (3206)..(3207): n is a, c, g, or t
  misc_feature (3209)..(3209): n is a, c, g, or t
  misc_feature (3213)..(3213): n is a, c, g, or t
  misc_feature (3215)..(3215): n is a, c, g, or t
  misc_feature (3217)..(3218): n is a, c, g, or t
  misc_feature (3220)..(3220): n is a, c, g, or t
  misc_feature (3226)..(3227): n is a, c, g, or t
  misc_feature (3229)..(3229): n is a, c, g, or t
  misc_feature (3231)..(3234): n is a, c, g, or t
  misc_feature (3237)..(3241): n is a, c, g, or t
  misc_feature (3243)..(3243): n is a, c, g, or t
  misc_feature (3247)..(3248): n is a, c, g, or t
  misc_feature (3251)..(3252): n is a, c, g, or t
  misc_feature (3254)..(3254): n is a, c, g, or t
  misc_feature (3258)..(3259): n is a, c, g, or t
  misc_feature (3261)..(3261): n is a, c, g, or t
  misc_feature (3272)..(3272): n is a, c, g, or t
  misc_feature (3275)..(3277): n is a, c, g, or t
  misc_feature (3279)..(3279): n is a, c, g, or t
  misc_feature (3282)..(3283): n is a, c, g, or t
  misc_feature (3286)..(3286): n is a, c, g, or t
  misc_feature (3290)..(3292): n is a, c, g, or t
  misc_feature (3294)..(3295): n is a, c, g, or t
  misc_feature (3297)..(3298): n is a, c, g, or t
  misc_feature (3301)..(3301): n is a, c, g, or t
  misc_feature (3303)..(3306): n is a, c, g, or t
  misc_feature (3309)..(3309): n is a, c, g, or t
  misc_feature (3311)..(3313): n is a, c, g, or t
  misc_feature (3315)..(3318): n is a, c, g, or t
  misc_feature (3321)..(3321): n is a, c, g, or t
  misc_feature (3324)..(3325): n is a, c, g, or t
  misc_feature (3335)..(3337): n is a, c, g, or t
  misc_feature (3341)..(3341): n is a, c, g, or t
  misc_feature (3343)..(3345): n is a, c, g, or t
  misc_feature (3347)..(3348): n is a, c, g, or t
  misc_feature (3352)..(3361): n is a, c, g, or t
  misc_feature (3363)..(3366): n is a, c, g, or t
  misc_feature (3370)..(3370): n is a, c, g, or t
  misc_feature (3372)..(3379): n is a, c, g, or t
  misc_feature (3382)..(3383): n is a, c, g, or t
  misc_feature (3385)..(3385): n is a, c, g, or t
  misc_feature (3389)..(3389): n is a, c, g, or t
  misc_feature (3392)..(3393): n is a, c, g, or t
  misc_feature (3396)..(3396): n is a, c, g, or t
  misc_feature (3400)..(3402): n is a, c, g, or t
  misc_feature (3405)..(3405): n is a, c, g, or t
  misc_feature (3408)..(3408): n is a, c, g, or t
  misc_feature (3410)..(3410): n is a, c, g, or t
  misc_feature (3412)..(3412): n is a, c, g, or t
  misc_feature (3414)..(3415): n is a, c, g, or t
  misc_feature (3420)..(3421): n is a, c, g, or t
  misc_feature (3425)..(3425): n is a, c, g, or t
  misc_feature (3431)..(3431): n is a, c, g, or t
  misc_feature (3433)..(3433): n is a, c, g, or t
  misc_feature (3438)..(3438): n is a, c, g, or t
  misc_feature (3442)..(3444): n is a, c, g, or t
  misc_feature (3449)..(3450): n is a, c, g, or t
  misc_feature (3452)..(3453): n is a, c, g, or t
  misc_feature (3457)..(3457): n is a, c, g, or t
  misc_feature (3459)..(3461): n is a, c, g, or t
  misc_feature (3479)..(3479): n is a, c, g, or t
  misc_feature (3481)..(3482): n is a, c, g, or t
  misc_feature (3484)..(3486): n is a, c, g, or t
  misc_feature (3494)..(3494): n is a, c, g, or t
  misc_feature (3502)..(3502): n is a, c, g, or t
  misc_feature (3504)..(3504): n is a, c, g, or t
  misc_feature (3507)..(3507): n is a, c, g, or t
  misc_feature (3510)..(3510): n is a, c, g, or t
  misc_feature (3514)..(3514): n is a, c, g, or t
  misc_feature (3516)..(3517): n is a, c, g, or t
  misc_feature (3520)..(3520): n is a, c, g, or t
  misc_feature (3522)..(3524): n is a, c, g, or t
  misc_feature (3526)..(3526): n is a, c, g, or t
  misc_feature (3529)..(3529): n is a, c, g, or t
  misc_feature (3535)..(3535): n is a, c, g, or t
  misc_feature (3538)..(3538): n is a, c, g, or t
  misc_feature (3541)..(3542): n is a, c, g, or t
  misc_feature (3544)..(3547): n is a, c, g, or t
  misc_feature (3549)..(3549): n is a, c, g, or t
  misc_feature (3552)..(3552): n is a, c, g, or t
  misc_feature (3554)..(3558): n is a, c, g, or t
  misc_feature (3561)..(3562): n is a, c, g, or t
  misc_feature (3573)..(3573): n is a, c, g, or t
  misc_feature (3577)..(3577): n is a, c, g, or t
  misc_feature (3579)..(3580): n is a, c, g, or t
  misc_feature (3583)..(3583): n is a, c, g, or t
  misc_feature (3587)..(3588): n is a, c, g, or t
  misc_feature (3593)..(3593): n is a, c, g, or t
  misc_feature (3596)..(3597): n is a, c, g, or t
  misc_feature (3600)..(3602): n is a, c, g, or t
  misc_feature (3607)..(3607): n is a, c, g, or t
  misc_feature (3609)..(3609): n is a, c, g, or t
  misc_feature (3611)..(3612): n is a, c, g, or t
  misc_feature (3615)..(3615): n is a, c, g, or t
  misc_feature (3621)..(3621): n is a, c, g, or t
  misc_feature (3623)..(3624): n is a, c, g, or t
  misc_feature (3626)..(3627): n is a, c, g, or t
  misc_feature (3629)..(3630): n is a, c, g, or t
  misc_feature (3634)..(3635): n is a, c, g, or t
  misc_feature (3638)..(3638): n is a, c, g, or t
  misc_feature (3642)..(3642): n is a, c, g, or t
  misc_feature (3644)..(3644): n is a, c, g, or t
  misc_feature (3647)..(3647): n is a, c, g, or t
  misc_feature (3649)..(3652): n is a, c, g, or t
  misc_feature (3654)..(3654): n is a, c, g, or t
  misc_feature (3667)..(3667): n is a, c, g, or t
  misc_feature (3670)..(3670): n is a, c, g, or t
  misc_feature (3674)..(3674): n is a, c, g, or t
  misc_feature (3678)..(3679): n is a, c, g, or t
  misc_feature (3681)..(3683): n is a, c, g, or t
  misc_feature (3685)..(3685): n is a, c, g, or t
  misc_feature (3688)..(3689): n is a, c, g, or t
  misc_feature (3691)..(3691): n is a, c, g, or t
  misc_feature (3693)..(3693): n is a, c, g, or t
  misc_feature (3698)..(3698): n is a, c, g, or t
  misc_feature (3703)..(3709): n is a, c, g, or t
  misc_feature (3713)..(3716): n is a, c, g, or t
  misc_feature (3718)..(3718): n is a, c, g, or t
  misc_feature (3720)..(3721): n is a, c, g, or t
  misc_feature (3724)..(3725): n is a, c, g, or t
  misc_feature (3729)..(3729): n is a, c, g, or t
  misc_feature (3731)..(3731): n is a, c, g, or t
  misc_feature (3733)..(3733): n is a, c, g, or t
  misc_feature (3738)..(3738): n is a, c, g, or t
  misc_feature (3740)..(3740): n is a, c, g, or t
  misc_feature (3745)..(3745): n is a, c, g, or t
  misc_feature (3747)..(3747): n is a, c, g, or t
  misc_feature (3751)..(3751): n is a, c, g, or t
  misc_feature (3754)..(3754): n is a, c, g, or t
  misc_feature (3756)..(3757): n is a, c, g, or t
  misc_feature (3759)..(3762): n is a, c, g, or t
  misc_feature (3767)..(3772): n is a, c, g, or t
  misc_feature (3774)..(3774): n is a, c, g, or t
  misc_feature (3777)..(3777): n is a, c, g, or t
  misc_feature (3779)..(3780): n is a, c, g, or t
  misc_feature (3782)..(3783): n is a, c, g, or t
  misc_feature (3786)..(3786): n is a, c, g, or t
  misc_feature (3792)..(3792): n is a, c, g, or t
  misc_feature (3794)..(3796): n is a, c, g, or t
  misc_feature (3802)..(3802): n is a, c, g, or t
  misc_feature (3804)..(3804): n is a, c, g, or t
  misc_feature (3806)..(3807): n is a, c, g, or t
  misc_feature (3809)..(3809): n is a, c, g, or t
  misc_feature (3812)..(3812): n is a, c, g, or t
  misc_feature (3822)..(3822): n is a, c, g, or t
  misc_feature (3825)..(3826): n is a, c, g, or t
  misc_feature (3828)..(3830): n is a, c, g, or t
  misc_feature (3834)..(3834): n is a, c, g, or t
  misc_feature (3836)..(3836): n is a, c, g, or t
  misc_feature (3844)..(3844): n is a, c, g, or t
  misc_feature (3847)..(3847): n is a, c, g, or t
  misc_feature (3849)..(3849): n is a, c, g, or t
  misc_feature (3851)..(3853): n is a, c, g, or t
  misc_feature (3859)..(3860): n is a, c, g, or t
  misc_feature (3863)..(3863): n is a, c, g, or t
  misc_feature (3865)..(3865): n is a, c, g, or t
  misc_feature (3867)..(3870): n is a, c, g, or t
  misc_feature (3872)..(3872): n is a, c, g, or t
  misc_feature (3874)..(3876): n is a, c, g, or t
  misc_feature (3878)..(3878): n is a, c, g, or t
  misc_feature (3882)..(3882): n is a, c, g, or t
  misc_feature (3884)..(3884): n is a, c, g, or t
  misc_feature (3886)..(3886): n is a, c, g, or t
  misc_feature (3891)..(3894): n is a, c, g, or t
  misc_feature (3901)..(3901): n is a, c, g, or t
  misc_feature (3909)..(3916): n is a, c, g, or t
  misc_feature (3919)..(3920): n is a, c, g, or t
  misc_feature (3924)..(3925): n is a, c, g, or t
  misc_feature (3927)..(3928): n is a, c, g, or t
  misc_feature (3931)..(3932): n is a, c, g, or t
  misc_feature (3934)..(3934): n is a, c, g, or t
  misc_feature (3942)..(3942): n is a, c, g, or t
  misc_feature (3944)..(3944): n is a, c, g, or t
  misc_feature (3946)..(3947): n is a, c, g, or t
  misc_feature (3949)..(3949): n is a, c, g, or t
  misc_feature (3951)..(3951): n is a, c, g, or t
  misc_feature (3954)..(3954): n is a, c, g, or t
  misc_feature (3956)..(3957): n is a, c, g, or t
  misc_feature (3964)..(3964): n is a, c, g, or t
  misc_feature (3966)..(3966): n is a, c, g, or t
  misc_feature (3970)..(3970): n is a, c, g, or t
  misc_feature (3976)..(3976): n is a, c, g, or t
  misc_feature (3978)..(3981): n is a, c, g, or t
  misc_feature (3984)..(3984): n is a, c, g, or t
  misc_feature (3989)..(3992): n is a, c, g, or t
  misc_feature (3995)..(3995): n is a, c, g, or t
  misc_feature (3998)..(3998): n is a, c, g, or t
aaattacgccgttctgtattctttcaagcgcgcgcgtgtgagcatcgctgaccatcacacgtgcgccgaatcctttgcgcagtggtacgcggatgagatgaaagatcgcggctacgcgcctggaaattggaagtggatcgtaccccccaccgcggcttcgacgtcttcgatttatctcggcttgaacaagatgacggagtatacgctgaaaccggcgctcgtcggcggtatgagtctgaatcaactcgtgattcgcgcgcggcgcgccaacttcttcaccgcttctgggctgtctcaagcggcgatgcacgtcgccgtcgcggcggcgaagtggcgcaagcgcatggtgcgagtaaagggancgcttattctgtacgcttcggacggaggccgcacgcaagcacgcgcgtcatggctgtggttgttcttgaggcaaagatttccgatgattcggccaatcaacgtcgcgaatcctgacctgcgaagtgacgaccttttgaaagcgctcgagcgcgttgaattcgtaatcgtgctcgcgtcgaccacggggtcgggggcagttccgacggggtcggaaaggttcatcgagtggtgccgtagtgacggagcgcgcgaggcgttgaaagacaaaaatttcgcgttgtgcgcgttcggctcgcgcgcctatccaaagttttgcggcggtggcaagcagttcgcgatggcactccgcgaagccgacgcgaaagagatgtttcctatggtttgcgccgatcagctcgagggtgaagacgccagcgtgcacgagttcacgaagagtctgttcaattggttccacaaacacgagcgcattaccgcgtcgctgcgcgatcttttgaccaatcagcttgtaagcggggcgcggcttcaaccgtcgtttgtcttgaacgtgcgtcgccgtgacgtgcacggacgagaccacacggctgaccatcgagcaggcgtgccggcgacgttaaccgatcgagtcgtgctcggcgacggtagtagattgaacactgtcgccgtgacactcaccttaccgcgcgggcatcgagacaccgagttttacaaacccggcgatcatgtttcagtgtaccctcgaacgagcgaagcgcgcgcgcgctatttcgtcgcgcactttggcatcgactttgacgatcaaatcgaactagttcctctggacgaatcagaaatctttgagaattcactcgactcgagcattccgaacccagtcggtgccggttatcttttcactacggtgctggatatcaacaaagagccatcggcggagttgctgcaagccctcgcgcattacgtcgacgacgaaacgtgcaaagcacaaatggaaaacttggcgctcgatgaagacgcgcggcgagagtggatttcgcagactggcgcgcggatatctacactcttcgatcaatttccgacgttgagcgcgacgcatcgccgtgacaaggcggtgggcatcgaaatgctgcgagacattcttctcaagataccaaaacttcgcgcgcgttattactccgtctcgagctcgccgcgcgccgtcggaaataacgtgttttctttaaccgtcggacgtgtgacgtacaggaatggcgacggcgtgaattcgcacatgcatctcggcttctgttctgatttcttggcgacgttgcccttgcgcacaaacgtcatggtcgagatgctcccggcgccggcgtttcgattgccgcggtctccgaaggtgccgattctgatgatcgctggcgggactgggatagcgccctttaaggggttcgtcgatcatcgcgcgtgcatggcgcctgaacaaaggagcgacgcatggcttattgtgggatgtcgaacgcgaggaaatcagttgtatcgcgacgagatggaaatcgccgccgaaaatggcgcgttgacagcgtacctcgtcgggtattctcgcgagccagacttgccgaaaatgtacgtcgacgccgtgatgcgcgagaacggcgncgggattcgcgatttgattaaangaggcggacacgtgtacgtatgcggggacgtgcgaatcgagacgtccgtgcgtggcgcgctcgatgacatactcggtcgagccgaagtggagtcgctcgaaaaatcgggtagataccatcttgatatattcggcgccttcgacgtgcagacgtcgctgaatcaacaactcaaatcggcgcgaaggtcgctttcgtgtagaaagaaatgagttgtaaagttgataggagatccaatcggcgcgtgnnnannnnnncnnngtgannncnntnnntcntncnnnncnncatnncnncntttgtnnnacnnnnnnnngnngcngtnaanatntangcncgnntnnngnngtntgtnncncgncgngnnnnncngcggcgtngntgncgnngaannngngctngncgnnnngntcntcgactgngnannngcccnngnnnancnctgcgngngcnncnngctggnnnnncggnncccngtnatcgtnnngtgnntacaccgcgnnnnngcgcccgttatccncncctcggcgancnngcgcgnnctnnnnnnnnngnnnngtcnattnngcgnnctcgnnccgcncnnnnnntnnnnnattnannngnnnntgcnnncnnngcnntnnnnnngnnntgnncgcgnnggnnntntccnnggnttntgnnanngtatnnnncaacnnnnncnatnnnacgncnggngcgnnnaancgtnacgcgtnnnnanntcgtncnanngcgtnnnnnangnnnnatantngnntcnnnnancnnannctngattnnanngtgntnnnngtnttnnngtnnnnannnnnnntnnancccancacnncncnnnncntnnnnnatccnagcnnagncnncgngnnnngcgcnangtganctcnnnnanngtgncnnnnnacnnnnangggcnctnnnccntcgtngncnnannnncgntnnanntnnncnnnnnnntgnntntntngcncntncnnngnnnannnctcgnnannnncncgnnnttnnnncncgntnngnccnanntnnncgncgacgtcgacncnnnnngnnnnnnacnngncnnanngcgttnnngcnnnnntcgngtnanacnacgcgcnanngnnnntncntggnnccangannnngcgnngnnnntnncnntcngcgnnncgcgcgcnnangattncgtnctnacncncngtnngngtgnangnngncgtcgnngncnnnncgnnnnncncggnncgnncncganngntgtcgcgcganacnnngntgnnacnttcnnnanncnntanannnngcnannncnnnntcntcnncgcgcgtccnnnacgncnnntnngacnnnnnnnnnncnnnnacancnnnnnnnntcnngngtgnganngcncgcnnncgngangncncnnaaccnngcgncgcggngngcggngacnnncgcgnngnnaacncnnntcgcgcgcgcgaaatcgngnngnnnattttcanagaacccncnggnggncttngnntcnannntntcnacgtcnacncanngnnnntngcncnnnnnacnntagatttttancccntnngtntgcnngacgncgnngannnactcngngnncancttttncnncnnanntccnnacncgcntntcncnnnncncgtcgacgcgagngtncctntcanntnnncntcnngngngtcgncgaannnnnnnttgnnnnanannatnntcgncnantcgancncggtngngctngtncnngnnnntatgnnnnnngntcncnngnncgnggcatngnnnatcgcngngnngntgnggccgcgcgnggnntnnncgananagatgaantcncnannntgcgtnncgncncnnnnantnnngngcgncncncccgnnnncgcggangcgaaaannnnnnnngtnnccanngnntgnncnccctccgngngnncntntgngnnatacacnanaaanaagcgngnnnngancgccnnnncgncgnac

SEQ ID NO: 900 - DNA, 4000 bp, Escherichia coli
  misc_feature (1)..(4): n is a, c, g, or t
  misc_feature (6)..(12): n is a, c, g, or t
  misc_feature (14)..(22): n is a, c, g, or t
  misc_feature (24)..(24): n is a, c, g, or t
  misc_feature (26)..(32): n is a, c, g, or t
  misc_feature (34)..(35): n is a, c, g, or t
  misc_feature (37)..(37): n is a, c, g, or t
  misc_feature (43)..(44): n is a, c, g, or t
  misc_feature (46)..(49): n is a, c, g, or t
  misc_feature (51)..(56): n is a, c, g, or t
  misc_feature (59)..(60): n is a, c, g, or t
  misc_feature (63)..(68): n is a, c, g, or t
  misc_feature (70)..(72): n is a, c, g, or t
  misc_feature (74)..(75): n is a, c, g, or t
  misc_feature (78)..(82): n is a, c, g, or t
  misc_feature (84)..(84): n is a, c, g, or t
  misc_feature (86)..(86): n is a, c, g, or t
  misc_feature (88)..(90): n is a, c, g, or t
  misc_feature (92)..(94): n is a, c, g, or t
  misc_feature (96)..(99): n is a, c, g, or t
  misc_feature (101)..(105): n is a, c, g, or t
  misc_feature (107)..(110): n is a, c, g, or t
  misc_feature (112)..(114): n is a, c, g, or t
  misc_feature (116)..(118): n is a, c, g, or t
  misc_feature (120)..(122): n is a, c, g, or t
  misc_feature (125)..(132): n is a, c, g, or t
  misc_feature (134)..(134): n is a, c, g, or t
  misc_feature (136)..(136): n is a, c, g, or t
  misc_feature (139)..(141): n is a, c, g, or t
  misc_feature (143)..(143): n is a, c, g, or t
  misc_feature (145)..(145): n is a, c, g, or t
  misc_feature (147)..(149): n is a, c, g, or t
  misc_feature (151)..(158): n is a, c, g, or t
  misc_feature (162)..(170): n is a, c, g, or t
  misc_feature (174)..(174): n is a, c, g, or t
  misc_feature (178)..(179): n is a, c, g, or t
  misc_feature (181)..(186): n is a, c, g, or t
  misc_feature (189)..(190): n is a, c, g, or t
  misc_feature (193)..(193): n is a, c, g, or t
  misc_feature (195)..(200): n is a, c, g, or t
  misc_feature (203)..(203): n is a, c, g, or t
  misc_feature (205)..(207): n is a, c, g, or t
  misc_feature (209)..(218): n is a, c, g, or t
  misc_feature (220)..(222): n is a, c, g, or t
  misc_feature (224)..(226): n is a, c, g, or t
  misc_feature (229)..(234): n is a, c, g, or t
  misc_feature (236)..(244): n is a, c, g, or t
  misc_feature (246)..(249): n is a, c, g, or t
  misc_feature (253)..(257): n is a, c, g, or t
  misc_feature (259)..(262): n is a, c, g, or t
  misc_feature (264)..(264): n is a, c, g, or t
  misc_feature (267)..(268): n is a, c, g, or t
  misc_feature (270)..(275): n is a, c, g, or t
  misc_feature (277)..(279): n is a, c, g, or t
  misc_feature (281)..(291): n is a, c, g, or t
  misc_feature (293)..(302): n is a, c, g, or t
  misc_feature (304)..(305): n is a, c, g, or t
  misc_feature (307)..(307): n is a, c, g, or t
  misc_feature (346)..(346): n is a, c, g, or t
  misc_feature (355)..(355): n is a, c, g, or t
  misc_feature (1137)..(1137): n is a, c, g, or t
  misc_feature (1142)..(1142): n is a, c, g, or t
  misc_feature (1144)..(1144): n is a, c, g, or t
  misc_feature (1986)..(1986): n is a, c, g, or t
  misc_feature (2964)..(2964): n is a, c, g, or t
nnnntnnnnnnntnnnnnnnnncnannnnnnnannantttttnnannnncnnnnnnttnnaannnnnnannntnnttnnnnntncnannncnnntnnnncnnnnntnnnngnnncnnngnnnttnnnnnnnntngnttnnnantncnnnannnnnnnnaaannnnnnnnntttnaaanntnnnnnnttnnccnannnnnnaantnnngnnnnnnnnnnannntnnnttnnnnnncnnnnnnnnngnnnnaaannnnntnnnnanttnnannnnnntnnngnnnnnnnnnnntnnnnnnnnnnannantttttttaaaaatttattttaaaatctttatttagtgcntttttggcnggtgtatgttgaaaattagtttgttagcagtactgctagtctttgtagtaggtactggtgttatatttgcagttccagatgcagcaggtgacgttgtagctggaaaaggcgaatttaggcttggtgaggttttagatgaatcagtaggctggtttatcgttgtaggtttaggaatgatatttgcaggtgttatttctgtagagattaagcttgaggaaaaatatttaggtcatacacaaaactccgagtggtttaacactgctggcagaattatcaagacaggtctaactgcagcagcaatcgtatctgcctggacttgggctgcgacactgctacaatcttcgacagtagcgtatctctatggtattagcggacctttctggtatgcttctggcgcaacaattcaggttcttttgttcggaatattagcaatcgaactaaaacgaaaagcaccaaacgctcacactttcttagaaattatcagagcaagatttggtaacggtactcacaaaattttcttaggttttgcattaacatgtaacatgattgtaactggaatgctcctacttggaggtgcagcagttgtaaacggtctaacaggaatggacattacccttgcagcatttttgattcctgtaggtgttatgatctatacgctggtaggcggtctaaaggctacatttgtggcagactatatgcatactgtaattatctttactgtaattctcacatttgtttcaatggtattcttcatcagtccaattacgggcggaattgaaggnatgtncnacaaactggcagaagctgcagtgttaaaaccagttctattgcctactttcgtagaaggaacaccaggcaatgctatgggcgcttaccttacaatggcttctgctggcggtttgatctttggagttatcaacatagtgggtaactttggaactgtatttgtcgaccaggcatattggcaacgagcaatcgctgcacaaccaagttcaactgtaagaggtttcttacttggtggaatgtgttggttctcaattccatttacactagcaactacgatggggcttactgcggtggcgcttcaagtatcgcttacgccagagcaggtgcagctcggacttacggttcctgctgcagcaacagtactaatgggtccagtaggcgcaatcatggttttggtaatgttatttatggcggtaacttcggcaggatctgctgaactaatcgcggtatcttctttgattacttatgatgtgtacagaacatacaagaatccaaatgctacaggtaagcaactactcaaagtgagccggacggttatagtcatatttggtcttggaatgggagctctggctgcaatattattaggcatgggattaagcttaggatttgtatacttggcgatgggcatcttgattggctctgctgtaattccgattgcattaacaatcgcttggagtagaactacaagggctggtgcagtttctggtgcccttattggtgttatgttatcattaatcacatggacaggtgttgcttctgcagagtctggtggcgttgttgacattgcatcacttggtggtgcgttcccaatgctttatggtaacgttgtagcaatcttatcatcnggattgatttgtgtagtaatcagtttggctcagaggaaggtctatgattggaagttgatgaatcctcaaatgaaaattgtccaggctgacatgtctgagaacatgaaagcggaaatagcagcacgagcacaagacgaagagacattaaagaaagcatacaagttcagcctaaagggaggcggaattttgactttgatttgtgtagtattttggccattgcctttgtacttctctggatatgtatttgatttgggattctacaccttctgggtttggattgccattgtttgggtatccgttgcatcattcaccattatctgcatgccaatatacgaagccagagggggcttcgccaaagtatttcgtggtcaaaaagcagacgtaaaataatactctgagagagagcaaaatggagtcatagatcttcttgatcatgcattcctctcaaaatttaacaattctttttaatgatgtattgatggttttgttatgacatcatgtaccggttgtggtcttgtacttggttttaaaaagtacaagttcaataagctttggcgagttccaggtaagttctgcaagccttgtatgatgttgattggaaaagattgggacgatcatggaaagatcaccttaccacaacgtcgatgtgacttgtgccaaacggaattttattttcttcaagttgcatggcaggggcagaagcaaaaacacttttgcgatgtatgccacaaggttgcaattagcggagtgttgcctgataaaagcaggaaggaaatgacaaacaaatttccaatacccatgctgataattggaggtcttggagctgtgctaatggttctaggcgcgttattcacattgataggaacgacatcaggcgatgccaacttggttaacatcttatttggtgcatttactactgcagcaggattcatgttggttcgacgtactataaacaacagaaagctgcttttaggaaangtctagaacaaacagtacaatcttgaaagagatacatcttttgctggatccactgtagcaatcttcccgttcactttgacctcgtacgtttctgggtcgatttcaatttttggtgtagcatcattgtacatcatgtccttttttccaatattgcggcagttctttactgggagcaattttttttcaattttgagtttttcttccaagccgttgtccagtgcgagttgcgatgtaaacgtaacagacgttgtcttctttgcctttccgagtgcgccaaacataggtctgtagtagactggctcagttgtaggaattgatgcatttgggtcgcccatcagcgagtatgcgatgaatccacccttgataatcagtttcggcttgattccaaaaaactgtggggtccatactacaatgtctgcaatctttccaggttcaagcgagccaacatactccgagattccatgcgttattgcagggttaattgtgatctttgagatataccgtttgattctgtaattgtcattttctgcactatcttcaggaagactacctttcatctttttcatcttgtctgcagtttgccaatttcttgtagtcacttcaccaactcttcccattgcttggctgtctgatgacatcatactgattgccccgatatcatgcaagacatcttcagcagcaattgtctcagcgcggattctagactctgcaaacgagatgtcttctggaacagacggattcaagtgatggcaaaccatcatcatgtccaaatgttcctctagcgtattgattgtaaatggtcttgtaggattggtagacgatggcaaaatgtttggctcgcctgcaattttcattatatctggagcatggcctccacctgcaccttcagtgtggtatgtgtggattaccctgccatttatggcatttatggtatcatctacatatccacattcgtttagtgtgtctgtatgaattgcaacttgcgtatcagtcttgtctgcaacatttagggcagaattaattgtagctggagttg

SEQ ID NO: 901 - DNA, 4000 bp, Escherichia coli
  misc_feature (1)..(1): n is a, c, g, or t
  misc_feature (3)..(6): n is a, c, g, or t
  misc_feature (8)..(8): n is a, c, g, or t
  misc_feature (11)..(16): n is a, c, g, or t
  misc_feature (18)..(28): n is a, c, g, or t
  misc_feature (30)..(34): n is a, c, g, or t
  misc_feature (36)..(39): n is a, c, g, or t
  misc_feature (41)..(41): n is a, c, g, or t
  misc_feature (43)..(43): n is a, c, g, or t
  misc_feature (49)..(49): n is a, c, g, or t
  misc_feature (52)..(52): n is a, c, g, or t
  misc_feature (59)..(60): n is a, c, g, or t
  misc_feature (67)..(68): n is a, c, g, or t
  misc_feature (70)..(81): n is a, c, g, or t
  misc_feature (83)..(91): n is a, c, g, or t
  misc_feature (95)..(95): n is a, c, g, or t
  misc_feature (97)..(98): n is a, c, g, or t
  misc_feature (100)..(107): n is a, c, g, or t
  misc_feature (109)..(118): n is a, c, g, or t
  misc_feature (120)..(124): n is a, c, g, or t
  misc_feature (126)..(143): n is a, c, g, or t
  misc_feature (147)..(147): n is a, c, g, or t
  misc_feature (150)..(150): n is a, c, g, or t
  misc_feature (152)..(152): n is a, c, g, or t
  misc_feature (155)..(155): n is a, c, g, or t
  misc_feature (162)..(183): n is a, c, g, or t
  misc_feature (185)..(186): n is a, c, g, or t
  misc_feature (188)..(191): n is a, c, g, or t
  misc_feature (193)..(206): n is a, c, g, or t
  misc_feature (211)..(211): n is a, c, g, or t
  misc_feature (213)..(213): n is a, c, g, or t
  misc_feature (215)..(215): n is a, c, g, or t
  misc_feature (218)..(218): n is a, c, g, or t
  misc_feature (221)..(224): n is a, c, g, or t
  misc_feature (226)..(228): n is a, c, g, or t
  misc_feature (230)..(238): n is a, c, g, or t
  misc_feature (241)..(242): n is a, c, g, or t
  misc_feature (244)..(245): n is a, c, g, or t
  misc_feature (247)..(247): n is a, c, g, or t
  misc_feature (250)..(250): n is a, c, g, or t
  misc_feature (252)..(253): n is a, c, g, or t
  misc_feature (256)..(256): n is a, c, g, or t
  misc_feature (261)..(261): n is a, c, g, or t
  misc_feature (264)..(264): n is a, c, g, or t
  misc_feature (266)..(266): n is a, c, g, or t
  misc_feature (271)..(273): n is a, c, g, or t
  misc_feature (278)..(280): n is a, c, g, or t
  misc_feature (283)..(284): n is a, c, g, or t
  misc_feature (286)..(291): n is a, c, g, or t
  misc_feature (293)..(295): n is a, c, g, or t
  misc_feature (302)..(303): n is a, c, g, or t
  misc_feature (306)..(306): n is a, c, g, or t
  misc_feature (311)..(318): n is a, c, g, or t
  misc_feature (320)..(323): n is a, c, g, or t
  misc_feature (325)..(340): n is a, c, g, or t
  misc_feature (342)..(343): n is a, c, g, or t
  misc_feature (345)..(349): n is a, c, g, or t
  misc_feature (351)..(354): n is a, c, g, or t
  misc_feature (357)..(357): n is a, c, g, or t
  misc_feature (362)..(363): n is a, c, g, or t
  misc_feature (367)..(367): n is a, c, g, or t
  misc_feature (427)..(427): n is a, c, g, or t
  misc_feature (2196)..(2196): n is a, c, g, or t
  misc_feature (2472)..(2472): n is a, c, g, or t
  misc_feature (2490)..(2490): n is a, c, g, or t
  misc_feature (2492)..(2492): n is a, c, g, or t
  misc_feature (2494)..(2494): n is a, c, g, or t
  misc_feature (2499)..(2499): n is a, c, g, or t
  misc_feature (2503)..(2503): n is a, c, g, or t
  misc_feature (2513)..(2515): n is a, c, g, or t
  misc_feature (2518)..(2518): n is a, c, g, or t
  misc_feature (2521)..(2521): n is a, c, g, or t
  misc_feature (2527)..(2528): n is a, c, g, or t
  misc_feature (2539)..(2540): n is a, c, g, or t
  misc_feature (2542)..(2542): n is a, c, g, or t
  misc_feature (2547)..(2548): n is a, c, g, or t
  misc_feature (2550)..(2550): n is a, c, g, or t
  misc_feature (2557)..(2557): n is a, c, g, or t
  misc_feature (2589)..(2589): n is a, c, g, or t
  misc_feature (2591)..(2614): n is a, c, g, or t
  misc_feature (2616)..(2616): n is a, c, g, or t
  misc_feature (2618)..(2618): n is a, c, g, or t
  misc_feature (2620)..(2637): n is a, c, g, or t
  misc_feature (2639)..(2646): n is a, c, g, or t
  misc_feature (2648)..(2649): n is a, c, g, or t
  misc_feature (2651)..(2653): n is a, c, g, or t
  misc_feature (2655)..(2655): n is a, c, g, or t
  misc_feature (2657)..(2657): n is a, c, g, or t
  misc_feature (2659)..(2674): n is a, c, g, or t
  misc_feature (2676)..(2690): n is a, c, g, or t
  misc_feature (2692)..(2692): n is a, c, g, or t
  misc_feature (2694)..(2694): n is a, c, g, or t
  misc_feature (2698)..(2698): n is a, c, g, or t
  misc_feature (2700)..(2702): n is a, c, g, or t
  misc_feature (2704)..(2713): n is a, c, g, or t
  misc_feature (2715)..(2715): n is a, c, g, or t
  misc_feature (2717)..(2721): n is a, c, g, or t
  misc_feature (2723)..(2740): n is a, c, g, or t
  misc_feature (2742)..(2744): n is a, c, g, or t
  misc_feature (2746)..(2746): n is a, c, g, or t
  misc_feature (2748)..(2748): n is a, c, g, or t
  misc_feature (2750)..(2750): n is a, c, g, or t
  misc_feature (2753)..(2754): n is a, c, g, or t
  misc_feature (2756)..(2757): n is a, c, g, or t
  misc_feature (2759)..(2763): n is a, c, g, or t
  misc_feature (2765)..(2767): n is a, c, g, or t
  misc_feature (2769)..(2769): n is a, c, g, or t
  misc_feature (2773)..(2773): n is a, c, g, or t
  misc_feature (2777)..(2777): n is a, c, g, or t
  misc_feature (2779)..(2779): n is a, c, g, or t
  misc_feature (2783)..(2784): n is a, c, g, or t
  misc_feature (2786)..(2786): n is a, c, g, or t
  misc_feature (2788)..(2810): n is a, c, g, or t
  misc_feature (2812)..(2824): n is a, c, g, or t
  misc_feature (2826)..(2827): n is a, c, g, or t
  misc_feature (2829)..(2829): n is a, c, g, or t
  misc_feature (2831)..(2840): n is a, c, g, or t
  misc_feature (2843)..(2858): n is a, c, g, or t
  misc_feature (2861)..(2861): n is a, c, g, or t
  misc_feature (2866)..(2870): n is a, c, g, or t
  misc_feature (2873)..(2873): n is a, c, g, or t
  misc_feature (2875)..(2903): n is a, c, g, or t
  misc_feature (2905)..(2905): n is a, c, g, or t
  misc_feature (2907)..(2910): n is a, c, g, or t
  misc_feature (2912)..(2912): n is a, c, g, or t
  misc_feature (2914)..(2914): n is a, c, g, or t
  misc_feature (2916)..(2947): n is a, c, g, or t
  misc_feature (2949)..(2950): n is a, c, g, or t
  misc_feature (2952)..(2952): n is a, c, g, or t
  misc_feature (2954)..(2954): n is a, c, g, or t
  misc_feature (2956)..(2956): n is a, c, g, or t
  misc_feature (2958)..(2958): n is a, c, g, or t
  misc_feature (2961)..(2968): n is a, c, g, or t
  misc_feature (2970)..(2981): n is a, c, g, or t
  misc_feature (2986)..(3017): n is a, c, g, or t
  misc_feature (3019)..(3038): n is a, c, g, or t
  misc_feature (3040)..(3040): n is a, c, g, or t
  misc_feature (3042)..(3046): n is a, c, g, or t
  misc_feature (3049)..(3056): n is a, c, g, or t
  misc_feature (3058)..(3058): n is a, c, g, or t
  misc_feature (3060)..(3061): n is a, c, g, or t
  misc_feature (3063)..(3067): n is a, c, g, or t
  misc_feature (3069)..(3070): n is a, c, g, or t
  misc_feature (3072)..(3090): n is a, c, g, or t
  misc_feature (3092)..(3101): n is a, c, g, or t
  misc_feature (3103)..(3104): n is a, c, g, or t
  misc_feature (3106)..(3120): n is a, c, g, or t
  misc_feature (3122)..(3123): n is a, c, g, or t
  misc_feature (3125)..(3131): n is a, c, g, or t
  misc_feature (3133)..(3135): n is a, c, g, or t
  misc_feature (3139)..(3152): n is a, c, g, or t
  misc_feature (3154)..(3172): n is a, c, g, or t
  misc_feature (3174)..(3177): n is a, c, g, or t
  misc_feature (3179)..(3182): n is a, c, g, or t
  misc_feature (3184)..(3184): n is a, c, g, or t
  misc_feature (3186)..(3186): n is a, c, g, or t
  misc_feature (3188)..(3189): n is a, c, g, or t
  misc_feature (3191)..(3195): n is a, c, g, or t
  misc_feature (3197)..(3197): n is a, c, g, or t
  misc_feature (3199)..(3199): n is a, c, g, or t
  misc_feature (3201)..(3208): n is a, c, g, or t
  misc_feature (3210)..(3263): n is a, c, g, or t
  misc_feature (3265)..(3275): n is a, c, g, or t
  misc_feature (3277)..(3301): n is a, c, g, or t
  misc_feature (3303)..(3303): n is a, c, g, or t
  misc_feature (3305)..(3308): n is a, c, g, or t
  misc_feature (3310)..(3310): n is a, c, g, or t
  misc_feature (3312)..(3319): n is a, c, g, or t
  misc_feature (3321)..(3321): n is a, c, g, or t
  misc_feature (3325)..(3325): n is a, c, g, or t
  misc_feature (3327)..(3334): n is a, c, g, or t
  misc_feature (3336)..(3336): n is a, c, g, or t
  misc_feature (3338)..(3339): n is a, c, g, or t
  misc_feature (3341)..(3341): n is a, c, g, or t
  misc_feature (3343)..(3343): n is a, c, g, or t
  misc_feature (3345)..(3348): n is a, c, g, or t
  misc_feature (3350)..(3350): n is a, c, g, or t
  misc_feature (3352)..(3371): n is a, c, g, or t
  misc_feature (3373)..(3385): n is a, c, g, or t
  misc_feature (3387)..(3387): n is a, c, g, or t
  misc_feature (3389)..(3389): n is a, c, g, or t
  misc_feature (3391)..(3394): n is a, c, g, or t
  misc_feature (3396)..(3396): n is a, c, g, or t
  misc_feature (3398)..(3415): n is a, c, g, or t
  misc_feature (3417)..(3417): n is a, c, g, or t
  misc_feature (3419)..(3429): n is a, c, g, or t
  misc_feature (3431)..(3431): n is a, c, g, or t
  misc_feature (3433)..(3463): n is a, c, g, or t
  misc_feature (3465)..(3465): n is a, c, g, or t
  misc_feature (3467)..(3467): n is a, c, g, or t
  misc_feature (3469)..(3469): n is a, c, g, or t
  misc_feature (3471)..(3474): n is a, c, g, or t
  misc_feature (3476)..(3501): n is a, c, g, or t
  misc_feature (3503)..(3503): n is a, c, g, or t
  misc_feature (3505)..(3505): n is a, c, g, or t
  misc_feature (3507)..(3533): n is a, c, g, or t
  misc_feature (3535)..(3535): n is a, c, g, or t
  misc_feature (3537)..(3537): n is a, c, g, or t
  misc_feature (3539)..(3547): n is a, c, g, or t
  misc_feature (3549)..(3549): n is a, c, g, or t
  misc_feature (3551)..(3555): n is a, c, g, or t
  misc_feature (3558)..(3558): n is a, c, g, or t
  misc_feature (3560)..(3560): n is a, c, g, or t
  misc_feature (3562)..(3562): n is a, c, g, or t
  misc_feature (3564)..(3570): n is a, c, g, or t
  misc_feature (3572)..(3616): n is a, c, g, or t
  misc_feature (3618)..(3618): n is a, c, g, or t
  misc_feature (3620)..(3623): n is a, c, g, or t
  misc_feature (3625)..(3626): n is a, c, g, or t
  misc_feature (3628)..(3630): n is a, c, g, or t
  misc_feature (3632)..(3635): n is a, c, g, or t
  misc_feature (3637)..(3640): n is a, c, g, or t
  misc_feature (3642)..(3652): n is a, c, g, or t
  misc_feature (3654)..(3658): n is a, c, g, or t
  misc_feature (3660)..(3664): n is a, c, g, or t
  misc_feature (3666)..(3696): n is a, c, g, or t
  misc_feature (3698)..(3698): n is a, c, g, or t
  misc_feature (3700)..(3700): n is a, c, g, or t
  misc_feature (3702)..(3706): n is a, c, g, or t
  misc_feature (3708)..(3718): n is a, c, g, or t
  misc_feature (3720)..(3721): n is a, c, g, or t
  misc_feature (3723)..(3728): n is a, c, g, or t
  misc_feature (3730)..(3753): n is a, c, g, or t
  misc_feature (3755)..(3755): n is a, c, g, or t
  misc_feature (3757)..(3757): n is a, c, g, or t
  misc_feature (3759)..(3770): n is a, c, g, or t
  misc_feature (3772)..(3772): n is a, c, g, or t
  misc_feature (3774)..(3774): n is a, c, g, or t
  misc_feature (3776)..(3794): n is a, c, g, or t
  misc_feature (3796)..(3796): n is a, c, g, or t
  misc_feature (3800)..(3817): n is a, c, g, or t
  misc_feature (3819)..(3826): n is a, c, g, or t
  misc_feature (3828)..(3829): n is a, c, g, or t
  misc_feature (3831)..(3836): n is a, c, g, or t
  misc_feature (3838)..(3839): n is a, c, g, or t
  misc_feature (3841)..(3842): n is a, c, g, or t
  misc_feature (3844)..(3844): n is a, c, g, or t
  misc_feature (3846)..(3846): n is a, c, g, or t
  misc_feature (3848)..(3855): n is a, c, g, or t
  misc_feature (3857)..(3860): n is a, c, g, or t
  misc_feature (3862)..(3862): n is a, c, g, or t
  misc_feature (3864)..(3869): n is a, c, g, or t
  misc_feature (3871)..(3871): n is a, c, g, or t
  misc_feature (3873)..(3873): n is a, c, g, or t
  misc_feature (3875)..(3880): n is a, c, g, or t
  misc_feature (3882)..(3882): n is a, c, g, or t
  misc_feature (3884)..(3893): n is a, c, g, or t
  misc_feature (3895)..(3902): n is a, c, g, or t
  misc_feature (3904)..(3916): n is a, c, g, or t
  misc_feature (3918)..(3918): n is a, c, g, or t
  misc_feature (3920)..(3936): n is a, c, g, or t
  misc_feature (3938)..(3942): n is a, c, g, or t
  misc_feature (3944)..(3952): n is a, c, g, or t
  misc_feature (3954)..(3954): n is a, c, g, or t
  misc_feature (3956)..(3956): n is a, c, g, or t
  misc_feature (3958)..(3961): n is a, c, g, or t
  misc_feature (3963)..(3963): n is a, c, g, or t
  misc_feature (3965)..(3965): n is a, c, g, or t
  misc_feature (3969)..(3974): n is a, c, g, or t
  misc_feature (3976)..(4000): n is a, c, g, or t
ntnnnngngtnnnnnnannnnnnnnnnnannnnngnnnnananaagaanaanaagagannaaaagannannnnnnnnnnnnannnnnnnnnaaanannannnnnnnnannnnnnnnnntnnnnnannnnnnnnnnnnnnnnnntttnttntnttnttttttnnnnnnnnnnnnnnnnnnnnnntnntnnnnannnnnnnnnnnnnnaaaanananatngannnntnnntnnnnnnnnnganngnnangangnngangaggnggnanaggannnagaannngannannnnnnannncagcagnnacnacgannnnnnnngnnnntnnnnnnnnnnnnnnnngnngnnnnngnnnntantaatnntaanaataataataataataataataataataaggatgatgatgatgaaaatgcgagcgaactngaagaacgtcttctcgatgttacaattcaatggaagagaagacggttggtcgtgcacgagtggaggacggtgagagatagaagcggagctcgattagaagaagaagaagaagataaactcgtgggtgtcggtggcggaaaagagggcaagctgtattttgatatccttttgtcgtttttagggacgtctggggacgagtctcttctgttgagaaagatgtggacgcgagtcgttcgtcacgagaaaaggctcgacgtatttttgaaagacgactttggaggcgacgacgggaggaaaaggaggagcaggaacgcgatgatgattacggcgaaggacgcggacgtgttgatgtcggcaccgtgccggtttccgtttttgaaagacgagagcgagagttgcgacggtaaatacagttacgataaaagacacgagagagagaaaaaggacgacttgagagaaaacttccgagcgaacgggtatttgattgctgacggtggtaccgctgcgaaaggaacgagcagttgtcgagtgtcaaaaacgctcgttgattcgtttcgaatgaaaacgcacgagagaatcgaggtaattttaagcgccctgcgagagaatcattcgcacgtttctgttggaaccgacgcgtttgcttataaagaaatcgggagtcgagggaagtatcgattcgacgcgttattcgataaagaaaaggaggaggaagatgcactttttaagttcgctaaatcagacgcgccgtgggtggaaccggtgaaggatattttacggaacgcagaagatatagacattaacatatccatcgtttggacggaaccgaactgttcagaccaagagtggcattgcgacggcgcgcacagaggcgaccaggaaacgtacgacgaacaaacgggcgctttagtcaaaacgcacggtccaccgtacgccgtgtgtgtattcatgaccctcctcgatttggacgatacggttggatacacagaattttggccaacttcgcataaaaatgccggtttactcgggttcggagcagccgcgcacgctttaggtggcgtgcaatcgaacaaaaacgctaaagcgggagattgggtcgtgtacgattatcgattgatgcacagaggcatcggaaacgaaagtaaagacacgcggcgaccgatattgcagtttatgtatgccgtggacgggtataaagaacggaaaaattacggccagaagagtgtgtttagtccctgttgaaggtgtcgtcgtttgcgacgacacgtgtatttttattagtgctgctactgcatctgtgcgctacgtgctactactaccaccactcccacttgtgcgactcctactttcctctaagctctccgacatccgtctcctcttctccctcgcttttctcctcgcctcctccgccgtgacatttttaggtaaaccaacgctctcaaagttcccaacttcctctcgtaacccctcgtgtacaatcttcacgtccccacctcctgagctcgtcacgttcgccatcctctcgtacgcgatgccgtagttttcgcacatgtaaattctcgtgcgagcgtaatcaatcgctttttgcacgtgcgcgtggtctttcaagaatcggttttctctgaatcgattcttgcactccgaggtgatgtattccgcctctttaaggctatcgcgtttcatttttctcgccaagcgaaacatgtgccggaaaagcgagaacacttccgccctttgaagaagcgaagaagacggagaagacatgagtnttacgaacgagtttttgtgcgcgcgcgtaatgatgtgtgacgaattcgtggaagtacttctcttcggggattttcaaatctattttactcttcgtcttcgctctcgtcctctaagttcgccgcggcgtacatctgtttcgtaaacaccggcctcgtcgatcgactggctcgtccaccggcgatgatgtttgactggtcgacttcgtcgccggataaatcgtcgatgacgtctgagttttccgaatccgaatcatcttgtttcttcttcttcttctncttcttcttcttcgtgtntntnttttncttnttttgcttcnnntcnccntcgtcnnccgtgctctcnncntcctnntnataaatnttatgcgcacagagagagagagagagagaganannnnnnnnnnnnnnnnnnnnnnnngngngnnnnnnnnnnnnnnnnnncnnnnnnnncnncnnnananannnnnnnnnnnnnnnnannnnnnnnnnnnnnnananacanannncnnnnnnnnnnanannnnnannnnnnnnnnnnnnnnnncnnnanananaannannannnnnannnanaaanaaananaaannanannnnnnnnnnnnnnnnnnnnnnncnnnnnnnnnnnnntnngngnnnnnnnnnntcnnnnnnnnnnnnnnnnctntctcnnnnnccncnnnnnnnnnnnnnnnnnnnnnnnnnnnnntntnnnntntntnnnnnnnnnnnnnnnnnnnnnnnnnnnnnnnnannananananacnnnnnnnnannnnnnnnnnnnaaaannnnnnnnnnnnnnnnnnnnnnnnnnnnnnnnannnnnnnnnnnnnnnnnnnntntnnnnnatnnnnnnnntntnntnnnnncnntnnnnnnnnnnnnnnnnnnnannnnnnnnnnannannnnnnnnnnnnnnngnngnnnnnnngnnngagnnnnnnnnnnnnnncnnnnnnnnnnnnnnnnnnntnnnngnnnnanananncnnnnnananannnnnnnngnnnnnnnnnnnnnnnnnnnnnnnnnnnnnnnnnnnnnnnnnnnnnnnnnnnnnntnnnnnnnnnnntnnnnnnnnnnnnnnnnnnnnnnnnntntnnnntntnnnnnnnngngtgngnnnnnnnntntnntntntnnnntntnnnnnnnnnnnnnnnnnnnnannnnnnnnnnnnngngngnnnnanannnnnnnnnnnnnnnnnngngnnnnnnnnnnntntnnnnnnnnnnnnnnnnnnnnnnnnnnnnnnntntntntnnnntnnnnnnnnnnnnnnnnnnnnnnnnnncncncnnnnnnnnnnnnnnnnnnnnnnnnnnntntntnnnnnnnnncncnnnnnttntntntnnnnnnncnnnnnnnnnnnnnnnnnnnnnnnnnnnnnnnnnnnnnnnnnnnnnanannnntnnannnannnntnnnntnnnnnnnnnnngnnnnngnnnnngnnnnnnnnnnnnnnnnnnnnnnnnnnnnnnntntntnnnnntnnnnnnnnnnngnntnnnnnnannnnnnnnnnnnnnnnnnnnnnnngngngnnnnnnnnnnnntntntnnnnnnnnnnnnnnnnnnntntttnnnnnnnnnnnnnnnnnngnnnnnnnngnnannnnnnannannananannnnnnnngnnnngngnnnnnngngngnnnnnngngnnnnnnnnnngnnnnnnnntnnnnnnnnnnnnngngnnnnnnnnnnnnnnnnntnnnnntnnnnnnnnnananannnnananagannnnnnannnnnnnnnnnnnnnnnnnnnnnnn

SEQ ID NO: 902 - DNA, 4000 bp, Escherichia coli
  misc_feature (339)..(339): n is a, c, g, or t
  misc_feature (355)..(355): n is a, c, g, or t
  misc_feature (611)..(611): n is a, c, g, or t
  misc_feature (671)..(671): n is a, c, g, or t
  misc_feature (749)..(749): n is a, c, g, or t
  misc_feature (1985)..(1985): n is a, c, g, or t
  misc_feature (2024)..(2024): n is a, c, g, or t
ttaccaattacactaattttttctttatagaaaatccctgaaggaattaaatgtaatttatacgttacgccgtcgaatttaatggtatgtccggcgttatctccgccttggtaacgagcgatcacttctgcgttttcacttagaaagtctgtaatttttcctttaccttcgtcgccccattgcgttccaacaactactactgatgacattcgaacacctcgttcataatttttttgtcctgaatcattgtaccagtaaaaccagtccctttcaagggtaaaaatcgaatattctttcacaatcaaaagcgtttctgtcaaaaatacgaacatttttagntatgtttttgtaaaanaataaaatatacgaatattgttcgtgttttactctctgattttaatcccttaataagcaaaaaaacgaactcaaaaaatgagttcgttttttaaaattctgtcctcggcgaaagcgaagaaaatttattatattctttaatgaaaagtaattcgaccgttccacgcgcaccactacggtttttctcaatgatgacttctacaacattgtcaacttctggtggctcatgatcgccgtcttctccttcaccacgatcntagtaatcatcacgataaagaaaggcaacgatatcggcatcttgctcaatggaacctgantcacgaatatcacttaacacaggacgtttatcttgacgttgttccacgccacgagaaagctgtgacaaagcgataacngggacttttaattctttcgctaatttttttaattgacgtgaaatatcagaaacctcctgttggcggttctcttttccagttccttcaatcaattgtaggtagtcgatcaaaattagacctaagttgcctttttcttgtgctaatttacgacatttcgcacgaatttcggtaattttaatccctggtgtgtcatcaatatagatattcgcacgggacaaactacccatcgcaataattaagttttgccattcttcttcagataattgccctgttcttaaatggctggcctcaatggatccttctgcacaaagcatccggttcactaatgattctgcccccatttctaaactaaaaatagcgacagctttatctgttttggtgccgacattttgggcaatatttaatgcaaaagcggttttccctaccgctggacgggccgctaaaataattagctcttccgcttgcaagccggcagtcattttatccaatgcttgatagcctgtaggtaaaccagtaatctcttcatcattttggtataattggtcaatattcgcaatagttgtatttagaacatctgaaattgataaaaagccactacgattccgcttttcggagacttctaaaatgcttcgttctgcatcatccaaaatagattcaacatcttcaccttgctcaaagcctttagttacaatctctgtagcggtttggattaagttgcgcagcaacgatttttgttcaacaatttttgcataataaatgacattggcagctgtcggcacagctaaagctaaatctgacagataacttagtccaccaacatcttctaacaaattctcttgttctaggcgatctttgattgttaccacatcaatcgcttcatttcggtcgcttaaggtcatcatcgtttggaaaatcaactgatgactacgacgatagaaatctttaggttccacatattccatcgcttctattagcacatctgcatctaagaaaatagaacctaaaacggcttgttccgcttcaatattttgtggcggtaccctatcttgcaataattcattcattttgttctctcccacgatgtcttactttctggttcatttagtctatccattttaacacaatttcattaaaaaaagtacattttttctctgctgatttctctatttttagttcactttccaattttaaaaaatatacaattaataaaaatataatacttttgttaatttaaantgttgtatatttgatttttaaatattataaaaataattngagtaatttattttgtataaaaaagaagccggagaaatcggcttcttttttatcgattgtattattccgctacgacatgaaccttaattttcgctgtaacttcatgatgtagtttgactggtacgttagtgtaacctagagaacgaattgggttggctaattcgattttgcgtttatccaattttacattgtattgtttgtttaaggcttctgcaatttgttttgaaggaattgagccaaataaacggctgtcttctccagcttttgccttgatctctacaacagtcttttcatcttctaaaaaggcttgcatttcttttgcttgtgctaaaacttctgcttcatgtttttcttgggctttcttttgacccgctaacgcactcatgctccctttattggcttctttcgcataaccatttttaattaaaaagttttgggcgtaaccagttggcacttcttttacgtcccctttttttccttttcctttaacgtcttgtaaaaaaatgactttcatttccttcactcctgttcatacatttcattaatattttgacgaattacatcaagtagttgctcttttacttctgctactgttacgtttgataattgtactgccgcattagtaaagtgaccgccaccacctaaattttccataataatttggacattaattgaaccattactccgagcactaatgccaatctgttgatccgtccgcttggtaatgacaaatgctgcattaatccctgccatagaaagtaatgtgtccgctgttttggcagctgtgacactatcatattctttgtcttcactcccggcaacaacgacggtatcttttgtgacatattcgcttttagagattaagttgttcatttccagatagcttgtaagatcagaacttaatagatattgtactaaagatgagtctgctccacaagttcgtaaataactagccacatcaaatgttcgcgccgtcgttcgtgtattgaaacttttcgtatcaaccacaattcccgccaacatcatggttgcttcaaaggcctgcagtttatttgcgctattactttggtattcgatcaattctgtgactaattctgaagcagaagaggcagaagattcaatataagaaagcaagggttttgctggaaattcgtctcctcgtcgatggtgatcaatgattaccactttatcaaaacgctcatagagctcttgtgagatcgatagagacggtttatggtaatctaccataactaataagctactttctttcttgcgcttcatggcctctttaggactaataatgcgctcttctaattctgggtactctttaatcgcctctaacactcttttgacatcgggaatgatttcattttcatctaaaacaatccacgcttttcgattattaaacgaggctaaacgagcaacaccaaatgctgaacctaacgcatccatatctggataacgatggcccataatatagatgtcagcagattccgcaataattcccttaattgccatgctcattgcgcgagaacgtacttgggaacgtttcgtcgttactgccgtttttccaccaaaaaataacggcttcgcttcatctttggcttcttttacaaccacttgatcgccgccacgtactaaagctgtatctaggtttgtttgagccgtggtcccggtttgatctaaggttggccccccataagcaatccccatacttaacgtaatggctacttcatggttagctgattccttacggatcgtatccaaaatagaaaatttttcgtccatcattttttgaatatcttcccattgggcaatgaaaaaataacgttctgcgttgattcgcttataaaaaactttgtattggtccatccaatcagaaaccatcgtcgtaatgaaactattcaaataagaaatttctttctcatccattgtatcggtgacatcatcataattatcgacagacacaatgccaa

SEQ ID NO: 903 - DNA, 4000 bp, Escherichia coli
  misc_feature (1992)..(1992): n is a, c, g, or t
ggctgagcgggcacgacgcacgatggcgttcaggtcgtcgtcggcgcttggcacttcgcctcggccgtagccgtcgacgccgaggacgaattcgccaccgacaccggtgaccgtgatcgtctggatctcagcgattggggctgtgcggccttgacgctcggtgtcgatcttgacgaaggccgagttgtctgggttcggtgtcaggttcgagccagcttcgttccaaacgatctgttcccagttgtaaccggcttgggagcgcaagaaggtaacggtgtagcggacgtcggtcgaggtgcgttctgcggtgacgtcgatgccttcgattccgaacaggtaacgcaggcgttcttcgaacccttcagcgtcgaggccgtactcgaagcggcgggtccgctcgatgccatcgatatcgatgccagtcagttcgtagtcgcccttgtttgcctggactaaaatcgtctggatctcaggaaccgatggcatgtcaattccagaaaccgtgttctgggtgacggtgagtttgttgtcgttgtcgtcgccagagtcatcgatggtgacgatgtcgccgagacggccgatcgaagagatctcgtaggtcgatgtgttgtcgagcgccacgccaaaggcttggtcgatctcgaaggtcgtagcggtgttaccgacgatgagtgcttgctgtccagcaccggtgccgccagtgatcgtgatggtcgagccgctcaggtccaccacatacttggtgcggttgactttcaggcttttgtcatcgctgtacaggttgcccgaccattcgcggttcactaggtcgtcggtgtcgatgctcacgacgtagcgggcacagacgccgtcgatgtcgcacaggcggtagttgaagacgaaaacatcgaagtcatcgaagttgtcgttggcgatgaaggtgacgttgccggttggatcggcgaatggggcagtgtctgcatttgcgatggccacatcgacgatgagcgtgccgatgtcggtttgggtgcggacatcaacggtcgtgcggcgacgatccactgcattgccgatgtcaactgggttctgtgcgttggtgtctgtgattgtcttggtgtcagcgtcgtagccattgactgggcctgcacctgtgccgctgtctgggccaagcacgctgccaacgatgcggtcgctgccgccgttgatagtcaggatcgcactgatcgaatcggcgtagtgagcgaagtctggggccttgaccacgtcgacgccgtcgttgatgtcggcggcaaagttgacgccggtacccacgttgacggtgtcgttgtttgcgccagtgttgatctcggtgtgaccaccgatgctgcgcacattgaaggtgtcataaccagcaccgctggtgatgatggtcgcaccttcgtgggtcgagtcgatcgtgaatcggttgttgccctgacccagctcgatgtcgagttcttccacgtcgaagtaggtcactcccccatcaaggcgcaggccagcaataacggcgtcgccacccaaaccaaggccggtgagacggtcctcagtcaggtaaccaacatcgtcggcggggctgttcttatggaagatattaagcgtgtcgacctggtcggcttcgaggacacgttcattcggattgagcggcgtgatcgaataatcgattccagcggctggtacatcgccacccggccaagcactcgtgaaggtaaccgtcgtacccgacacgacaggagcgagattcccttgattcccgcggatctgacgggcgaattcgttggtcagatcttcgatactgcggatgttgttggtagcgccattgacgtcgtaggtcttgccgcccacaacaatctgccaggcgccggtgtagtcgccgctgaagaagaagccggccttgttccatttgacgcccgctgcagtcgaggtaaccggcgtaccgctgacaatcacggcgccatcggtagtgacggaatcaccgttgcgatcatgaccggnaacaacattgatgcctgcgccgctgttgcccagggtgaacggcgtcgttgattggatgacgatccggacgttcccgaggagtccaatggcgatgttggcggtgtagttgctgcgctcattgatgtcagccaccaggagcttggcggcaccaacgagggatgcatcatcggcgctgaggcggccgctggtgtaggtcgtggtgccaatgacgagcttccactcttcgccaaattcatcgttgtcgtcggtgatggttgggtcatcggtgaagccgtggaccttcgaggcagtgagttcgagggtggcctgcgtccattcgatcgtgtcggacagatcgccctggtcgggagttccctggaaggtgagttcgccgtcgcctgcagtgaacgaggtgacatcgaaggaattctcgacgtcgacgagcgacaagatgtcggcggaaacaccgtcggggttgacgtcaagttctgtttcttggaatgtgaccgggtcgatgaaggtgacgacgtagctgaagtcgtccatacgagggtcaaagccaggacgttcgcctgtggttgcgttgacatgatctgcgagtgggtcgaccagcacgccgtcacccgcgttgagagcacccagatcgaccgtcgttgcacccacgccgaagtcactgtcactgatgaaaccttcagggcgcagcaggttggtttctgttggcagaccgaacgggtcgttgatctgttgttcggagccctcagggataccaccctggatagtcagtggaccacggatggcattgactcgttcttcgaacgctgggaacacgagtgcgtcgccgccgtcgatgaagtcgtcatcgacagccatgacccagacggtttggcgcttattccaggcgttgtcagcgccgccatcagcaacaaactcgaggaacgattggaccgttgcggttgtagatggatcgacgttcgagttcacgcttgcggtgacgtccgcgatccggacaccatccttgcgggcgatggtcagaactcgaccggtcaccagcacgtcgtagctaccggacgctgcaatggctgcggcgatcgcagcagcggcaacgtcggggccttcacggaaacgagcggtataggtgtaggtgtcagcagccgccgggccgagtttcagtgtccagatttcgccgacctgggtgaagccgccgaactcgatggcgagtcggtccgtgattggcagtgtcttgaacggaggctcaatgacaccgttctcacaacgtcggtcctcgagctcgcctgagtcgcagcgatcgatggtgatggtgccgcgaccctgtgtaaatgcggtagagacgctgatgtcggtcgagacgaagaacttgccggtcaggccagtcgcagtgaccggtacaccggtcaggctgatgatcgaaccggccaccgtggcgctaacgccggttgttgctgtccgcaggttgacctccgcacccaaggtttgggccgcagatgcagccgatgttgcgccggttatcgaaacgatttcaggtgtgacgacagggcggccatcggaatcgaccgggcgcaggaccacagtccagatctgcgaggcctcgacgacgccgtcgatctcgattgttgccttggtcgtcgctaccgcgacctggacttcttctttctggccgaaaccggcgcgagcgtcaaacaccaagtcggagtcaaacgtgcgggtcggacgtgggctgacattcacggtgacgagactgtccggggcgccggtcagcacgacgtcatagctgtcggtgagcgggctgttgtcgccgaacgtgtcctgggtggtcccgtcggtgtacgggtcagtggtgatctcgaacgtgtcctcggctttgacattatcgctgatcgaaccttcaaggatgtaggtctggtattcggcgttgtagccagcgatcacgccggcctcgcccttgccgtcgccgtctatgaaggtgacgaccttgccgacgaggtctatttgtgacttgtttgcttcatgg

SEQ ID NO: 904 - DNA, 4000 bp, Escherichia coli
  misc_feature (6)..(6): n is a, c, g, or t
  misc_feature (12)..(12): n is a, c, g, or t
  misc_feature (18)..(18): n is a, c, g, or t
  misc_feature (21)..(21): n is a, c, g, or t
  misc_feature (72)..(72): n is a, c, g, or t
  misc_feature (75)..(75): n is a, c, g, or t
  misc_feature (87)..(87): n is a, c, g, or t
  misc_feature (93)..(93): n is a, c, g, or t
  misc_feature (120)..(120): n is a, c, g, or t
  misc_feature (129)..(129): n is a, c, g, or t
  misc_feature (149)..(149): n is a, c, g, or t
  misc_feature (165)..(165): n is a, c, g, or t
  misc_feature (168)..(168): n is a, c, g, or t
  misc_feature (174)..(174): n is a, c, g, or t
  misc_feature (177)..(177): n is a, c, g, or t
  misc_feature (204)..(204): n is a, c, g, or t
  misc_feature (228)..(228): n is a, c, g, or t
  misc_feature (252)..(252): n is a, c, g, or t
  misc_feature (273)..(273): n is a, c, g, or t
  misc_feature (315)..(315): n is a, c, g, or t
  misc_feature (318)..(318): n is a, c, g, or t
  misc_feature (369)..(369): n is a, c, g, or t
  misc_feature (375)..(375): n is a, c, g, or t
  misc_feature (387)..(387): n is a, c, g, or t
  misc_feature (402)..(402): n is a, c, g, or t
  misc_feature (405)..(405): n is a, c, g, or t
  misc_feature (411)..(411): n is a, c, g, or t
  misc_feature (435)..(435): n is a, c, g, or t
  misc_feature (441)..(441): n is a, c, g, or t
  misc_feature (450)..(450): n is a, c, g, or t
  misc_feature (462)..(462): n is a, c, g, or t
  misc_feature (465)..(465): n is a, c, g, or t
  misc_feature (468)..(468): n is a, c, g, or t
  misc_feature (474)..(474): n is a, c, g, or t
  misc_feature (477)..(477): n is a, c, g, or t
  misc_feature (483)..(483): n is a, c, g, or t
  misc_feature (488)..(488): n is a, c, g, or t
  misc_feature (498)..(498): n is a, c, g, or t
  misc_feature (512)..(513): n is a, c, g, or t
  misc_feature (534)..(534): n is a, c, g, or t
  misc_feature (573)..(573): n is a, c, g, or t
  misc_feature (582)..(582): n is a, c, g, or t
  misc_feature (645)..(645): n is a, c, g, or t
  misc_feature (665)..(666): n is a, c, g, or t
  misc_feature (672)..(672): n is a, c, g, or t
  misc_feature (724)..(724): n is a, c, g, or t
  misc_feature (793)..(793): n is a, c, g, or t
  misc_feature (797)..(797): n is a, c, g, or t
  misc_feature (800)..(802): n is a, c, g, or t
  misc_feature (806)..(806): n is a, c, g, or t
  misc_feature (968)..(968): n is a, c, g, or t
  misc_feature (1142)..(1142): n is a, c, g, or t
  misc_feature (1241)..(1241): n is a, c, g, or t
  misc_feature (1409)..(1409): n is a, c, g, or t
  misc_feature (1508)..(1508): n is a, c, g, or t
  misc_feature (1806)..(1806): n is a, c, g, or t
  misc_feature (1986)..(1986): n is a, c, g, or t
  misc_feature (2729)..(2729): n is a, c, g, or t
  misc_feature (2828)..(2828): n is a, c, g, or t
  misc_feature (2909)..(2909): n is a, c, g, or t
  misc_feature (2966)..(2966): n is a, c, g, or t
  misc_feature (3150)..(3150): n is a, c, g, or t
  misc_feature (3290)..(3290): n is a, c, g, or t
  misc_feature (3512)..(3512): n is a, c, g, or t
  misc_feature (3524)..(3524): n is a, c, g, or t
  misc_feature (3579)..(3579): n is a, c, g, or t
  misc_feature (3686)..(3686): n is a, c, g, or t
  misc_feature (3869)..(3869): n is a, c, g, or t
  misc_feature (3895)..(3895): n is a, c, g, or t
  misc_feature (3991)..(3991): n is a, c, g, or t
ttgccnaaaccncatttnggncaatggaacttgccgatatgtgaatactgataatagtcatagacaagctcngtntcgcagaaaggncagaanttgccctcgcccacctcataaggcttntccgttgcnccctgatatctgtcaacgcngaaatagtggatattnttnttattnggnttagcaagtccaagtcttgccacgttngggtcatcggcattgagaacaacnttgccctcaaatgtttcaaggaantttttcactttgagaatgagngtttccacctcgccgtttctgtcaagctggtcacggaagaanttnagcagaacaagggtctgcaaattgagctttgaatagaccacaggaacgtgngactcntcagtttcaagnacaagataatcggcntgnactctncccctcatatcgcagtgattgagnagaagngagcatatncccgtatcaagnttnttnccctcnggntttgtnattancttctttccnccgcttgcaaaaanntggctgagatagtttgtaacngaggtcttgccgttggtgcctgtgacggcaacgataggncaatccacnttgaaagccttaaggcagtctttatttatagtccacagcacaagcccgggaaagttgcctgcntccctgccaagcaggtgcanngttttnaccataagcttgccgaaaataatggtgaaagcgttttttaaactcatttatntatctcctattaaaataaagtcgtataaaataataatagaccataacgcccataatgtcaagcattttngacnttnnnaaanaaaaaaacaccgcacaaagacgataggcgccccttgtgcggtgttggcttctatataatttttgagagaaaatctttcaaacgctgattttcagggtgtgcaaagaactctgacggcttgttctgctcgagtatttttccgtctgccataaacagaactctngaagcaacttcccttgcaaagcccatttcgtgggtaacgacaaccattgtcattccgtcgtttgcaagctgtttcataagctccagcacctcgcccaccatttcagggtcaagtgcagaagtaggctcgtcaaaaagcattacttcagggttcatcgccagtgaacgtgcgatngctattctctgcttctgaccgcctgagagccttgaaggatactcgtcagccttatcaggcagaccaactctttccaaaagctcctccgcctttttgtcngcttcatcggctgtcataaggccaagcttcacaggggcaagagtgatattcttttttattgtaagatgtgggaagaggttgaaatgctgaaaaaccatgcccattctctgtctgagcttgttcatttcatgctcgttcgcctgagtgatgttctcgccctcgaagaanatatcacctgaggtcggcttttccataaggttaagacagcggagaaaggtggattttcctgagcctgacggaccaacgataacgaccttttcgcccttntcgatagtttcgtttatatctttcagcacttcgacctcgccgaaagacttgctgagatgtttaacgtctatcactttgcgacagcctcctttcaagctttcctaccagatgagtaagcacaactaccattataaggtaaataagtgcaactgttataagcggcatgaatgccgagaacgtctgagaacggattatatctccgccctttgtaaggtcctgaattgcgatatatcctgcaacagaggtttctttaagcaaaactatgcactcgtttgcaagggcaggcagaacagttttnaaagcctgcggaagaactattgatatcattgtctgacgatagctaaggccaaggcttcttcctgcttcaaactgaccgttgtcaactgacatgatacctgaacggactatctcagccacatatgcgcctgagttcacgccgaatgcaagcacagccacaagagtcttgtctatgttcacncttccaaaaataacaaaatatgttataaggagctgaactaccataggagttcctcttatcactgtaagatacactctgcaaagggcgttgagtatcttcattttgcctgtcttatcatgagtagagcggactatagccacaagaaatcccaacacaaagccaagtatgaccgcaaagaaggttatgataagtgttgttttaagaccattggtaagataatgccaacggctctcgtccaaaaaattttgctggaaatcgtcgatcaatttgttcaattcagcacttcctgttctttatcaaaataatttcggctgccgctctacgacagccgaagtgtgaaaaattatttctttcttacgattattacctgacttgatgatgtgtaagtgtcagagaaaagaacgtttttctctctgtcaggtgtaactgtcatacctgcaacgccaacgtctgccttgcctgactgaacggctgagatgatagaatcaaatgccatatcgtctatcttaagctcataaccaagcttgtcgcaaactgcctgcatcatatcagcgtcgataccaacgaccttatcgttctctttgctctcgtatggagggaactcagcgtttgttgccattacaagcgtacccttatctctgctaacattatcaggggacttgtatgggttcttgccagcgttctcgccaacgtagtttgccttgatagcgtcaagtgttccgtcagccttaagctccttgagngcaccgttgacagctgtctgaagctcagtgttgtcaagcttcatagcgatagcgtattcttcctcagcaaaaggctcgtcaagtatttcaagatcgtcnttcttctcaacgaataccttagcaggctcagcgtcgattataacagcgtctatcttgccctgcttcagagcctgaacagcntcagcgcccttgttgtatttttctaccttagcgtccttaacgtcctcggcatagatntcgcctgttgttccaagctgaacaccgatagtcttgccctccagatcgtcaacgctgtgaactgtattagcaggcactccgcagcctgcaagcattgtaacgctcattgccactgcaataagtcctgctgcaaatttcttcataacatacattcctttcaaaaattgatagcgacagccctccnataccgactgtgcataaacctatatcatatattataactgaacacacggctttttgcaatagcttttatcagtgatttaatatataaattatgaattttttgttttgccaaaccattttagtaaacaaaaaaggtatccncccaatggggacacctctttgtgaaaatcagcttagaaattcattgtgaactgaactctgtggttgccgtctgcgtcatcatctatcatttcagcctttacgatagtgataggcgtaacaggctttgactgtgcgttgtctgaacctgttgttctctcaactttaagaaagtcatcaacaacgtccatgccctctgttaccatgccgaaagccgcatactgnccgtcaaggaangtatccttatcgctgtagcagataaagaactggcttgaagcactgtccatatcgnttgctcttgccattgaaacaacgcctcttgtatggctcaggctgttttcaacgccatttgctgagaactcgcccttgatagtttccttgcttccgcctgtgccgtcnccgttagggtcaccgccctgtgccataaagccgtctacaactctatggaaagtaagtccgtcatagaacttttcctttaccagcttctcgaagttctcgcaggtgataggtgcgtcattggcataaagcgtgataacgaacttcttgtcagtgtcagccgcagaggtctgtgatgagctgtcncccttatctccgcaggctgtaagaantgcgcaggcaagcacgcctgctgtgcaaagagccaatgctctgaatagctttttaagtttcatttttatcgtcctttcgatcattattaatggcanttctgcctt

SEQ ID NO: 905 - DNA, 4000 bp, Escherichia coli
  misc_feature (5)..(5): n is a, c, g, or t
  misc_feature (8)..(10): n is a, c, g, or t
  misc_feature (13)..(14): n is a, c, g, or t
  misc_feature (16)..(16): n is a, c, g, or t
  misc_feature (18)..(18): n is a, c, g, or t
  misc_feature (26)..(27): n is a, c, g, or t
  misc_feature (29)..(31): n is a, c, g, or t
  misc_feature (34)..(34): n is a, c, g, or t
  misc_feature (39)..(39): n is a, c, g, or t
  misc_feature (42)..(42): n is a, c, g, or t
  misc_feature (44)..(44): n is a, c, g, or t
  misc_feature (48)..(48): n is a, c, g, or t
  misc_feature (52)..(52): n is a, c, g, or t
  misc_feature (54)..(56): n is a, c, g, or t
  misc_feature (61)..(61): n is a, c, g, or t
  misc_feature (65)..(69): n is a, c, g, or t
  misc_feature (72)..(72): n is a, c, g, or t
  misc_feature (75)..(75): n is a, c, g, or t
  misc_feature (77)..(79): n is a, c, g, or t
  misc_feature (82)..(82): n is a, c, g, or t
  misc_feature (85)..(85): n is a, c, g, or t
  misc_feature (93)..(94): n is a, c, g, or t
  misc_feature (96)..(98): n is a, c, g, or t
  misc_feature (104)..(104): n is a, c, g, or t
  misc_feature (107)..(107): n is a, c, g, or t
  misc_feature (109)..(110): n is a, c, g, or t
  misc_feature (114)..(115): n is a, c, g, or t
  misc_feature (118)..(118): n is a, c, g, or t
  misc_feature (121)..(122): n is a, c, g, or t
  misc_feature (124)..(125): n is a, c, g, or t
  misc_feature (130)..(131): n is a, c, g, or t
  misc_feature (137)..(138): n is a, c, g, or t
  misc_feature (140)..(140): n is a, c, g, or t
  misc_feature (146)..(146): n is a, c, g, or t
  misc_feature (152)..(153): n is a, c, g, or t
  misc_feature (157)..(158): n is a, c, g, or t
  misc_feature (161)..(161): n is a, c, g, or t
  misc_feature (169)..(169): n is a, c, g, or t
  misc_feature (171)..(171): n is a, c, g, or t
  misc_feature (179)..(179): n is a, c, g, or t
  misc_feature (182)..(184): n is a, c, g, or t
  misc_feature (189)..(190): n is a, c, g, or t
  misc_feature (195)..(195): n is a, c, g, or t
  misc_feature (203)..(205): n is a, c, g, or t
  misc_feature (207)..(207): n is a, c, g, or t
  misc_feature (219)..(219): n is a, c, g, or t
  misc_feature (221)..(221): n is a, c, g, or t
  misc_feature (223)..(223): n is a, c, g, or t
  misc_feature (225)..(228): n is a, c, g, or t
  misc_feature (233)..(233): n is a, c, g, or t
  misc_feature (237)..(237): n is a, c, g, or t
  misc_feature (239)..(239): n is a, c, g, or t
  misc_feature (242)..(242): n is a, c, g, or t
  misc_feature (253)..(253): n is a, c, g, or t
  misc_feature (256)..(258): n is a, c, g, or t
  misc_feature (261)..(261): n is a, c, g, or t
  misc_feature (263)..(263): n is a, c, g, or t
  misc_feature (267)..(268): n is a, c, g, or t
  misc_feature (271)..(271): n is a, c, g, or t
  misc_feature (275)..(277): n is a, c, g, or t
  misc_feature (285)..(285): n is a, c, g, or t
  misc_feature (289)..(290): n is a, c, g, or t
  misc_feature (294)..(294): n is a, c, g, or t
  misc_feature (297)..(297): n is a, c, g, or t
  misc_feature (302)..(302): n is a, c, g, or t
  misc_feature (306)..(307): n is a, c, g, or t
  misc_feature (310)..(312): n is a, c, g, or t
  misc_feature (315)..(315): n is a, c, g, or t
  misc_feature (321)..(321): n is a, c, g, or t
  misc_feature (325)..(325): n is a, c, g, or t
  misc_feature (327)..(327): n is a, c, g, or t
  misc_feature (331)..(331): n is a, c, g, or t
  misc_feature (334)..(334): n is a, c, g, or t
  misc_feature (338)..(339): n is a, c, g, or t
  misc_feature (343)..(343): n is a, c, g, or t
  misc_feature (354)..(354): n is a, c, g, or t
  misc_feature (360)..(360): n is a, c, g, or t
  misc_feature (365)..(367): n is a, c, g, or t
  misc_feature (371)..(371): n is a, c, g, or t
  misc_feature (376)..(376): n is a, c, g, or t
  misc_feature (388)..(388): n is a, c, g, or t
  misc_feature (395)..(395): n is a, c, g, or t
  misc_feature (399)..(399): n is a, c, g, or t
  misc_feature (404)..(404): n is a, c, g, or t
  misc_feature (478)..(478): n is a, c, g, or t
  misc_feature (888)..(888): n is a, c, g, or t
  misc_feature (1277)..(1277): n is a, c, g, or t
  misc_feature (1985)..(1985): n is a, c, g, or t
  misc_feature (1995)..(1995): n is a, c, g, or t
  misc_feature (2142)..(2142): n is a, c, g, or t
  misc_feature (3023)..(3023): n is a, c, g, or t
  misc_feature (3341)..(3341): n is a, c, g, or t
  misc_feature (3660)..(3660): n is a, c, g, or t
  misc_feature (3750)..(3750): n is a, c, g, or t
tttanttnnnaannananacaacaanngnnncanttttntcncntatntcantnnntactncctnnnnntantanannnacnatngttggggnncnnnaaacanaanannaatnncanatnntnnttcannaacctnntnaattgnatatannttannatntaataaantntacggagnacnnnacacnnttatntatacttnnncnttggcaaaaagnanangnnnntgggntgtntntgntgaattatttngannnaantntaannaanaatnnncaaatagntatnncttnggnttaanttannttnnnaangaaaanattnantttnatntttnnttgngaaagggattnaataanaaaannnattnttttnctttgggtgtangttgganttangattnaaataaataagtaaatcaatcacagtcacagcttccgtttccacagcccttttctggtttttgaaaaaagaatnttttagataaatatccaattgagattagaactgccaaaatggtaagtattatttgaatcatcgtttacgaaataatttgataaacaaataatgcacaaaaatatgctattagcgtcattattattaattgtagtataggccatttccaactgttggtttcctttttaacaatagctaatgtactcatacattgcattgcaaaagcataaaaaatcattaatgatattccagaagctaatccaaataccggctgtccatcttcacgaacttcattagccattctttcttttatggtttcttcttgatctccttgaacactatatattgttgccaaagttccaacaaaaacttccctggctgcaaaagatgtaactatagctattccaattttccagtcatatccaagtggncttataagaggctctatacttttgcccattgccccaagtaatgaatgttctaatttgtgtgaacttaatttgttttcaaattcgtcaacagaactatagttttcgacgactatgattttttcagcattattaaattgatctccaacaccaacagacgcaagcccccaaagtaatattgaaatagccataataattttacctgcctcaaaaacaaatgactttgttttttcaaaaactgtaaaaaaaacatttcttaaaagaggaaacttataatttggcatttcaacaacaaaaaatgttttagatctaattttaagaatattatttaaaatttttgctgaaaaaattgcagcaaaaaatcctaataagtatagccccatgagagttantccttgagcatttacacctaaaaatctttcatcgggaataactaatgaaatcaaaatcaagtatactggcagtctagctgagcatgtagtaaaaggagttactagaattgtaataagtctttctttccagttttcaatatttcgagttgccataatagctggaattgcacaagctgttccagaaattagaggaactatacttttaccgcttaaaccatattttctcataactctatccataagaaaaacaacacgactcatgtatccagtttcttcaagaattgaaataaataaaaataagaacgcgatttgaggaatgaaaattacaatgccgccaaccccaggaataattccttcagaaagtaagcttgtaaagactccctcaggtaaagtgttttttaccatcgaacttaacttgctaaaagcactatcaatagcatccattggataactgctccaatcaaaaatagcttgaaaaatggttaataatattataaaaaatatagcgtagccccaaaatttgtgaattaaaattttatctaatttagagccaaaatcactagctaatttaggatcatgaacgtaagactctttcaaaacattattaataaactgatatcttttaatagtttctttttgctgtaatctctttaaataagaaacagattttgtttgaaaagtagatgaatcatttaccacttctctatncaaattcccnaaatttacatcttgagtaataactaaccaaagtttataaattgattgatcaggaaaagttttttttaagctcttaaaatattcttcatcaatattaattatatctaaacactgattagtttctagttttttataattagttattatnttttttagatcattcaatccctttttttctcttgaactgtatagaataactttagtaccaagatgtttttctaaaacagaaatatcaatagaaattccttttcttttcataacatctgacatgttaataacaaggattgaaggaatgtttaaatctttaatttgagtaaatagtaagagatttcttttcaaattttcaacatcagatattacaactgcaacatcaggaaaatctttatcatttttatttaataatagttctattacaacactttcatctagtgaagatgcatttaagctataagttccaggaagatctagtatgtgtgctttaactcccctttccaacttacaaataccttcctttttttcaactgttattccaggataatttcccactttttgatttaagccggttaaatcattaaaaactgatgattttcctgtatttggatttccaataagagcaacagttagtcttttactcattactggattttttaataataatataatttgcggtttctcttctgatcgctaatctagttccatttacatctaagtacatgggatctttaaatggagcaaattgtaataatttaatagtattacctggaagacatcccatttcaattaatttcaatggaatataatctgtgattatatcttcaataatacctgattcccccttttttaaatcgtttaaagtcaatgttctttatttagaatgattttaaagaagcaaaagtaaactattttttattttataaattattaatttaatctaaatatgaattctgtaggatcttcacatcttttaataatttgttcatttcaacttcattagttccatcataaaatccgcggattctattttctttntcaattagaacaaaattttcggtatgaatcatatcatattttccaccatctccatcattttttgctactaaaaaagattttctagcaagctcgtaaatatcttttttgcttccagtaaacaaattccatttagaatcgtcaactccctttaagtcagcataagctcttaaaacactaactgaatcaatattaggagttaccgaaaacgaaactaacaaaacatcagtttgattttttaactcattttgcaaatagcccatattctctgtcatttttgggcaaatgtcagggcatgtagtaaagaaaaagtctgctatntatattttattttgataaaattcttgattaataagctctccattttgattagttagtgaaaaattactgatgctatgatatttcttaacatatctaatatcttcttcaactagttcttcagaaaccattgaaggactgtaaataggcaaacttacttttggttgtaatataaaataaaaagaagttattacaacaattgaaaaaaaactcattataaaaataacaggtccatatcttttaaaaaactttttgtaactggctgatatattcaaaataaacggtttaagagttcattaaatcttcaatttcctcaacttcnattggaatatttttcatgagattgattggttctgaattttcttgaacaacaacatcatcttcaagtcttatgccaaaattttctttaggnagataaatccctggctctacagtaaaaaccatgtttttagtaataggatagcttaagtctccatagtcatgagtgtctaatcctaaattatgagaaactccatgtgtaaaatattttttaaaagcaggattttctttagtttgattttgaatatcactttttgataaaagacctaatttcaataattcagaactcattattttaccgacttcattgtaatgatctttccaaataactcctggttttaata

SEQ ID NO: 906 - DNA, 4000 bp, Escherichia coli
  misc_feature (1612)..(1612): n is a, c, g, or t
  misc_feature (1988)..(1988): n is a, c, g, or t
  misc_feature (1992)..(1992): n is a, c, g, or t
  misc_feature (2016)..(2016): n is a, c, g, or t
  misc_feature (2423)..(2423): n is a, c, g, or t
actaaaaaatgggaaatgactgatgtctggagtagttgctggaaatgactccgatcttgccctttctcaacaggcactcaaaaacttgggttccaaacgcaagatcaaaggctttacgcaaccattttcgccacaaactcagtttttattaggagtacgaaattctatctatatatttctatccatttattcaactccatgagaattatcacaaaatattcacaatctgcctctatctttagaaaaaattggttaatcattggggttcctgtgagcgatcaagggtgcaacattttttccaggcatgtttagccgatcgtggcacgttggatagcggatgtagaacgcaggttgcccgtcgccgctccccttgtacagaaaccatcagctaacgatcgctgacgtacatgccatcgtacacaagtgaaacctacatctatggagtaacaactactatgaccctggcacacaatccacccgccccaaccaaacttggcttacccatagttagtgaaatttgccctgttggcagtttgggccgatcgtgcggcagcctgctcagtaatagcattgcctcccacctcaaaatggggagccaagccatcctcatcgacctgaaagaggttcccttcatcgacagcagtggcttagggggattggttaaagcgctaaaactgctaaggaagcaccaagtcagactgagtttatgttccctcaatggtcagattcggatgcttttagaactgactcaactacaccagttgtttgaaatccttgatagtaagcaggaattctacagcaagtacaccaactatgctctgttgactgagaaagatggctacattgtgcggcaacttcatgccagctagcaaatgccctataacgcttatgaagaatagtttatgggtaactactcagcctaccctcaccctaaatccctctccctagggagagggacttcaatccggctccccttctcccatgggagaaggggctgggggatgagggcggctcgacactgagttagtggactgagtaattacgtttatggaataaatcatctcttcgcggtgtaaatatcttaacctgggtgtagcaattattaagtacaaattaataagtcagtgtatagggtaccttaatgccctgacgtttacccccatacaggttaaagtagctgtagcgaaattatcaggtatctgggaacttaagcacaatggcactgaaggcgttgctccgtcagctatccccctctcccacaaactccccacgtcagactaagcctcagccatctaatctcttcagccggatgcctctgcgcctcattttgattgtgccctttgtgctacaagtctctgcggctgtaggattagtaggctttttgtcgtttaggaatgggcagaaagccgtcagcagcctggcgaatcaactcatgaatgaggtgagcctgcgggttgatcaacatttgacaggctatctgagttcggctcagcaagtcaacttcattaatcggagtgcagtccaggcagggttgctcaactttcaaaatgctgagaggacgggcaaatacttctggaaacaactacaagtttatgatttcgcctacatcaanctaggacatgtggaaactaatgaatttattggggctggctatgtgaatggcaagatggaaattgctgagtcgtttaagcctcagaaagggacgctctatgcctatgctcccgatgcttgggggaatcgcatttacccacctgccaatatttacaaagatacgaacccgaatctagaagcctggtataccaatgcagttgcggctggtaagctgacctggagtgcaatttatgcttgggaaggtgtggaaaccaccctggcaatttcagccagttcccccgtttacgatacgtctgggaagttggttgctgtgactggggttgacctgagtattgccaagatcgatgagtttttgagcaagttagaagttgccaaangggnaaaaatcttcattgtggaacgttngggggcattggtagctcagtctggtcgtcaatcgtaccagatttggcaaggacaggccacacgattgaacgccagggacagtagcgatcgagtaacgcaaaatacgatgcagtacttgagtcagcaatttcctgatttgaacgcaattcaggttccgcagcaacgtgtctctgagattgaggggcaacggcggtttgtgcaagtcacgccctaccgcgatcggtttgggctggattggctgattgttgtggtcattccagaatccaactttatgcagcaagtggatgaaaataatcgcacaacagtgttgctctgtttcctggctttagtcgccacggtagtgttaggtattatcacctcccgctggatttctgggccgattcttcagttaagcctggcttcagagncgatcgcccaaggcgcacgcaacgccaatgctaatggagaattaaaccaggagattccggtgaggggagccaaggagctaagaaccttggcggggtcttttaaccatatggctcgccagttaaaagcgtcttttaatgaactggaagaatataatgctgaactagagcagcgggtagaccagagaaccagggaactcagattgtctgaaacccaattgcaggtgcaagcccagcacttggagcagacgctctatgaactccagcagacgcaagtgcaaatggtgcaaagtgaaaaaatgtctagcctggggcaaatggtggctggagttgcccacgagattaataatccggttaactttatttatggcaacttggtctatgcggatgaatatgtcaaggaattactagacctagtgaaactctatcaacagcactatccccaccccccagccgccttacaagcaaaattgcaggcgatcgaccctgagttcttgcaagaggatctgattaagttatttcgctctatgaacataggcacaacccggattcgtgagattgtcaaatccctacgcaacttttcgcggctggatgaatcggagatgaagccagttgatattcatgaaggcattgacagtacgttaattattcttcatcatcgctttaagtctcctaagttgcagtcctcagaaatttcagttgtgaaaacgtatgggactttgccactggtggagtgctatccggggccgctcaatcaagtgttcatgaaccttttaagcaatgcgatcgatgccttggaagaggagatgaggcagggcagtgtcctttcgccgacgatcaccattaccacgaccactgagaaccattgggtgacgattcggattgctgataatggagccggaattgatgcagccgtgcaatctaagctgtttgacccctttttcaccacaaagcccgtagggcagggaaccggtttgggactatccattagctaccaaattattgtagagaagcatgggggcagaatcagttgtcaatcggcacctatccacggcgcagagtttgtgattgaaattccgatcgagcaagaggcttcccagttcgcaaaaaatgtaacgactactgcttgaatcgcttgcttgaattgctgatgccttaaattgatacagaatgagcagactaatcacagcgatcgatagatatggctgttcagaaagggaggtagtgggaaacggctgaaaatggattacactcaagctggactttctctacgatcgccctttacttatccccccctaccatgaacgtcaaccgccgtcgatttcttgccctcctcagcgttagtggcttaggtatagctgctttttggaagttattgcggagtcaggcggctcaacgccaagtctccaccttggtgcccccatcaacccaagccgctgtagccagtaccccaaagaatcgttcagaagctagccccagcgctgccaaagatacgccactgttgcgcttcatcgcggttgctgacacaggcactgggggagaaggacagtatgctgtcgccaaggcgatgacccactacc

SEQ ID NO: 907 - DNA, 4000 bp, Escherichia coli
  misc_feature (338)..(338): n is a, c, g, or t
  misc_feature (538)..(538): n is a, c, g, or t
  misc_feature (616)..(616): n is a, c, g, or t
  misc_feature (619)..(623): n is a, c, g, or t
  misc_feature (625)..(626): n is a, c, g, or t
  misc_feature (628)..(629): n is a, c, g, or t
  misc_feature (634)..(634): n is a, c, g, or t
  misc_feature (637)..(637): n is a, c, g, or t
  misc_feature (646)..(646): n is a, c, g, or t
  misc_feature (650)..(652): n is a, c, g, or t
  misc_feature (661)..(661): n is a, c, g, or t
  misc_feature (685)..(685): n is a, c, g, or t
  misc_feature (692)..(692): n is a, c, g, or t
  misc_feature (694)..(694): n is a, c, g, or t
  misc_feature (886)..(886): n is a, c, g, or t
  misc_feature (892)..(892): n is a, c, g, or t
  misc_feature (898)..(898): n is a, c, g, or t
  misc_feature (908)..(908): n is a, c, g, or t
  misc_feature (925)..(925): n is a, c, g, or t
  misc_feature (928)..(930): n is a, c, g, or t
  misc_feature (942)..(942): n is a, c, g, or t
  misc_feature (950)..(951): n is a, c, g, or t
  misc_feature (964)..(964): n is a, c, g, or t
  misc_feature (966)..(966): n is a, c, g, or t
  misc_feature (1060)..(1060): n is a, c, g, or t
  misc_feature (1063)..(1064): n is a, c, g, or t
  misc_feature (1072)..(1072): n is a, c, g, or t
  misc_feature (1075)..(1075): n is a, c, g, or t
  misc_feature (1117)..(1117): n is a, c, g, or t
  misc_feature (1123)..(1123): n is a, c, g, or t
  misc_feature (1129)..(1129): n is a, c, g, or t
  misc_feature (1240)..(1240): n is a, c, g, or t
  misc_feature (1246)..(1246): n is a, c, g, or t
  misc_feature (1249)..(1249): n is a, c, g, or t
  misc_feature (1727)..(1727): n is a, c, g, or t
  misc_feature (1844)..(1844): n is a, c, g, or t
  misc_feature (1873)..(1873): n is a, c, g, or t
  misc_feature (1925)..(1925): n is a, c, g, or t
  misc_feature (1975)..(1976): n is a, c, g, or t
  misc_feature (1978)..(1986): n is a, c, g, or t
  misc_feature (1988)..(1993): n is a, c, g, or t
  misc_feature (1995)..(1996): n is a, c, g, or t
  misc_feature (1998)..(2001): n is a, c, g, or t
  misc_feature (2050)..(2053): n is a, c, g, or t
  misc_feature (2057)..(2064): n is a, c, g, or t
  misc_feature (2066)..(2068): n is a, c, g, or t
  misc_feature (2070)..(2071): n is a, c, g, or t
  misc_feature (2073)..(2075): n is a, c, g, or t
  misc_feature (2077)..(2078): n is a, c, g, or t
  misc_feature (2127)..(2127): n is a, c, g, or t
  misc_feature (2130)..(2131): n is a, c, g, or t
  misc_feature (2133)..(2136): n is a, c, g, or t
  misc_feature (2138)..(2142): n is a, c, g, or t
  misc_feature (2145)..(2146): n is a, c, g, or t
  misc_feature (2148)..(2152): n is a, c, g, or t
  misc_feature (2155)..(2155): n is a, c, g, or t
  misc_feature (2205)..(2206): n is a, c, g, or t
  misc_feature (2208)..(2211): n is a, c, g, or t
  misc_feature (2213)..(2214): n is a, c, g, or t
  misc_feature (2216)..(2220): n is a, c, g, or t
  misc_feature (2222)..(2232): n is a, c, g, or t
  misc_feature (2280)..(2280): n is a, c, g, or t
  misc_feature (2282)..(2282): n is a, c, g, or t
  misc_feature (2284)..(2287): n is a, c, g, or t
  misc_feature (2289)..(2297): n is a, c, g, or t
  misc_feature (2300)..(2303): n is a, c, g, or t
  misc_feature (2305)..(2309): n is a, c, g, or t
  misc_feature (2352)..(2352): n is a, c, g, or t
  misc_feature (2356)..(2360): n is a, c, g, or t
  misc_feature (2362)..(2370): n is a, c, g, or t
  misc_feature (2372)..(2382): n is a, c, g, or t
  misc_feature (2385)..(2386): n is a, c, g, or t
  misc_feature (2388)..(2388): n is a, c, g, or t
  misc_feature (2390)..(2390): n is a, c, g, or t
  misc_feature (2396)..(2397): n is a, c, g, or t
  misc_feature (2400)..(2400): n is a, c, g, or t
  misc_feature (2402)..(2403): n is a, c, g, or t
  misc_feature (2407)..(2407): n is a, c, g, or t
  misc_feature (2409)..(2409): n is a, c, g, or t
  misc_feature (2411)..(2413): n is a, c, g, or t
  misc_feature (2422)..(2423): n is a, c, g, or t
  misc_feature (2427)..(2427): n is a, c, g, or t
  misc_feature (2433)..(2444): n is a, c, g, or t
  misc_feature (2446)..(2446): n is a, c, g, or t
  misc_feature (2448)..(2453): n is a, c, g, or t
  misc_feature (2455)..(2465): n is a, c, g, or t
  misc_feature (2467)..(2467): n is a, c, g, or t
  misc_feature (2469)..(2469): n is a, c, g, or t
  misc_feature (2471)..(2474): n is a, c, g, or t
  misc_feature (2476)..(2481): n is a, c, g, or t
  misc_feature (2484)..(2484): n is a, c, g, or t
  misc_feature (2486)..(2490): n is a, c, g, or t
  misc_feature (2492)..(2492): n is a, c, g, or t
  misc_feature (2496)..(2496): n is a, c, g, or t
  misc_feature (2499)..(2501): n is a, c, g, or t
  misc_feature (2504)..(2508): n is a, c, g, or t
  misc_feature (2510)..(2526): n is a, c, g, or t
  misc_feature (2528)..(2529): n is a, c, g, or t
  misc_feature (2531)..(2542): n is a, c, g, or t
  misc_feature (2544)..(2551): n is a, c, g, or t
  misc_feature (2553)..(2558): n is a, c, g, or t
  misc_feature (2561)..(2567): n is a, c, g, or t
  misc_feature (2569)..(2569): n is a, c, g, or t
  misc_feature (2573)..(2573): n is a, c, g, or t
  misc_feature (2576)..(2578): n is a, c, g, or t
  misc_feature (2581)..(2585): n is a, c, g, or t
  misc_feature (2587)..(2590): n is a, c, g, or t
  misc_feature (2592)..(2592): n is a, c, g, or t
  misc_feature (2594)..(2600): n is a, c, g, or t
  misc_feature (2603)..(2609): n is a, c, g, or t
  misc_feature (2611)..(2615): n is a, c, g, or t
  misc_feature (2617)..(2617): n is a, c, g, or t
  misc_feature (2621)..(2627): n is a, c, g, or t
  misc_feature (2630)..(2634): n is a, c, g, or t
  misc_feature (2638)..(2639): n is a, c, g, or t
  misc_feature (2642)..(2642): n is a, c, g, or t
  misc_feature (2653)..(2654): n is a, c, g, or t
  misc_feature (2658)..(2659): n is a, c, g, or t
  misc_feature (2664)..(2669): n is a, c, g, or t
  misc_feature (2671)..(2681): n is a, c, g, or t
  misc_feature (2683)..(2684): n is a, c, g, or t
  misc_feature (2686)..(2694): n is a, c, g, or t
  misc_feature (2698)..(2704): n is a, c, g, or t
  misc_feature (2707)..(2711): n is a, c, g, or t
  misc_feature (2715)..(2716): n is a, c, g, or t
  misc_feature (2719)..(2719): n is a, c, g, or t
  misc_feature (2730)..(2731): n is a, c, g, or t
  misc_feature (2735)..(2736): n is a, c, g, or t
  misc_feature (2742)..(2751): n is a, c, g, or t
  misc_feature (2753)..(2764): n is a, c, g, or t
  misc_feature (2766)..(2768): n is a, c, g, or t
  misc_feature (2770)..(2772): n is a, c, g, or t
  misc_feature (2774)..(2774): n is a, c, g, or t
  misc_feature (2776)..(2776): n is a, c, g, or t
  misc_feature (2778)..(2781): n is a, c, g, or t
  misc_feature (2783)..(2788): n is a, c, g, or t
  misc_feature (2791)..(2791): n is a, c, g, or t
  misc_feature (2793)..(2797): n is a, c, g, or t
  misc_feature (2799)..(2799): n is a, c, g, or t
  misc_feature (2803)..(2803): n is a, c, g, or t
  misc_feature (2807)..(2808): n is a, c, g, or t
  misc_feature (2812)..(2815): n is a, c, g, or t
  misc_feature (2817)..(2834): n is a, c, g, or t
  misc_feature (2836)..(2847): n is a, c, g, or t
  misc_feature (2849)..(2850): n is a, c, g, or t
  misc_feature (2852)..(2866): n is a, c, g, or t
  misc_feature (2869)..(2872): n is a, c, g, or t
  misc_feature (2874)..(2874): n is a, c, g, or t
  misc_feature (2876)..(2876): n is a, c, g, or t
  misc_feature (2880)..(2881): n is a, c, g, or t
  misc_feature (2885)..(2886): n is a, c, g, or t
  misc_feature (2889)..(2891): n is a, c, g, or t
  misc_feature (2894)..(2896): n is a, c, g, or t
  misc_feature (2898)..(2905): n is a, c, g, or t
  misc_feature (2907)..(2912): n is a, c, g, or t
  misc_feature (2914)..(2927): n is a, c, g, or t
  misc_feature (2929)..(2929): n is a, c, g, or t
  misc_feature (2931)..(2942): n is a, c, g, or t
  misc_feature (2946)..(2953): n is a, c, g, or t
  misc_feature (2957)..(2957): n is a, c, g, or t
  misc_feature (2961)..(2962): n is a, c, g, or t
  misc_feature (2965)..(2968): n is a, c, g, or t
  misc_feature (2970)..(2982): n is a, c, g, or t
  misc_feature (2984)..(2986): n is a, c, g, or t
  misc_feature (2988)..(3003): n is a, c, g, or t
  misc_feature (3006)..(3006): n is a, c, g, or t
  misc_feature (3010)..(3010): n is a, c, g, or t
  misc_feature (3012)..(3012): n is a, c, g, or t
  misc_feature (3014)..(3014): n is a, c, g, or t
  misc_feature (3017)..(3019): n is a, c, g, or t
  misc_feature (3023)..(3023): n is a, c, g, or t
  misc_feature (3025)..(3025): n is a, c, g, or t
  misc_feature (3027)..(3027): n is a, c, g, or t
  misc_feature (3030)..(3030): n is a, c, g, or t
  misc_feature (3034)..(3034): n is a, c, g, or t
  misc_feature (3038)..(3039): n is a, c, g, or t
  misc_feature (3042)..(3043): n is a, c, g, or t
  misc_feature (3046)..(3046): n is a, c, g, or t
  misc_feature (3050)..(3058): n is a, c, g, or t
  misc_feature (3060)..(3065): n is a, c, g, or t
  misc_feature (3067)..(3069): n is a, c, g, or t
  misc_feature (3071)..(3073): n is a, c, g, or t
  misc_feature (3075)..(3080): n is a, c, g, or t
  misc_feature (3082)..(3082): n is a, c, g, or t
  misc_feature (3084)..(3097): n is a, c, g, or t
  misc_feature (3099)..(3104): n is a, c, g, or t
  misc_feature (3106)..(3107): n is a, c, g, or t
  misc_feature (3111)..(3111): n is a, c, g, or t
  misc_feature (3115)..(3116): n is a, c, g, or t
  misc_feature (3120)..(3121): n is a, c, g, or t
  misc_feature (3123)..(3127): n is a, c, g, or t
  misc_feature (3129)..(3138): n is a, c, g, or t
  misc_feature (3140)..(3156): n is a, c, g, or t
  misc_feature (3159)..(3173): n is a, c, g, or t
  misc_feature (3176)..(3177): n is a, c, g, or t
  misc_feature (3181)..(3181): n is a, c, g, or t
  misc_feature (3183)..(3184): n is a, c, g, or t
  misc_feature (3187)..(3188): n is a, c, g, or t
  misc_feature (3192)..(3193): n is a, c, g, or t
  misc_feature (3195)..(3195): n is a, c, g, or t
  misc_feature (3197)..(3197): n is a, c, g, or t
  misc_feature (3201)..(3205): n is a, c, g, or t
  misc_feature (3207)..(3207): n is a, c, g, or t
  misc_feature (3209)..(3211): n is a, c, g, or t
  misc_feature (3213)..(3226): n is a, c, g, or t
  misc_feature (3229)..(3235): n is a, c, g, or t
  misc_feature (3237)..(3250): n is a, c, g, or t
  misc_feature (3254)..(3255): n is a, c, g, or t
  misc_feature (3257)..(3262): n is a, c, g, or t
  misc_feature (3264)..(3265): n is a, c, g, or t
  misc_feature (3269)..(3270): n is a, c, g, or t
  misc_feature (3273)..(3276): n is a, c, g, or t
  misc_feature (3278)..(3284): n is a, c, g, or t
  misc_feature (3286)..(3299): n is a, c, g, or t
  misc_feature (3301)..(3301): n is a, c, g, or t
  misc_feature (3303)..(3327): n is a, c, g, or t
  misc_feature (3330)..(3332): n is a, c, g, or t
  misc_feature (3334)..(3335): n is a, c, g, or t
  misc_feature (3337)..(3337): n is a, c, g, or t
  misc_feature (3339)..(3343): n is a, c, g, or t
  misc_feature (3346)..(3348): n is a, c, g, or t
  misc_feature (3350)..(3357): n is a, c, g, or t
  misc_feature (3359)..(3361): n is a, c, g, or t
  misc_feature (3364)..(3368): n is a, c, g, or t
  misc_feature (3371)..(3377): n is a, c, g, or t
  misc_feature (3379)..(3382): n is a, c, g, or t
  misc_feature (3384)..(3384): n is a, c, g, or t
  misc_feature (3386)..(3386): n is a, c, g, or t
  misc_feature (3388)..(3388): n is a, c, g, or t
  misc_feature (3390)..(3390): n is a, c, g, or t
  misc_feature (3392)..(3394): n is a, c, g, or t
  misc_feature (3396)..(3396): n is a, c, g, or t
  misc_feature (3399)..(3399): n is a, c, g, or t
  misc_feature (3401)..(3401): n is a, c, g, or t
  misc_feature (3403)..(3403): n is a, c, g, or t
  misc_feature (3405)..(3405): n is a, c, g, or t
  misc_feature (3407)..(3409): n is a, c, g, or t
  misc_feature (3412)..(3413): n is a, c, g, or t
  misc_feature (3415)..(3420): n is a, c, g, or t
  misc_feature (3423)..(3426): n is a, c, g, or t
  misc_feature (3428)..(3429): n is a, c, g, or t
  misc_feature (3431)..(3433): n is a, c, g, or t
  misc_feature (3435)..(3437): n is a, c, g, or t
  misc_feature (3440)..(3446): n is a, c, g, or t
  misc_feature (3448)..(3456): n is a, c, g, or t
  misc_feature (3458)..(3465): n is a, c, g, or t
  misc_feature (3467)..(3467): n is a, c, g, or t
  misc_feature (3469)..(3471): n is a, c, g, or t
  misc_feature (3473)..(3475): n is a, c, g, or t
  misc_feature (3478)..(3480): n is a, c, g, or t
  misc_feature (3482)..(3482): n is a, c, g, or t
  misc_feature (3484)..(3486): n is a, c, g, or t
  misc_feature (3488)..(3491): n is a, c, g, or t
  misc_feature (3493)..(3496): n is a, c, g, or t
  misc_feature (3500)..(3501): n is a, c, g, or t
  misc_feature (3503)..(3503): n is a, c, g, or t
  misc_feature (3505)..(3516): n is a, c, g, or t
  misc_feature (3518)..(3521): n is a, c, g, or t
  misc_feature (3523)..(3524): n is a, c, g, or t
  misc_feature (3526)..(3536): n is a, c, g, or t
  misc_feature (3539)..(3540): n is a, c, g, or t
  misc_feature (3542)..(3542): n is a, c, g, or t
  misc_feature (3544)..(3544): n is a, c, g, or t
  misc_feature (3546)..(3548): n is a, c, g, or t
  misc_feature (3550)..(3550): n is a, c, g, or t
  misc_feature (3552)..(3557): n is a, c, g, or t
  misc_feature (3559)..(3559): n is a, c, g, or t
  misc_feature (3561)..(3563): n is a, c, g, or t
  misc_feature (3565)..(3567): n is a, c, g, or t
  misc_feature (3569)..(3573): n is a, c, g, or t
  misc_feature (3577)..(3578): n is a, c, g, or t
  misc_feature (3580)..(3592): n is a, c, g, or t
  misc_feature (3594)..(3605): n is a, c, g, or t
  misc_feature (3607)..(3614): n is a, c, g, or t
  misc_feature (3616)..(3617): n is a, c, g, or t
  misc_feature (3619)..(3619): n is a, c, g, or t
  misc_feature (3621)..(3621): n is a, c, g, or t
  misc_feature (3623)..(3625): n is a, c, g, or t
  misc_feature (3627)..(3627): n is a, c, g, or t
  misc_feature (3629)..(3630): n is a, c, g, or t
  misc_feature (3632)..(3634): n is a, c, g, or t
  misc_feature (3636)..(3636): n is a, c, g, or t
  misc_feature (3638)..(3640): n is a, c, g, or t
  misc_feature (3643)..(3644): n is a, c, g, or t
  misc_feature (3646)..(3650): n is a, c, g, or t
  misc_feature (3654)..(3655): n is a, c, g, or t
  misc_feature (3657)..(3658): n is a, c, g, or t
  misc_feature (3660)..(3680): n is a, c, g, or t
  misc_feature (3683)..(3685): n is a, c, g, or t
  misc_feature (3687)..(3688): n is a, c, g, or t
  misc_feature (3690)..(3691): n is a, c, g, or t
  misc_feature (3694)..(3707): n is a, c, g, or t
  misc_feature (3709)..(3713): n is a, c, g, or t
  misc_feature (3715)..(3715): n is a, c, g, or t
  misc_feature (3717)..(3718): n is a, c, g, or t
  misc_feature (3720)..(3726): n is a, c, g, or t
  misc_feature (3730)..(3731): n is a, c, g, or t
  misc_feature (3733)..(3737): n is a, c, g, or t
  misc_feature (3739)..(3745): n is a, c, g, or t
  misc_feature (3748)..(3752): n is a, c, g, or t
  misc_feature (3754)..(3754): n is a, c, g, or t
  misc_feature (3756)..(3760): n is a, c, g, or t
  misc_feature (3762)..(3773): n is a, c, g, or t
  misc_feature (3775)..(3779): n is a, c, g, or t
  misc_feature (3781)..(3784): n is a, c, g, or t
  misc_feature (3786)..(3788): n is a, c, g, or t
  misc_feature (3790)..(3792): n is a, c, g, or t
  misc_feature (3796)..(3796): n is a, c, g, or t
  misc_feature (3798)..(3798): n is a, c, g, or t
  misc_feature (3800)..(3803): n is a, c, g, or t
  misc_feature (3807)..(3809): n is a, c, g, or t
  misc_feature (3812)..(3831): n is a, c, g, or t
  misc_feature (3833)..(3843): n is a, c, g, or t
  misc_feature (3845)..(3846): n is a, c, g, or t
  misc_feature (3848)..(3850): n is a, c, g, or t
  misc_feature (3853)..(3854): n is a, c, g, or t
  misc_feature (3856)..(3856): n is a, c, g, or t
  misc_feature (3859)..(3861): n is a, c, g, or t
  misc_feature (3863)..(3865): n is a, c, g, or t
  misc_feature (3868)..(3870): n is a, c, g, or t
  misc_feature (3872)..(3873): n is a, c, g, or t
  misc_feature (3875)..(3875): n is a, c, g, or t
  misc_feature (3877)..(3879): n is a, c, g, or t
  misc_feature (3881)..(3881): n is a, c, g, or t
  misc_feature (3884)..(3886): n is a, c, g, or t
  misc_feature (3889)..(3905): n is a, c, g, or t
  misc_feature (3908)..(3927): n is a, c, g, or t
  misc_feature (3929)..(3931): n is a, c, g, or t
  misc_feature (3937)..(3938): n is a, c, g, or t
  misc_feature (3940)..(3942): n is a, c, g, or t
  misc_feature (3944)..(3944): n is a, c, g, or t
  misc_feature (3946)..(3946): n is a, c, g, or t
  misc_feature (3949)..(3950): n is a, c, g, or t
  misc_feature (3954)..(3958): n is a, c, g, or t
  misc_feature (3960)..(3963): n is a, c, g, or t
  misc_feature (3966)..(3970): n is a, c, g, or t
  misc_feature (3972)..(3983): n is a, c, g, or t
  misc_feature (3987)..(3993): n is a, c, g, or t
  misc_feature (3995)..(3998): n is a, c, g, or t
  misc_feature (4000)..(4000): n is a, c, g, or t
agatggaaaacctgtattaggtaattatgtacaaacaagtaacaatcatcatatagctttctataccgatgaaaaaggaaacttgcaagacaaagcagtatctttctttgaagctgccgaacgtaaatcgcaaggtcttcctatcgttgataaaaactataatcacgataagggttggcgtttcttatttactatgaagcaaaacgaatactttgtgttccctaatgaagctacagggtttattcctacggaagtgaatttaatggacgaagccaattatgatatgataagtccaaatctatacagagttcaaaaggtgtcaagaatcgagaaaggancgtctacttcaagggattactggtttagacatcacttagaaactattctgaatgatgattcaaggcttaagaactctgcgttcaaacgaataaattcattaaagcctttagaaggtatcattaaagtgcgtattaactctattggtaagatagttgcagtaggtgaatacgattaatatagatagcttatgataaagaanacattatgttttagcaatcctgcctatttaagtttacagaatgcacagttagcaattcgtttgcccgaagtagaaacntgnnnnnanntnnctganagntttaaaaancaannngagcgtacnattccaatagaagatattggagtngtactgntngataacaaaagaataaccattacttcgtctctattagaagctttaatagaaaacaactgtgcagttataacttgcgacaataagagtatgcccattggtcttctgcttcctttatgtggcaataaaacacaaagcgaacgcttccgagcgcagatagaggcatcgctaccactaaaaaagcaactatggcancaaacnattaancagaaaatangcaatcaagccaaactnttnnncagatatactanggttgatnntggttgtatgtangnttgggcagacaaagttagaagtggcgaccctgataattttgaagcaagagcagctgcatattattggaaaaatatcttttctgatattcctaanttnntaagaggncgngaaggagaacctcctaataatcttttaaattatggttatgcnatattncgtgcngtagtagcacggtctttagttgccagcggattgcttccaactttaggcattcaccaccataataagtataatgcttattgtcttgccgatgatgtaatggaaccttatcgnccttangtngatggattagtcttagacataatggaatcaacctacgattatagcgaacttacgaaggaaattaaaatgaaacttcttgctattcctgtgctcgatacaaccattggaaataagaagagcccattgatgatagctacacaacaaacaacttcttcgctttacaagtgctttagcggagagcaaagaagaatggtttatccagaattataaatactatttggtggaaacttatagatttagtcaatacagaactatgtggttaatggtattctttgatttacccacagatacaaagaaggaaagaaaggctgctgctgtctttcgtcagaacttaataaaagatgggttcactatgtttcaattttccatctacatacgccattgtggtagtaaagagaatatggaagtacacataaaacgaatatcttcttttattcctgcatacggaaaggttggaattatgggcataacagataancaattcgcagaaataaaactcttctatggacagaaaccacaacttcctaaggctccaggtgcgcagttagaactcttttagtctctctttgaaacaaataaagttccattcgtttanaatggaactttattttgcttgcatttttntatctctcgaaatgctcataatacattaatactaaatgttttaagccaaatnagttgtatatgcctatgcaaagatactaattttaaagcaaatcacaactnntnnnnnnnnnannnnnntnnannnntgttgtatatgcctatgcaaagatactaattttaaagcaaatcacaacnnnnatannnnnnnntnnnanngnnncnnagttgtatatgcctatgcaaagatactaattttaaagcaaatcacaacnaannannnntnnnnnatnntnnnnntanagttgtatatgcctatgcaaagatactaattttaaagcaaatcacaactnnannnnanntnnnnnannnnnnnnnnngttgtatatgcctatgcaaagatactaattttaaagcaaatcacaacnanannnnannnnnnnnntannnntnnnnngttgtatatgcctatgcaaagatactaattttaaagcaaatcncaannnnntnnnnnnnnnannnnnnnnnnnatnngntntatatnnctntnnaaananannnattttaaannaaancacaannnnnnnnnnnngntnnnnnnannnnnnnnnnntntntnnnncnnnnnnaanannnnnantttnaannnaannnnnannnnnnnnnnnnnnnnntnncnnnnnnnnnnnntnnnnnnnncnnnnnnaannnnnnnantttnaannnaannnnnannnnantnnnnnnnttnnnnnnntnnnnntngttnnnnnnnccnnnnnaaanntantaattttaaannaaannacaannnnnnannnnnnnnnnntnntnnnnnnnnngttnnnnnnnccnnnnnaaanntantaattttaaannaaannacaacnnnnnnnnnnannnnnnnnnnnnannntnnntntntnnnncnnnnnnaanannnnnantttnaaannaaannnnannnnnnnnnnnnnnnnnntnnnnnnnnnnnntnntnnnnnnnnnnnnnnnaannnnantntttnnaaannaannnacnnnannnnnnnntnnnnnnannnnnnnnnnnnnntntnnnnnnnnnnnnaaannnnnnnntttnaaannaannnnannnnnnnnnnnnntnnntnnnnnnnnnnnnnnnnttntatntncntannnaaananantantttnaaannaanncanaacnnnnnnnnntnnnnnnannnannntnnnnnntntnnnnnnnnnnnnnnannnnnntnntttnaaannaaannannnnnannnnnnnnnnannnnnnnnnnnnnnnnngtnnnnnnnnnnnnnnnaannatantnnttnnaaannanancacnnnnntntnnntnnnnnnnnnnnnnnagnnnnnnntnnnnnnnnnnnnnnaaannannnnnntnnaaannaannnnannnnnnntnnnnnnnnnnnnnntntnnnnnnnnnnnnnnnnnnnnnnnnnaannnanntntnnnnnaannnannnnnnnntnnnatnnnnntannnnnnntnnnngntntntntnnntntgnanananannnatnntnnnnnnaannnnanncnnnannnttnnnnnnntnnnnnnnnntnnnnnnnntntnnntnnncannnanannnannnnannnnaaannanannnnnnnnnnnntnnnntnntnnnnnnnnnnngtnntntntnnntntnnnnnnanannnannntnnnnnaaannannnnnnnnnnnnntnnnnnnnnnnnnannnnnnnntnntntntnnntntnnannnanannnatnntnnnnnaaannannannnnnnnnnnnnnnnnnnnnnttnnnanngnntgnnnnnnnnnnnnnnannnnnananntnnnnnnnaaannannnnncnnnnnnnttnnnnnantnnnnnannnnnnnnnnnntnnnnntnnnnannnannnatantnannnnaaannnaannnnnnnnnnnnnnnnnnnntnnnnnnnnnnntnntnnntgnntntgnnnannnaannntnntnannntnaannnaannnnnnnnnnnnnnnnnttnnnnnnnnnnnnnnnnnnnntnnntatgcnnannnananatnntaannnnnannnnaannnnnannnnnnnnnnnntaannnnnnntnnnngn

SEQ ID NO: 908 - DNA, 4000 bp, Escherichia coli
  misc_feature (930)..(930): n is a, c, g, or t
  misc_feature (1988)..(1988): n is a, c, g, or t
  misc_feature (2146)..(2146): n is a, c, g, or t
  misc_feature (2149)..(2156): n is a, c, g, or t
  misc_feature (2158)..(2158): n is a, c, g, or t
  misc_feature (2160)..(2160): n is a, c, g, or t
  misc_feature (2162)..(2162): n is a, c, g, or t
  misc_feature (2167)..(2167): n is a, c, g, or t
  misc_feature (2169)..(2172): n is a, c, g, or t
  misc_feature (2174)..(2174): n is a, c, g, or t
  misc_feature (2177)..(2177): n is a, c, g, or t
  misc_feature (2179)..(2179): n is a, c, g, or t
  misc_feature (2181)..(2182): n is a, c, g, or t
  misc_feature (2186)..(2187): n is a, c, g, or t
  misc_feature (2191)..(2192): n is a, c, g, or t
  misc_feature (2194)..(2194): n is a, c, g, or t
  misc_feature (2197)..(2197): n is a, c, g, or t
  misc_feature (2199)..(2200): n is a, c, g, or t
  misc_feature (2202)..(2203): n is a, c, g, or t
  misc_feature (2208)..(2209): n is a, c, g, or t
  misc_feature (2213)..(2215): n is a, c, g, or t
  misc_feature (2218)..(2218): n is a, c, g, or t
  misc_feature (2220)..(2220): n is a, c, g, or t
  misc_feature (2222)..(2222): n is a, c, g, or t
  misc_feature (2224)..(2224): n is a, c, g, or t
  misc_feature (2226)..(2231): n is a, c, g, or t
  misc_feature (2233)..(2234): n is a, c, g, or t
  misc_feature (2237)..(2237): n is a, c, g, or t
  misc_feature (2240)..(2242): n is a, c, g, or t
  misc_feature (2245)..(2245): n is a, c, g, or t
  misc_feature (2247)..(2247): n is a, c, g, or t
  misc_feature (2250)..(2250): n is a, c, g, or t
  misc_feature (2252)..(2253): n is a, c, g, or t
  misc_feature (2256)..(2256): n is a, c, g, or t
  misc_feature (2258)..(2260): n is a, c, g, or t
  misc_feature (2263)..(2263): n is a, c, g, or t
  misc_feature (2265)..(2266): n is a, c, g, or t
  misc_feature (2269)..(2269): n is a, c, g, or t
  misc_feature (2271)..(2271): n is a, c, g, or t
  misc_feature (2273)..(2273): n is a, c, g, or t
  misc_feature (2275)..(2276): n is a, c, g, or t
  misc_feature (2278)..(2278): n is a, c, g, or t
  misc_feature (2282)..(2285): n is a, c, g, or t
  misc_feature (2287)..(2296): n is a, c, g, or t
  misc_feature (2298)..(2304): n is a, c, g, or t
  misc_feature (2308)..(2310): n is a, c, g, or t
  misc_feature (2314)..(2315): n is a, c, g, or t
  misc_feature (2319)..(2320): n is a, c, g, or t
  misc_feature (2322)..(2322): n is a, c, g, or t
  misc_feature (2324)..(2325): n is a, c, g, or t
  misc_feature (2332)..(2336): n is a, c, g, or t
  misc_feature (2338)..(2339): n is a, c, g, or t
  misc_feature (2341)..(2341): n is a, c, g, or t
  misc_feature (2343)..(2344): n is a, c, g, or t
  misc_feature (2347)..(2348): n is a, c, g, or t
  misc_feature (2351)..(2352): n is a, c, g, or t
  misc_feature (2356)..(2358): n is a, c, g, or t
  misc_feature (2360)..(2361): n is a, c, g, or t
  misc_feature (2364)..(2364): n is a, c, g, or t
  misc_feature (2369)..(2375): n is a, c, g, or t
  misc_feature (2378)..(2379): n is a, c, g, or t
  misc_feature (2387)..(2389): n is a, c, g, or t
  misc_feature (2391)..(2400): n is a, c, g, or t
  misc_feature (2402)..(2403): n is a, c, g, or t
  misc_feature (2405)..(2405): n is a, c, g, or t
  misc_feature (2407)..(2409): n is a, c, g, or t
  misc_feature (2411)..(2411): n is a, c, g, or t
  misc_feature (2414)..(2415): n is a, c, g, or t
  misc_feature (2417)..(2419): n is a, c, g, or t
  misc_feature (2422)..(2423): n is a, c, g, or t
  misc_feature (2425)..(2425): n is a, c, g, or t
  misc_feature (2427)..(2427): n is a, c, g, or t
  misc_feature (2430)..(2430): n is a, c, g, or t
  misc_feature (2435)..(2435): n is a, c, g, or t
  misc_feature (2437)..(2439): n is a, c, g, or t
  misc_feature (2441)..(2442): n is a, c, g, or t
  misc_feature (2444)..(2444): n is a, c, g, or t
  misc_feature (2450)..(2452): n is a, c, g, or t
  misc_feature (2454)..(2454): n is a, c, g, or t
  misc_feature (2456)..(2456): n is a, c, g, or t
  misc_feature (2458)..(2459): n is a, c, g, or t
  misc_feature (2463)..(2465): n is a, c, g, or t
  misc_feature (2467)..(2472): n is a, c, g, or t
  misc_feature (2474)..(2476): n is a, c, g, or t
  misc_feature (2479)..(2481): n is a, c, g, or t
  misc_feature (2484)..(2486): n is a, c, g, or t
  misc_feature (2489)..(2490): n is a, c, g, or t
  misc_feature (2492)..(2495): n is a, c, g, or t
  misc_feature (2498)..(2499): n is a, c, g, or t
  misc_feature (2501)..(2501): n is a, c, g, or t
  misc_feature (2503)..(2503): n is a, c, g, or t
  misc_feature (2505)..(2509): n is a, c, g, or t
  misc_feature (2511)..(2511): n is a, c, g, or t
  misc_feature (2514)..(2514): n is a, c, g, or t
  misc_feature (2517)..(2518): n is a, c, g, or t
  misc_feature (2520)..(2521): n is a, c, g, or t
  misc_feature (2523)..(2524): n is a, c, g, or t
  misc_feature (2526)..(2528): n is a, c, g, or t
  misc_feature (2530)..(2530): n is a, c, g, or t
  misc_feature (2532)..(2538): n is a, c, g, or t
  misc_feature (2541)..(2543): n is a, c, g, or t
  misc_feature (2547)..(2547): n is a, c, g, or t
  misc_feature (2549)..(2550): n is a, c, g, or t
  misc_feature (2552)..(2558): n is a, c, g, or t
  misc_feature (2560)..(2561): n is a, c, g, or t
  misc_feature (2563)..(2567): n is a, c, g, or t
  misc_feature (2570)..(2570): n is a, c, g, or t
  misc_feature (2572)..(2572): n is a, c, g, or t
  misc_feature (2574)..(2576): n is a, c, g, or t
  misc_feature (2579)..(2580): n is a, c, g, or t
  misc_feature (2583)..(2584): n is a, c, g, or t
  misc_feature (2587)..(2589): n is a, c, g, or t
  misc_feature (2594)..(2596): n is a, c, g, or t
  misc_feature (2600)..(2600): n is a, c, g, or t
  misc_feature (2602)..(2604): n is a, c, g, or t
  misc_feature (2608)..(2608): n is a, c, g, or t
  misc_feature (2613)..(2614): n is a, c, g, or t
  misc_feature (2616)..(2616): n is a, c, g, or t
  misc_feature (2618)..(2619): n is a, c, g, or t
  misc_feature (2621)..(2621): n is a, c, g, or t
  misc_feature (2623)..(2624): n is a, c, g, or t
  misc_feature (2627)..(2628): n is a, c, g, or t
  misc_feature (2630)..(2630): n is a, c, g, or t
  misc_feature (2632)..(2634): n is a, c, g, or t
  misc_feature (2636)..(2636): n is a, c, g, or t
  misc_feature (2638)..(2641): n is a, c, g, or t
  misc_feature (2644)..(2645): n is a, c, g, or t
  misc_feature (2648)..(2648): n is a, c, g, or t
  misc_feature (2650)..(2650): n is a, c, g, or t
  misc_feature (2654)..(2657): n is a, c, g, or t
  misc_feature (2659)..(2660): n is a, c, g, or t
  misc_feature (2663)..(2663): n is a, c, g, or t
  misc_feature (2665)..(2668): n is a, c, g, or t
  misc_feature (2672)..(2672): n is a, c, g, or t
  misc_feature (2674)..(2674): n is a, c, g, or t
  misc_feature (2676)..(2676): n is a, c, g, or t
  misc_feature (2678)..(2679): n is a, c, g, or t
  misc_feature (2682)..(2683): n is a, c, g, or t
  misc_feature (2689)..(2689): n is a, c, g, or t
  misc_feature (2691)..(2693): n is a, c, g, or t
  misc_feature (2696)..(2696): n is a, c, g, or t
  misc_feature (2701)..(2702): n is a, c, g, or t
  misc_feature (2709)..(2709): n is a, c, g, or t
  misc_feature (2711)..(2711): n is a, c, g, or t
  misc_feature (2713)..(2715): n is a, c, g, or t
  misc_feature (2717)..(2718): n is a, c, g, or t
  misc_feature (2720)..(2720): n is a, c, g, or t
  misc_feature (2722)..(2723): n is a, c, g, or t
  misc_feature (2725)..(2726): n is a, c, g, or t
  misc_feature (2729)..(2730): n is a, c, g, or t
  misc_feature (2732)..(2732): n is a, c, g, or t
  misc_feature (2734)..(2740): n is a, c, g, or t
  misc_feature (2746)..(2749): n is a, c, g, or t
  misc_feature (2751)..(2752): n is a, c, g, or t
  misc_feature (2756)..(2757): n is a, c, g, or t
  misc_feature (2763)..(2764): n is a, c, g, or t
  misc_feature (2766)..(2766): n is a, c, g, or t
  misc_feature (2768)..(2770): n is a, c, g, or t
  misc_feature (2772)..(2774): n is a, c, g, or t
  misc_feature (2776)..(2777): n is a, c, g, or t
  misc_feature (2779)..(2779): n is a, c, g, or t
  misc_feature (2782)..(2782): n is a, c, g, or t
  misc_feature (2784)..(2784): n is a, c, g, or t
  misc_feature (2788)..(2789): n is a, c, g, or t
  misc_feature (2793)..(2794): n is a, c, g, or t
  misc_feature (2797)..(2800): n is a, c, g, or t
  misc_feature (2802)..(2803): n is a, c, g, or t
  misc_feature (2805)..(2805): n is a, c, g, or t
  misc_feature (2807)..(2807): n is a, c, g, or t
  misc_feature (2809)..(2815): n is a, c, g, or t
  misc_feature (2817)..(2817): n is a, c, g, or t
  misc_feature (2821)..(2822): n is a, c, g, or t
  misc_feature (2825)..(2825): n is a, c, g, or t
  misc_feature (2827)..(2827): n is a, c, g, or t
  misc_feature (2829)..(2831): n is a, c, g, or t
  misc_feature (2834)..(2835): n is a, c, g, or t
  misc_feature (2837)..(2839): n is a, c, g, or t
  misc_feature (2848)..(2849): n is a, c, g, or t
  misc_feature (2852)..(2852): n is a, c, g, or t
  misc_feature (2855)..(2855): n is a, c, g, or t
  misc_feature (2857)..(2857): n is a, c, g, or t
  misc_feature (2863)..(2865): n is a, c, g, or t
  misc_feature (2867)..(2868): n is a, c, g, or t
  misc_feature (2870)..(2870): n is a, c, g, or t
  misc_feature (2872)..(2872): n is a, c, g, or t
  misc_feature (2874)..(2874): n is a, c, g, or t
  misc_feature (2879)..(2879): n is a, c, g, or t
  misc_feature (2881)..(2881): n is a, c, g, or t
  misc_feature (2883)..(2883): n is a, c, g, or t
  misc_feature (2886)..(2890): n is a, c, g, or t
  misc_feature (2893)..(2894): n is a, c, g, or t
  misc_feature (2897)..(2901): n is a, c, g, or t
  misc_feature (2903)..(2903): n is a, c, g, or t
  misc_feature (2905)..(2906): n is a, c, g, or t
  misc_feature (2908)..(2910): n is a, c, g, or t
  misc_feature (2912)..(2912): n is a, c, g, or t
  misc_feature (2915)..(2916): n is a, c, g, or t
  misc_feature (2920)..(2920): n is a, c, g, or t
  misc_feature (2924)..(2925): n is a, c, g, or t
  misc_feature (2928)..(2929): n is a, c, g, or t
  misc_feature (2931)..(2931): n is a, c, g, or t
  misc_feature (2933)..(2933): n is a, c, g, or t
  misc_feature (2935)..(2936): n is a, c, g, or t
  misc_feature (2938)..(2938): n is a, c, g, or t
  misc_feature (2940)..(2943): n is a, c, g, or t
  misc_feature (2946)..(2948): n is a, c, g, or t
  misc_feature (2952)..(2953): n is a, c, g, or t
  misc_feature (2958)..(2958): n is a, c, g, or t
  misc_feature (2960)..(2960): n is a, c, g, or t
  misc_feature (2962)..(2962): n is a, c, g, or t
  misc_feature (2964)..(2964): n is a, c, g, or t
  misc_feature (2966)..(2966): n is a, c, g, or t
  misc_feature (2968)..(2969): n is a, c, g, or t
  misc_feature (2971)..(2972): n is a, c, g, or t
  misc_feature (2975)..(2975): n is a, c, g, or t
  misc_feature (2977)..(2978): n is a, c, g, or t
  misc_feature (2980)..(2980): n is a, c, g, or t
  misc_feature (2982)..(2983): n is a, c, g, or t
  misc_feature (2986)..(2987): n is a, c, g, or t
  misc_feature (2989)..(2991): n is a, c, g, or t
  misc_feature (2993)..(2994): n is a, c, g, or t
  misc_feature (2999)..(2999): n is a, c, g, or t
  misc_feature (3003)..(3004): n is a, c, g, or t
  misc_feature (3007)..(3007): n is a, c, g, or t
  misc_feature (3017)..(3019): n is a, c, g, or t
  misc_feature (3021)..(3022): n is a, c, g, or t
  misc_feature (3026)..(3030): n is a, c, g, or t
  misc_feature (3037)..(3039): n is a, c, g, or t
  misc_feature (3041)..(3042): n is a, c, g, or t
  misc_feature (3046)..(3047): n is a, c, g, or t
  misc_feature (3053)..(3055): n is a, c, g, or t
  misc_feature (3057)..(3058): n is a, c, g, or t
  misc_feature (3060)..(3061): n is a, c, g, or t
  misc_feature (3064)..(3065): n is a, c, g, or t
  misc_feature (3067)..(3067): n is a, c, g, or t
  misc_feature (3070)..(3072): n is a, c, g, or t
  misc_feature (3075)..(3076): n is a, c, g, or t
  misc_feature (3078)..(3082): n is a, c, g, or t
  misc_feature (3084)..(3084): n is a, c, g, or t
  misc_feature (3086)..(3086): n is a, c, g, or t
  misc_feature (3092)..(3092): n is a, c, g, or t
  misc_feature (3094)..(3094): n is a, c, g, or t
  misc_feature (3096)..(3097): n is a, c, g, or t
  misc_feature (3099)..(3099): n is a, c, g, or t
  misc_feature (3101)..(3101): n is a, c, g, or t
  misc_feature (3108)..(3108): n is a, c, g, or t
  misc_feature (3110)..(3114): n is a, c, g, or t
  misc_feature (3116)..(3117): n is a, c, g, or t
  misc_feature (3122)..(3123): n is a, c, g, or t
  misc_feature (3125)..(3126): n is a, c, g, or t
  misc_feature (3128)..(3129): n is a, c, g, or t
  misc_feature (3134)..(3134): n is a, c, g, or t
  misc_feature (3137)..(3138): n is a, c, g, or t
  misc_feature (3141)..(3142): n is a, c, g, or t
  misc_feature (3144)..(3145): n is a, c, g, or t
  misc_feature (3148)..(3148): n is a, c, g, or t
  misc_feature (3150)..(3154): n is a, c, g, or t
  misc_feature (3156)..(3156): n is a, c, g, or t
  misc_feature (3158)..(3158): n is a, c, g, or t
  misc_feature (3160)..(3160): n is a, c, g, or t
  misc_feature (3163)..(3168): n is a, c, g, or t
  misc_feature (3172)..(3172): n is a, c, g, or t
  misc_feature (3174)..(3178): n is a, c, g, or t
  misc_feature (3187)..(3187): n is a, c, g, or t
  misc_feature (3193)..(3194): n is a, c, g, or t
  misc_feature (3196)..(3201): n is a, c, g, or t
  misc_feature (3204)..(3204): n is a, c, g, or t
  misc_feature (3206)..(3206): n is a, c, g, or t
  misc_feature (3209)..(3209): n is a, c, g, or t
  misc_feature (3211)..(3211): n is a, c, g, or t
  misc_feature (3214)..(3214): n is a, c, g, or t
  misc_feature (3216)..(3216): n is a, c, g, or t
  misc_feature (3218)..(3219): n is a, c, g, or t
  misc_feature (3222)..(3222): n is a, c, g, or t
  misc_feature (3225)..(3225): n is a, c, g, or t
  misc_feature (3230)..(3232): n is a, c, g, or t
  misc_feature (3234)..(3236): n is a, c, g, or t
  misc_feature (3238)..(3239): n is a, c, g, or t
  misc_feature (3241)..(3248): n is a, c, g, or t
  misc_feature (3252)..(3253): n is a, c, g, or t
  misc_feature (3257)..(3261): n is a, c, g, or t
  misc_feature (3265)..(3265): n is a, c, g, or t
  misc_feature (3270)..(3271): n is a, c, g, or t
  misc_feature (3274)..(3274): n is a, c, g, or t
  misc_feature (3276)..(3276): n is a, c, g, or t
  misc_feature (3278)..(3279): n is a, c, g, or t
  misc_feature (3281)..(3288): n is a, c, g, or t
  misc_feature (3290)..(3290): n is a, c, g, or t
  misc_feature (3296)..(3296): n is a, c, g, or t
  misc_feature (3299)..(3301): n is a, c, g, or t
  misc_feature (3305)..(3307): n is a, c, g, or t
  misc_feature (3309)..(3310): n is a, c, g, or t
  misc_feature (3312)..(3313): n is a, c, g, or t
  misc_feature (3317)..(3321): n is a, c, g, or t
  misc_feature (3323)..(3323): n is a, c, g, or t
  misc_feature (3326)..(3326): n is a, c, g, or t
  misc_feature (3329)..(3329): n is a, c, g, or t
  misc_feature (3331)..(3331): n is a, c, g, or t
  misc_feature (3333)..(3333): n is a, c, g, or t
  misc_feature (3335)..(3338): n is a, c, g, or t
  misc_feature (3340)..(3340): n is a, c, g, or t
  misc_feature (3343)..(3343): n is a, c, g, or t
  misc_feature (3347)..(3347): n is a, c, g, or t
  misc_feature (3349)..(3353): n is a, c, g, or t
  misc_feature (3355)..(3355): n is a, c, g, or t
  misc_feature (3360)..(3361): n is a, c, g, or t
  misc_feature (3364)..(3366): n is a, c, g, or t
  misc_feature (3368)..(3368): n is a, c, g, or t
  misc_feature (3372)..(3372): n is a, c, g, or t
  misc_feature (3376)..(3377): n is a, c, g, or t
  misc_feature (3379)..(3379): n is a, c, g, or t
  misc_feature (3382)..(3382): n is a, c, g, or t
  misc_feature (3386)..(3386): n is a, c, g, or t
  misc_feature (3388)..(3391): n is a, c, g, or t
  misc_feature (3394)..(3394): n is a, c, g, or t
  misc_feature (3397)..(3397): n is a, c, g, or t
  misc_feature (3400)..(3400): n is a, c, g, or t
  misc_feature (3402)..(3402): n is a, c, g, or t
  misc_feature (3405)..(3406): n is a, c, g, or t
  misc_feature (3408)..(3410): n is a, c, g, or t
  misc_feature (3412)..(3415): n is a, c, g, or t
  misc_feature (3421)..(3422): n is a, c, g, or t
  misc_feature (3425)..(3425): n is a, c, g, or t
  misc_feature (3428)..(3432): n is a, c, g, or t
  misc_feature (3435)..(3438): n is a, c, g, or t
  misc_feature (3440)..(3443): n is a, c, g, or t
  misc_feature (3447)..(3448): n is a, c, g, or t
  misc_feature (3450)..(3451): n is a, c, g, or t
  misc_feature (3455)..(3456): n is a, c, g, or t
  misc_feature (3459)..(3462): n is a, c, g, or t
  misc_feature (3464)..(3464): n is a, c, g, or t
  misc_feature (3469)..(3471): n is a, c, g, or t
  misc_feature (3475)..(3477): n is a, c, g, or t
  misc_feature (3480)..(3481): n is a, c, g, or t
  misc_feature (3483)..(3486): n is a, c, g, or t
  misc_feature (3490)..(3490): n is a, c, g, or t
  misc_feature (3492)..(3492): n is a, c, g, or t
  misc_feature (3500)..(3503): n is a, c, g, or t
  misc_feature (3508)..(3509): n is a, c, g, or t
  misc_feature (3511)..(3512): n is a, c, g, or t
  misc_feature (3516)..(3516): n is a, c, g, or t
  misc_feature (3518)..(3519): n is a, c, g, or t
  misc_feature (3521)..(3521): n is a, c, g, or t
  misc_feature (3523)..(3523): n is a, c, g, or t
  misc_feature (3526)..(3527): n is a, c, g, or t
  misc_feature (3529)..(3529): n is a, c, g, or t
  misc_feature (3532)..(3532): n is a, c, g, or t
  misc_feature (3534)..(3535): n is a, c, g, or t
  misc_feature (3538)..(3538): n is a, c, g, or t
  misc_feature (3543)..(3547): n is a, c, g, or t
  misc_feature (3549)..(3551): n is a, c, g, or t
  misc_feature (3553)..(3553): n is a, c, g, or t
  misc_feature (3556)..(3558): n is a, c, g, or t
  misc_feature (3564)..(3565): n is a, c, g, or t
  misc_feature (3568)..(3568): n is a, c, g, or t
  misc_feature (3570)..(3572): n is a, c, g, or t
  misc_feature (3577)..(3578): n is a, c, g, or t
  misc_feature (3580)..(3580): n is a, c, g, or t
  misc_feature (3585)..(3585): n is a, c, g, or t
  misc_feature (3588)..(3592): n is a, c, g, or t
  misc_feature (3595)..(3602): n is a, c, g, or t
  misc_feature (3605)..(3606): n is a, c, g, or t
  misc_feature (3609)..(3609): n is a, c, g, or t
  misc_feature (3611)..(3613): n is a, c, g, or t
  misc_feature (3616)..(3618): n is a, c, g, or t
  misc_feature (3622)..(3622): n is a, c, g, or t
  misc_feature (3625)..(3632): n is a, c, g, or t
  misc_feature (3634)..(3635): n is a, c, g, or t
  misc_feature (3638)..(3640): n is a, c, g, or t
  misc_feature (3642)..(3643): n is a, c, g, or t
  misc_feature (3646)..(3646): n is a, c, g, or t
  misc_feature (3648)..(3648): n is a, c, g, or t
  misc_feature (3650)..(3652): n is a, c, g, or t
  misc_feature (3654)..(3654): n is a, c, g, or t
  misc_feature (3656)..(3656): n is a, c, g, or t
  misc_feature (3659)..(3662): n is a, c, g, or t
  misc_feature (3665)..(3666): n is a, c, g, or t
  misc_feature (3668)..(3668): n is a, c, g, or t
  misc_feature (3670)..(3671): n is a, c, g, or t
  misc_feature (3673)..(3673): n is a, c, g, or t
  misc_feature (3675)..(3679): n is a, c, g, or t
  misc_feature (3685)..(3686): n is a, c, g, or t
  misc_feature (3688)..(3694): n is a, c, g, or t
  misc_feature (3696)..(3696): n is a, c, g, or t
  misc_feature (3698)..(3699): n is a, c, g, or t
  misc_feature (3701)..(3702): n is a, c, g, or t
  misc_feature (3706)..(3710): n is a, c, g, or t
  misc_feature (3712)..(3713): n is a, c, g, or t
  misc_feature (3716)..(3716): n is a, c, g, or t
  misc_feature (3718)..(3719): n is a, c, g, or t
  misc_feature (3721)..(3722): n is a, c, g, or t
  misc_feature (3724)..(3724): n is a, c, g, or t
  misc_feature (3728)..(3728): n is a, c, g, or t
  misc_feature (3730)..(3732): n is a, c, g, or t
  misc_feature (3736)..(3736): n is a, c, g, or t
  misc_feature (3738)..(3739): n is a, c, g, or t
  misc_feature (3744)..(3745): n is a, c, g, or t
  misc_feature (3748)..(3751): n is a, c, g, or t
  misc_feature (3753)..(3753): n is a, c, g, or t
  misc_feature (3755)..(3756): n is a, c, g, or t
  misc_feature (3760)..(3760): n is a, c, g, or t
  misc_feature (3767)..(3770): n is a, c, g, or t
  misc_feature (3772)..(3775): n is a, c, g, or t
  misc_feature (3778)..(3778): n is a, c, g, or t
  misc_feature (3781)..(3781): n is a, c, g, or t
  misc_feature (3783)..(3784): n is a, c, g, or t
  misc_feature (3788)..(3788): n is a, c, g, or t
  misc_feature (3792)..(3793): n is a, c, g, or t
  misc_feature (3795)..(3797): n is a, c, g, or t
  misc_feature (3801)..(3804): n is a, c, g, or t
  misc_feature (3806)..(3808): n is a, c, g, or t
  misc_feature (3810)..(3810): n is a, c, g, or t
  misc_feature (3812)..(3812): n is a, c, g, or t
  misc_feature (3814)..(3814): n is a, c, g, or t
  misc_feature (3816)..(3817): n is a, c, g, or t
  misc_feature (3821)..(3821): n is a, c, g, or t
  misc_feature (3823)..(3826): n is a, c, g, or t
  misc_feature (3829)..(3829): n is a, c, g, or t
  misc_feature (3832)..(3832): n is a, c, g, or t
  misc_feature (3835)..(3838): n is a, c, g, or t
  misc_feature (3841)..(3842): n is a, c, g, or t
  misc_feature (3844)..(3844): n is a, c, g, or t
  misc_feature (3847)..(3851): n is a, c, g, or t
  misc_feature (3853)..(3854): n is a, c, g, or t
  misc_feature (3856)..(3859): n is a, c, g, or t
  misc_feature (3861)..(3861): n is a, c, g, or t
  misc_feature (3864)..(3865): n is a, c, g, or t
  misc_feature (3867)..(3867): n is a, c, g, or t
  misc_feature (3869)..(3870): n is a, c, g, or t
  misc_feature (3872)..(3873): n is a, c, g, or t
  misc_feature (3875)..(3878): n is a, c, g, or t
  misc_feature (3880)..(3882): n is a, c, g, or t
  misc_feature (3884)..(3884): n is a, c, g, or t
  misc_feature (3886)..(3887): n is a, c, g, or t
  misc_feature (3890)..(3891): n is a, c, g, or t
  misc_feature (3893)..(3893): n is a, c, g, or t
  misc_feature (3895)..(3895): n is a, c, g, or t
  misc_feature (3897)..(3897): n is a, c, g, or t
  misc_feature (3903)..(3904): n is a, c, g, or t
  misc_feature (3906)..(3907): n is a, c, g, or t
  misc_feature (3910)..(3912): n is a, c, g, or t
  misc_feature (3914)..(3917): n is a, c, g, or t
  misc_feature (3919)..(3920): n is a, c, g, or t
  misc_feature (3922)..(3923): n is a, c, g, or t
  misc_feature (3925)..(3927): n is a, c, g, or t
  misc_feature (3929)..(3929): n is a, c, g, or t
  misc_feature (3932)..(3932): n is a, c, g, or t
  misc_feature (3935)..(3937): n is a, c, g, or t
  misc_feature (3943)..(3944): n is a, c, g, or t
  misc_feature (3947)..(3949): n is a, c, g, or t
  misc_feature (3951)..(3954): n is a, c, g, or t
  misc_feature (3956)..(3959): n is a, c, g, or t
  misc_feature (3961)..(3961): n is a, c, g, or t
  misc_feature (3966)..(3969): n is a, c, g, or t
  misc_feature (3972)..(3972): n is a, c, g, or t
  misc_feature (3975)..(3975): n is a, c, g, or t
  misc_feature (3978)..(3981): n is a, c, g, or t
  misc_feature (3983)..(3983): n is a, c, g, or t
  misc_feature (3986)..(3986): n is a, c, g, or t
  misc_feature (3992)..(3992): n is a, c, g, or t
  misc_feature (3994)..(3996): n is a, c, g, or t
  misc_feature (3998)..(3998): n is a, c, g, or t
ggcgtggttgatgaagctagtgagagcctcaacagagaacacaacatcgtcagacttcaggacgtcgtacgtgttcagctgatcggcgaccaggatatggacgtcgggcaggttgcgggcactcttccaagcggtcttgtcctcacgtcccaggacgaggaggacagacttgcggtcagtcaggcgctcaatgaaggcgcgggcagccttggtggacggattctggccggggaccagttcttccaccacgtgaatgcggctgtggcgtgcgcggtcagtaagggcaccacgcagtgcagcagctttcatcttcttgggggtgcgctggctgtagtcacggggcttcggtccgtgcgagatgccaccaccggtgaagtggggtgcgcggatggagccctggcgtgcacggccagtgcctttctggcggaacggcttgcggccaccgccggagacttcaccacgagtcttggtgctgtgggtgccttgacgctttgcagcaagctgagcattaacaacctggtgcatcagcgcaatgctggcctcacggtcgaagatgtcagcaggcagctcaacctggccgttggtgccaccatcagcggtgtgtacgtcgagcttcagattggtcatgctcgttcaccgcccttcactgcggttttcacggttacgaggccgccgcgagcaccagggatggcacccttgatgatcagcaggttagcctcagtgtcaatcttttgaatcttcagattctgggtagtaacgcggtcgctacccatgcgtccggccatgcgggtgcccttgaagacgcgacccggggttgcacaggcaccgatgccaccgacgcggcggtgtgctgcctggttaccgtgggatgcgccctggccggaaaagccgtggcgtttcataccaccggcgaagcccttacccttggangtaccggtgacgtccacgaagtcaatgccttcgaaaatgtcgacggtgacgtcctgtccaacctcgtaaccagagacgtcgtccatgcgaatctcggccatgtggcggcggggggtaacgccagctttcttgaagtgacctgcctgcggcttcttagccttgcgggggtcaatctcgccataggcgatctggatggcgttgtagccatcgttttctacggtgcgaatctgggtaaccacacacggcccagcttcgacgacggtaaccggaacaacgcggttggattcgtcgaagatctgagtcatgccgagcttggtgcccagaatgcccttgatctcagtttcactcattagttattctccgctgccaaaaattccgtcgatcactgaatattcacatcgacgctggccggaagatcgatgcgcatcagggcatcaaccgtcttcggcgtcgggtcgaggatgtcgatcaagcgcttgtgagtgcgcatctcgaagtgttcgcgagaatccttgtacttgtggggagaacgaataactgcgtacacgttcttctctgtgggcaacggcactgggccaacgacacgggcacccgtacgggtaaccgtctcgacgatcttgcgtgcagacgcatcaatcgcctcgtggtcgtaggctttgagcctaatgcggatcttttgtcccgccacgcttatcctcttcctacgctgtcccacatcgcaatgattggtgggaatcgctgttgtctctataacgttgtccggcttcaggccacggctcaacgccagttttctcgtgcatgctggtatttccctcaaacaactgcggatgtgagcgtggcataaacacacgccattgatccgcagacgtcagggtcatgctttaccccttgccggaaataccaaccgcaaggttcaaacacgaaaccatatgtcacgtcggaagaggccccgccgaagcgatgctcttacctactgccgctgtttatttgccatgccccttcttcaccagtcccccacgcacaaacgcggggcaccaactctgtgcgataccctgatnaagcaggcgagtcgacactagaaggtggttcatgtttgccacaccaccacacaccctcaaaggcatgccgtgttgaagcaaccctgacatttaaccacacgtttcccaccaacacaagttatctttcccacgcttatcgacgcccgcccctaccgcanccnnnnnnnnanancncaccncnnnncntcncnannaccnncacnnancananntnnatcgnngcgnnnccngngngnannnnnngnnccngcnnnaancncgncnntancnnnccntnntgngncntnncnctgnnnntnnnnnnnnnngnnnnnnnccannncccnnccgnntnanntgacagnnnnngnntnanngcnnccnncatnnncnntgncaacnnnnnnncanncccccacnnngnnnnnnnnnncnncngnnnanccnncnnnaannangnggncgtcnannngnngnccaacnnnangnanntaannngnnnnnncnnnagnnntannncgnnannnntgnncnanannnnncnccntgnngnnannannnancnnnnnnnccnnnccancnngnnnnnnncnnannnnntgncnannnccnnacnngannncaacnnnatcncnnnaagnctgcnngncnnangnnccnncntnnntncnnnnggnngcnanaacnnnncnntcntnnnnaagncnangnntannacgccncnnngcngcaanngcggcgncntnnngnnantnncnnacnncncnnnnnnngtaggnnnncnngccnntggccnncncnnngnnntnngnacncnaccnnaccnngtnnnncnnancngnnnnnnncncagnntgnanannnccnncnnncaccccaannacnttncnccaatnnncnncntngnattcncnancannnnnatnnccnnnnncnannannntnccnnctgngcgnnctnncncngnntntnnnnggnnngctnntaggntnanancntnnannatncnncnannttnncnnntnntaaanaccnnggnaaaaagaaannnanncctnnnnnacaaggnnncnnagtnnattctnnntnntnntannantcnnngannannnnntnancttggncncnngncnagcgccnannnnncnnccacnntnncnnatagnganncgnngnnccncnnnnntngnanccnnnnnnatcngnnnnncagacatgncaacgnngnnnnnnggnanaancntcncngnnccntcnggcannncnnnannannnnnnnngtcnntggnnnnnaagnagaanngcngncnntnnnnnnnnangaacgnggnnnggcnnncnncnncatnnnnngncangangnanannnnanccncgancnnnnngngcggnntgnnngngccnggcnnanccncaancnnnncangcncancntcnncnnncnnnntgccannganaannnnnccnnnntnnnngccnncnncggnntannnnancagcnnncggnnnatnncnnnnccgntnacggtggnnnnggtgnncnnctcncnnangnccnngntcncnnccncttcnnnnncnnngngcnnnccgcgnncancnnnaccgnngnccacngtnnnnnggnnnnnnnnggnnaanannnccnnnatcngcnnnnnnnngnnctnnncnntcncncnnncngnatnnnnaanngncnngncnnnnnccttcnncnnnnnnncnanngnntggnnnnncnnggnanngnntncaanannnttcngnncaganntgnnnncnannggancttcctnnnngnnnnccngcncnnccancagnncnnnaacnnnnannncnancngnncgangnnnnccncancannnnccnngncgnnnnngnncnnnncnacnngnanntnngnnnngnnnancnngcnngngngnagaacnngnncannngnnnncnncnngnnncngtnggnnncggcannaannngnnnngnnnngnccatnnnngcngcnccnnnnancangttctngnnntngt

SEQ ID NO: 909 - DNA, 4000 bp, Escherichia coli
  misc_feature (106)..(106): n is a, c, g, or t
  misc_feature (109)..(110): n is a, c, g, or t
  misc_feature (113)..(114): n is a, c, g, or t
  misc_feature (116)..(117): n is a, c, g, or t
  misc_feature (120)..(120): n is a, c, g, or t
  misc_feature (122)..(123): n is a, c, g, or t
  misc_feature (125)..(127): n is a, c, g, or t
  misc_feature (129)..(130): n is a, c, g, or t
  misc_feature (132)..(132): n is a, c, g, or t
  misc_feature (136)..(136): n is a, c, g, or t
  misc_feature (140)..(140): n is a, c, g, or t
  misc_feature (144)..(144): n is a, c, g, or t
  misc_feature (146)..(147): n is a, c, g, or t
  misc_feature (149)..(149): n is a, c, g, or t
  misc_feature (152)..(154): n is a, c, g, or t
  misc_feature (156)..(156): n is a, c, g, or t
  misc_feature (159)..(159): n is a, c, g, or t
  misc_feature (162)..(165): n is a, c, g, or t
  misc_feature (178)..(179): n is a, c, g, or t
  misc_feature (181)..(181): n is a, c, g, or t
  misc_feature (188)..(188): n is a, c, g, or t
  misc_feature (190)..(190): n is a, c, g, or t
  misc_feature (192)..(194): n is a, c, g, or t
  misc_feature (196)..(198): n is a, c, g, or t
  misc_feature (201)..(203): n is a, c, g, or t
  misc_feature (209)..(210): n is a, c, g, or t
  misc_feature (212)..(212): n is a, c, g, or t
  misc_feature (216)..(217): n is a, c, g, or t
  misc_feature (221)..(222): n is a, c, g, or t
  misc_feature (226)..(226): n is a, c, g, or t
  misc_feature (230)..(230): n is a, c, g, or t
  misc_feature (232)..(233): n is a, c, g, or t
  misc_feature (239)..(240): n is a, c, g, or t
  misc_feature (242)..(247): n is a, c, g, or t
  misc_feature (249)..(250): n is a, c, g, or t
  misc_feature (252)..(253): n is a, c, g, or t
  misc_feature (255)..(256): n is a, c, g, or t
  misc_feature (258)..(259): n is a, c, g, or t
  misc_feature (261)..(261): n is a, c, g, or t
  misc_feature (263)..(263): n is a, c, g, or t
  misc_feature (265)..(269): n is a, c, g, or t
  misc_feature (273)..(274): n is a, c, g, or t
  misc_feature (276)..(276): n is a, c, g, or t
  misc_feature (278)..(280): n is a, c, g, or t
  misc_feature (283)..(283): n is a, c, g, or t
  misc_feature (286)..(287): n is a, c, g, or t
  misc_feature (290)..(291): n is a, c, g, or t
  misc_feature (294)..(295): n is a, c, g, or t
  misc_feature (297)..(297): n is a, c, g, or t
  misc_feature (299)..(306): n is a, c, g, or t
  misc_feature (308)..(308): n is a, c, g, or t
  misc_feature (310)..(311): n is a, c, g, or t
  misc_feature (313)..(313): n is a, c, g, or t
  misc_feature (315)..(315): n is a, c, g, or t
  misc_feature (317)..(317): n is a, c, g, or t
  misc_feature (319)..(321): n is a, c, g, or t
  misc_feature (323)..(325): n is a, c, g, or t
  misc_feature (328)..(328): n is a, c, g, or t
  misc_feature (330)..(331): n is a, c, g, or t
  misc_feature (335)..(335): n is a, c, g, or t
  misc_feature (338)..(339): n is a, c, g, or t
  misc_feature (341)..(343): n is a, c, g, or t
  misc_feature (346)..(346): n is a, c, g, or t
  misc_feature (353)..(353): n is a, c, g, or t
  misc_feature (356)..(356): n is a, c, g, or t
  misc_feature (358)..(358): n is a, c, g, or t
  misc_feature (360)..(365): n is a, c, g, or t
  misc_feature (367)..(368): n is a, c, g, or t
  misc_feature (376)..(376): n is a, c, g, or t
  misc_feature (381)..(384): n is a, c, g, or t
  misc_feature (392)..(394): n is a, c, g, or t
  misc_feature (396)..(399): n is a, c, g, or t
  misc_feature (402)..(402): n is a, c, g, or t
  misc_feature (404)..(404): n is a, c, g, or t
  misc_feature (407)..(408): n is a, c, g, or t
  misc_feature (414)..(414): n is a, c, g, or t
  misc_feature (416)..(421): n is a, c, g, or t
  misc_feature (423)..(424): n is a, c, g, or t
  misc_feature (426)..(427): n is a, c, g, or t
  misc_feature (429)..(430): n is a, c, g, or t
  misc_feature (433)..(433): n is a, c, g, or t
  misc_feature (441)..(441): n is a, c, g, or t
  misc_feature (444)..(445): n is a, c, g, or t
  misc_feature (449)..(451): n is a, c, g, or t
  misc_feature (453)..(454): n is a, c, g, or t
  misc_feature (456)..(456): n is a, c, g, or t
  misc_feature (458)..(461): n is a, c, g, or t
  misc_feature (466)..(466): n is a, c, g, or t
  misc_feature (468)..(469): n is a, c, g, or t
  misc_feature (471)..(473): n is a, c, g, or t
  misc_feature (475)..(475): n is a, c, g, or t
  misc_feature (477)..(477): n is a, c, g, or t
  misc_feature (479)..(480): n is a, c, g, or t
  misc_feature (482)..(482): n is a, c, g, or t
  misc_feature (488)..(489): n is a, c, g, or t
  misc_feature (491)..(491): n is a, c, g, or t
  misc_feature (494)..(494): n is a, c, g, or t
  misc_feature (498)..(498): n is a, c, g, or t
  misc_feature (503)..(503): n is a, c, g, or t
  misc_feature (935)..(935): n is a, c, g, or t
  misc_feature (1957)..(1957): n is a, c, g, or t
  misc_feature (1980)..(1980): n is a, c, g, or t
  misc_feature (1991)..(1991): n is a, c, g, or t
taaatgaccggatttctcgttgccttgatggtcggaaaattttctaccggacctaataatgaaaggtgcttatatacatgtttactctaaatgtaggtttattttnttnnttnntnntcntnngnnntnntntttngggncccngnngnttnnntnggncgnnnnactttttctttcnntnaccggcngnannncnnnctnnnttcgtnngncacnnccgnncggncgtncnnaaaaannannnnnncnntnncnngnncncnannnnncccnnancnnnaanacnnccnnctnncntnnnnnnnnantnncngncngnnntnnnttnannaaanatnntnnnccntggaaanaancngnnnnnncnntttttccnatttnnnnaaatttcnnntnnnnttncnttnnccggtnannnnnncnntnngnnggngggttttntgnnggannncnntngnnnngggancnngnnncngntnngnttttcnnancgnccgnccggnggtgtctgacgaacgaagtgaggagttccgccggtcagtgaaggaaagccttagcggatcgttccaggcgaaccggtctgacgggataaaacccggaatcggaatagaaagaaaaaaaataaacctacatttataagttgtaaatatgtatatcactacctgatagaaatgcttagcgggcttgaaatgccttttatctatcgaagattttcggtcaattagggtggaaatatttataaaaaaacagcagttgataatctattgcattattccaatattcgtgtgtatgcccgcccggacgggtgaggaaatcgtggggaatattgtaataccggagtttttcatgtaatttctgatttacggtatagaagaagtcgtaatatccgcaatcgataatgatggctaaaggtcccgacttgctgttgtagggcnattggttgattacggtatattcgttccaacgctggggattctcggaataggggcccagcaattgcttcatttcccaattttcggggaaaggccggatatcgacacctccgcttatcgagccacaggctccgtaagtgtccgggtgacggaaagccagccataaagcaccgtgcccgcccatactgaaaccggtgatagctcttcctttgcggttattataagtgcggtattgggaatcgatatagttgatcagctctttgctcacataagtttcatagcggtaggaaggattgatggggctatcccaataccaactgttcaggccgtcgggacatacgatgatcatatcgaaattagaagccatttgagccagatcgggttttgtataggtggcccacgtatcgtaacatcctccataaccgtggagcagataggctaccgggtattttttctgtgtattttgggtatagctggcaggcaggataatgatatttttaatttgttttttcatggacgtactgtaaaccgagatcgtgtctattttctgggcttgagttgggaggtaggtcccgatcagaaataaggataggaacaataattgtatcagtcttatttttttcataagggtatacttattggtttgttaccggatattaacaatataaaacttgctgcaaatactctgtaaagatatttatttcttgtatattttcctgcatatttttttgtttttctttgattttgtccctgcggatatgtaacaaatacgtcattatttttcaatagtttcgtcataaatttgcattttgtatatggatttcttgtaaaggttcatcttcctcgactgttacgggcaacatttgacgtaaactctggtaggcataaaataccggatacaaagaatgttttggagattaaaatctaaagtgatcctactgattattttggaaactatcgattttatagtaaaatctatttttattgtaggtgtgtgtaaaattgggggggtatgtattgaattntttgtgttttattttgatatatntgtattttttngggggggtatgtggaaaaataattcaaattttatttgattattgttctaaatatatatttttgtcttggttttaatgaaaataagaaatgggtttggaaaaatactttttgtagcgtatatatccccttgtttttttagattgaatattgaaaacagatgtttttattgaaacaatatcggcaaatcgtctcttttttcccggaatgtcagattgtgggaacggctaaagacacttttcaatttccttctgccgggaaaagacttccggcacttatcgtttgatttaaaatttcaggcttatgaagattacactatcacagttgaacgttatggtcggagatattctctcgaataaaagtaagaacatagactatattgacgaggctgcggatagtggtgcagatccggcgttacccggcgaaatggtcctgtctgctgtgggaagggtgtaagatgccgttggccgatgatgtatacagagataaagaaccacctaaacaataaatattatgacaacacttagatttaaaatggttgaagaggcgatcggaagaaaagccgtagaagtaaaagcacctgccgaacgtccggcagagtatttcggaaaatatgtttttgatcgggacaaaatgcggaaatatttgccgaaagcttgtttcgaaacgttgatgaatacgatgaagaacgggagcccgttggatcgggaaacagccgattgtgtggctgccggaatgaaacagtgggctcaggatatgggagctactcactatacgcattggtttcaacccttgacgggaggaactgcggagaaacacgatgcttttatcgaggccgatcacgaaggaggagtgttggaagagttcacaggaaagttgctgatacaacaagaaccggatgcttccagttttccgagcggtggtcttcgcaatacatttgaagcccggggatatagtgcctgggatcctagttctccggcctttattgtcgatacgaccctttgtataccgactatctttattgcttatacgggggaggccctggatttcaaggcccctcttttgagggctctcgaggcagtaaaccgtgcggctgtggatatttgccggtatttcgacccgaaggtggaaaaagtgttctcttatctgggatgggagcaggaatattttttggtagacgaaagcctgtgggcggcccgtcctgatctggtacttaccggccggacgatgatgggacatgaaagtgctaaaaatcaacagctggatgatcattatttcggttctataccgactcgggtgattgcttttatgaaggatctggaatacgaatgtcagcaattgggaatcccggtaaaaacccgccacaatgaggtggctccgaaccagttcgaacttgctccggttttcgaagagaccaatctggctaatgaccacaatcagttgttgatgtctaccatgaaagtggtggcgaggcgtcattgtttccgggtacttttgcacgaaaaacctttcaaggggatcaacggttcgggcaagcacaacaactggtctttgggtaccgatacgggagtgaatctgttatctccgggacgttctgctacagagaatctgcaatttatcacctttctggtgaatatcctgatggcggtctatcgacggaatggcttattgaaagcctctgtgatgagtgcaggcaatgcccatcgtttaggagctaacgaagctcctcctgctattttgtcggtattcctggggactcagttgtcggctattctggataaaatcgaattcagccaatcggatgaagcgattcagttggataaaaagaccgggttcaggatggacgggattacgcatatccctgaactattcagggatacgaccgatcgtaaccggacatcaccgtttgcatttaccggtaaccggttcgaattccgtgccgtcggttcctcggataattgtgccgatgccatgattactttgaatacggcagtggcttatcagttaaaaga

SEQ ID NO: 910 - DNA, 4000 bp, Escherichia coli
  misc_feature (3363)..(3363): n is a, c, g, or t
tgttctgcgcattttcctatacgctctatgtcagccaagaccatcctgattttgaatacattgcgcatcttgttcgctctggcaaagttggcggcgtgatgttttccaaaggtgatgtatatgaggcggctatgctggcaaaccgtttgcaacggctcgccaaagtcccactgctcatcagcgccgacatggaatggggcgtttccatgcgcatagaccgtgccacagaatttccttataacatggctattgcagccacacaaaagcccgactatgctttccaagtggcttacgctattgccgaagaagctcgtgccttaggcatccaccaaaactacgctccctctgttgaccttaatagcaacccgcgaaatcctgtcatcaacacccgtgcctttagcgaaaatgttgcgctcaccaaccaaatggcggcagctttcatcaaaggcacacaatctggcggactgattgccactgccaaacattttcccggtcatggagatactgacatcgatagccataaagacctacctgtgctgcattttgagcgagcgcgtcttcaagcactcgaactcaagcccttccaacacgctattgagcaaggcgtcatcagcgtgatggttgggcatctggctttgcccaagattagtctttctgacaaaatcccggctacactttcgcctgaaatcatcaccaaaattttacgcgaagagctgggtttcaatggcttagtggttactgatgccatgaacatgcaaggggttaagaagaactttgaggttggcgaggcggcagttcgcgctgtgctggctggtaacgacatgattttgatgtcgccaaatatcgaggcggcacaatcagctattctcaaggcggttcaagacaagcgcattgatgtcgggcgcattgatgcttctgtgcgcaaaattcttgcactcaaagagtggcttggtctgcacaaatcccgctttgtgaatatcgatgagattgaaaccaaagtcggcacgcgtgcacatcaatggctggcgcaagaagtagccaatcactccatcaccttgcttaaaaatgagcgccaaattttgcccctgaaacttccaagccccaacctgcgcgtgctgaacatttcgctgcagacttcagaaaactgtaacactggcaaaaacttttttgccgaactctcaaaattctactccaacacgctacacttgcaacttttgccaaaaagcaacgagcttaatttcaagttcgctttgcgtgccgccgaaaaatctgcggcagtcgtggtatcgtgctacgccgacacgcgagcttgggaaggcaaatttggcttggataaagaccagacgaagttcctacaaaccttggtcaaagtttgcaacgagcgccatattccattgattctcgtctcatttggcacgccatacatcgttcttgatgtgccagatgtgcccgtgtacctttgtgcctactgtcccgtcaaggtgtccgagaatgcagcagttaaagtcatcacaggtcagctcgtgccaaaaggcaaacttccagtaaccattcccaatctctttccctttggttcaggacttaccagttttagtgccctgcctgattctacacgctaacttgtgccgcttgcatcgactgtgttaaggaaacgttttctgcttctaatgaaattcttagatttaatctaaataattctcaagtgattctacttacggaggttaaaaaagggtctcgattcaaggttgttcgcattgatgagaaggatattcgcacgcagctcttgcgttttggcttaggggaagggagcgaagcggtctgctttgaacgcctgcctttaggtccgattgtcatcaagcatcagcgtcaggaagtggctattggtcgagaatttgctaataaaatctgggtagagccgcttgagagataactctttcaacatttttgattatgggcaaatctgcatctgaggcattagtagaggcggaaaaacttgagcccagctcttcggctgaaccgctcagctcagcactttcttcagcacgcactaagttggtgttggtgggcaatccgaatgttggcaagtcaggcttttttaatcacttcagcggtctttatgtcgatgtatccaattttcccggcaccacagttgaaattgcacatgggcattacaaaaactatgatgtctatgacacgccgggcatttatggcgtcagctcttttaatgatgaagagcgcgtagcacgcgataccattctctcggcagatgtagtgctcaacgtcgttgatgccaccaatcttgagcgcgaccttttcctaactctgcagctaattgacatgcgctttcgcatgattgttgcgctcaacatgatggatgccctgcacgctgctggattagagatagatacccaagaacttgagcgcattcttggcgtgcccgtcgttgaagtggttgccatcaaaaaacaagggtttgatgagttggaatcacggcttagagaagcacgccccggtcactccgaccctgccctgcaagcggaacttcaaccgcttatctcgaagctcaaaccaactgccaatcctaccgccgatgccctgatgattctcgaaggtgatgaggtcatcagtgagcgacatggtcttgagcctattgataagcgcgaggcgatttatgttgctcgtcgcaatcgtgtcaatgaaattgtagcaaaggtttatcgccaaaagtcagccgctcgcttcagcgcacagtttagcgagaagctaggacgctggacacttcaccctatcacaggcattcccattctcctttttgcactatggctgatttatcaagtcgttggtgtcttggtggcacagcgtgtggtcggacacttagaagtggaatatggcaaccgcctttgggaaccagcagtcaaacatctttttgcacgcgttacgcctgtcagcattgaagttgaagtgctcgaaaaagatgacaatggcgaataccagaccgtcgagcggcgcacatttgattttccaaacggcacgcacgccgacccagccttgcttgaagccatgaagcagttcatggcagagaaaaccgtgatgcaaaattttactttttcgcaagagacgctctggggcaaacttgtggtcatcttggctggcgagtttggcgctattacgatgacggttacctacctacttttcctactcttgccgctcatcgttggtttttaccttttccttgcattgctcgaggattgcggctatttgcctcgccttgctacgatggtcgaccggctgctcaacgcgatggggctgaatggtcgcgcagtcattcccatcattttgggttttggctgcgtaacgatggcnacgattaccacacgcttgcttaacacctcgcgagagaaaaccattgccgcttcaattctcaatttcgcaattccttgttcggctcaacttgcggtgattacggctttgctcaccaaggcaggcggcgaatacaccttaattttctttgtgattattctcgccaatctcatcggtattggcaccgtcatagacaaaattttgcccggcaaatcttcagccctgctgattgatttgccacccatgcgcttaccacgccttagtaatgttgccaaaaaaacttggattaaaacgcttagtttcatgaaagaagcctcgccatggttttttgctggcgcattgctcatttctacaatgcaagtaactgggcttcttgatgtctggattcggctctttgaaccgattaccaccaactggcttgggttgcctgccgatgcagcacgctcgtttgtgatgggcatggtgcgccgcgattttggcgcggcaggtctatatgaacttgccctttcaccaaagcaaattgttgtctcgcttaccgtcatcactctgtttgtgccttgcattgccagcttgatggtactgctcaaagagcgcgggctgtgtgaagccatgaccatttggtttggcagttggattttag

SEQ ID NO: 911 - DNA, 4000 bp, Escherichia coli
  misc_feature (199)..(199): n is a, c, g, or t
  misc_feature (2230)..(2230): n is a, c, g, or t
  misc_feature (2374)..(2374): n is a, c, g, or t
  misc_feature (2867)..(2867): n is a, c, g, or t
  misc_feature (3585)..(3585): n is a, c, g, or t
  misc_feature (3597)..(3597): n is a, c, g, or t
  misc_feature (3629)..(3629): n is a, c, g, or t
  misc_feature (3644)..(3646): n is a, c, g, or t
  misc_feature (3648)..(3651): n is a, c, g, or t
  misc_feature (3655)..(3655): n is a, c, g, or t
  misc_feature (3657)..(3662): n is a, c, g, or t
  misc_feature (3664)..(3664): n is a, c, g, or t
  misc_feature (3666)..(3668): n is a, c, g, or t
  misc_feature (3672)..(3680): n is a, c, g, or t
  misc_feature (3682)..(3682): n is a, c, g, or t
  misc_feature (3685)..(3685): n is a, c, g, or t
  misc_feature (3688)..(3688): n is a, c, g, or t
  misc_feature (3690)..(3696): n is a, c, g, or t
  misc_feature (3699)..(3708): n is a, c, g, or t
  misc_feature (3710)..(3711): n is a, c, g, or t
  misc_feature (3714)..(3714): n is a, c, g, or t
  misc_feature (3716)..(3716): n is a, c, g, or t
  misc_feature (3718)..(3720): n is a, c, g, or t
  misc_feature (3722)..(3722): n is a, c, g, or t
  misc_feature (3724)..(3729): n is a, c, g, or t
  misc_feature (3735)..(3739): n is a, c, g, or t
  misc_feature (3742)..(3745): n is a, c, g, or t
  misc_feature (3748)..(3750): n is a, c, g, or t
  misc_feature (3752)..(3753): n is a, c, g, or t
  misc_feature (3756)..(3757): n is a, c, g, or t
  misc_feature (3759)..(3760): n is a, c, g, or t
  misc_feature (3762)..(3762): n is a, c, g, or t
  misc_feature (3767)..(3767): n is a, c, g, or t
  misc_feature (3771)..(3771): n is a, c, g, or t
  misc_feature (3774)..(3775): n is a, c, g, or t
  misc_feature (3779)..(3779): n is a, c, g, or t
  misc_feature (3782)..(3782): n is a, c, g, or t
  misc_feature (3785)..(3786): n is a, c, g, or t
  misc_feature (3790)..(3790): n is a, c, g, or t
  misc_feature (3793)..(3793): n is a, c, g, or t
  misc_feature (3795)..(3795): n is a, c, g, or t
  misc_feature (3798)..(3799): n is a, c, g, or t
  misc_feature (3802)..(3802): n is a, c, g, or t
  misc_feature (3806)..(3807): n is a, c, g, or t
  misc_feature (3810)..(3811): n is a, c, g, or t
  misc_feature (3813)..(3814): n is a, c, g, or t
  misc_feature (3817)..(3830): n is a, c, g, or t
  misc_feature (3833)..(3833): n is a, c, g, or t
  misc_feature (3835)..(3835): n is a, c, g, or t
  misc_feature (3837)..(3839): n is a, c, g, or t
  misc_feature (3842)..(3844): n is a, c, g, or t
  misc_feature (3847)..(3851): n is a, c, g, or t
  misc_feature (3855)..(3857): n is a, c, g, or t
  misc_feature (3859)..(3871): n is a, c, g, or t
  misc_feature (3874)..(3878): n is a, c, g, or t
  misc_feature (3880)..(3880): n is a, c, g, or t
  misc_feature (3882)..(3882): n is a, c, g, or t
  misc_feature (3884)..(3891): n is a, c, g, or t
  misc_feature (3894)..(3895): n is a, c, g, or t
  misc_feature (3897)..(3899): n is a, c, g, or t
  misc_feature (3902)..(3906): n is a, c, g, or t
  misc_feature (3908)..(3908): n is a, c, g, or t
  misc_feature (3910)..(3918): n is a, c, g, or t
  misc_feature (3920)..(3922): n is a, c, g, or t
  misc_feature (3924)..(3924): n is a, c, g, or t
  misc_feature (3926)..(3929): n is a, c, g, or t
  misc_feature (3931)..(3933): n is a, c, g, or t
  misc_feature (3935)..(3939): n is a, c, g, or t
  misc_feature (3941)..(3944): n is a, c, g, or t
  misc_feature (3946)..(3953): n is a, c, g, or t
  misc_feature (3956)..(3960): n is a, c, g, or t
  misc_feature (3963)..(3963): n is a, c, g, or t
  misc_feature (3965)..(3973): n is a, c, g, or t
  misc_feature (3975)..(3977): n is a, c, g, or t
  misc_feature (3979)..(3987): n is a, c, g, or t
  misc_feature (3989)..(3998): n is a, c, g, or t
tatttatcacgctggatataagaaggcgttctatgttcagcctctagagctttatcaataagctgacttgtatctgacttaccacaaccaattaatattgttaaagagaataaaataagaaaaagtttatataattttttatttgtcatgtttatgtaaatttaaatattgatttgagggttaaagtaaaataatcaantatgattataaaaatatattaattgattactaatcaaaaacaagactttttattaaatgaagacattcagaaattacggatattggctttatctattatttatattattttattctggaaatactttctccaatgaattatttccatccaagggtgcagttgtaacttcgaacgctctagcaactaaagcaggagagaaaattttagctgaaggcggaaacgcttatgatgctgctaccacaatcagtgcaatgctttctgtggtagagccatttgcatcaggtctagggggtggtgcattctggttaatttatgatgctaaaagtaagaaatataaaatgttagatgccagagaaactgccccacttcaatctcataaaaatatgtatctagatgaaaatgagaaccttataaaaaatatttcaaagcttgggccattgtctgcaggaataccaggtattcctgcggtattgagttacgtcaatgagaaatacggttcaaaaaaattaagcacacttttagtccctgcctataaggcagcaataaatggatttcctgtaaatgaaaggtatttaaaaggagcaaattataaaaaggaatggctgaaaaaatataaagaaaccgaagcaatttttttagataaaggtgaggtaccaaaaaaaggatggattctaaaacaaactgatctagcaaaaacgatcaaaaaaataatgaaaggtggccacaaaagtttttacacaggaagttttgctaaaaaaatggttgaatctgttcaaaataatggcggtatttggagcgaagaagatttaaatagatataaagttattgagagagagccagttaaatcgacctacaaaggaatttcaattatcgccccaggacttccatcctcagggggcttggttttatctaatgctcttaatatattagcaggatatgaattagataaacttagtcttaccacccaaaaacatttaattattgaggctctaagacgagcgtattatgaaagagccataaaaatgggagacccagatttcatggctaattctcttgaatttcttttaactcccagttatgcagcaaaacaaagagaaagcattaatattaattatgcaacagataatcaaacgctcgagtttgctgacccaccatatcaagggcaaggaaatgatacaacgcatttttcggtaatcgataaatatggtaatcgtgtagcagtgacccaatctatcaacttttggtttgggtctgcttttgttccaaaagggacaggtgttttgctgaataatgaaatggatgatttttctatcaagcctggaaccgagaatggctatggattaattggctatgatgctaatgcagtggaacctggaaaaagaatgttatccagtatgacgccaacctttcttgaatcagatagaggttttgtaattttaggaactcccggaggttcgaggattataagtatgattcttcttgcaacattggaatgggtaaatggaggagacgctaaatctatggtctctttgccaaggtttcatcatcaatatcatccagattatgtgctctatgaggaagaagcatttatgtcgagcgagatcgatgaattggaaagtatgggacatatatttaaaaaatcaaataggcagtttggtaatatgcagataattatgtgggatcaagtaaataataaaattgaaattgcctctgacccaagaggaaaagaaaaaggccgtgaagaagtctattgattttaaaaacacatatagctttttataaaaggttacatagagacttatagagcaatttagctcaccttcatcaaccacctaaaaagaatagtttttattgggagttacacagcatgtcaaagggatatcatattcgtttgtatcttctataatttcgcaaggcataaaaagactgatgccaattttttttacatccttatgtaaagaggcaaaaaaacgatcgtaaaatcctttcccatagcctaccctatatccttttgtatcaaatgctaaaagnggggtgataaccatatcaatcttatcgttttctatccaaataggatcaattggttcggtaatattatatttggtttgtttagtttttgtatctggactgaatgctgcatttctcatggtcccctcttcaaagttactcacaggnacaacaacattaatgttatttttccaacaatattgaatgattggtgaagtattaatttcaccttttgtatgaatgggtaaaaagcaatgaacaaattttagctcatattttttaataagctcgattgtgttctgaatgagatgagatgaattttcttcaagttctaatgaagaaagttcttggcgctttttcaaatatatctttcttgctgtatcttttttcaaaataatcgtgatatcagagggctacaaattaaactgtgtgacatttattatcattccttataaccctctgtaatcacctatacaaagtacaatatacttatttcagttgatccttacccggcgcgtatgtttctgccgctcctggaaatgcttttgcatggacatcagctgcgaactgattaacggcatctttaataagatcagctccattcatgtatgttctgacaaacttaggtttaaagtctgtagaaaaaccgagcatatctggnagaaccaatgcttgcccatccacatcaagacctgctccaacacccacaactgggatagaaactgctttactgactgctgcacctacatgctgcggaacagcctccaaaacaatggcaatacacccaagttgatcaagttttttggcttcttcgacgatgctaagcgcactttcttttgttttaccttgagctttaaatccaccgattgcattatggtgggatggtgtaaggccaatatgtcctattgttggaataccggattgggaaagatgagcataaagctcttcgtttccatcaacaccttctattttaagagcatttgccccagccttgattaagatttcaacgttatccaatgaatcctttaacccctttctatttgccataaatggcataccagcgattaggaatttatcttttgctccttttttcacggctctggtgtgcattgcaattgtttccacatcgcaactcaaagtgtcttcatggccatgtacaaccatatttaaatcatcaccaattaaaattccatttatatttgtgtcgttaagaatcttggcactccaatactcatgtgaagtaacaacaacaatctttgttccttccgcttttaattgtttaaaactttctaatacgctcatttatctgtttccttaaattgtttatataaaaagtgacaattaaataaattacattaaatcctattttggattaaacntaaaaattaatnatcaggttttaaaacaagaagacttttggtcntgaattgtttttttnnnannnntttngnnnnnnantnnntttnnnnnnnnntnaanaangnnnnnnnttnnnnnnnnnncnnaanantnnntntnnnnnnttcccnnnnnttnnnnaannntnnaanntnntntttanaaanaannattnatnaannatanttntntannccntatnnttnngnnttnnnnnnnnnnnnnntananannnttnnntannnnnattnnnannnnnnnnnnnnnaannnnntngntnnnnnnnnggnnannnttnnnnnanannnnnnnnntnnnantnnnnannnannnnnannnnannnnnnnnaannnnntanannnnnnnnnannnannnnnnnnnannnnnnnnnntg

SEQ ID NO: 912 - DNA, 4000 bp, Escherichia coli
  misc_feature (1)..(1): n is a, c, g, or t
  misc_feature (25)..(25): n is a, c, g, or t
  misc_feature (55)..(55): n is a, c, g, or t
  misc_feature (58)..(58): n is a, c, g, or t
  misc_feature (76)..(76): n is a, c, g, or t
  misc_feature (85)..(85): n is a, c, g, or t
  misc_feature (87)..(87): n is a, c, g, or t
  misc_feature (94)..(94): n is a, c, g, or t
  misc_feature (100)..(100): n is a, c, g, or t
  misc_feature (121)..(121): n is a, c, g, or t
  misc_feature (193)..(193): n is a, c, g, or t
  misc_feature (199)..(199): n is a, c, g, or t
  misc_feature (202)..(202): n is a, c, g, or t
  misc_feature (208)..(208): n is a, c, g, or t
  misc_feature (217)..(217): n is a, c, g, or t
  misc_feature (250)..(250): n is a, c, g, or t
  misc_feature (256)..(256): n is a, c, g, or t
  misc_feature (271)..(271): n is a, c, g, or t
  misc_feature (292)..(292): n is a, c, g, or t
  misc_feature (328)..(328): n is a, c, g, or t
  misc_feature (334)..(334): n is a, c, g, or t
  misc_feature (346)..(346): n is a, c, g, or t
  misc_feature (349)..(349): n is a, c, g, or t
  misc_feature (376)..(376): n is a, c, g, or t
  misc_feature (382)..(382): n is a, c, g, or t
  misc_feature (388)..(388): n is a, c, g, or t
  misc_feature (391)..(391): n is a, c, g, or t
  misc_feature (430)..(431): n is a, c, g, or t
  misc_feature (436)..(436): n is a, c, g, or t
  misc_feature (439)..(439): n is a, c, g, or t
  misc_feature (448)..(448): n is a, c, g, or t
  misc_feature (460)..(460): n is a, c, g, or t
  misc_feature (463)..(463): n is a, c, g, or t
  misc_feature (475)..(475): n is a, c, g, or t
  misc_feature (508)..(509): n is a, c, g, or t
  misc_feature (547)..(547): n is a, c, g, or t
  misc_feature (568)..(568): n is a, c, g, or t
  misc_feature (649)..(649): n is a, c, g, or t
  misc_feature (658)..(658): n is a, c, g, or t
  misc_feature (771)..(771): n is a, c, g, or t
  misc_feature (974)..(974): n is a, c, g, or t
  misc_feature (977)..(977): n is a, c, g, or t
  misc_feature (1013)..(1013): n is a, c, g, or t
  misc_feature (1019)..(1019): n is a, c, g, or t
  misc_feature (1026)..(1026): n is a, c, g, or t
  misc_feature (1034)..(1034): n is a, c, g, or t
  misc_feature (1046)..(1046): n is a, c, g, or t
  misc_feature (1163)..(1163): n is a, c, g, or t
  misc_feature (1169)..(1169): n is a, c, g, or t
  misc_feature (1184)..(1185): n is a, c, g, or t
  misc_feature (1193)..(1193): n is a, c, g, or t
  misc_feature (1244)..(1244): n is a, c, g, or t
  misc_feature (1247)..(1247): n is a, c, g, or t
  misc_feature (1253)..(1253): n is a, c, g, or t
  misc_feature (1286)..(1286): n is a, c, g, or t
  misc_feature (1292)..(1292): n is a, c, g, or t
  misc_feature (1307)..(1307): n is a, c, g, or t
  misc_feature (1311)..(1311): n is a, c, g, or t
  misc_feature (1313)..(1313): n is a, c, g, or t
  misc_feature (1986)..(1986): n is a, c, g, or t
  misc_feature (2262)..(2262): n is a, c, g, or t
  misc_feature (2553)..(2553): n is a, c, g, or t
  misc_feature (2576)..(2578): n is a, c, g, or t
  misc_feature (2594)..(2594): n is a, c, g, or t
  misc_feature (2598)..(2598): n is a, c, g, or t
  misc_feature (2610)..(2610): n is a, c, g, or t
  misc_feature (2724)..(2724): n is a, c, g, or t
  misc_feature (3565)..(3565): n is a, c, g, or t
ntgcttggggatttgggacgacatnaagaatataccggctaaggtaaagctgacnggncagattattgccgcagcnattcccgtngncttcggngtacanatcgaatgggtaaccaatccnttcggaaccattttaatcattcccgaatggttggccgtaccggttacgattttttggattgtcggatttacnaatacngtnaatctnattgacggnttagacggcttggcggcaggggtatcggtaatngcttcnatttccatgtttttnatggctgtcagtatgaatcantatttgccggctatgattttagtggctatgtcgggngctgcnttgggatttttncantataactttaatcccgccaaaatcttnatgggngatacnggnagcatgcttctggggtatactatggcggttgtggctgtnntgggnctngtcaagacngcggcaacggtngcncttattgtaccnatcatcgccttaggggtacctattttagatacnntgtttgctattgtgcgtcgcaaaatgagcggcgttccnatatttcagcccgataaaggncatttgcatcaccgtttactggctttggggatgactcagaaacaagctgttctcagcatgtacatggtcagtgcggttttnggatttgtngcgattttcgttgccaatgtaagctataagaccggtattgttacggttatcgccgtcttggctattattatttattcggcccgtcgaatcggtgtgttacggcgctccgacancacaaacggcatgaaaaaatagaagggtatacgtctaaggaggcgctttcatgattaaagtaatgaccgtattcggcactcgaccggaagccataaaaatggctcctgtcgtattggaactgaaaaaacatcaggacgaaatcgagacggtcgtggccgtaacggctcaacatcggcaaatgcttgatcaagtgttgcatttnttnaaaatcaaacccgattacgatttggatattatgtcncagggncagactntatacganataacctcgcgngcgatgaacggattaaaagaggttttggaaaaagaaaagcccgatctggttctcgttcacggcgatacgacgacgacctttgccggtgctttggcttcttactacagtcagactgcngtcggncatgtagaagcgggnntgagaacnggggatatatattcgccttttcccgaagaaatgaatcgtaagctcacaggngcnattgcntcttttcattttgcaccgacggaaacggctaangccaancttttacgtgaaggngtgnanccggaaaaaatatatgtaacaggaaatacggttattgacgccttaatgaagaccgttcgtcccgactacgagtttgatgacgagaaattgcgccaaatcgactttgaacagcatcgagttatcttattaaccacccatcgtcgggaaaatctaggggagccgatgcgacatatttataaagctttacgttcggtcgtacaagaaacgcccgatgcggaaatcgtttttcccgtacatcgcaacccgcttgttcgacaggtcgttaacgaagaactggcgggggtagacagaatccacctcattgaaccgcttgattatgaaccctttgccaaccttatgagtcgcagctatctggtgctgaccgattcgggcggtattcaggaagaagctccgtctttgggaaaaccggttctcgttttgagaaatacgacggaacgaccggaagcggtaaaagcgggaaccgtatctcttatcggtaccaatgtggatgtcgtttatgaaacgacgagacgcctattgactgataaaaaagcttatgaagccatgagcaatgccgtcaacccctatggtgacggaagggcttcggaacggattgttcaagctgtgcgttatgtatacaatgaatgctccgaacggcctgaagaatttaaataaaatgaataaatattcaaancaaatagtatgattaaaaggcgacaaaatgtcgccttttttagtactctttacacttttaaaccttaagaaaaaaagggctaagcccattcggttttgttgcattttatcaaatggaagagtaaaatatacatcaggtacggggtcaatcgatgcggatataatcattgatttttaccgtattcactgtagttgccgtgaggggtaaatattcgtgggccaagcaacggaagaccgcaaaaaatcacaaaaaagaagcgacggcatgtcgacattncagctcgtagccgtagccggttcattgggccttactttatttgtgaacattattgtcggtattttcattggacgctttgtggattcgtattttaatacaagtccgttcgggctcatggcatttgcactcttaggttccgttaccgggttttggactttgtataaaaaagcggggactttgaatgaacgtggcaagtaacaggggaaatgaaaggacgaccggtggacgtatttactttatatgttaaaaaaacggtaattcgtcttgctgtaggcaccgtactgggggctnttgccgcttgggcggtcggagcnnncgagtatatttccggntggntcatcggtagcntggtcaatctgttgtacttcgtaatgctcagcagtcggttagcgaaatccgcacgtatgccggccgaacaagccttggtctttatccgcggcggcgtagtagtgaggctgttgntgattatgcttgtgcttatcgttgtactgcaatttcctcaaatcaggatttcctcctttgtggcaggtgtcatgatgtacagagtactgattttcggtgaactttttgtcaaggcgttacagcgcattttgtaggaagggaggtgcagcttatggaattacacgcggggcatcatacggttgttcagttgttagggttaaatgtcaatattgacaccttgatgatgacatggattgttgccgccatcgttattgtggttacactgttggcgacgcggggacgtgccttggtaccgagcggtatgcaaaacggcatggaaatgattgttgaagccttacttgaacagtttaaagaaaacctgggacctaaatacggtcaggttacatctgttctcttaaccatgtttttgttcattttctttgctaatgaattcggtctgttaccgaatccgggtgtattatcatcacctacaaatgatttgaacacgaccgtcgcattggctttggtcgcatcgtttttgacacatgcgttgtatattcgcaatcagggtgccggaaagtatttcaaacatttcttccagccttttgtattgttcttccccatcaacttaatggaagaatttacaaaaccgttgaccttgtcattccgtcttttcggtaatattttggccggtgaaattttgatggaagtgctgtatgaactggtacctgtaggcgtgccgctcatttggctcgtgttcagcttggttatcggtttaatccaggcatttatctttactattttgacaacatcttatttagctccgtcgttccacggatcacattaaatttttacatatctnggagggttataacttatggaaaaggcaattgttttggcattctcggcattcggtgcttgcttgggtattggtttggcagctttgggcgcggctcttgccgacggcaatgcggcttcgaaaatgttggaaggtacggcacgtcagcctgaaatgggcggcaagctccttacgaacatgcttatctctatcggcttgattgaatctattcctattatcgctgccgttatcgccattgtattggtattcgccaatccgtttgtaagtttactctaatttgaataaagaagtgttacttaccgaaacggggagggaataccattgatcagtataaacggtactttgcttttccaattcctcaacttctttgttctggtcgctattttggccaagtttgcttataaaccgatgttgaaggttctggaggaacggagaaac

SEQ ID NO: 913 - DNA, 4000 bp, Escherichia coli
  misc_feature (1991)..(1992): n is a, c, g, or t
  misc_feature (3422)..(3424): n is a, c, g, or t
  misc_feature (3426)..(3427): n is a, c, g, or t
  misc_feature (3429)..(3429): n is a, c, g, or t
  misc_feature (3432)..(3434): n is a, c, g, or t
  misc_feature (3438)..(3439): n is a, c, g, or t
  misc_feature (3441)..(3444): n is a, c, g, or t
  misc_feature (3448)..(3450): n is a, c, g, or t
  misc_feature (3453)..(3455): n is a, c, g, or t
  misc_feature (3457)..(3457): n is a, c, g, or t
  misc_feature (3459)..(3468): n is a, c, g, or t
  misc_feature (3470)..(3471): n is a, c, g, or t
  misc_feature (3474)..(3482): n is a, c, g, or t
  misc_feature (3484)..(3484): n is a, c, g, or t
  misc_feature (3486)..(3499): n is a, c, g, or t
  misc_feature (3501)..(3501): n is a, c, g, or t
  misc_feature (3503)..(3506): n is a, c, g, or t
  misc_feature (3508)..(3508): n is a, c, g, or t
  misc_feature (3512)..(3522): n is a, c, g, or t
  misc_feature (3524)..(3525): n is a, c, g, or t
  misc_feature (3528)..(3528): n is a, c, g, or t
  misc_feature (3531)..(3535): n is a, c, g, or t
  misc_feature (3537)..(3537): n is a, c, g, or t
  misc_feature (3539)..(3541): n is a, c, g, or t
  misc_feature (3543)..(3545): n is a, c, g, or t
  misc_feature (3547)..(3548): n is a, c, g, or t
  misc_feature (3551)..(3552): n is a, c, g, or t
  misc_feature (3555)..(3560): n is a, c, g, or t
  misc_feature (3562)..(3563): n is a, c, g, or t
  misc_feature (3568)..(3574): n is a, c, g, or t
  misc_feature (3576)..(3577): n is a, c, g, or t
  misc_feature (3579)..(3580): n is a, c, g, or t
  misc_feature (3582)..(3585): n is a, c, g, or t
  misc_feature (3588)..(3590): n is a, c, g, or t
  misc_feature (3592)..(3594): n is a, c, g, or t
  misc_feature (3597)..(3605): n is a, c, g, or t
  misc_feature (3607)..(3610): n is a, c, g, or t
  misc_feature (3612)..(3613): n is a, c, g, or t
  misc_feature (3617)..(3620): n is a, c, g, or t
  misc_feature (3624)..(3625): n is a, c, g, or t
  misc_feature (3627)..(3627): n is a, c, g, or t
  misc_feature (3629)..(3631): n is a, c, g, or t
  misc_feature (3633)..(3633): n is a, c, g, or t
  misc_feature (3635)..(3637): n is a, c, g, or t
  misc_feature (3641)..(3641): n is a, c, g, or t
  misc_feature (3647)..(3654): n is a, c, g, or t
  misc_feature (3656)..(3659): n is a, c, g, or t
  misc_feature (3664)..(3665): n is a, c, g, or t
  misc_feature (3667)..(3667): n is a, c, g, or t
  misc_feature (3670)..(3672): n is a, c, g, or t
  misc_feature (3674)..(3674): n is a, c, g, or t
  misc_feature (3676)..(3678): n is a, c, g, or t
  misc_feature (3680)..(3681): n is a, c, g, or t
  misc_feature (3683)..(3684): n is a, c, g, or t
  misc_feature (3688)..(3688): n is a, c, g, or t
  misc_feature (3691)..(3691): n is a, c, g, or t
  misc_feature (3695)..(3695): n is a, c, g, or t
  misc_feature (3700)..(3703): n is a, c, g, or t
  misc_feature (3705)..(3705): n is a, c, g, or t
  misc_feature (3707)..(3707): n is a, c, g, or t
  misc_feature (3709)..(3710): n is a, c, g, or t
  misc_feature (3713)..(3713): n is a, c, g, or t
  misc_feature (3718)..(3718): n is a, c, g, or t
  misc_feature (3721)..(3721): n is a, c, g, or t
  misc_feature (3726)..(3728): n is a, c, g, or t
  misc_feature (3730)..(3734): n is a, c, g, or t
  misc_feature (3737)..(3738): n is a, c, g, or t
  misc_feature (3740)..(3740): n is a, c, g, or t
  misc_feature (3744)..(3744): n is a, c, g, or t
  misc_feature (3746)..(3747): n is a, c, g, or t
  misc_feature (3750)..(3750): n is a, c, g, or t
  misc_feature (3753)..(3754): n is a, c, g, or t
  misc_feature (3758)..(3758): n is a, c, g, or t
  misc_feature (3763)..(3763): n is a, c, g, or t
  misc_feature (3767)..(3767): n is a, c, g, or t
  misc_feature (3771)..(3771): n is a, c, g, or t
  misc_feature (3775)..(3777): n is a, c, g, or t
  misc_feature (3780)..(3780): n is a, c, g, or t
  misc_feature (3782)..(3782): n is a, c, g, or t
  misc_feature (3788)..(3790): n is a, c, g, or t
  misc_feature (3792)..(3792): n is a, c, g, or t
  misc_feature (3795)..(3795): n is a, c, g, or t
  misc_feature (3797)..(3798): n is a, c, g, or t
  misc_feature (3805)..(3806): n is a, c, g, or t
  misc_feature (3811)..(3811): n is a, c, g, or t
  misc_feature (3813)..(3813): n is a, c, g, or t
  misc_feature (3817)..(3817): n is a, c, g, or t
  misc_feature (3820)..(3821): n is a, c, g, or t
  misc_feature (3824)..(3824): n is a, c, g, or t
  misc_feature (3826)..(3829): n is a, c, g, or t
  misc_feature (3833)..(3833): n is a, c, g, or t
  misc_feature (3837)..(3837): n is a, c, g, or t
  misc_feature (3839)..(3839): n is a, c, g, or t
  misc_feature (3842)..(3842): n is a, c, g, or t
  misc_feature (3845)..(3848): n is a, c, g, or t
  misc_feature (3850)..(3851): n is a, c, g, or t
  misc_feature (3859)..(3866): n is a, c, g, or t
  misc_feature (3868)..(3868): n is a, c, g, or t
  misc_feature (3870)..(3872): n is a, c, g, or t
  misc_feature (3878)..(3879): n is a, c, g, or t
  misc_feature (3883)..(3883): n is a, c, g, or t
  misc_feature (3885)..(3890): n is a, c, g, or t
  misc_feature (3895)..(3896): n is a, c, g, or t
  misc_feature (3898)..(3900): n is a, c, g, or t
  misc_feature (3902)..(3902): n is a, c, g, or t
  misc_feature (3905)..(3905): n is a, c, g, or t
  misc_feature (3911)..(3911): n is a, c, g, or t
  misc_feature (3915)..(3917): n is a, c, g, or t
  misc_feature (3920)..(3920): n is a, c, g, or t
  misc_feature (3926)..(3926): n is a, c, g, or t
  misc_feature (3928)..(3929): n is a, c, g, or t
  misc_feature (3932)..(3932): n is a, c, g, or t
  misc_feature (3938)..(3938): n is a, c, g, or t
  misc_feature (3940)..(3942): n is a, c, g, or t
  misc_feature (3947)..(3949): n is a, c, g, or t
  misc_feature (3952)..(3953): n is a, c, g, or t
  misc_feature (3958)..(3958): n is a, c, g, or t
  misc_feature (3961)..(3962): n is a, c, g, or t
  misc_feature (3964)..(3964): n is a, c, g, or t
  misc_feature (3966)..(3967): n is a, c, g, or t
  misc_feature (3970)..(3972): n is a, c, g, or t
  misc_feature (3974)..(3974): n is a, c, g, or t
  misc_feature (3977)..(3977): n is a, c, g, or t
  misc_feature (3981)..(3981): n is a, c, g, or t
  misc_feature (3983)..(3983): n is a, c, g, or t
  misc_feature (3987)..(3987): n is a, c, g, or t
  misc_feature (3997)..(4000): n is a, c, g, or t
tcgcacgcgcctcgccgcgcgcgaaccatctcgatcccatcgtcattatcatcgataccgccaccgcttcctgagatgatcgcgtgcgacgcgactgcgactaggcggcaactcgtgcgcgcgtccgcgtcggagaaggcgccgcgccgctcgacgagcgcgccgcgcgacgtcatgatacccgcgccgaccacatctgcgtgcgacacgacgcgtttcagcgcttcgtccaccgacactcgttgcgccaccgccatcgcgtcgccctctgccgttccatcctcgcgttgactcggccaaaaaaaacttcaactctccgaaaactaacacatctgtcgatgataatacaaacgcgcgacttgcgctccgccggcgccgcgcgctcacggcggcggtaatcgatgcaatcccggtgaatgtccggtactcacgctacttgtgctcacgatcgaccgcttcaaccgatcgctcgtctcttctaattctttcctcagcgcttgcacttcgctcgacaacgtctccttgagactcgccaactcgcccttgtaattcttcacctgattatccatcttataccgccaatcctgaagttctgtcttcagcgcgtgcacgcgattgagcaactcttcgcgcgtttgttgatgatcctgcgcggacgcgagtcggcgatgtttcggcgtcagtgcgcgatttgatttcgattttgatttcgacgtcttcgtcgcgatcgtcgtcgtcgtgtcgcgtcgcgtcgcgtcgcgtcgcgtcgcgttcgcgccgtacctttaactgtctcacttcggtctccatcccggtgttcccgtacgcgttcgcgcgcgcgggagagtccatggcgcgcgacgccgagtgacgatggcggggcgtggcggtggtgactggacgtcctcgcaaacatttctgagacggagaaaattgtgcccgcaactgtggaatttgtggatattgcgggaaaaaaggactacggcgactacggactacgaactacgaaggactgcggcgagcgctaagcctagaaatgtcgcgatggaattcgcgagcgtggcgattaaaactgccggcgcgcgtaacgaacgccaaccgacggcgtcggcgagcgaagccacggtggcgggaccgccgatgctggcgttgctcgcgaggacgtactcgcgacggcgatcggcgtcgacgcgaatgccgacgaatacaaaggcgagatggacggcgtacaggatgaatgagaagacgaagacgttggcgtatcgcgcaaacgtggaagcgctcaaaacgccgcccgcggcgccggcggcgacgaagaacacgaagagcatcgcgttcgcgagcggttccgcggcgacggcgagcgacgccgcgcgtttcggcgccaaagtcgcgaaaacgacggtgaaaaccgtcgccatcgggagcacggcgtcgggttggcccacgaggcgagcgacgagctcgcccgcggcgaggaagccgacggcgacgaagaacgccgacaacgcgtcgtccgcgcccgagcgcgccgccgcgccgtccgcgtcctcggcctcgcgctccgtcgtcgcctcgcgctcgcgctcggcgtcgtcctcgtcgtccgccgcgtcgccgcttcctcgctcgccctcgcgtcgcgccaaccacgaaatgaacggaaagtacgccagcgccatcgcgttatcgacgcacagtcccgcgacgaattcttcgccatccatccccagcgtcgtcgccacggcgacgtaattcaatccaccgccgacgtttttcgccgccagcgccgcggcgagtttccaactaaacgcccccccgaacgccgcgctcgcgccgcgcgccccgaacaccgcgccgaaagcgctcccgatcgccgcgacgacgaacgctcgcgccatcgcgcgcgtccttcttctcgtccctcccgcgcgcgcgttcgctcgcaggagcgtcatcggcgtcgcggcgaacgcgcacatcttttgcanntccgcgacgccgcgcgcgccgccgctcggcagcgcgccgatcgcggcgaacgcggcgccgaacgccatcgcgcacacgggcgcggtcgccgcgcgtccgacgcgcgttcgcgacgcgacgacgcgtccgagcgacgccgccgcgagcacggcgaacggcacggcgaacgccgacgccgcgggcgcgagcgcgcgcgcgcgatgccgcggcgcgcgtcgccgacgtcgcggcgtcaccgcgcgacgcgtcgtcgcgcgatcgacgcgcgcggcgagacgcgcgcgcggcgccgtcgccatgacgccgcgacgccgcgatgtgacgcgccgcgacgtcggcgccactcgacgacgcgcgccgggcgacgcgcgacgaacggcgcgcgcgtcgcgctcgacgacgatgcttcgcgcgacgacgcgacgcgcgctcgcggcgtcgcgcgtcgcgcgcgcgtcgatcgcgcgcgagacgacgacgacgacgacgacggcgcgcgtcgacgacgcgacgcaccgcgcgacgcaccgcgcggcgtcgtcgaacgcgacgacggcgacgcggtattcgcgcgatggttcgcgcgaccgcggcgcgcgatcgacgcgcgcggcgacgacgccgacgcgcgcgcgagggttcgccgagggcggcgcggcgccgccgcgggacgacgagacgcgaggatttgatttctacgacgccgcggacgtgggcgtcgtccggggaccgggaactgtgatcgaacacgacaccgggggcgtgctggcgctgaacgcgctgcgagacgtggacggggcgaggaaaaatcgtaaacgcgtggggcgaggcgtcgggagcgggaaggggaagacgagcgggcgagggcacaagggacagaaggcgcgaagcggaggggggccgaggctcgggtttgagggcggacaaacgccgctgcgattgacgctgccgaaacgcggcgcgcataatccgcacgcgatgacgtttgatgtggtgaatttgaacgcgctgcgagcgcacgtcgaggcgggacgattcggggagtacgactacgaaaatccgcgcgtgttgacgatgaaggatttcgtcgacgcggggttgtcgaacaggaaaattaagcatggggtgaaaattttagcgggcgcgctcggagacgacgccgagggcgcggatgatgcgttcataaaggtgcgattggaggtgtcgcgcgcgagcgccaaggcgaaggaaatcatcgaacgcgcgggcgggagcgtgacgcgagtgcattacaatcgcctcgggttgcgcgcgttgttgcagccggagaaatttccgcgcggcttgcccaagcccgcgcgagcgccgccgaagattcgtccattcatcgatcgcgaaggaactttgcccgcgccggcgcccttggaggccgactcgtgaagaagcgcgannnanntnaannncganntnnnnacgnnntcnnnanannnnnnnnnncnnggnnnnnnnnngntnnnnnnnnnnnnnncngnnnncncttnnnnnnnnnnnanntcnttnnnnncncnnncnnncnngannttnnnnnncnntcgannnnnnntnntnncnnnnttnnncnnncgnnnnnnnnngnnnncnnattnnnncacnncncnnncncnnncgangacgannnnnnnncnnnngttgnncnaannncncnnnanncnncccnagngcangcccnnnncnancnnggncgggnccncggannngnnnnnggnntnggcntnngcnttnntgtncttgncctngccngcgnnncgncncaacannntnaancnnttcgccnncgccngnccgncgnngcngnnnngggngganangangannnncnntccccccnnnnnnnngntnnnggcgcnnccgngnnnnnntttcnncnnnanccngagctngggnnngancatgancnngtncggcgncnnnttgcnnntgnntttgnganncngnnacnnnanctnggtngngccnttggctttgnnnn

SEQ ID NO: 914 - DNA, 4000 bp, Escherichia coli
  misc_feature (2)..(2): n is a, c, g, or t
  misc_feature (7)..(8): n is a, c, g, or t
  misc_feature (12)..(12): n is a, c, g, or t
  misc_feature (14)..(14): n is a, c, g, or t
  misc_feature (16)..(17): n is a, c, g, or t
  misc_feature (19)..(19): n is a, c, g, or t
  misc_feature (21)..(21): n is a, c, g, or t
  misc_feature (23)..(23): n is a, c, g, or t
  misc_feature (27)..(28): n is a, c, g, or t
  misc_feature (30)..(30): n is a, c, g, or t
  misc_feature (35)..(35): n is a, c, g, or t
  misc_feature (37)..(37): n is a, c, g, or t
  misc_feature (39)..(39): n is a, c, g, or t
  misc_feature (41)..(42): n is a, c, g, or t
  misc_feature (47)..(48): n is a, c, g, or t
  misc_feature (51)..(52): n is a, c, g, or t
  misc_feature (54)..(55): n is a, c, g, or t
  misc_feature (57)..(58): n is a, c, g, or t
  misc_feature (60)..(60): n is a, c, g, or t
  misc_feature (63)..(65): n is a, c, g, or t
  misc_feature (216)..(216): n is a, c, g, or t
  misc_feature (377)..(377): n is a, c, g, or t
  misc_feature (402)..(402): n is a, c, g, or t
  misc_feature (486)..(486): n is a, c, g, or t
  misc_feature (1126)..(1126): n is a, c, g, or t
  misc_feature (1293)..(1293): n is a, c, g, or t
  misc_feature (1980)..(1980): n is a, c, g, or t
  misc_feature (1986)..(1986): n is a, c, g, or t
  misc_feature (1991)..(1992): n is a, c, g, or t
  misc_feature (1998)..(1998): n is a, c, g, or t
  misc_feature (2029)..(2029): n is a, c, g, or t
  misc_feature (2764)..(2764): n is a, c, g, or t
  misc_feature (3461)..(3461): n is a, c, g, or t
  misc_feature (3464)..(3464): n is a, c, g, or t
antcccnncacnangnnancnanaagnngnggcancnanannacgtnnttnnanncnncncgnnnagcagctacctgtagaaacctacctacggtccggtgtgttgccccaaaataaaacgaagccgcgtggacacttcatcgccgaccgtgctcgtcgttatcgatcaatcggtcgattcgcacccgtgcgtcgacgagttgtgagcgtagcccnacaaggtcgtcgctccccaaccgcatggacgtgttgcactcgctgcatgccagcgtgcgaagccgccatgcgagttctacggagtgcgtcgtgatcgcgccacatcgacggcacttggcaatcagttcggcgactccaccctgtgcgtggaccagaagagngaacccgccggtattcttctgttcngttgtatcgttcgcgagcatcaggcgagtatgggctgatgctcagcgacgatgcaagcgataggggtgaggcccgatcatcgcnaagggcttataagtccatatgaagccgtccgaaagaaatgtcggaatcttcacggctcgcagttggctttcttgcgaaaggccccatcgttggataggcagcacgctccgcgctcaatccgcccggccctggcgatatccttcatccattgggctaaagccagggggcacttctccagtaatctcaccaggaacatctggggcgaacaagagcgcctgcaactcttctttggcttctcttttacgagggcttctcgctgtgatccccgaccgcgggcatgaagtttccagactgtccgcaaccgacgtgtgcggaagcgcacgcctgaccggcgaacagctcgatagcctgcgcgcgtgcgcgaagggcatctcgcttcgattcgagaagtcagaaatagtcaatgcgttggttgccgcaggttacgccgagaggaacatcgtcggcgtcatcaagcttacggcaagcggagatcagcatttgcgcttgcagagggttgacgcaagctcagcgtaagtgcaagacggcaccgactcgaggcgttgtccccgacctgcggcccgctgcgtactcaaacgataggcagcgcgaaagcagaccctaagtagcgccctcgaccgttgctgcgctagctcgatcntgtttcagtatctcgcgcgcagcgcacgcgtaggtactaccgagtggaatgccgaatcgcgcacacgtgatgctaggtagcggattgctgcagccggtcaagttcgtcgccagttcgatcgcaagcccttgttgattcgcgtcaatcgacaacaggaattggtctcnaacgttcgccggcgcatatggggtcgtcattgcattgttccttctcgcccgtcttgatggactgacgaccatccgtaaacgcatgcctgttgactgacggagacgagcccgtccacaacggtcaatccgttcgaggacctgagcgcaatgaggaacgagcgcgcctcattgcccgatcggccgcgcgaattcgaactctcgtagtgtggcgtattcatttgctctttcgggttttacgcccgagaagccgagcgtcaccttgctcatggttgagcaaggaggatgagtatggcctcaatttgcccccagcgccgcgagcgaatgaaatagatatgccggtcctttgccatgccttggtgggaccttttgttcagtaaagcgtcctttcacgtccggtaaagcgcgactcgatcgcgttgtgccctgcggtttgcccgatatcagcgccgagctgctcgccatcaaagtcgcaagcgtcagtcctggcaccgccgtggacaccgacgagcatgaaagtcgctgcgccacgcaacgcccgaatcatctgcgtaccggttcggcccgctaagtccgatcgcgaaatgcgccaacaggcagtccctggacaaccggggcggagccgggtgtgcatccagcctccgcctcggtgattcaagaatgccggctcttgcttttcttgtataggtnttgtanaattnntattcnccttacagaacaagctttgtacatagtgctnccgatccgcacagtatgctccatgacaggtttgaatccggtcaccttgcgcgcctgggagcggcgctacggcctgatcaagcctgaacgcaccagcagtggacaccgcatgtacagcgacggcgacgtcgaacgcattcggaaggttcttgcgttgacgcgggagggcgtcgcgatcgggcaggtgaaagcagcgctcgaggccgaacctgtagtcgctacaccaccaccggacaagggtccgtggctcggttatcgccgccgtttagccgcagccatcgccgggttcgacgaaggtgcgcttgaagctatctatgacgaagcgctggctttgcactcagtgaacgtcgtcgatcgcatgttgctagtgccgatgctcgcagagctcggtacgcggtggaccaaggtgaccggtggcgtggcggaggagcacttcttttctgcgtacctgcgcaacaagatcggtgcgcggtttcatcatcgacgcatgcatgaagtgggtccaaaaatcctcatggcttgcggccccggcgagctgcacgagacgggccttctcctgttcgcactcgctgcgcacgacgctgggtttcgtgtcgtgcttctcggggccaacgtgccgttccgcgagaccgcggccgccgcacatcgcacgcaatgcgacgcagtcgtcatttcgaacacgctggacctcggaactcccgagttctacgccgaactgtcagctctcgtttcagcnaccaagcgccccgtctttgtcggcggccatatcgcctcggttcgcgagaaggaaattcaagcgtctggagcagtggcccttgcgacatccatcgaattggcactgcgccgcgtggcctccggcattcagcgtgcgcgagggcgccaatgagcgttattagtcaattttgaggtgcccgacgatcgacgatcgcacggagatacgaactgctactcggcgctgccgttgcacccgcgtcaacgccaacaaattcaacttcaatgaaggagccgtcatgagaaacaaattgcttgccattgccgcctcgacgctgatagcagcatccgcgtcggccaaagatatcgtcgacaccgcagtttcggccggccagttcaatacgctcgctaccgcgctgcaagctgctggactcgtcgacacgcttaagggacccggtcccttcaccgtgttcgcgccgaccgatgcggcattcgccaaaattccaaaagctgatctggatgcgctgctgaaggacaaggcgaagctcacggcagtgctgacctatcacgtcgttcctgggaaagtaatggccaaggacgtcaaacctggcgcattgaagagcgtagaaggtagcccgatcacggtggcagcgaccggaggcaaggtaatggtcgacggcgcaacggttacaaagaccgacatcagcgccgacaacggcgtnatncacgtaatcgattctgtaatcgttccaaagaattagttctggaggtgctcgccgggtggtcgcccggcgacgtctatttcgctaaagaggaaccatgaaagctctcacttggatagccgttatcgttctcgtcatcggcggcatcaactggctgctggtcggcgcattcaatttcgatcttgtcgcaacgctgtttggcgagatgtccgcgatgtcgaggatcgtctacatgctggtcgggcttgcggccatttatgtcgcgatctactcgccgcgactcgtccgtagcgctacttgattagcgtcggcgggcgtcagcgactgttgacgctcgccaccagtcctgtacccgggattgaatgcaacacatcatctcccttctggtctgtattgcgatcaccgccgccgcggctgtggttggcggcattgcctcatttgaggcgggccctttctacctgcaactcgaaaggccggcgtgggcccctccaccctggttgttcgggccggtatggaccatcttgtatctcttcatggct

SEQ ID NO: 915 - DNA, 4000 bp, Escherichia coli
  misc_feature (219)..(219): n is a, c, g, or t
  misc_feature (1948)..(1948): n is a, c, g, or t
  misc_feature (1991)..(1991): n is a, c, g, or t
  misc_feature (2007)..(2007): n is a, c, g, or t
  misc_feature (2012)..(2012): n is a, c, g, or t
  misc_feature (2025)..(2025): n is a, c, g, or t
  misc_feature (2029)..(2029): n is a, c, g, or t
  misc_feature (2047)..(2047): n is a, c, g, or t
  misc_feature (2334)..(2334): n is a, c, g, or t
  misc_feature (2371)..(2371): n is a, c, g, or t
  misc_feature (2434)..(2434): n is a, c, g, or t
  misc_feature (2455)..(2455): n is a, c, g, or t
  misc_feature (2633)..(2634): n is a, c, g, or t
  misc_feature (3153)..(3153): n is a, c, g, or t
  misc_feature (3183)..(3184): n is a, c, g, or t
  misc_feature (3209)..(3209): n is a, c, g, or t
  misc_feature (3297)..(3297): n is a, c, g, or t
  misc_feature (3849)..(3849): n is a, c, g, or t
ttaatcttctcacgaattaacttgcctgagatcaaacatgcagagactgaagaagacaaaatcaaaggaactcgcatcatgaagctattccgtcatcacccgatgtttgtctttggactctttgctttgttagcttatgaggtggcagagatatcaatcaacagctactttattaactttgttacgggtcaaggatggttagatgacaacacagcaagnatcgttttgaccattgctttgggcttctttatggtgggaaggtttgtgggtagctggctcatgcgacgcattcgagcagaaataatgctgtttgtttgtgcagtagcgagcgtcataagtatggttgttgtgctattaaacattgggcgattctctatggttgccatcattatcaactatctttttgaagccattatgtttccaaccatcttctcattggcccttaatggtctgggaaatctaaagaaaagtgcagcttctttgctaatgatgacaccgattggaggctgtggtttcttgctcatgggcatcattgcagacaatgcaaaccttgtgattcctttcttaattcccttctttggcttcttcgttgtattgctttatgcttctgaattgatgcgaaagagattgtaatccaacagaagataggaggtaacattgctatatccatgttgcaactgacgccatgtcgcttgatttaacgcaaaattaaactttttaacctgcttcgaattgaaaaaagagaaccaacattttgcgtcatcaaaagattatgttaaatttgcaatcagaaaaagatgaagagataacattcatttagtgatctatttataaacataatattacagattatggcagttagttttaaagaattaggtctcgttaatacacgcgagatgtttaagagagcagtgaatggcggctatgcaattcctgcatttaacttcaacaatttagagcagcttcaggctattattacggcgtcatctgaattgaaatcaccggtaatcttacaggtttcaaagggtgcccgcaattatgctaacccgacattactacgttatatggcagaaggagcagtagcttttgcaaaggaacttggctgtgctcatcctgagattgcacttcacttggaccacggagacagcttcgagctcgtgaaagattgcgtagatatgggcttctcttcagtcatgatagatgcttcttcaaaaccttttgaagagaatattgagttgactaagaagtgcgttgattacgctcatcagttcgatgtgactgtagaagcagagttaggtgtacttgctggtgttgaggatgaagttgcttcagaggaatctcactacactcgaccagaagaagtgattgagttctcacagcgttcaggctgcgatagtctcgccatttcaatcggtacatctcatggtgcatataagtttaagccagaacagtgtactcgtgacccgaagactggccgcttagtacctcctcctttggctttcgatgttctcgcagagatagagaagaagcttccaggattccctattgtacttcatggttcgtcttcagttccacagaaatatgttgatattatcaaccagtatggaggcaaattacctgatgcagtgggtatacctgaggaacaattacgtagggctgctaagagtgctgtatgtaagattaacatcgattctgactctcgtttggcttacactgcaggcgtaagagagactcttgcgaaccatcctgactactttgatccacgtcaatatggtaaggttgcacgcgattatatgatcgaaatgtataaagagaagatcacagacgtgcttggttctgagaacaaacttgctcaattgtaagcaaactacgactgaaaggtcgaataaaataataaaggtgagcacttcatagtgcccaccttttttcgtatatcattatcttttgnggtgtatatcaatacttttgagggtatatatcgatatcttttngggtgtatatcaatanttttnagggtatatatcnatanatttgagggtatatatcnatatatttggctgcgcaaacagaaagggctctctaattcattagcctacaattgagagccgatttgcatcattttgctgaacaaccatattatagttgtttacccaaatgccacacaagaccgaaattaagaataccttgcaggccgtaaccaagttcagaagtgaatctcaaatgattcgaaccaatctctattcccacaggagaaagctgataagccaccctcattttgttttctttaatgttagggaaactgctgctatttgacgacagatgataagcacttanccccaaacctcctcttgaataaagtgcaaagtgcccnttgtctaaccaagaatagcgcactgaaggcatgaaagtaaaggccttactcgataatttcaantcatcatttgggacgattgantagatgagtccaaggtaaacgaggctaaaagcgtcattattcacttgcttttctaatggcacatgtgctccttgtgccactgcttctgtataactaagtcctgcacctactgcccatttctcattcaaatgatagaaatattccatatttaatgaacagttaatgttgctgagtgtcnngaacaaagaagcgtcgtcttcaagctcaaacaatttaatatagtcatttctcacgctctttaagtgcggttcatcaccgaatccgatactccatctcaattcatgtttgaaatgttgtgcctgtattgtcaatgcaaaacaagtcagaagtaaagttagaagtccttttttcatgttatcgtttctatttaattagtttgctacaaagataaagaaaaaatccataatcaaacattttttcacatcttttttttcattttattgaatcaagtcaatctcatgagaaatcatcgagatagtaaacgaaagatgagttaaacgttttgaaagtaatttacaacagagaccacaaaaccttacaatatgaaagctcttagcacaactatccaacagcgtgctattttcttgcattttacaaactccttacaatcaatcaattacgaaaaaggccttaaaatttatgatgatatcacataaaaacaacgtgtaatctctatggaatcatacgctcatctctgncatttcatcgcatgaaatgaagcatttgtnngcgccatttgtgccgaattagagantcgaatggcgcaaaacaccctatcttcttatagccttcgttgattaaaccctatttttctatgatttactctctatttcatcactccncgaagtgttaaaaaactatcattaatctttacgatataagcctctacttcttgactaaaacgaagacaagaacaagagtttcagctaaaactttatatcatttcgctttgtttattccagcatattatcatcccgaaggccaaatattttgtcgttttccaacatttgttgaacccaaagagaaaggcactttgctcatgaaaacaaagtgccttagtcttgatatgttataaacagcgtttactttatagggaaaagaccatagagttcggcatcaatctggtcggtaatcctttgaaaatcctgaggattattctcgaaatcagtgtgatctccatcaacaatgatgagatgacctttatagtctttaatccagttttcatagcgatcgttcagtccagagaggtaatcgatgcggatactcttttcaaattcgcgcccacgtttaccgatatggttaaccaaagtcggtatacttgaacggatatatatcatgagatcgggtaactttacgagtgaaatcatgagctcaaacaagtcagaatagttagnaaagtcacgatcactcatcatgcccatactatgtaaattcggcgcaaagatacacgcatcttcaaatatagtgcggtcttgtatgatggtatctgcactctttgatatctcaactacctccttaaaacgtttatttaagaaatagatttgg

SEQ ID NO: 916 - DNA, 4000 bp, Escherichia coli
  misc_feature (189)..(189): n is a, c, g, or t
  misc_feature (499)..(499): n is a, c, g, or t
  misc_feature (1314)..(1314): n is a, c, g, or t
  misc_feature (1430)..(1430): n is a, c, g, or t
  misc_feature (1986)..(1986): n is a, c, g, or t
  misc_feature (2273)..(2273): n is a, c, g, or t
  misc_feature (2279)..(2279): n is a, c, g, or t
  misc_feature (2321)..(2321): n is a, c, g, or t
  misc_feature (2342)..(2342): n is a, c, g, or t
  misc_feature (2351)..(2351): n is a, c, g, or t
  misc_feature (2357)..(2357): n is a, c, g, or t
  misc_feature (2360)..(2360): n is a, c, g, or t
  misc_feature (2369)..(2370): n is a, c, g, or t
  misc_feature (2373)..(2373): n is a, c, g, or t
  misc_feature (2378)..(2378): n is a, c, g, or t
  misc_feature (2381)..(2381): n is a, c, g, or t
  misc_feature (2384)..(2385): n is a, c, g, or t
  misc_feature (2393)..(2393): n is a, c, g, or t
  misc_feature (2399)..(2399): n is a, c, g, or t
  misc_feature (2402)..(2402): n is a, c, g, or t
  misc_feature (2409)..(2409): n is a, c, g, or t
  misc_feature (2429)..(2429): n is a, c, g, or t
  misc_feature (2432)..(2432): n is a, c, g, or t
  misc_feature (2438)..(2441): n is a, c, g, or t
  misc_feature (2444)..(2444): n is a, c, g, or t
  misc_feature (2446)..(2446): n is a, c, g, or t
  misc_feature (2449)..(2449): n is a, c, g, or t
  misc_feature (2459)..(2459): n is a, c, g, or t
  misc_feature (2474)..(2474): n is a, c, g, or t
  misc_feature (2790)..(2790): n is a, c, g, or t
  misc_feature (2831)..(2831): n is a, c, g, or t
  misc_feature (2837)..(2837): n is a, c, g, or t
  misc_feature (2842)..(2847): n is a, c, g, or t
  misc_feature (2849)..(2849): n is a, c, g, or t
  misc_feature (2854)..(2858): n is a, c, g, or t
  misc_feature (2860)..(2861): n is a, c, g, or t
  misc_feature (2863)..(2869): n is a, c, g, or t
  misc_feature (2871)..(2873): n is a, c, g, or t
  misc_feature (2875)..(2878): n is a, c, g, or t
  misc_feature (2880)..(2884): n is a, c, g, or t
  misc_feature (2886)..(2888): n is a, c, g, or t
  misc_feature (2890)..(2893): n is a, c, g, or t
  misc_feature (2895)..(2905): n is a, c, g, or t
  misc_feature (2907)..(2908): n is a, c, g, or t
  misc_feature (2910)..(2913): n is a, c, g, or t
  misc_feature (2915)..(2917): n is a, c, g, or t
  misc_feature (2920)..(2923): n is a, c, g, or t
  misc_feature (2926)..(2927): n is a, c, g, or t
  misc_feature (2929)..(2929): n is a, c, g, or t
  misc_feature (2931)..(2935): n is a, c, g, or t
  misc_feature (2937)..(2942): n is a, c, g, or t
  misc_feature (2944)..(2944): n is a, c, g, or t
  misc_feature (2948)..(2950): n is a, c, g, or t
  misc_feature (2953)..(2954): n is a, c, g, or t
  misc_feature (2956)..(2956): n is a, c, g, or t
  misc_feature (2958)..(2959): n is a, c, g, or t
  misc_feature (2961)..(2961): n is a, c, g, or t
  misc_feature (2963)..(2963): n is a, c, g, or t
  misc_feature (2967)..(2967): n is a, c, g, or t
  misc_feature (2969)..(2971): n is a, c, g, or t
  misc_feature (2974)..(2975): n is a, c, g, or t
  misc_feature (2979)..(2979): n is a, c, g, or t
  misc_feature (2983)..(2983): n is a, c, g, or t
  misc_feature (2985)..(2988): n is a, c, g, or t
  misc_feature (2990)..(2994): n is a, c, g, or t
  misc_feature (2996)..(2998): n is a, c, g, or t
  misc_feature (3000)..(3000): n is a, c, g, or t
  misc_feature (3002)..(3006): n is a, c, g, or t
  misc_feature (3008)..(3010): n is a, c, g, or t
  misc_feature (3013)..(3016): n is a, c, g, or t
  misc_feature (3018)..(3019): n is a, c, g, or t
  misc_feature (3021)..(3021): n is a, c, g, or t
  misc_feature (3023)..(3025): n is a, c, g, or t
  misc_feature (3027)..(3030): n is a, c, g, or t
  misc_feature (3032)..(3038): n is a, c, g, or t
  misc_feature (3043)..(3046): n is a, c, g, or t
  misc_feature (3048)..(3048): n is a, c, g, or t
  misc_feature (3050)..(3054): n is a, c, g, or t
  misc_feature (3056)..(3056): n is a, c, g, or t
  misc_feature (3058)..(3058): n is a, c, g, or t
  misc_feature (3060)..(3064): n is a, c, g, or t
  misc_feature (3066)..(3068): n is a, c, g, or t
  misc_feature (3071)..(3075): n is a, c, g, or t
  misc_feature (3077)..(3077): n is a, c, g, or t
  misc_feature (3079)..(3083): n is a, c, g, or t
  misc_feature (3085)..(3087): n is a, c, g, or t
  misc_feature (3089)..(3089): n is a, c, g, or t
  misc_feature (3091)..(3097): n is a, c, g, or t
  misc_feature (3102)..(3102): n is a, c, g, or t
  misc_feature (3105)..(3110): n is a, c, g, or t
  misc_feature (3112)..(3130): n is a, c, g, or t
  misc_feature (3133)..(3136): n is a, c, g, or t
  misc_feature (3138)..(3141): n is a, c, g, or t
  misc_feature (3143)..(3145): n is a, c, g, or t
  misc_feature (3147)..(3147): n is a, c, g, or t
  misc_feature (3150)..(3151): n is a, c, g, or t
  misc_feature (3153)..(3153): n is a, c, g, or t
  misc_feature (3155)..(3156): n is a, c, g, or t
  misc_feature (3158)..(3160): n is a, c, g, or t
  misc_feature (3162)..(3166): n is a, c, g, or t
  misc_feature (3169)..(3170): n is a, c, g, or t
  misc_feature (3172)..(3174): n is a, c, g, or t
  misc_feature (3176)..(3181): n is a, c, g, or t
  misc_feature (3183)..(3185): n is a, c, g, or t
  misc_feature (3187)..(3200): n is a, c, g, or t
  misc_feature (3202)..(3203): n is a, c, g, or t
  misc_feature (3207)..(3208): n is a, c, g, or t
  misc_feature (3210)..(3229): n is a, c, g, or t
  misc_feature (3232)..(3234): n is a, c, g, or t
  misc_feature (3237)..(3239): n is a, c, g, or t
  misc_feature (3241)..(3245): n is a, c, g, or t
  misc_feature (3247)..(3254): n is a, c, g, or t
  misc_feature (3256)..(3256): n is a, c, g, or t
  misc_feature (3258)..(3260): n is a, c, g, or t
  misc_feature (3263)..(3265): n is a, c, g, or t
  misc_feature (3268)..(3268): n is a, c, g, or t
  misc_feature (3270)..(3275): n is a, c, g, or t
  misc_feature (3278)..(3282): n is a, c, g, or t
  misc_feature (3284)..(3287): n is a, c, g, or t
  misc_feature (3289)..(3290): n is a, c, g, or t
  misc_feature (3293)..(3298): n is a, c, g, or t
  misc_feature (3301)..(3303): n is a, c, g, or t
  misc_feature (3306)..(3307): n is a, c, g, or t
  misc_feature (3309)..(3313): n is a, c, g, or t
  misc_feature (3315)..(3328): n is a, c, g, or t
  misc_feature (3330)..(3337): n is a, c, g, or t
  misc_feature (3341)..(3343): n is a, c, g, or t
  misc_feature (3346)..(3348): n is a, c, g, or t
  misc_feature (3350)..(3358): n is a, c, g, or t
  misc_feature (3360)..(3362): n is a, c, g, or t
  misc_feature (3364)..(3376): n is a, c, g, or t
  misc_feature (3378)..(3378): n is a, c, g, or t
  misc_feature (3380)..(3386): n is a, c, g, or t
  misc_feature (3388)..(3389): n is a, c, g, or t
  misc_feature (3391)..(3395): n is a, c, g, or t
  misc_feature (3398)..(3398): n is a, c, g, or t
  misc_feature (3401)..(3404): n is a, c, g, or t
  misc_feature (3406)..(3406): n is a, c, g, or t
  misc_feature (3408)..(3408): n is a, c, g, or t
  misc_feature (3410)..(3411): n is a, c, g, or t
  misc_feature (3413)..(3416): n is a, c, g, or t
  misc_feature (3418)..(3418): n is a, c, g, or t
  misc_feature (3420)..(3427): n is a, c, g, or t
  misc_feature (3429)..(3431): n is a, c, g, or t
  misc_feature (3433)..(3434): n is a, c, g, or t
  misc_feature (3436)..(3437): n is a, c, g, or t
  misc_feature (3439)..(3442): n is a, c, g, or t
  misc_feature (3444)..(3454): n is a, c, g, or t
  misc_feature (3457)..(3458): n is a, c, g, or t
  misc_feature (3460)..(3460): n is a, c, g, or t
  misc_feature (3463)..(3467): n is a, c, g, or t
  misc_feature (3470)..(3477): n is a, c, g, or t
  misc_feature (3479)..(3479): n is a, c, g, or t
  misc_feature (3481)..(3481): n is a, c, g, or t
  misc_feature (3483)..(3483): n is a, c, g, or t
  misc_feature (3485)..(3490): n is a, c, g, or t
  misc_feature (3492)..(3497): n is a, c, g, or t
  misc_feature (3499)..(3504): n is a, c, g, or t
  misc_feature (3506)..(3514): n is a, c, g, or t
  misc_feature (3516)..(3518): n is a, c, g, or t
  misc_feature (3520)..(3520): n is a, c, g, or t
  misc_feature (3523)..(3524): n is a, c, g, or t
  misc_feature (3526)..(3531): n is a, c, g, or t
  misc_feature (3533)..(3537): n is a, c, g, or t
  misc_feature (3539)..(3539): n is a, c, g, or t
  misc_feature (3541)..(3543): n is a, c, g, or t
  misc_feature (3547)..(3548): n is a, c, g, or t
  misc_feature (3550)..(3552): n is a, c, g, or t
  misc_feature (3554)..(3554): n is a, c, g, or t
  misc_feature (3556)..(3557): n is a, c, g, or t
  misc_feature (3559)..(3565): n is a, c, g, or t
  misc_feature (3567)..(3567): n is a, c, g, or t
  misc_feature (3569)..(3569): n is a, c, g, or t
  misc_feature (3571)..(3572): n is a, c, g, or t
  misc_feature (3575)..(3576): n is a, c, g, or t
  misc_feature (3578)..(3578): n is a, c, g, or t
  misc_feature (3580)..(3581): n is a, c, g, or t
  misc_feature (3583)..(3592): n is a, c, g, or t
  misc_feature (3594)..(3596): n is a, c, g, or t
  misc_feature (3598)..(3598): n is a, c, g, or t
  misc_feature (3600)..(3600): n is a, c, g, or t
  misc_feature (3602)..(3602): n is a, c, g, or t
  misc_feature (3605)..(3610): n is a, c, g, or t
  misc_feature (3612)..(3612): n is a, c, g, or t
  misc_feature (3614)..(3618): n is a, c, g, or t
  misc_feature (3620)..(3622): n is a, c, g, or t
  misc_feature (3624)..(3624): n is a, c, g, or t
  misc_feature (3626)..(3626): n is a, c, g, or t
  misc_feature (3628)..(3629): n is a, c, g, or t
  misc_feature (3631)..(3631): n is a, c, g, or t
  misc_feature (3634)..(3636): n is a, c, g, or t
  misc_feature (3640)..(3640): n is a, c, g, or t
  misc_feature (3642)..(3642): n is a, c, g, or t
  misc_feature (3644)..(3644): n is a, c, g, or t
  misc_feature (3647)..(3647): n is a, c, g, or t
  misc_feature (3653)..(3654): n is a, c, g, or t
  misc_feature (3657)..(3658): n is a, c, g, or t
  misc_feature (3660)..(3662): n is a, c, g, or t
  misc_feature (3664)..(3664): n is a, c, g, or t
  misc_feature (3668)..(3669): n is a, c, g, or t
  misc_feature (3672)..(3674): n is a, c, g, or t
  misc_feature (3677)..(3677): n is a, c, g, or t
  misc_feature (3681)..(3681): n is a, c, g, or t
  misc_feature (3685)..(3686): n is a, c, g, or t
  misc_feature (3690)..(3690): n is a, c, g, or t
  misc_feature (3693)..(3694): n is a, c, g, or t
  misc_feature (3697)..(3698): n is a, c, g, or t
  misc_feature (3700)..(3702): n is a, c, g, or t
  misc_feature (3705)..(3707): n is a, c, g, or t
  misc_feature (3712)..(3712): n is a, c, g, or t
  misc_feature (3714)..(3718): n is a, c, g, or t
  misc_feature (3720)..(3720): n is a, c, g, or t
  misc_feature (3722)..(3722): n is a, c, g, or t
  misc_feature (3724)..(3724): n is a, c, g, or t
  misc_feature (3727)..(3731): n is a, c, g, or t
  misc_feature (3733)..(3735): n is a, c, g, or t
  misc_feature (3738)..(3740): n is a, c, g, or t
  misc_feature (3742)..(3742): n is a, c, g, or t
  misc_feature (3744)..(3744): n is a, c, g, or t
  misc_feature (3747)..(3747): n is a, c, g, or t
  misc_feature (3749)..(3749): n is a, c, g, or t
  misc_feature (3751)..(3752): n is a, c, g, or t
  misc_feature (3754)..(3754): n is a, c, g, or t
  misc_feature (3756)..(3757): n is a, c, g, or t
  misc_feature (3761)..(3761): n is a, c, g, or t
  misc_feature (3763)..(3763): n is a, c, g, or t
  misc_feature (3766)..(3770): n is a, c, g, or t
  misc_feature (3772)..(3773): n is a, c, g, or t
  misc_feature (3776)..(3776): n is a, c, g, or t
  misc_feature (3778)..(3778): n is a, c, g, or t
  misc_feature (3782)..(3782): n is a, c, g, or t
  misc_feature (3787)..(3787): n is a, c, g, or t
  misc_feature (3789)..(3790): n is a, c, g, or t
  misc_feature (3795)..(3795): n is a, c, g, or t
  misc_feature (3798)..(3799): n is a, c, g, or t
  misc_feature (3802)..(3802): n is a, c, g, or t
  misc_feature (3804)..(3805): n is a, c, g, or t
  misc_feature (3808)..(3808): n is a, c, g, or t
  misc_feature (3810)..(3811): n is a, c, g, or t
  misc_feature (3815)..(3817): n is a, c, g, or t
  misc_feature (3820)..(3820): n is a, c, g, or t
  misc_feature (3823)..(3823): n is a, c, g, or t
  misc_feature (3826)..(3826): n is a, c, g, or t
  misc_feature (3828)..(3830): n is a, c, g, or t
  misc_feature (3832)..(3834): n is a, c, g, or t
  misc_feature (3836)..(3844): n is a, c, g, or t
  misc_feature (3846)..(3846): n is a, c, g, or t
  misc_feature (3849)..(3853): n is a, c, g, or t
  misc_feature (3857)..(3858): n is a, c, g, or t
  misc_feature (3860)..(3863): n is a, c, g, or t
  misc_feature (3870)..(3871): n is a, c, g, or t
  misc_feature (3875)..(3876): n is a, c, g, or t
  misc_feature (3878)..(3880): n is a, c, g, or t
  misc_feature (3882)..(3883): n is a, c, g, or t
  misc_feature (3886)..(3887): n is a, c, g, or t
  misc_feature (3890)..(3890): n is a, c, g, or t
  misc_feature (3892)..(3895): n is a, c, g, or t
  misc_feature (3898)..(3899): n is a, c, g, or t
  misc_feature (3901)..(3901): n is a, c, g, or t
  misc_feature (3904)..(3904): n is a, c, g, or t
  misc_feature (3906)..(3911): n is a, c, g, or t
  misc_feature (3915)..(3915): n is a, c, g, or t
  misc_feature (3917)..(3921): n is a, c, g, or t
  misc_feature (3923)..(3924): n is a, c, g, or t
  misc_feature (3931)..(3932): n is a, c, g, or t
  misc_feature (3935)..(3935): n is a, c, g, or t
  misc_feature (3938)..(3939): n is a, c, g, or t
  misc_feature (3946)..(3951): n is a, c, g, or t
  misc_feature (3953)..(3955): n is a, c, g, or t
  misc_feature (3957)..(3957): n is a, c, g, or t
  misc_feature (3960)..(3960): n is a, c, g, or t
  misc_feature (3962)..(3962): n is a, c, g, or t
  misc_feature (3965)..(3965): n is a, c, g, or t
  misc_feature (3967)..(3968): n is a, c, g, or t
  misc_feature (3970)..(3971): n is a, c, g, or t
  misc_feature (3974)..(3974): n is a, c, g, or t
  misc_feature (3976)..(3976): n is a, c, g, or t
  misc_feature (3980)..(3981): n is a, c, g, or t
  misc_feature (3984)..(3985): n is a, c, g, or t
  misc_feature (3987)..(3988): n is a, c, g, or t
  misc_feature (3990)..(3992): n is a, c, g, or t
  misc_feature (3995)..(3995): n is a, c, g, or t
  misc_feature (3998)..(3998): n is a, c, g, or t
  misc_feature (4000)..(4000): n is a, c, g, or t
ggcgcgaagatcacgatcgactcggcaacgctcatgaacaaggggctcgagatcatcgaggcgcggtggctgttcgacgtgcgcccggaccaggtgcaggtcgtggtccatccgcagtcgatcgtgcactcgatggtggagtacgtggacgggtcggtcctcgcccagctcggtgtcgccgacatggcngtgccgatcctctacgccctcacgtatcccgagcggcggccgacgccggccgcccggctcgatctcacgcgggcggggcagctgacgttctacgagcccgacgcggacaagttcccctgccttgggctggcgcgcggggcgctcgagcgcggcggggccgcaccggtcgtgctcaacgcggcgaacgagatcgcggtcgcggccttcctcgatcggcgcatcggattcacggagatcgctcagctgatcgagtgggcgctcgacgccgccagcgccgtcgccgtgcgctcgctcgaggagtgcgtggcgntcgacgccgagacccggctgcgggtcgggcggaggatcgacgcgcgcagcggaggcccttccgcgtgacgacgctcgtctcgttcctcgttgtcatcggcatcctgatcctgatccacgagctcgggcacttcatcgtcgcgcgcctcaccggggtcggggtcgagcgcttctcgatcgggttcggcccggtgctcgtgcgctggcgcgggaaggagaccgagtactgtctctccgcagtcccgatgggcggctacgtcaagatgatgggcgaggagaacccgctcgagggcggcggcggggccgtgcccttcgacccggcgaagtcgttcgcgctcaagccgctcccggtgcggttcctgatcgtcttcgctggccccgggatgaattttgtcctcgccgcgctcatcttcggggtcgtgctcgcgaccatcggacggccggtgtggccgccggtcgtcggccgggtcaccgacgggagccccgcggccgcggcgggcctcctgaccgacgacgtcgtgacgcgcgtggacgggcgcccgatcggctattgggaggacctcgaccgcgcggtcgccgggtcggacggacggacgctcgtgctcacggtcagacgcggcggggccgagcgcacgttcagcgtgacgccgcggcgaacgaccgtgcgcgacccgatcttccgggacccgaaggacgcgtgggagctcggcgtggggccgaagctcaccccgcagatcggcgccgtgaacccgggctcgcccgccgagacggcgggcctgcgcgtcggggactgggtcctggcggtcgcgggccagncggtgttcacgcccgacgagctcatgcaggcgatccagaagcgtggcggccagacgttcgacatcgtcgcggaacgcgacggcaagcccgagacgctgaccgtcacggccaccgcngtcagggagaaagggcccagcgggcaagaggtcgagatcgggcgcatcggggtcggcatcgtgacgcgcgtcgtgcgttacgagccctatcacccgctcgtcgcggccgcgtacggctgggtcaggacgtgggacatgaccctgctcacggccaagggcctctggaagatcgtctcgcggcagatcgactcctcgaacatcggcggcccgatccagatcgcggccgaggccgggcgccaggcgaaagagggcgtcgcctcgctcgcggtgttcacggcgatcatcagcgtgaacctggcgctgctgaacctcctgccggtgccgatgctcgacggcgggcacctcttcttcttcgtcatcgaagcggtcatggggcggccgctgtcgctcaagaagcgcgaagcggcgcaacagctcgggttcgttttgctgatgctcctcatggtctacgcgctctacaatgacctggtgaggatcgatgcgtttcgaatgttcaaataggacgactccatgatcacacggcggaagacgcgacagatccggttgggcggcgtgnagattggcggcgacgcgccgctcaccgtgcaatcgatgacgaagaccgacacgcgcgacgtccaggcgacgctgctcgagatctgggcgctcgaagcggccggctgcgacatcgtgcggtgcgcggtgcccgtccgcgaggcggccgagaagctcggcgagatcaagcggcagatccgcattcccctcgtggccgacatccacttcaactacaagctggcgctcatcgcgctcgagcagggcgtcgacggcctgcgcctcaaccccggaaacatcggcggcaagccnttcgtncaggaggtcgtgaacgtcgccaaggaaaagcaaattcccgtncggatcggggtcaacgcgggntctctcganaagganctnctcgccaannacngtggnccnacnnccgaaggnatggtngantccgcgntgcgacacatccggatcctngangactgnnnntancnggngatgaagatntcgctgaaggcctcngacccgcgcatgatgatcgaggcgtaccggatgctcgccgaccaggtcgactacccgttccacctgggcgtgaccgaggcgggcacgcccggcgtcgggacgatcaagtcggcggttggcctcggggcgctcctctccgagggcatcggcgatacgatccgtgtctcgctctccgcggatccgaccgaagaagttcgggtcgggatcgacatcttgaaatcgcttggcctccggaagggcggcctcaccttcgtctcgtgcccctcgtgcggccgcgccgacgtcgatctcgtcaagctcgcgaaggaggtcgagnacgagttccgtgggctgaacgaggagatccacatcgcggtnatgggntgcgnnnnnnanggccnnnnngnngnnnnnnngnnngnnnncnnnnngnnngnnnngnnnnnnnnnnncnncnnnntnnngannnncgnngncnnnnncnnnnnngncgannnggnnancnngnangcgntnnncgnngagntcgncnnnntnnnnncnnngngnnnnncnnngcnnnngnngncnnngnnnnannnnnnntgggnnnntncnnnnncnangnnnnngnnngcnnnnngngnnnnncnnncncnnnnnnnggcgncgnnnnnngnnnnnnnnnnnnnnnnnnnggnnnngnnnngnnngntgnncncnngnnngnnnnncgnntnnncnnnnnngnnngnnnnnnnnnnnnnngnnacgnncnnnnnnnnnnnnnnnnnnnngannncgnnngnnnnngnnnnnnnnangnnngcnnnctncnnnnnntcnnnnngnnnnanntcnnnnnnggnnngcnngnnnnncnnnnnnnnnnnnnncnnnnnnnnggannngcnnncnnnnnnnnngnnncnnnnnnnnnnnnngncnnnnnnngnncnnnnntcncannnncngngnngnnnncncnnnnnnnnannngnngnncnnnnannnnnnnnnnngcnncngcnnnnngcnnnnnnnngncncngnnnnnnannnnnncnnnnnncnnnnnnnnngnnncntcnncnnnnnnannnnnancnnncgcnngnnnangnncnnnnnnngngngnnggnnancnngnnnnnnnnnntnnntncngncgnnnnnngnannnnncnnngncncnngngcnnnccgncnangtncatcannttnngnnncngctnnggnnnccngcgnttcnncatnatnncgnncnnngtnnncgccngnnnnncngngncgnnnnngnnnccnnncngncgngncnngnannactngngcnnnnncnncancncggngcgcngnnaggangcnncgncnncgncnngggnnnggncgngcngnnngnnncnnnnnnnnncntcnnnnnccgnncnnnncgtcgtnncgcnngnnngnngcnngtncnnnnccnngnggncnnnnnngcgnannnnntnncactgcnnggngcnntgctgcnnnnnngnnnantcnanggncnngnngangngcgnncgnncnncnnnggngtngn

SEQ ID NO: 917 - DNA, 4000 bp, Escherichia coli
  misc_feature (56)..(56): n is a, c, g, or t
  misc_feature (60)..(61): n is a, c, g, or t
  misc_feature (226)..(226): n is a, c, g, or t
  misc_feature (278)..(278): n is a, c, g, or t
  misc_feature (289)..(289): n is a, c, g, or t
  misc_feature (311)..(311): n is a, c, g, or t
  misc_feature (317)..(317): n is a, c, g, or t
  misc_feature (374)..(374): n is a, c, g, or t
  misc_feature (442)..(442): n is a, c, g, or t
  misc_feature (514)..(514): n is a, c, g, or t
  misc_feature (542)..(542): n is a, c, g, or t
  misc_feature (769)..(769): n is a, c, g, or t
  misc_feature (803)..(803): n is a, c, g, or t
  misc_feature (818)..(818): n is a, c, g, or t
  misc_feature (870)..(870): n is a, c, g, or t
  misc_feature (895)..(895): n is a, c, g, or t
  misc_feature (958)..(958): n is a, c, g, or t
  misc_feature (1028)..(1028): n is a, c, g, or t
  misc_feature (1502)..(1502): n is a, c, g, or t
  misc_feature (1874)..(1874): n is a, c, g, or t
  misc_feature (3071)..(3071): n is a, c, g, or t
  misc_feature (3122)..(3122): n is a, c, g, or t
  misc_feature (3245)..(3245): n is a, c, g, or t
  misc_feature (3792)..(3792): n is a, c, g, or t
  misc_feature (3803)..(3806): n is a, c, g, or t
  misc_feature (3808)..(3809): n is a, c, g, or t
  misc_feature (3811)..(3811): n is a, c, g, or t
  misc_feature (3886)..(3886): n is a, c, g, or t
  misc_feature (3899)..(3899): n is a, c, g, or t
  misc_feature (3902)..(3902): n is a, c, g, or t
caggatgagtatgctcgaccaaacgatgcgtcgcgccggcgatgatggcggcaacnatgnngcatacgatcaggatgagcccgtggtcgccgaacagaaggctcgccgcgagaccaataaacacgaaggaaatggcgatgaaatgcagacgacgagtgactggtttgctatgaacacgcagataaaagagccagaactgctcgaagtctgcgtccttcgctggcgntgcggagccaacccggtcaccttcctttaaggctgctcgcttcatgccggcntccggctagantaggcgcgcattgccgggcaanggtgcnaggccgaagcccgacatgcgcatgctaaaacagaggaacaaccatggattctgctgntccctatctcaagcttgtgggccgcgtgcttctttccatcatgttcatccagtccggcgtcggaaagntcttcggctatgccggcacggaagagcatatgaacgcggcgggcgtgccagggaccctccttcctcttgtcntcgtcactgaggtgggcggcggtcttcncgtgctgcttgggctttttactcgctatgcggcgatcgctctcgccggtttctgcgtgctcgccgcctggttcttccactatcagccgggcgacatgggccagatgatcaacttcatgaaaaacatcactatcgcaggtgggttcctcgtgctggcgggcgccggcccgggcgctttcgctctcgataatctgcgccgctaacgggggaacgttaaccctcggcgcnttcgcccaaattgacgatggcgttctgtgccagnggatcggcgacggcnatctccgtcaccaacggacggcccgcataatagttgcgcaacagcatgaacngtgccgccgcgccgactagcggcangaggagggacacggaaatcggaacgccgagcgctgagagaagcgcagcgagcaaacagccacntgccgccccgacatcccaggcgccttccgtcgcgacgtggaacctaagggtgcagggcgaacgcttggcntgattgtacacggcggtcattatcgtcgggatgtagaggcagaccacgagcgcgccgagcgcgttggcgacgacggcgagaagcgcgtggcccggtgccagcgcgcgcagtaccgtggtgaaggcgagcacgccaatcgcgtaagtgaccgctctctgtccatgcccggcatcgatcagacggccaagcaacaggcctgaaaccgcgccgaccagcgccgcgagcgcaagcgcgccgccgaacgccacgaagctttcgccgagcgacaagaacagggcgatctgccagacgaagaaatagccagccgcgatccagccgtcggccaggaacagcttcatgccgggaatggcggcgcggaaagcaccgggacaatgtcgcgcgacggggacgtcgggcgtcaacagcagaggcaaagcggcgagcagcagcaccacggcggttacaccgaaggccatgcggggaccaaaggccacnagcgcccaacccgtcacgagcgggctcacgatcccgaccagcgccgcgagcgcttcgcgcgcgccaagctcggagccgcgatgttcgtgattgccgagcgcggcgtaataggcgtggtagctcgaccagtaaagcgtatcgccaagcgaagcgaccacgcagagtgtgagcagcgctggtccgagcccatgcacctcggcaagcagcgggtattgcagggcggtaagacaggtgccggcgataacgagggcccgcaggccgaatttggccgcaagcggcacgagtaccggcctgatgatgaagcggccggccaggatcagggcaagcgaggcaagcaccagcgggatcgaaaggcctgacttaagcagatanacggcaaagaatgcgccgccgccggaaagcgcgatggcgtggatgccatagtgcaggttcagcagattgaccgtccggtcgcgaaaaaatgccatgagtccctaagatgcgcgttagatcgagcggtttcctagcggcagggcagcgcgcagacaacgcgcgaagtgacatccgccaggatggctttacttcgcgccccgcttgcccttaaagacggcaccaagcagcaaggagcaagtcatgggttacaaagtcgccgtggtcggcgcgaccggcaatgtcgggcgcgagatgctcaacatcctggccgagcgcgaattccccgccgatgaagtgttcgccatcgcctcgcgtcgctcgatgggcgtcgaggtctcctatggcgatcaccggctgaaatgccgcgatctcgagcaattcgacttcaggggcgtcgatttcgcgctgatgtcggcgggctctgctgtgtccaaggactggtcgccgcagatcggcgcgcaaggttgcgtcgtcatcgacaactcatcctgctggcgctacgaccccgacgttccgctagtggtgcccgaagtcaatgccgacgctgtcgaaggtttcaccaagaagaacatcgtcgccaatcccaattgctcgaccgcccagctcgtcgtggtgctgaagcctctgcacgaccgcgccaagatcaagcgcgtggtggtcgcgacctatcagtccgtctccggcgccggtaaggaggccatggacgagctgtgggaccaaaccaagggcattttcgtcaccgagccgcctgagcccaaaaaattcaccaagcagatcgccttcaacgtcattcctcacatcgacgtcttcctcgacgacggctcgaccaaggaggaatggaagatgtcggccgagaccaagaagattctcgatcccaagatcaagctgactgcaacttgcgtccgcgtgccggtgttcgtcggccactccgaggcggtcaatgtcgaattcgaggagccgatcacggcggaagaagcgcgcaaaattctgcgcgaggcgccgggcgtgctggtagtcgacaagcaggagcctggcggctacgtgacgccgatcgaatgcgtcggcgactacgcgacattcgtctcgcgcatcagggaggaccagacgctcgataacgggctctcgttctgggttgtgtccgacaatctgcgcaaaggngcggcgctcaacacggtgcagatcgccgagacgatcatcaaccgcaatctnttggaaaaggctgcctagttctgtcgcgtgcgcctctaggccccgttcaaggccgcgaagttgtcgcttgcctcgtcgagctcaatcagctcgccgctggcaatgtcgaaatgcaggccgtgnaacgcgagcaggccttcattcattcgcttcttgatgaatgggaaggtgcggagattggcaagcgaagagcggatcgcagcaagctcgaacgccacctcttcgccgtgggcgaacacgtcggtctccaagaccttgagattgtcgagcagcgtcagccagcgcccgatgaagcctcgctccggcacgtgttccctgaccttctggcggtacgctgcgacgccgccgcaatgtgaatgcccgagcacaatgatgtgcggaactttcagcgcgagtgcggcgaattcgatcgcggcgcttgttccgtggtatttgccctcaggctcgtagggcggcacgaggttggccacgttgcgcaagatgaataaggcgccgggctcggcgtcgaagatggccgagacatcgacacgggcatctgaacaggcgatgaccattgcggtcggtgtctggccaagctcggcgagctggatgtagcggccgcggtccttggcgtgaacctcgcggcggaagcggaaatgcccgtccaccagggttttcggtaaacgcaaangtgacctcccnnnngnngnattgactgacaccgcgttgctccgtcgctggcacgattcccgccctttgcgcgtttgtctagtgcacgcgcgcangcgattggcaganccnatcgcccgttcgtgagtgcctacttgatcttgaccgttgggtggagcgaggcttttgcgctggccgcccccaagaagcgcgatttccctaccgcggcg

SEQ ID NO: 918 - DNA, 4000 bp, Escherichia coli
  misc_feature (145)..(145): n is a, c, g, or t
  misc_feature (211)..(211): n is a, c, g, or t
  misc_feature (304)..(304): n is a, c, g, or t
  misc_feature (1171)..(1171): n is a, c, g, or t
  misc_feature (1174)..(1174): n is a, c, g, or t
  misc_feature (1300)..(1300): n is a, c, g, or t
  misc_feature (1567)..(1567): n is a, c, g, or t
  misc_feature (1579)..(1579): n is a, c, g, or t
  misc_feature (1594)..(1594): n is a, c, g, or t
  misc_feature (1714)..(1714): n is a, c, g, or t
  misc_feature (1717)..(1717): n is a, c, g, or t
  misc_feature (1986)..(1986): n is a, c, g, or t
  misc_feature (2522)..(2522): n is a, c, g, or t
  misc_feature (2696)..(2696): n is a, c, g, or t
  misc_feature (2824)..(2824): n is a, c, g, or t
  misc_feature (2834)..(2834): n is a, c, g, or t
  misc_feature (2855)..(2855): n is a, c, g, or t
  misc_feature (2861)..(2861): n is a, c, g, or t
  misc_feature (3327)..(3327): n is a, c, g, or t
  misc_feature (3410)..(3410): n is a, c, g, or t
  misc_feature (3578)..(3578): n is a, c, g, or t
  misc_feature (3645)..(3645): n is a, c, g, or t
  misc_feature (3800)..(3800): n is a, c, g, or t
  misc_feature (3842)..(3842): n is a, c, g, or t
  misc_feature (3965)..(3965): n is a, c, g, or t
  misc_feature (3998)..(3998): n is a, c, g, or t
agcaacggtcgcgccgtcgatagtttcttgctcgagcaggctctgagccacaagatcaagacctgcacgattcttttcgagcaagacttttgcgcgggcttcttgctcgcgaaggattaatccaatttctgagtcgatcattcgngcggtctcgtctgagtattcgcgaccgttagtcatcaagtcttcgcctaaaaagacctgctgctgngaactccaggccattgggccaaccgcgtcgctcattccccattcgcgcaccattcgtcgcgcaattgaagttgcctgctcaaggtcgtttgcngcgccactattcaaatgaccaaacacaatcatttctgcaacacggccacccatggctttgcagatcatgtctttgaagtagtcacgagaatatgtatgtcgctcttctggcagagtccatgtaacaccaagcgccatgccacgcggcaagatcgtcactttgtgcagtggatcactgtggggtagaacagttgcaagaaccgcgtgaccaccttcgtgatatgcagttgctcgtttttcttcggcgttaaggatcaaactttcacgacgagcacccatgatcactcggtcacgggcattttcgaagtcgatgtgttcaataacttttgagcctcgacgcacggcgagcaacgccgattcattgacaaggtttgcaagatctgcgccactcattcctggtgttgctttggccatcgtgtcgagaacgacgtcggtacccattcgcttgccttttgagtgcacggtcagaatcgccaagcgctcttcacattctggcaacggcattattacttgacgatcgaagcgacctggtcgcaaaagtgctgcatccaaaatgtcaggacggtttgtcgccgccataacaatcacgccttctgttgtttcgaatccgtccatttcggcgagcaattgatttaaagtctgctcacgctcgtcatgtccgccaccaagacctgcgccacgctttcgtccgattgagtcaatttcgtcaacgaaaataattgctctacccattttgcgggcttgctgaaagagatcgcgcacgcgacttgcgccgacgccgacgaacatttccatgaagtcagaacccgtcaccgacaaaaagccaacacctgcttcgccagccaccgcacgcgcgaaaagagttttnccngtgcccggagggccaactagcaaaacacctttaggaacgcgagcaccgatctctttgaagctctcgggcattttcaagaagtcaacgacttcgcgaatctcttgcttgacgccgtcatatccggcnacgtcggcaaatgtagtggcgggtttatcggcgttgtagtttttggctcggctacgaccgatcgacatgatgcttccggcttgacccatggctcgacgttgcatccaaacgaaaaaacccatgatcaaaatgaatggcaatagaagtggaatcaaattcgtaaagaagttgccttgcggtgtcgcatagtcatagtcgacacctttttctttgagcaaagtttcgtctgcatcagaaagaatcacggcaccggtcgtcgcgaattcnctgccgtctttnagggttccgctgatntcattcgaaagattgttgatttgaacttgtgtcacttgattttgtttgacaagttccagaaactctgtgtacgaaactttcgtagcggtggatgctggccacaatcgaggtccggctatnaanaagacgaccacggccacgattgcccatgtcgcccaacggggcatgtttggtttttcggtgtcgctacttacatttgattttttttgagtcttttttgaagacttcttgttcaaaaaatttgcaggcttcttgcgggcggcaggcttacgctttgacgacgaaggctttgctggtggcggtgggggaggaagtttggtcacgcttttaatgatacgacccgatgttgaaaccctgcaatggcgaatgtctcgttctcggcagggtattcncccgatttgaaatcccctgtggccgatgactcatcaattattgttatctctatggttcgtcgttgttcacgttgcacatgtaacgaactcgcaacaattactttgacctatcaatacagtcgtgccttggtatggatagatgacttgaccgccgagcgagatccgcacgcttatgatttgtgcgatcgacacggcgtaagaattacggctccgtctggttggaggctcgaagatcgccgcaaccgtttcagagttgtaatgccaaaccgcctcgcgggatgaaccaatcgccgtgggctccgccctatgggcaggagccggcaagaagccaaacttttaatctaaagacggtcattttgacttggaccgcgagttacttcgtggcgctgttcgtcagttcggcaattctcgtggcaactggcaacacagacatagtttctggcaaagaaccgaagtggttcttgggtgtttctgcgcttgcactttgggttccgttcattatcggtttgtatctggtctcacagaaacttggtagncaaagattttcgagcgacttttttttaaagtttcggcgtgtcgatctttggggtcttccgattggcatcgcaggtcagcttgttctcgtcgggcttgtgacttggccatttcgtgttttgttccctgaaaaatttgctccagaactgatcgagaagcgagcgcaagacttattnaacaacgcaactggcccatggttgatcgttttgattttggtcgttgtcattggcgcaccgtttgttgaagagttggtatatcgcggctttattcagtcaggattaaaaaaccgtttaggaagttcagntgctgtcgtnattactgccgtttggtttgcngccgtncaccttcaacttgtcgagtttcccggcctgctcgcgtttgcgctcgtcctcggtttttgttttcatcgaactcacagaattggcatgtcaattgttgcgcatgtcgcgtttaatgcgactggtttgttgctcgtggccctgctctaatcaagaacaactattcacgactagagtttctacgcagtgaagcaaattaattttcgcagttggaccgctcagcaaattacttcggctgtgatcgttgctggttcaactttgatgttgttaatgaccctgcacccagagttgatattgcgaaacaacacgccaactggcggagacatgggcgcacatgtctatggtccggcgttcttgcgtgattttttgttgcctcattttcgcttaacgggttggagcaatgactggtactcgggttttccgatgtatcgcttctacatggttttgcccgcacttgcagttttgctanttgatctgatcttgccgtatggcatcgcgttgaaaattattgccgttctcggaatcttgaccctgccggtttgcgtttggctntttggcaagtttgcaaaatttctctttccgattcctgaactgttgacattggcatctgttgtctttttgtacgacgagagttttacgatttacggcggcaatatcgcatcaacaatggccggtgagttttcgttttcaatttcgttgtcactagctattttgactttngggcttttaattcgagcttttgaagaacatcgaggcaagatgctgactgctgttgtgcttgctcttngcgcattgagtcacggcattgttttgttgttcgttttcggtggagtagtgctgctggccgcaatttggtacaccaaaaagacaacaatcaccgctgtaacaatttctgtcacggcaattttgctttcttcgttttgggttttgccgttcttgacnggtcacgcatatatgaccgatatgaaatatgaaccaagaccnagtggcgcgagtgattctttttggaaaatgtattttcctttggcaactttttgggatgtcctgatttttgtttttgcttgcgtgggtttcgcagtgttcgtcaagcgtcgcaatcgaaccggnatctggatgggtgtctattgcgtcgtgttggtntt

SEQ ID NO: 919 - DNA, 4000 bp, Escherichia coli
  misc_feature (1868)..(1868): n is a, c, g, or t
  misc_feature (2172)..(2173): n is a, c, g, or t
  misc_feature (3845)..(3845): n is a, c, g, or t
tggcgcgcaacgacgtggaccccatggccgtcgaggacgtggtgttcggatgcgttgacaccctcggtccccaggctggcgacatcgcccgcacggcgtggttggccgctggcctgccggaggcgatcccgggtacgaccatcgaccgccagtgcggttccgggcagcaggccgtgagcttcgccgccatgggcgtcatgtccggcctgcaggacctggtggtcgccggcggtgtgcagaacatgagcatgatccccatcggcctggccctcgaggccgcccggcccttcgggcacgaggatccgttctccgggtccaccggctgggtggcgcgctatggaacccaggaggtgtcccagttccggggtgccgagctgattgccgagaagtggaacatcagtcgcgaggagatggaggcgttcgccttcacgagccacgagcgggccatcaccgccatcgacgaggggcgcttcgagcgggaggtcgccccgctggctggagtcgaggtggacgagggtccccgacggggcggcagcatcgagaagatggcccagctggcacccctggtcgacggaggccggatcacggccgccctggccagccaggtgagtgacggcgcagcggccatcctcgtggcctcggagcgggccatcgaagaccacggcctcaccccgcgggccaggatccaccacatcagcgtgcgtggtgatgacccgatctacatgctctccgggcccattgcggcgaccacctacgcgctggagaagtccgggatgtcgatcgacgacatcgacctcttcgagtgcaacgaggccttcgcccccgtgccgctcgcgtggatggccgagcacagggtgccccacgagaaggtcaacgtgaacggcggggcgatcgccctgggccacccgctgggctgtagcggtgccaagctcatgaccacgctgctgaacgagttggaacgcacgggcgggcgcttcgggctccagacgatgtgcgagggcggcggccaggcgaacgtgaccatcctcgagcgcctctgaccgcccggccgcccggcgatttgctccggggtaggtcggacgcggctcaggtcgggtggatcaatccacgatcgcgtcgacgaggccccaccccaacgcggtggtggcgtcgatggtggcgccggtcaggcacatccgggccgtctgctggcgcccgatacgccgtgggatgctgaccgtgcctccagcgcccggtatgaggcccatggatacctccggcaggcagaacgtcgccgagccggtggcctccaggcgtccggcgaatgcagccaactcgactccggcaccgacggctggaccatgcacccggacggtgagccggtcggccagcaggtccagccagggagcggcgttggccgaggaccggatcaggtgagccgccaccggatcggcgaccgtgccgaactcggccggatcgccaccacagcagaatgccggccccctgccggtcagcaggacctgacgcctgtcgtccggtgccaccagcgggcggagtgcctcgaccagcgcatcgcgcatcgctgcggagaaggcgttgcgtagtcgcggtcggttcaacgtcagcgtcacggtgtcgtcgtcggcgtccaccagaacgggagggtccggctcgacgggcctgaccctccgcccgcgaccctccagccaccctgcgaactcggcgcctgcctgcagcgtgccgtaggccgtggactccagcaggaggccggccggcgtatccaggccctccccgtggcgaaggacctgacagcaggccagtgccgcccggggggcgccggccaccccgtcggcgatccggacggcatcgacggcatcctcgaccagcangtcgaaggcgggggctgtgcccggggcggccagcccgatggagacgatgggtagccgggccagtgatgcggcggcctccggcggaagcaggtgggcatcgtcgacgatcagcagtgtcaggtcacgaaggacgccgatgtcgaggtccgccgtcggcgtcgtcagacgtgtcgtcgcctcgtccacggacaggacacggttcggaactgcgttggccacctgcccagtctgctcgttgcccggaccgtcgtcagcccggagaaccgtcgccgaggtgggcgaggtccgagcgcagcacccgccnnagcagctttccggtgtcgttgtaggggagcgacgccacgaactccacgtggtcgggcgtgcggttggatcgcagccggtcacgtacggcgtcgcgtagttgctccgggctggccgaggcgcccgggtggaggaccacggcggcgatgatccgttccccccactgcatgtcgggtaggccgatggctgcggcgtcggccaccgccgggtgacagaccaggacctcctcgatctcgccgggggagacgttctggccgcccttcacgatgacgtcgtcgattcggcccgtgacgtggaggtacccgtcggtgtccatccagccaccgtcatgggtggggaaccagccgtcggcggtcaggcgtggggccgacccccggtattcgcctgagacctgttctccccggacccagatctccccgggctggcccactgccacctcgtctccaagatcgtcccggatcgtgacctcgatggtgggtagcggccgccccgctgatccgaggcgtgcccggatcgccggatcggcgctcgccatggcctcccggtgctcgtcgggccccagcagggccacggtcgagctggtctcggtgagcccgtaggcgttcacgaatgcggtgttcggaagtagctcaagggcccgctggatagtgggcgaaggcatccggccgccgccgtaggagagagatcgcagggtgggtagtcccggtccgtcggagccttcggcatccagcacctcgacgatgcgtgtcagcatcgtgggcaccaccatggcgctggtgaccgattcggcccggacgagcgcgacccagtcgtcggcatcgaaggtgggcagttggacgacccggcgtccagcgaagacgttggagaggatcgctgcgatgccggccacgtggtacggcggcacgctcacgagggcggcctcgtcctcgttggcgcccatgaactccaccgatccgaggacgtacgacacgaggtgccggtggcgcagtacagcggccttgggctcgccggttgtgccgctggtgaacaactcgatggcggttccctcgccggtcatgtcccattcgggttccggtggttcggcaccgtcgacgaggtccatcagcccgtggcgcgacaggagcccgatgccgtcgatgccggtcaggcggttgggggattcggggtccacgacgatgatcgccggggagatcctggaggccagcgcggccagctcgccgtcggtcaaccggtagttgaggggcacgaagggcaggtcggcccaggccgctccgaagagcgatatcggcatggcgaccgaggacaggtcggccatggccacgtgcgagccgccatcggcgcggaaccgtacggaggccgcaccggcggagtcgtagaggtcccggtaggtgaggccgccgtcagccggtccgagggcgacccggtctccgaaaccgtccgctgccatctccagcagcatcatgaggttcacgtcgtcgccctaccttgtcgtgggctgccggatcgggtcagtccgaggccggcaggggcttggcttccttcaggtccagcagggcatcgccgatgcccagtgatccgtcccccggcttggtgcagagcacttcgaccgtctcgtccggatccacgtaacgcttacccatgagggtcccgcccgatgtcccctcggcgggcagnccgctgtcgcccgctgcaccgggagcgagcatgggcgcaccgccacaccgcaggtcgacctcgcctacacccttcacgacgatcacctgggtggtgcagacgctgctggtgaaccggcttccgggcttcagggatggcatctgggtgtctcctgc

SEQ ID NO: 920 - DNA, 4000 bp, Escherichia coli
  misc_feature (1)..(3): n is a, c, g, or t
  misc_feature (5)..(5): n is a, c, g, or t
  misc_feature (8)..(10): n is a, c, g, or t
  misc_feature (15)..(18): n is a, c, g, or t
  misc_feature (20)..(25): n is a, c, g, or t
  misc_feature (27)..(31): n is a, c, g, or t
  misc_feature (33)..(34): n is a, c, g, or t
  misc_feature (40)..(40): n is a, c, g, or t
  misc_feature (43)..(43): n is a, c, g, or t
  misc_feature (45)..(47): n is a, c, g, or t
  misc_feature (50)..(50): n is a, c, g, or t
  misc_feature (52)..(52): n is a, c, g, or t
  misc_feature (54)..(55): n is a, c, g, or t
  misc_feature (57)..(58): n is a, c, g, or t
  misc_feature (60)..(62): n is a, c, g, or t
  misc_feature (64)..(70): n is a, c, g, or t
  misc_feature (74)..(74): n is a, c, g, or t
  misc_feature (76)..(77): n is a, c, g, or t
  misc_feature (79)..(80): n is a, c, g, or t
  misc_feature (83)..(85): n is a, c, g, or t
  misc_feature (88)..(92): n is a, c, g, or t
  misc_feature (94)..(94): n is a, c, g, or t
  misc_feature (97)..(97): n is a, c, g, or t
  misc_feature (100)..(101): n is a, c, g, or t
  misc_feature (104)..(110): n is a, c, g, or t
  misc_feature (112)..(112): n is a, c, g, or t
  misc_feature (114)..(121): n is a, c, g, or t
  misc_feature (124)..(124): n is a, c, g, or t
  misc_feature (127)..(131): n is a, c, g, or t
  misc_feature (134)..(134): n is a, c, g, or t
  misc_feature (136)..(136): n is a, c, g, or t
  misc_feature (139)..(145): n is a, c, g, or t
  misc_feature (147)..(148): n is a, c, g, or t
  misc_feature (150)..(150): n is a, c, g, or t
  misc_feature (152)..(154): n is a, c, g, or t
  misc_feature (156)..(157): n is a, c, g, or t
  misc_feature (159)..(160): n is a, c, g, or t
  misc_feature (163)..(163): n is a, c, g, or t
  misc_feature (165)..(166): n is a, c, g, or t
  misc_feature (168)..(171): n is a, c, g, or t
  misc_feature (173)..(173): n is a, c, g, or t
  misc_feature (175)..(175): n is a, c, g, or t
  misc_feature (177)..(179): n is a, c, g, or t
  misc_feature (181)..(184): n is a, c, g, or t
  misc_feature (188)..(192): n is a, c, g, or t
  misc_feature (194)..(196): n is a, c, g, or t
  misc_feature (199)..(199): n is a, c, g, or t
  misc_feature (202)..(213): n is a, c, g, or t
  misc_feature (215)..(219): n is a, c, g, or t
  misc_feature (221)..(224): n is a, c, g, or t
  misc_feature (227)..(228): n is a, c, g, or t
  misc_feature (230)..(234): n is a, c, g, or t
  misc_feature (236)..(236): n is a, c, g, or t
  misc_feature (239)..(240): n is a, c, g, or t
  misc_feature (242)..(245): n is a, c, g, or t
  misc_feature (247)..(247): n is a, c, g, or t
  misc_feature (250)..(255): n is a, c, g, or t
  misc_feature (257)..(257): n is a, c, g, or t
  misc_feature (259)..(264): n is a, c, g, or t
  misc_feature (266)..(266): n is a, c, g, or t
  misc_feature (269)..(275): n is a, c, g, or t
  misc_feature (278)..(280): n is a, c, g, or t
  misc_feature (283)..(287): n is a, c, g, or t
  misc_feature (290)..(292): n is a, c, g, or t
  misc_feature (296)..(298): n is a, c, g, or t
  misc_feature (300)..(305): n is a, c, g, or t
  misc_feature (307)..(307): n is a, c, g, or t
  misc_feature (309)..(311): n is a, c, g, or t
  misc_feature (313)..(317): n is a, c, g, or t
  misc_feature (321)..(327): n is a, c, g, or t
  misc_feature (329)..(330): n is a, c, g, or t
  misc_feature (332)..(334): n is a, c, g, or t
  misc_feature (337)..(338): n is a, c, g, or t
  misc_feature (341)..(341): n is a, c, g, or t
  misc_feature (343)..(350): n is a, c, g, or t
  misc_feature (352)..(355): n is a, c, g, or t
  misc_feature (358)..(364): n is a, c, g, or t
  misc_feature (366)..(374): n is a, c, g, or t
  misc_feature (378)..(381): n is a, c, g, or t
  misc_feature (383)..(388): n is a, c, g, or t
  misc_feature (392)..(392): n is a, c, g, or t
  misc_feature (395)..(399): n is a, c, g, or t
  misc_feature (403)..(406): n is a, c, g, or t
  misc_feature (410)..(410): n is a, c, g, or t
  misc_feature (412)..(413): n is a, c, g, or t
  misc_feature (415)..(415): n is a, c, g, or t
  misc_feature (417)..(418): n is a, c, g, or t
  misc_feature (420)..(420): n is a, c, g, or t
  misc_feature (422)..(422): n is a, c, g, or t
  misc_feature (424)..(430): n is a, c, g, or t
  misc_feature (433)..(437): n is a, c, g, or t
  misc_feature (440)..(443): n is a, c, g, or t
  misc_feature (445)..(446): n is a, c, g, or t
  misc_feature (448)..(450): n is a, c, g, or t
  misc_feature (452)..(452): n is a, c, g, or t
  misc_feature (455)..(457): n is a, c, g, or t
  misc_feature (459)..(460): n is a, c, g, or t
  misc_feature (463)..(466): n is a, c, g, or t
  misc_feature (468)..(468): n is a, c, g, or t
  misc_feature (470)..(470): n is a, c, g, or t
  misc_feature (472)..(472): n is a, c, g, or t
  misc_feature (474)..(477): n is a, c, g, or t
  misc_feature (479)..(484): n is a, c, g, or t
  misc_feature (486)..(487): n is a, c, g, or t
  misc_feature (498)..(498): n is a, c, g, or t
  misc_feature (567)..(567): n is a, c, g, or t
  misc_feature (579)..(579): n is a, c, g, or t
  misc_feature (616)..(616): n is a, c, g, or t
  misc_feature (618)..(618): n is a, c, g, or t
  misc_feature (620)..(620): n is a, c, g, or t
  misc_feature (629)..(629): n is a, c, g, or t
  misc_feature (651)..(651): n is a, c, g, or t
  misc_feature (666)..(666): n is a, c, g, or t
  misc_feature (669)..(669): n is a, c, g, or t
  misc_feature (693)..(693): n is a, c, g, or t
  misc_feature (711)..(711): n is a, c, g, or t
  misc_feature (756)..(756): n is a, c, g, or t
  misc_feature (759)..(759): n is a, c, g, or t
  misc_feature (766)..(766): n is a, c, g, or t
  misc_feature (771)..(771): n is a, c, g, or t
  misc_feature (816)..(816): n is a, c, g, or t
  misc_feature (834)..(834): n is a, c, g, or t
  misc_feature (894)..(894): n is a, c, g, or t
  misc_feature (912)..(912): n is a, c, g, or t
  misc_feature (975)..(975): n is a, c, g, or t
  misc_feature (999)..(999): n is a, c, g, or t
  misc_feature (1011)..(1011): n is a, c, g, or t
  misc_feature (1038)..(1038): n is a, c, g, or t
  misc_feature (1050)..(1050): n is a, c, g, or t
  misc_feature (1058)..(1058): n is a, c, g, or t
  misc_feature (1065)..(1065): n is a, c, g, or t
  misc_feature (1068)..(1068): n is a, c, g, or t
  misc_feature (1140)..(1140): n is a, c, g, or t
  misc_feature (1296)..(1296): n is a, c, g, or t
  misc_feature (1323)..(1323): n is a, c, g, or t
  misc_feature (1389)..(1389): n is a, c, g, or t
  misc_feature (1395)..(1395): n is a, c, g, or t
  misc_feature (1481)..(1482): n is a, c, g, or t
  misc_feature (1488)..(1488): n is a, c, g, or t
  misc_feature (1512)..(1512): n is a, c, g, or t
  misc_feature (1545)..(1545): n is a, c, g, or t
  misc_feature (1557)..(1557): n is a, c, g, or t
  misc_feature (1566)..(1566): n is a, c, g, or t
  misc_feature (1575)..(1575): n is a, c, g, or t
  misc_feature (1611)..(1611): n is a, c, g, or t
  misc_feature (1617)..(1617): n is a, c, g, or t
  misc_feature (1635)..(1635): n is a, c, g, or t
  misc_feature (1674)..(1674): n is a, c, g, or t
  misc_feature (1713)..(1713): n is a, c, g, or t
  misc_feature (1719)..(1719): n is a, c, g, or t
  misc_feature (1725)..(1725): n is a, c, g, or t
  misc_feature (1749)..(1749): n is a, c, g, or t
  misc_feature (1752)..(1752): n is a, c, g, or t
  misc_feature (1758)..(1758): n is a, c, g, or t
  misc_feature (1791)..(1791): n is a, c, g, or t
  misc_feature (1797)..(1797): n is a, c, g, or t
  misc_feature (1803)..(1803): n is a, c, g, or t
  misc_feature (1821)..(1821): n is a, c, g, or t
  misc_feature (1824)..(1824): n is a, c, g, or t
  misc_feature (1827)..(1827): n is a, c, g, or t
  misc_feature (1836)..(1836): n is a, c, g, or t
  misc_feature (1944)..(1944): n is a, c, g, or t
  misc_feature (1959)..(1959): n is a, c, g, or t
  misc_feature (1977)..(1977): n is a, c, g, or t
  misc_feature (2025)..(2025): n is a, c, g, or t
  misc_feature (2713)..(2713): n is a, c, g, or t
  misc_feature (2715)..(2715): n is a, c, g, or t
  misc_feature (2744)..(2744): n is a, c, g, or t
  misc_feature (2788)..(2788): n is a, c, g, or t
  misc_feature (2819)..(2819): n is a, c, g, or t
  misc_feature (2828)..(2828): n is a, c, g, or t
  misc_feature (2891)..(2891): n is a, c, g, or t
  misc_feature (2894)..(2894): n is a, c, g, or t
  misc_feature (2924)..(2924): n is a, c, g, or t
  misc_feature (2930)..(2930): n is a, c, g, or t
  misc_feature (2978)..(2978): n is a, c, g, or t
  misc_feature (2981)..(2981): n is a, c, g, or t
  misc_feature (2987)..(2987): n is a, c, g, or t
  misc_feature (2990)..(2990): n is a, c, g, or t
  misc_feature (3056)..(3056): n is a, c, g, or t
  misc_feature (3452)..(3452): n is a, c, g, or t
  misc_feature (3929)..(3929): n is a, c, g, or t
  misc_feature (3968)..(3968): n is a, c, g, or t
nnncnaannnaaagnnnngnnnnnntnnnnntnnaaaccnaancnnnttncngnntnntnnnannnnnnnaaantnncnnaannnttnnnnncnaanttnnaannnnnnncnannnnnnnnaanttnnnnnttnanttnnnnnnnanncnannntnnannaantnntnnnncngnannntnnnnaaannnnngnnnaanttnnnnnnnnnnnncnnnnncnnnnccnncnnnnncnaannannnnanttnnnnnntnannnnnntnaannnnnnnggnnnttnnnnnccnnnaaannntnnnnnngntnnngnnnnnaaannnnnnncnncnnnggnnaantnnnnnnnntnnnnttnnnnnnnannnnnnnnnaaannnncnnnnnncccnaannnnncccnnnnaaantnncnanngntnannnnnnnccnnnnnaannnngnngnnnantannnannccnnnnantnantnnnntnnnnnntnntccaaaaaacnaaaaataatcggtgcattatagcggtaacttaatgttttgtcagtaaatggtgtttacgaacacccaanagcaccaatacncctaaataaacgaccgcagccagtccgattaaccaancnanccaataganacgcattaaaaatgtcatggcngcccattcttcaatngangggcagttataccaaagcaagccncccatggctaaggctgcncctaaaactttcagaaaaaagaccgcacttttacgtgaaaaatgntanacatccnctttngctaaaccacgataaagcaaataagcatttaaggttgctgacatngcagaagcaatcgctaancccacataactaaatggaatcgccaatacgttaaagcccatattgctcaccatagcgatnatcccgattttcacgggngttttggtgtcttggcgtgcgtaatagccattagccaggatcttaatcagcataaagctaagnaaacccgcattgaatgcccataangaataagaggcngcatgcacatctgttaaggtaaaactnccacgcataaanaataccantaacatnggntgggctaacacggcaataccaatcgcggcaggcacaccgagtaataaaatcattcgcacgccccagtccatngtgttacgaaaatcaaccgcactttgggaagaattgtcttctcgattcacatgatggcgagcaagtgtcggtaaaatcacggtggaaatggcgataccaaatagaccaagtggaaactctaatagacgatcagaataataaagccaactaatagancccgtcattaagaaactggcaatgacngtatcaagcagcaagttgatttgacttacggaaaccccgaacaaggcaggaatcatcaatcgacgnattttngctaccccttcatcatgccacgcccattttggttttacgagcaagcctgctttcttcaagaaagggatttggaataaaaattgtannaaaccncctaagaagatcccgatagcaagngcaagatcaggattgtctaatcttggcgcgagnaaaagtgcggtngcaatcatngcgatattnagtaaaacaggcgaaaacgacatcacgccaaatttncctatngtatttaaaatcgcgccngaaagtgccacaaaggtgacaaaccataaataaggaaangtaatttttaagagtaaagacgcttgttcaaatttgtgngcatcnggtccntcatttagccaatcggtaaaccanccnatcccnaagatcgccgccacaacaggtgatcccaccatngcaagnaaagtnacaatactgactaatccnccnagngtacccganactttcccgataaattctcgcgttttagaaagatcgcccgatttttgatattcagctaatacgggtacaaaggcttgagaaaatgcgccttccgcaaataaacgacgnaaaaagtttgggatncggttagcgaataaaaanacgtctgccgccgcgcctgcaccgattaaatgggcaatcaccacatcncggactaaacctaacacacgggacactaatgtcatcccactcacgataatgccggattttaaaagtcgtttactcaaaataggggtctcttcaaaaaaatttgccttaattgtatagaatttttgtttttacgctatattccaacgaaaaaaactgataaaatcctgcccacatcgtttgtgtgagccaatagaaagcgctttttttaaataacgatgcttactttcggttgtgtctcaccgaaatcaacacaaattattcattgacaaaagtataaaaaatcggcatattctacgcccttattttgtcataatcatctaacagaaattttaggagtttgaccttggctaatatcaagtcagcaaaaaaacgcgcggttcaatctgaaaaacgccgccaacacaacgcaagccaacgctctatgatgcgtacttacatcaaaaaagtatatgctcaagtagcagcaggtgaaaaagcagcagctgaagcagcattcgttgaaatgcaaaaagttgttgaccgtatggcttctaaaggcttaatccacgctaacaaagcagcaaaccacaaagctaaattagctgctcaaatcaaaaaattagcgtaattaaagcattaaaacagcttaaaaataaaaccgcactttggtgcggtttttgtttgtcttaaaccgtcctgccacaaacgncngataacaagcttgcattcccccctttaanctgtaaactaccccacaacttaaaaattaatcataaaataaacnataaatgaccaaaaaatcttttaaaaaagcngatccgaantatcaaaaagaattagccaaatatggtaatccgatcccaagcagagactacattctgcaaatnatncgtgaaaataatgccccgatgagtcgggangaaatnctgaccgcactttcaattaaaagtgacgaacaacaagaagccatgcgncgncgcttncgngccatggaaaatgatggacagttagtttttactaaacgtaaacgctatgccttgcctgaaaaattngatttattcaaaggcatggtcatcggccatcgcgaaggctatggctttttacaagtcgaaggtaaaaaagaggatctctttattcctaatcaccaaatgcaacgtgtaatgcatggtgattttgtattagcccaacctgcaggcttagatcgtcgtggacgccgtgaagtccgtattgttcgtgtacttgaaagtcgcaaaaaacaaattgtcggtcgtttcttcttagaaaatggttttagctatgtggtgcctgatgatagccgtatcggacgagatattttagtccctaatgaacaccgcaatggggcccgaatgggacaagttgtcgtggttgaattgcaagaacgatctgcctccttcactcaacctgttggtattatcaccgaaattctnggtgacaatatggcaaaagggatggaagtggagatcgcccttcgtaatcatgatattcctcaccaatttccaagtgcggtcgaaaaatacgttaaaaaattcaccgaagaagtgcctgaagaagcgaaaaaaggccgtgtggatttacgcaatctgccactggttaccattgatggcgaagatgcgcgcgattttgatgatgccgtatattgcgaaaaaagtggtaaaggctggaaactttgggtggcaattgccgatgtcagctactatgttcgtttacgttctgcattagatactgaagcttataaccgtggtaactccgtttacttcccaaatcgtgttgtgccaatgctgccggagattttatcgaacggattgtgttcactgaatccacaagttgatcgcttgtgtatggtgtgtgaaatgcacgtttccgcaaaaggtaaactcacggactatcgtttttatgaagcggtnatgaactctcatgctcgcttaacctatacgaaagtcgcngcgattttagacggcgatgatgaacttcgcac

SEQ ID NO: 921 - DNA, 4000 bp, Escherichia coli
  misc_feature (1)..(25): n is a, c, g, or t
  misc_feature (27)..(43): n is a, c, g, or t
  misc_feature (45)..(58): n is a, c, g, or t
  misc_feature (60)..(60): n is a, c, g, or t
  misc_feature (62)..(66): n is a, c, g, or t
  misc_feature (68)..(76): n is a, c, g, or t
  misc_feature (78)..(83): n is a, c, g, or t
  misc_feature (85)..(91): n is a, c, g, or t
  misc_feature (93)..(99): n is a, c, g, or t
  misc_feature (101)..(145): n is a, c, g, or t
  misc_feature (147)..(151): n is a, c, g, or t
  misc_feature (153)..(158): n is a, c, g, or t
  misc_feature (160)..(162): n is a, c, g, or t
  misc_feature (164)..(169): n is a, c, g, or t
  misc_feature (172)..(175): n is a, c, g, or t
  misc_feature (177)..(180): n is a, c, g, or t
  misc_feature (183)..(184): n is a, c, g, or t
  misc_feature (186)..(186): n is a, c, g, or t
  misc_feature (189)..(191): n is a, c, g, or t
  misc_feature (194)..(194): n is a, c, g, or t
  misc_feature (196)..(196): n is a, c, g, or t
  misc_feature (198)..(198): n is a, c, g, or t
  misc_feature (200)..(210): n is a, c, g, or t
  misc_feature (212)..(212): n is a, c, g, or t
  misc_feature (214)..(215): n is a, c, g, or t
  misc_feature (217)..(222): n is a, c, g, or t
  misc_feature (224)..(244): n is a, c, g, or t
  misc_feature (247)..(247): n is a, c, g, or t
  misc_feature (250)..(252): n is a, c, g, or t
  misc_feature (254)..(256): n is a, c, g, or t
  misc_feature (258)..(271): n is a, c, g, or t
  misc_feature (273)..(287): n is a, c, g, or t
  misc_feature (290)..(296): n is a, c, g, or t
  misc_feature (299)..(312): n is a, c, g, or t
  misc_feature (315)..(331): n is a, c, g, or t
  misc_feature (334)..(339): n is a, c, g, or t
  misc_feature (341)..(343): n is a, c, g, or t
  misc_feature (345)..(352): n is a, c, g, or t
  misc_feature (354)..(357): n is a, c, g, or t
  misc_feature (359)..(364): n is a, c, g, or t
  misc_feature (366)..(372): n is a, c, g, or t
  misc_feature (374)..(378): n is a, c, g, or t
  misc_feature (380)..(391): n is a, c, g, or t
  misc_feature (393)..(394): n is a, c, g, or t
  misc_feature (396)..(400): n is a, c, g, or t
  misc_feature (402)..(404): n is a, c, g, or t
  misc_feature (406)..(435): n is a, c, g, or t
  misc_feature (437)..(442): n is a, c, g, or t
  misc_feature (444)..(448): n is a, c, g, or t
  misc_feature (450)..(479): n is a, c, g, or t
  misc_feature (481)..(484): n is a, c, g, or t
  misc_feature (486)..(515): n is a, c, g, or t
  misc_feature (517)..(520): n is a, c, g, or t
  misc_feature (522)..(522): n is a, c, g, or t
  misc_feature (524)..(554): n is a, c, g, or t
  misc_feature (556)..(558): n is a, c, g, or t
  misc_feature (560)..(560): n is a, c, g, or t
  misc_feature (563)..(581): n is a, c, g, or t
  misc_feature (583)..(602): n is a, c, g, or t
  misc_feature (605)..(613): n is a, c, g, or t
  misc_feature (615)..(616): n is a, c, g, or t
  misc_feature (618)..(636): n is a, c, g, or t
  misc_feature (638)..(638): n is a, c, g, or t
  misc_feature (640)..(648): n is a, c, g, or t
  misc_feature (650)..(689): n is a, c, g, or t
  misc_feature (691)..(694): n is a, c, g, or t
  misc_feature (696)..(696): n is a, c, g, or t
  misc_feature (698)..(702): n is a, c, g, or t
  misc_feature (705)..(716): n is a, c, g, or t
  misc_feature (718)..(739): n is a, c, g, or t
  misc_feature (742)..(742): n is a, c, g, or t
  misc_feature (744)..(744): n is a, c, g, or t
  misc_feature (746)..(747): n is a, c, g, or t
  misc_feature (749)..(750): n is a, c, g, or t
  misc_feature (752)..(765): n is a, c, g, or t
  misc_feature (767)..(771): n is a, c, g, or t
  misc_feature (774)..(774): n is a, c, g, or t
  misc_feature (777)..(778): n is a, c, g, or t
  misc_feature (781)..(782): n is a, c, g, or t
  misc_feature (785)..(786): n is a, c, g, or t
  misc_feature (791)..(793): n is a, c, g, or t
  misc_feature (796)..(800): n is a, c, g, or t
  misc_feature (802)..(804): n is a, c, g, or t
  misc_feature (808)..(808): n is a, c, g, or t
  misc_feature (818)..(828): n is a, c, g, or t
  misc_feature (830)..(830): n is a, c, g, or t
  misc_feature (832)..(832): n is a, c, g, or t
  misc_feature (834)..(835): n is a, c, g, or t
  misc_feature (838)..(841): n is a, c, g, or t
  misc_feature (843)..(844): n is a, c, g, or t
  misc_feature (847)..(849): n is a, c, g, or t
  misc_feature (852)..(852): n is a, c, g, or t
  misc_feature (854)..(854): n is a, c, g, or t
  misc_feature (857)..(858): n is a, c, g, or t
  misc_feature (862)..(868): n is a, c, g, or t
  misc_feature (870)..(871): n is a, c, g, or t
  misc_feature (873)..(876): n is a, c, g, or t
  misc_feature (879)..(885): n is a, c, g, or t
  misc_feature (887)..(887): n is a, c, g, or t
  misc_feature (889)..(889): n is a, c, g, or t
  misc_feature (891)..(897): n is a, c, g, or t
  misc_feature (900)..(902): n is a, c, g, or t
  misc_feature (904)..(904): n is a, c, g, or t
  misc_feature (906)..(906): n is a, c, g, or t
  misc_feature (908)..(909): n is a, c, g, or t
  misc_feature (911)..(917): n is a, c, g, or t
  misc_feature (920)..(925): n is a, c, g, or t
  misc_feature (927)..(928): n is a, c, g, or t
  misc_feature (930)..(939): n is a, c, g, or t
  misc_feature (942)..(942): n is a, c, g, or t
  misc_feature (947)..(950): n is a, c, g, or t
  misc_feature (952)..(952): n is a, c, g, or t
  misc_feature (955)..(956): n is a, c, g, or t
  misc_feature (962)..(964): n is a, c, g, or t
  misc_feature (967)..(967): n is a, c, g, or t
  misc_feature (969)..(969): n is a, c, g, or t
  misc_feature (971)..(972): n is a, c, g, or t
  misc_feature (974)..(976): n is a, c, g, or t
  misc_feature (983)..(983): n is a, c, g, or t
  misc_feature (985)..(986): n is a, c, g, or t
  misc_feature (988)..(988): n is a, c, g, or t
  misc_feature (992)..(992): n is a, c, g, or t
  misc_feature (994)..(994): n is a, c, g, or t
  misc_feature (996)..(997): n is a, c, g, or t
  misc_feature (1003)..(1007): n is a, c, g, or t
  misc_feature (1009)..(1010): n is a, c, g, or t
  misc_feature (1013)..(1013): n is a, c, g, or t
  misc_feature (1015)..(1015): n is a, c, g, or t
  misc_feature (1017)..(1018): n is a, c, g, or t
  misc_feature (1021)..(1021): n is a, c, g, or t
  misc_feature (1023)..(1028): n is a, c, g, or t
  misc_feature (1031)..(1032): n is a, c, g, or t
  misc_feature (1036)..(1036): n is a, c, g, or t
  misc_feature (1039)..(1043): n is a, c, g, or t
  misc_feature (1045)..(1047): n is a, c, g, or t
  misc_feature (1050)..(1054): n is a, c, g, or t
  misc_feature (1058)..(1058): n is a, c, g, or t
  misc_feature (1060)..(1061): n is a, c, g, or t
  misc_feature (1063)..(1064): n is a, c, g, or t
  misc_feature (1067)..(1070): n is a, c, g, or t
  misc_feature (1075)..(1075): n is a, c, g, or t
  misc_feature (1077)..(1078): n is a, c, g, or t
  misc_feature (1081)..(1083): n is a, c, g, or t
  misc_feature (1086)..(1087): n is a, c, g, or t
  misc_feature (1089)..(1089): n is a, c, g, or t
  misc_feature (1092)..(1095): n is a, c, g, or t
  misc_feature (1099)..(1099): n is a, c, g, or t
  misc_feature (1101)..(1102): n is a, c, g, or t
  misc_feature (1104)..(1104): n is a, c, g, or t
  misc_feature (1106)..(1106): n is a, c, g, or t
  misc_feature (1111)..(1111): n is a, c, g, or t
  misc_feature (1113)..(1113): n is a, c, g, or t
  misc_feature (1115)..(1117): n is a, c, g, or t
  misc_feature (1119)..(1125): n is a, c, g, or t
  misc_feature (1128)..(1128): n is a, c, g, or t
  misc_feature (1132)..(1135): n is a, c, g, or t
  misc_feature (1138)..(1140): n is a, c, g, or t
  misc_feature (1142)..(1145): n is a, c, g, or t
  misc_feature (1147)..(1149): n is a, c, g, or t
  misc_feature (1319)..(1319): n is a, c, g, or t
  misc_feature (1460)..(1460): n is a, c, g, or t
  misc_feature (1535)..(1535): n is a, c, g, or t
  misc_feature (1735)..(1735): n is a, c, g, or t
  misc_feature (1778)..(1778): n is a, c, g, or t
  misc_feature (1993)..(1993): n is a, c, g, or t
  misc_feature (2615)..(2615): n is a, c, g, or t
  misc_feature (2742)..(2742): n is a, c, g, or t
  misc_feature (2759)..(2759): n is a, c, g, or t
  misc_feature (2768)..(2768): n is a, c, g, or t
  misc_feature (2782)..(2782): n is a, c, g, or t
  misc_feature (2834)..(2834): n is a, c, g, or t
  misc_feature (2865)..(2865): n is a, c, g, or t
  misc_feature (2872)..(2872): n is a, c, g, or t
  misc_feature (2884)..(2884): n is a, c, g, or t
  misc_feature (2919)..(2919): n is a, c, g, or t
  misc_feature (2926)..(2926): n is a, c, g, or t
  misc_feature (2929)..(2929): n is a, c, g, or t
  misc_feature (2934)..(2934): n is a, c, g, or t
  misc_feature (2971)..(2971): n is a, c, g, or t
  misc_feature (3010)..(3010): n is a, c, g, or t
  misc_feature (3020)..(3020): n is a, c, g, or t
  misc_feature (3022)..(3022): n is a, c, g, or t
  misc_feature (3027)..(3027): n is a, c, g, or t
  misc_feature (3040)..(3040): n is a, c, g, or t
  misc_feature (3047)..(3047): n is a, c, g, or t
  misc_feature (3059)..(3059): n is a, c, g, or t
  misc_feature (3082)..(3082): n is a, c, g, or t
  misc_feature (3085)..(3085): n is a, c, g, or t
  misc_feature (3088)..(3089): n is a, c, g, or t
  misc_feature (3094)..(3094): n is a, c, g, or t
  misc_feature (3112)..(3112): n is a, c, g, or t
  misc_feature (3131)..(3132): n is a, c, g, or t
  misc_feature (3136)..(3136): n is a, c, g, or t
  misc_feature (3155)..(3155): n is a, c, g, or t
  misc_feature (3245)..(3245): n is a, c, g, or t
  misc_feature (3258)..(3258): n is a, c, g, or t
  misc_feature (3299)..(3299): n is a, c, g, or t
  misc_feature (3331)..(3331): n is a, c, g, or t
  misc_feature (3355)..(3355): n is a, c, g, or t
  misc_feature (3367)..(3367): n is a, c, g, or t
  misc_feature (3395)..(3395): n is a, c, g, or t
  misc_feature (3401)..(3401): n is a, c, g, or t
  misc_feature (3452)..(3452): n is a, c, g, or t
  misc_feature (3467)..(3467): n is a, c, g, or t
  misc_feature (3483)..(3483): n is a, c, g, or t
  misc_feature (3530)..(3530): n is a, c, g, or t
  misc_feature (3545)..(3545): n is a, c, g, or t
  misc_feature (3576)..(3576): n is a, c, g, or t
  misc_feature (3611)..(3611): n is a, c, g, or t
  misc_feature (3643)..(3643): n is a, c, g, or t
  misc_feature (3653)..(3653): n is a, c, g, or t
  misc_feature (3668)..(3668): n is a, c, g, or t
  misc_feature (3677)..(3677): n is a, c, g, or t
  misc_feature (3692)..(3692): n is a, c, g, or t
  misc_feature (3758)..(3758): n is a, c, g, or t
  misc_feature (3779)..(3779): n is a, c, g, or t
  misc_feature (3806)..(3806): n is a, c, g, or t
  misc_feature (3809)..(3809): n is a, c, g, or t
  misc_feature (3818)..(3818): n is a, c, g, or t
  misc_feature (3833)..(3833): n is a, c, g, or t
  misc_feature (3841)..(3841): n is a, c, g, or t
  misc_feature (3848)..(3848): n is a, c, g, or t
  misc_feature (3851)..(3851): n is a, c, g, or t
  misc_feature (3899)..(3899): n is a, c, g, or t
  misc_feature (3926)..(3926): n is a, c, g, or t
  misc_feature (3985)..(3985): n is a, c, g, or t
nnnnnnnnnnnnnnnnnnnnnnnnnannnnnnnnnnnnnnnnnannnnnnnnnnnnnnanannnnnannnnnnnnnannnnnnannnnnnnannnnnnnannnnnnnnnnnnnnnnnnnnnnnnnnnnnnnnnnnnnnnnnnnnnannnnntnnnnnntnnngnnnnnnaannnnannnnctnntntcnnngcnananannnnnnnnnnntntnngnnnnnncnnnnnnnnnnnnnnnnnnnnnaanaannntnnntnnnnnnnnnnnnnnannnnnnnnnnnnnnnccnnnnnnnccnnnnnnnnnnnnnnggnnnnnnnnnnnnnnnnnttnnnnnngnnnannnnnnnngnnnntnnnnnntnnnnnnntnnnnngnnnnnnnnnnnnanngnnnnncnnntnnnnnnnnnnnnnnnnnnnnnnnnnnnnnncnnnnnnannnnnannnnnnnnnnnnnnnnnnnnnnnnnnnnnncnnnnannnnnnnnnnnnnnnnnnnnnnnnnnnnnngnnnngntnnnnnnnnnnnnnnnnnnnnnnnnnnnnnnnannntnccnnnnnnnnnnnnnnnnnnntnnnnnnnnnnnnnnnnnnnnccnnnnnnnnngnnannnnnnnnnnnnnnnnnnntngnnnnnnnnncnnnnnnnnnnnnnnnnnnnnnnnnnnnnnnnnnnnnnnnngnnnntncnnnnnttnnnnnnnnnnnncnnnnnnnnnnnnnnnnnnnnnnaanancnnannannnnnnnnnnnnnncnnnnnccnggnnttnnggnnaaaannnccnnnnncnnncccnaaaaaaaaannnnnnnnnnngngntnnttnnnncnnttnnnggntnccnnaaannnnnnncnnannnnttnnnnnnncnancnnnnnnnaannncntnanngnnnnnnnccnnnnnncnntnnnnnnnnnngcnctccnnnncntcnntttttnnngcntngnngnnntcgccananngnaggnancnnggccgnnnnncnngcngntnncgnannnnnnggnngggnagnnnnngnnnaannnnnaagnanntnnacnnnnaaaantnnccnnnggnntnggnnnncccnanncngngggcnangnnngnnnnnnnttncccnnnnttnnngnnnntnnnccccccttcaggctccatgcaccaattgcaccactgccaggcgacctccctggctactgtcgaagaggatttgtcggccttcggtgaggggaatgaatgcccctatgggaatgtcgcggccggcggtcacgtcgcgcaaaccgggcaaacggcgattgatgagaatccantgaccgttgtggaagtggaagtcgcccaccggaagtttgtcttctgcacttgttttttcgttgggtacaatcaaattgttcgtatgccaacgataaagggtttgccggtgatagaccatcatgcggtagttctctgaaatntacttgccatgggaaggggcatagtagaaattgagaatcggaagttgaccgacatagggttttccgcaaaacggncaaacaggctttgtcttgttgtcaaacacataccacccgtgttcgcaactgcagggttgcaacaaatcacacgtttttacgagggcttcttcccactctccggcactggggcggagtccgggattgtgcaaaccgtcgatgaacgcgcggttgaacattttggtgaggtaagggccgcacagcgtgtaggggcgttgctncggatcggcttgcggtagttcgcgcggatcgagttgtgccggnttcacacggttggtggcatcggtggggtgctcgataaaaagcgctttttctccatagcgaagatcgtcatcgcgctgaatatcgtcaagatcccaaactttgcctccattgagtggatggcgattgagcaagaaggtgtaaatgagtaccgctaaggcgtgccgatcggtggaaatctgcgggagatttttcttcggatcgccgaggcgcagacnccgcgtagccatcacttcgggggctatgaagccgggagtaccaacgacttcgggggggaacttcttggggacaaccaaaccatcgcaatcgatgatgcaagcattgccgcctacgggatcgaccaagacattgttgtacgacaagtcggaatgcgcaagtcccgcggcatgaaggcgccgcatggcacgggcgatttgcaagcacatgcgcaaacgagtgagaaaggtgcctttttgattggcaggcacgtagcgattgaccagtttggccgccgaaaaccactttccgttcttctcctgtccatttttgatgtaacgccatgtcggatcgactccactgaagaagaatttcttgtcgtagaaaggcatgactaaccccaccttctcgccccacataacaattttggtgggccaggcgaaaagtgtcgtccaatacttcccgacctcatcggtggtgaaaatcagttggcggtgcgtgttcacgatgtcatctatgcgctgccggtcattgggactgagggctttgcgatagaaggccaccacataggtgccatcggtggaaaaatagacatccttgacgccgccggaggctttgatttcgtcatagaactcaacggaactnccgtcagtggctgttagcgttacgatatttgccatggtcgtagggggttaacaatgagcatcaggggaattcgtgacttcgccgtcgcacggactcgaggttggctgcgcgtccgcggtctcggtgngaacgggaacttcaccngccgtggcngaagttgtttcggnttcttttgatgcgacttcagcaacaagttgttcagttgcttgggcagacgtnggttcgccggtctcgacatcgggtttgggcngcttttnctcttcgggagncttctcttcggcagcgggcgcagcgggcgtcgcancatctgnatnttgcnctgcggtcactgatgcttgtggagccaagacttcggntgccggctctttggcaggcgttacctcgctatcggtagncgtgtcgatngntgttntttctgtagaagnggtctcngcggttgttggntcttcgtgaggagccgcgctgtnggngtnnaccgncgacgtttccgcagaagnggcttctgctgttgcaggnncttngagagaggcctccgcgctnccggctttcgagacttcgtcggcgacagcagacgtcttttcgtcggacgacggggcttctttgccgcagagcactgcgatggtgcggtcntcgtaattgcccngcgaccaaaaatcgagccaagacaacaactgattttttgcnacttcttcaccggtagtgagtccgactccttngtgctccaaattctcccagagttngtcccacttttngggattcttcagattgttggtggtttcnaacttngcatcactcacgccatcggacatcaagaagagggcggtgaagtcgtcgacnaacgtgaatcgcagncgcttgtagcaagctnttggatcttggaatatttcgggcatggtgacaaaacgtgtttgtccnccatattctccttcntcgggctcgcccatcagtttaacctcatgcngatcgcggcgatagagggcaatggcgccgtcgccnacccaaaaggtaccgacaaaccaaccaaacgngaaacgcttngtgatgctgagcaanaaagtggcngcataggttcgaggntcgcgctgttgtttcgcagcttctgcttgtatggccttactggcattgaacgctgcagagcaaagnagatgataaagcacttcaccnaccttcgagatgttttcgctctctgantgntgataagcngaaatttgtgcttcnatgttttngagcgtntcngcatcggccagtttcttcaaacagcactcgaccgctgtttcacaagcnaaacgtgagccctcgcgggaataggcngcggagccggcaccgtcagaaacggccatgacgtaccaaccgttctcggcacaatagtncatgcggtaagcgtc

SEQ ID NO: 922 - DNA, 4000 bp, Escherichia coli
  misc_feature (3)..(3): n is a, c, g, or t
  misc_feature (183)..(183): n is a, c, g, or t
  misc_feature (204)..(204): n is a, c, g, or t
  misc_feature (285)..(285): n is a, c, g, or t
  misc_feature (471)..(471): n is a, c, g, or t
  misc_feature (542)..(543): n is a, c, g, or t
  misc_feature (873)..(873): n is a, c, g, or t
  misc_feature (1073)..(1073): n is a, c, g, or t
  misc_feature (1134)..(1134): n is a, c, g, or t
  misc_feature (1317)..(1317): n is a, c, g, or t
  misc_feature (1662)..(1662): n is a, c, g, or t
  misc_feature (1953)..(1953): n is a, c, g, or t
  misc_feature (1985)..(1986): n is a, c, g, or t
  misc_feature (2027)..(2027): n is a, c, g, or t
  misc_feature (2417)..(2417): n is a, c, g, or t
  misc_feature (2477)..(2477): n is a, c, g, or t
  misc_feature (2954)..(2954): n is a, c, g, or t
  misc_feature (3311)..(3311): n is a, c, g, or t
  misc_feature (3385)..(3385): n is a, c, g, or t
  misc_feature (3440)..(3440): n is a, c, g, or t
  misc_feature (3443)..(3443): n is a, c, g, or t
  misc_feature (3467)..(3467): n is a, c, g, or t
  misc_feature (3518)..(3518): n is a, c, g, or t
  misc_feature (3905)..(3905): n is a, c, g, or t
agngctctaaacccaagccattacggtgtagatgaggcttacataataaaaggcgatatagtggaggatgagggtaaagctagggtagatccgctggagggcttgaggatacttgccttcgatacagaggtttacaatccacagaaaacccctgatcctaagagggatccggttatactaatnggtttaatgagctaccctggngatgatgagccgttgatacttgaggctgacgagttcaacgatgctaggttgataagggcttttatcgaggaggttaggagnagggatccagacataatagtgggttacaatcagaataggttcgactggccttacctacttgagagggctaggatacacggtataccattggatgtggggcgtaggaggggtggggttccgcagagtagtgcttacggccacatatcgataccggggaggcttaacgtagacctcctggatttcgcnatggaggttagagaggttaaggttaagagcttagatgaggttgcagactacctaggcgttatgcctaaganngagagggttctactagagtggtggcagataggggagtattggagggatgagagtaagagggggttactgaagaggtaccttagagacgacgttctatcaactatggggctagcacttaaattcctacccttcggagcccagatgagccagattagcggtctcccactagaccaggttatgacagctagtgtaggctacaggcttgaatggaggcttatgagggaggcttacaagaggggggagcttgtaccgaatagggaggagaggggtgaggagagctacgagggggccatagtactagagcctaggcctggaatccatgagaacgtngcggttctcgatttcgcaagcatgtacccaaacataatggttaaatacaatgtaggccccgacacccttgtgagatccggggagctttacagcgatgaggtctacgtggctccagaggttgggcataggtttaggagggaacctccagggttcttcaagagagctctagagagattcctaaggtggaggaaggagataangaaggctatggagtcaactccaaagggtagccctgagtacaggctcctagatgaaaggcanaaggctataaaggttttagctaacgcaagctacggttacatgggctggctctccgctagatggtattgtagggagtgtgctgaagctgtaacagcatggggtaggaatctgataagatcagctatagctaaagcccgagagctagggcttaacgtcatatacggtgatactgatagcctattngttagatacgagcctgagaagcttgataagctagtcgagtatgttgaggaggagctgggtttcgatataaagctagataaaatctacactaaggtcttcttcacagaggctaagaagaggtatgttgggttaacagtagacggtaagatagatgttgtaggcttcgaggctgttagaggggattggagcgatctagctaaggagacacaggctgttgtagctgagatagtgttgaagacagggagtacagctaaggctgtagagtatgtaagggatactataaggaggcttagggaggggaggatggatatggataagctcatcatatggaagactataacgagnaggcttgaagagtataaagctgagcagccgcacgtaacagcagctaggatgatggttaaatcaggtgtaaaggtggaacccggggttaaggtgggatatgttatagttagaggatcaggccctctatacacaagggctaaaccatacttcatggcgtcagtggaggaggtggatgttgaatactatgtagataaacaggttataccagcagcgctaagaatcctagggtacttcggtgtaacagataaacagttgaagggaggaggtgctcagaggagcctcctagactanctatctaaatagaagcccagcgcatcatatgnngtgttcacgttaaatcactgaatgttaaaaccctgaggttnggcggcttataggatatcttactacccatcctagctcctatcaccaggtttacacctttctctgctgagagctctacaagcctttgggttataattccatcgaatactatggcgaaggcgttgccgggctccatgttctggaggcttgtgaatagatctttaaccttaaccctggctatctcattccacgatctatcgtatataaccccttcaagcgtccctttaagcttctcgatctcgctcacaacattccttgggatagctattgttatggtctccgttgggggcgcctgttgtacttccacaggtttaacctcttcaaccttttgaacctgctgttgaacctgctcctctacaggttgctgagcttcagcttcaggtactgttacnggtgttacaggtttaacctccgggggcttctctctagccttaagctccttcatgaaatcngctgctgtaaccatctcgcttaaagccttagctatctccctccccgttaactgctccacctctttatccttaggagctctagccacatagtctactttaatctggttaataacattaactgctattaactccccacctctatctccgtcaacaaataaaactatcttcttcttcgaggccaggttccttatagactcgggcacattctccttggccccttcaagtgcgatcacgttagtgtaaccgtatctaagcaggttgataacatcagctctaccctcaaccactataaccgtatcagaggtctcaacgtcagggcctgccggcaacctctcaggcccatactctatgagtctaggagctctagcaacctccccctcaatctgcctaataacctctttaacatcaggctcgctctcctttatcttcttcaaaatctccttcgctctctctatcacaacctttatcttctcagcnctcaaatcccttatatcctctactataaccctagcggtgtaaggtccaaccctgtcaacggtctctagcatagcagctattatggctgtctcaaccctatcaaggttacatggaacctgtatggagcctaaggtcttgttatcctggtatctaagctcaacctgaactctaccaatcttatccttctcctgtaaatcctctaagtcgaactcagagcctaggaggccctcagtctgaccgaagatagcccctataacatcgtgtctatcaaccctcccgtcaacctcaagcctagccttgataaggtacttcaagcccccacacctcaacgcctaaactctaagcccatgtagagtntctaagctgggctttaaatccctcaattaaactccttgaaaccagagtagcgcgatgtaatgtttttaagctgngggagtaagggttacctctaggtgttaggttattgtatcgagctccaccctaganctnatggttaggaatacagttgaggtnataacattagaggatctaagggaggctgtggagagcggtaggaggctgagngggtacataggctacgagcctagcggcctagttcacgtgggctggcttgtatggatgtttaaggtagcggatctcgttgaagcaggtgtagacttcatagtccttgaggccacatggcacgcttatatcaatgataagcttggaggggatatgggtttaataagggatgccgcctggcttgtaagagagttcatgagggagctcgggctccccgttgacaggattaagtttgttgatgcagaggagctagcatcagatccaagctactgggctctcgttataaatgttgctaagagctcaagcctagctaggattaggagagctttaacaataatgggtaggagggttgatgaggctgagctcgactcatccaagctaatatacccngctatgcaggtagccgacatatactacctagacctagacatagccctgggaggcttagatcagaggaaggcccacatgctagcaagggatttggc

SEQ ID NO: 923 - DNA, 4000 bp, Escherichia coli
  misc_feature (962)..(962): n is a, c, g, or t
  misc_feature (2561)..(2561): n is a, c, g, or t
  misc_feature (2979)..(2979): n is a, c, g, or t
  misc_feature (3772)..(3772): n is a, c, g, or t
  misc_feature (3963)..(3963): n is a, c, g, or t
agcgcacgaatctcaacatccatactgctactttctagagcctgcacaagctgggaaatttctgcgataccgggcagtattaccagcacatctcggctaccctctcgcttcagtgcctccttggtgactcgcaaggcagccctatctaatgattcatgagcctccacaggacagtagcgcgtttccactgaaaattcgcggccactactctcaataacgggggtgtcactacctaacacaccttttaaagcagcgacatccaatgtggcagacatcaccattagccgaagatcatcacggatgctctcttgtacatccagtgctaacgcaagtcctaggtctgcttcaatgcttcgctcatgaaactcatcgaaaataatgcccgccaccccttccaataaaggatcgtcttgcagtatgcgggtaagcacgccttgggtgaccacttccagccgggtattggggcctacattgctatcgccccgcatccggtaacccaccgtttcacctatctgttcgttgagctgtgacgccataaaggtggctgccaagcgagcggcgacacgacgcggctctaccagtaagagacgctgaccttgcgcccaggcgctggagagtaacattagcgggacacgggttgttttaccggcacctggttgagccaccagaataagccgagtgtgttcggctagcatggtttgaatggagcttagatgttgttcaatgggaagcgatatggtcatgaatcagtgcgaggttgcatttgaggaagtaataccgcatcccttcaggataacgtgctcaaggaactgacaaatggaagccaagtcagcctcactcagcgcttcttccccaagaatgccggtcacttgagcgctatattccgtgtagtgctgagtggccgaccaaattagaaagatcagccaacgtggatcaacatcgtccattttaccctgctgggnccactgacgaataatcactgcgcgggaggctacccactcctttagttcgccggcgagatactcttttaagaaaggtgcccccgccaatatctctgcggcaaacagtttggacccctcagggtaacgctgcccaagcatcattttggtgcgaataaaatcactgagtacctgccctgggtcgctatcctcagtaatatcctctagtaccgcattccagcgattcatcatccgatttagcagtcgcacatacagcgcctgcttgctccccatataataaagaatattggcttttggcagcttagcttggtctgcaatcgcctgcaggctagcaccacgataaccatgttgtgaaaacacctgctctgcagcgcttaatatggtttgttcaatacggtccctgctggcattttcttggttcgcggtatcagccgtcattcagtaagctcctttaataaaccttgcagtgtaatcgcgagaaatgtctaccaagcgtgcgtgtcgcatcactgtgcatttcgcagtgcgatgctcactaatagtgcatgtcacatctcatataacaaagtcttgcaagatttgcatttttgtcccaagctcaacgttgttgaccgatcggtcaaaacaatcataacggagtttggcatggcaacaattgagtttttgctcaatggcaccccgacccggtgtcatgtgccctctgacacaagcattctaacgctgctacgcgactatttggggatgaccggcacgaaagagggctgtgcatcgggtgactgcggcgcatgtaccgtcgccattaaaagcgatacagcgcctcattttgtaagcctgaatgcgtgtattacacccgctcaccagttacatggccagcacttgctaaccgtagagggcttggccactgacgaagaacttcacccggcacagcgtgccatggtggagtgccatggcagccagtgcggcttctgcacgcccggcatcgtaatgtcgctatttacgctacattcacaacagcaacagcggccagccccccttacgccagagcggcttgaagcagcactgggcggcaacttgtgccgttgtaccggatatcggcctattcgtgacgcagcgctaagcatgcaggagtcttcttggaaagcaccgcaatgggttgatgccagccaacccgctcatactccacttaccgctcctcaatctgcggaagccaacacggacctttttgctcagcccacgacactgagtcaactaactgaactacgccgacactatccatctgcacgccttgttgccggtgccaccgatctgtggctggaaaatacgcagcgcctggcgttgcttaatcaacttattgatgtcacacgggttgatgagctacgccatattgaagaagccatctttgatgagcagccaggctggtgggtaggcgcaggcgtcacctattcacagctcgaaccactgctagaaacccactatcccgcctttgcacatctacttcatcggctcggctcacagcaggtgcgtaaccgcggcacactgggtggcaatattgccaacgcatcgcccattggcgacaccccgcccgtactgctggcgctcaangcctgggtagaactggctaaccaggatggcagtcgcgcgctgccgctgagcgacttcttcctggattataaaaaaacggcgctggcagcggatgaagtcgtgagtcgaatatttattccacaattggcggacgacgccgtcctgaaagtatggaaactctccaaacggcgtgaagacgacatctctgccgtactaggagccttccattatcgtatcgacgatggcgttatgcaggatgttcgtatcgcctttggcggcatggcggccatccctaagcgagcgctacaaacagaggcagcgttaacagggcagcctatcgcgaaagagagctttcaagcggcacagcgggcgctatcggaagagtttcatcccatgagcgatgtgcgcggtacacaacactatcgtcatcaggtggcanccaacctgctcgaacgcctttatctatcgctctcagtacctaatcaagaggtgatgctccatgcgtacgctcactaagcttgatggcgacagcagccgcgctcgccgcgagctgcatgaccatatccaaggttctggtccactggctcgccatacggtggatagccacgggcaacggcaagccggtgcttccagcttccatgaaagcgcagagaaacatgtcaccggtaaagcaacctatattgatgacattaaaacaccccaagatgccctgtacgtggcgctcggcctttcacctgtcgctcacggcacgctaacgaaactggaacttgatgctgtaagacaggcgcctggcgttgtcgacgtgatcactctccatgatgtaccaggacacacagatattgggccggtattccccggcgaccctatttttgtcgaccaggagatcagttacgcgggacaatgcctatttgcggtggctgccacctctttacaggcagctcgccaagccgtgaagctggccacactgcatatcgacgaacagccggctagcctagatcctgtggccgctgctggacgtcaagaggttgtgcgcccaacccacgtgcaggagcggggcgactggcaaactaccttacagcaagccgaacaaactatagaaggcgagctatttatcggtgggcaggagcacttctatctcgagggccaagcgtgcattgtggtgcctacggaggatgaaggggtgatggttcatacctctaaccagcaccccagtgagacccaaaaattggtgncggaagtgctcggtattccttttcatgcggtcactgtagaagtgcgccgtatgggcggcggctttggcggtaaagagacacaagcatcgccctgggcctgcattgccgccattattgctcggcgtaccggtaaagccacgcgacttcgcctgccacgcagtgaagatatgcgtgccactggaaaacgccancctttccataaccgctatcaattagcgattgatgccc

SEQ ID NO: 924 - DNA, 4000 bp, Escherichia coli
  misc_feature (1)..(3): n is a, c, g, or t
  misc_feature (6)..(14): n is a, c, g, or t
  misc_feature (20)..(21): n is a, c, g, or t
  misc_feature (23)..(29): n is a, c, g, or t
  misc_feature (31)..(36): n is a, c, g, or t
  misc_feature (38)..(41): n is a, c, g, or t
  misc_feature (44)..(49): n is a, c, g, or t
  misc_feature (51)..(57): n is a, c, g, or t
  misc_feature (59)..(62): n is a, c, g, or t
  misc_feature (64)..(66): n is a, c, g, or t
  misc_feature (68)..(69): n is a, c, g, or t
  misc_feature (71)..(71): n is a, c, g, or t
  misc_feature (74)..(75): n is a, c, g, or t
  misc_feature (77)..(79): n is a, c, g, or t
  misc_feature (81)..(82): n is a, c, g, or t
  misc_feature (84)..(86): n is a, c, g, or t
  misc_feature (89)..(95): n is a, c, g, or t
  misc_feature (98)..(98): n is a, c, g, or t
  misc_feature (101)..(102): n is a, c, g, or t
  misc_feature (105)..(105): n is a, c, g, or t
  misc_feature (107)..(107): n is a, c, g, or t
  misc_feature (109)..(109): n is a, c, g, or t
  misc_feature (111)..(111): n is a, c, g, or t
  misc_feature (113)..(113): n is a, c, g, or t
  misc_feature (115)..(120): n is a, c, g, or t
  misc_feature (122)..(122): n is a, c, g, or t
  misc_feature (124)..(126): n is a, c, g, or t
  misc_feature (128)..(132): n is a, c, g, or t
  misc_feature (135)..(141): n is a, c, g, or t
  misc_feature (144)..(147): n is a, c, g, or t
  misc_feature (149)..(150): n is a, c, g, or t
  misc_feature (152)..(154): n is a, c, g, or t
  misc_feature (156)..(157): n is a, c, g, or t
  misc_feature (159)..(164): n is a, c, g, or t
  misc_feature (167)..(168): n is a, c, g, or t
  misc_feature (170)..(176): n is a, c, g, or t
  misc_feature (178)..(183): n is a, c, g, or t
  misc_feature (187)..(188): n is a, c, g, or t
  misc_feature (191)..(193): n is a, c, g, or t
  misc_feature (195)..(195): n is a, c, g, or t
  misc_feature (197)..(200): n is a, c, g, or t
  misc_feature (202)..(207): n is a, c, g, or t
  misc_feature (209)..(210): n is a, c, g, or t
  misc_feature (212)..(218): n is a, c, g, or t
  misc_feature (220)..(222): n is a, c, g, or t
  misc_feature (224)..(225): n is a, c, g, or t
  misc_feature (228)..(228): n is a, c, g, or t
  misc_feature (230)..(232): n is a, c, g, or t
  misc_feature (234)..(236): n is a, c, g, or t
  misc_feature (238)..(240): n is a, c, g, or t
  misc_feature (242)..(242): n is a, c, g, or t
  misc_feature (246)..(248): n is a, c, g, or t
  misc_feature (250)..(252): n is a, c, g, or t
  misc_feature (254)..(256): n is a, c, g, or t
  misc_feature (258)..(260): n is a, c, g, or t
  misc_feature (262)..(262): n is a, c, g, or t
  misc_feature (265)..(267): n is a, c, g, or t
  misc_feature (269)..(274): n is a, c, g, or t
  misc_feature (276)..(277): n is a, c, g, or t
  misc_feature (279)..(279): n is a, c, g, or t
  misc_feature (283)..(286): n is a, c, g, or t
  misc_feature (288)..(288): n is a, c, g, or t
  misc_feature (290)..(298): n is a, c, g, or t
  misc_feature (301)..(305): n is a, c, g, or t
  misc_feature (308)..(309): n is a, c, g, or t
  misc_feature (312)..(313): n is a, c, g, or t
  misc_feature (315)..(323): n is a, c, g, or t
  misc_feature (325)..(334): n is a, c, g, or t
  misc_feature (336)..(336): n is a, c, g, or t
  misc_feature (338)..(340): n is a, c, g, or t
  misc_feature (344)..(344): n is a, c, g, or t
  misc_feature (346)..(346): n is a, c, g, or t
  misc_feature (348)..(352): n is a, c, g, or t
  misc_feature (354)..(354): n is a, c, g, or t
  misc_feature (356)..(359): n is a, c, g, or t
  misc_feature (361)..(363): n is a, c, g, or t
  misc_feature (365)..(365): n is a, c, g, or t
  misc_feature (369)..(370): n is a, c, g, or t
  misc_feature (374)..(374): n is a, c, g, or t
  misc_feature (376)..(376): n is a, c, g, or t
  misc_feature (378)..(380): n is a, c, g, or t
  misc_feature (384)..(385): n is a, c, g, or t
  misc_feature (387)..(388): n is a, c, g, or t
  misc_feature (390)..(396): n is a, c, g, or t
  misc_feature (398)..(400): n is a, c, g, or t
  misc_feature (403)..(408): n is a, c, g, or t
  misc_feature (410)..(411): n is a, c, g, or t
  misc_feature (413)..(413): n is a, c, g, or t
  misc_feature (415)..(418): n is a, c, g, or t
  misc_feature (420)..(423): n is a, c, g, or t
  misc_feature (425)..(429): n is a, c, g, or t
  misc_feature (432)..(433): n is a, c, g, or t
  misc_feature (435)..(437): n is a, c, g, or t
  misc_feature (439)..(441): n is a, c, g, or t
  misc_feature (443)..(445): n is a, c, g, or t
  misc_feature (447)..(449): n is a, c, g, or t
  misc_feature (452)..(456): n is a, c, g, or t
  misc_feature (458)..(464): n is a, c, g, or t
  misc_feature (466)..(475): n is a, c, g, or t
  misc_feature (477)..(478): n is a, c, g, or t
  misc_feature (482)..(482): n is a, c, g, or t
  misc_feature (484)..(484): n is a, c, g, or t
  misc_feature (491)..(491): n is a, c, g, or t
  misc_feature (494)..(496): n is a, c, g, or t
  misc_feature (500)..(502): n is a, c, g, or t
  misc_feature (506)..(506): n is a, c, g, or t
  misc_feature (508)..(508): n is a, c, g, or t
  misc_feature (510)..(511): n is a, c, g, or t
  misc_feature (513)..(514): n is a, c, g, or t
  misc_feature (516)..(521): n is a, c, g, or t
  misc_feature (523)..(526): n is a, c, g, or t
  misc_feature (529)..(529): n is a, c, g, or t
  misc_feature (1987)..(1987): n is a, c, g, or t
  misc_feature (2932)..(2932): n is a, c, g, or t
  misc_feature (2946)..(2946): n is a, c, g, or t
  misc_feature (2953)..(2953): n is a, c, g, or t
  misc_feature (2957)..(2958): n is a, c, g, or t
  misc_feature (2962)..(2964): n is a, c, g, or t
  misc_feature (2970)..(2972): n is a, c, g, or t
  misc_feature (2976)..(2976): n is a, c, g, or t
  misc_feature (2978)..(2979): n is a, c, g, or t
  misc_feature (2983)..(2984): n is a, c, g, or t
  misc_feature (2988)..(2989): n is a, c, g, or t
  misc_feature (2992)..(2992): n is a, c, g, or t
  misc_feature (2995)..(2999): n is a, c, g, or t
  misc_feature (3001)..(3001): n is a, c, g, or t
  misc_feature (3003)..(3004): n is a, c, g, or t
  misc_feature (3006)..(3010): n is a, c, g, or t
  misc_feature (3012)..(3014): n is a, c, g, or t
  misc_feature (3016)..(3016): n is a, c, g, or t
  misc_feature (3019)..(3019): n is a, c, g, or t
  misc_feature (3021)..(3021): n is a, c, g, or t
  misc_feature (3023)..(3025): n is a, c, g, or t
  misc_feature (3028)..(3028): n is a, c, g, or t
  misc_feature (3035)..(3036): n is a, c, g, or t
  misc_feature (3039)..(3039): n is a, c, g, or t
  misc_feature (3041)..(3041): n is a, c, g, or t
  misc_feature (3043)..(3043): n is a, c, g, or t
  misc_feature (3045)..(3045): n is a, c, g, or t
  misc_feature (3053)..(3054): n is a, c, g, or t
  misc_feature (3057)..(3057): n is a, c, g, or t
  misc_feature (3725)..(3725): n is a, c, g, or t
  misc_feature (3742)..(3742): n is a, c, g, or t
nnnatnnnnnnnnnaataannannnnnnntnnnnnnannnntcnnnnnnannnnnnntnnnnannnanngnaannannnannannnacnnnnnnnaanaannaanananananannnnnnanannnannnnnatnnnnnnnatnnnntnnannnannannnnnnatnnannnnnnntnnnnnngatnnatnnntnannnntnnnnnncnntnnnnnnnannnannaanannnannnannnancaannnannnannnannnanaannnannnnnnanntnaatnnnnantnnnnnnnnnatnnnnnttnnttnntnnnnnnnnncnnnnnnnnnntncnnnctancnannnnntncnnnnannnanaaannaaananannnattnntnntnnnnnnnannnatnnnnnntnnantnnnnannnngnnnnnaannannnannnannnannnacnnnnntnnnnnnnannnnnnnnnnanntaantnaattaantannnattnnntttntntnnannannnnnnannnnatntatatatatataactatctttcaatttaattaatattattttttaataatttaatttaatatataatatttataataataattcattaaattatttatatacgtctctcttacatataatatatatatatatatataaatataaagattcaaagaaaaatatatccaaatatacctgtaacatggctttccatgagtaatgatggttggtgttggtttgtaagatttgctgatggttctatagcttggagaacaacaattgtttctttacatacacttttagaaaaacatcatactaaaggaactgtatcaaaagttactttttgtcgtaataatggatgggttgttattttctgtgatggtcaggtggcttttagtgaaattccatattcattagaagcagaattaagtaattatccacgatacatagaagatgtcacgatttctggaagaaaagaatgggtcattagaagaaatatgataattaataataattatgataataagaatcatatgaaatcatattccatacaaagaaatggttattatacttggagtaatggattatcttcctttttacaagataatttaattcatagaaataagaatattaaaaatattgtattatgttctggaacaaaaaaatcttatttcttacagtataataattatcattcagcattccgtcatcattcctctcttacagacgaaattaatgactttaaaccaggaaggaaaccttatcttaatccatttacagtacgttttacaacaagtactgtttctgttcatataaaaactgatactaatgttagagatcttgttcgaggagttcgaaataaatcaatatcttttaatcaattaccagaattaagagtaattcaagatccaagagatggtcgttggtgggctatagataattactggctttgggtattgaaagaagctggtattcgtagagtaacagttaaaatttttccatggacaaaagaattcttaagaggagttcggggtaaatgggatgttacagtattaaatgaagattataaaccctatgactattaaaattaatttaataataataaattgttattaaaaatattaaaatttaacaattttttaaaaactttatattaaaaaatatatatatgtatattttcttttcattagtttcaaaatataatataatttaattattatgattcaaggatttaatattaaataacattaagatgaactaatataaagtttttattcatatatatttcacatattttaaataatatttgtaaatgtatttaaatattttacaatatatatgtatttataatacatacaaattttgaatgaaaaagtagaaagaaaagaaaatattatatatataatctaaaatctctaaaatctattactattaatatatataaatatatatatatatatatatttttttttttttttntttaattttttttcttcttaatattttctaaataaatcaaaaatattatatatatatagatataaaataattttttaaataatattatatatatataatatttttttttaaataattatttttacttatcattaaatattatcttttttttttatccgttttatctttaaataaaaaatttttgatatatatattaataaaagtttaaatataaattatgtattttgttttttttatataatattaaaatgtattacaagtattattattttaaacctttttgaaatatttatatatataataaaccctaatgtttaaaaaaaaaaatatatatatatatataattactttaataattacattattaaaaatttttgtaattataaataaatattatttagtataattatgttgtataaattagatgaaaaagttaataggtataaaagaaatttaatttcaaagagataaataactttaaaatgaaaagaatttcagtatatatattaactaaatttaatcttttacataaagacttatcataccaaaggtctctggatcgatccccgtcagtatcaaatcttcacgatttttccctctagttttttcgtgaaaggataggggttaaatgatactcaggtaggtatgttttctatatttctaacactttaagaatcccattgcgtaagccttgtctgagaggattacagtgtccagctcctctgggatggcaaggaggtgacctatagggttctgctttcccgcgaggatcatgtagagtacttctatactggagtttcttttgcgagcgtcgacgccgtaccggtttggcagttaatcatacatccatatcaacatatgggggagatataagtcttcaatctataaaaaaaaaatcttttatataaataaaaaaagatataagaaaattaattaaaatatgantaaaataggtaaanaaaaaanaaannaaannnagattnnntttnannttannttannttntcnnnnntnanntnnnnntnnnantanantnnnttnattattnnatnananantatataanntantataataatgtattaataatgtaatatggataattcaacaaaacaaaataattaaattagaattaaaaaaaaagcaactaaaattaattaaatattatatggaatataatatatgaacatataataaattattttttatatgaattttatatttcattaatatattataattttgatatgttaaataataaataaaaactataataaataataatttaatattaaattgtttttatttaaattttaataataatattaatttttaaattttattatattatatttttattttttaattcttttattttttttctttattttaaataatattattttatttaaataatattgtttatttagtttaaaatttaatacaaagaagaagaaaaaataaggtatatatttgaaaagcgaacataaaatttttaattatgatcgtaaaatattaagttcataaacttttaataattgatcatgtataaagaaaagaaaacttttttaaatattataaatcaaataaaataaaataaagaaaaaaaggaaatttgaatgtgttaaattatatatatatatatatatatatatttataaaaaaaagaaaaaaattgtttttatagtaatatatagattcaaattatatatatatatatgaaaaaaaaaatattttnttaaaaatatataattntttttagaaatagaagttaatatataaaataaaagaaattttataaaatattaacattacaaaatatatatactaaacttacatatatataatattattattattatttttttttttaatttttatacatatatattttatttaaaaaattataatataactaaaatgttgaaactgaaaaatttgttttatgacattttaattactcttcattcaataattattacaaaaaaatactattaacaatataatataaaa

SEQ ID NO: 925 - DNA, 4000 bp, Escherichia coli
  misc_feature (407)..(407): n is a, c, g, or t
  misc_feature (731)..(731): n is a, c, g, or t
  misc_feature (1598)..(1598): n is a, c, g, or t
  misc_feature (1601)..(1601): n is a, c, g, or t
  misc_feature (1610)..(1610): n is a, c, g, or t
  misc_feature (1613)..(1614): n is a, c, g, or t
  misc_feature (1616)..(1616): n is a, c, g, or t
  misc_feature (1624)..(1624): n is a, c, g, or t
  misc_feature (1628)..(1628): n is a, c, g, or t
  misc_feature (1762)..(1762): n is a, c, g, or t
  misc_feature (1924)..(1924): n is a, c, g, or t
  misc_feature (3351)..(3351): n is a, c, g, or t
  misc_feature (3367)..(3367): n is a, c, g, or t
  misc_feature (3424)..(3424): n is a, c, g, or t
  misc_feature (3580)..(3580): n is a, c, g, or t
  misc_feature (3651)..(3651): n is a, c, g, or t
  misc_feature (3706)..(3706): n is a, c, g, or t
  misc_feature (3746)..(3746): n is a, c, g, or t
  misc_feature (3754)..(3754): n is a, c, g, or t
  misc_feature (3929)..(3929): n is a, c, g, or t
acgcgcgctcgcacggcaacatgtgggcgacggtctccaccgcgcacgacctccgcgacggcaagatcgggggtgaggcggcccgccagcgagcgaccgacaccggtgagcgctacgacctcatcgtggcgggtggcgggatttccgggcttggcgccgccgcgttcttccagaagctcaagggcggcaaggtgctcgttctcgataaccacccgatggtgggaggcgaagccaagcgaaacgagttcaacgtcgatggcgtgcgcctcatcgggccgcagggctcgaacgacttcggcacgagactgccgcccggatgggccggtgactactggaaggacatcgggcttccgtacggcaatgatgcattcgagcaccaggcatgggccgcgggggtcacgccgctngagatcccgcgcgagcactactacttccagctgtggggcgacgagttcgcgagccatggcttcttcttcaaggagcctaacggttcgctgcgcctcgtccgcgacgcgttcggcgcgggattcaacgagacgccatggtccgagaagctgcgcgccgacttcacgaagtggcgatcgtcgccgaaggtctatgagggaaacgacctcgcgcggtggctcgacagcatgacgtacgaggatctgctcgtcaaacagctgggcctcgacccggcggtggctcgttatgcggacccgattctcgccggcgccgccggcgggctcggnagcgacgtcatatccgcccagtgtgccggccagatcggacttcccggtaccgggaacggacagaccttgcgcattccttcccacaagctcgccgacacgctcggcttcatctcgtcattccccggcgggaacgacggtatcatgcgccacgtgctcaaaaagctcgtgcctgacgcgatcgacgggcagggcttcgctggcgtgttgaacggccccgttcgattcgagaggctcgaccgcccagccaaccccacgcgaatccggctcggcgccaccgtcgtacgggtaacgaacctgcctaacggctcggtcgaggtcgtgtaccaccagggtggcgggttgcacaaaacgaccgccggcagcgttgtcatggccaacggcgcgtggacgtcgcagtacatcgtggccgatgtccccgaatcccatcgggccgcgtttaccgatttcgtccgcgcgccgatgctcgtcgtgaacgtcgcgctcaagcgctggcgcttcatgtacgatctcgggctcacggcggcgagctatcgcgacctgtttggattctcgtgcaacatccgccaatcgatggtcgtcggcgactaccggccaacgctccaccccgacaagccgacgatcctcacgttctacattccgttcgaacggcccggcacaccgatcaagacgcaggcggccgcggcccgcacggagatgctcggcaccagttaccgcgactacgagcgcaggatccgcgagcaactcgtcaggctgttcggtcgcgccggcttcgacccgcgccaggacatcgcgggcatcatcctgaaccgttggggccacgcgtacgtttgcccggcgccggggttctactacggacgtgacgggaanccngcggcaccnganntncttcgccngccnatcgggcgggtagcgttcgcgaactcggagctcaacggtcaccagaactggcgggatgcgaccgcggaggggaagcgcgcggtggagcaattgctcgcctgagctaggtggacaagagtgttgtcgcaaacgantacgtcaaagacctgacacggatgaaccacgatcaccacgatgacgcggatttgttccgaaaccatccgaccatcgcggcgccggaaatcagttcgttggttttctgacaacgcaaccgagtggctgccgggcgtctggaatcgtcagcgtcagcggagccnatccgtgccatcgtcgtgatcgtggttcatccgcgttaggtcttggcggttttgccaccgccggtttggctcggtcaggagatgtcgacagctggcgaggggcgcgatatggcagagtcgccattcgcgcgcgggggaaccaacgcgtatgatgtgagggttgcgtttcctgaaccgaggcctgccatgaaagcgtacctcattaccacagggacggttttcacgctcgtcaccgcagcgcatgtctggcgtgctatcgcggagtccaccgcgctggcgcgagatccctggttcatcctgctcaccgtgttcgcggccgcgctctccgtgtgggcgtggcggttgctgcgagtggcaacgcggtcctgagggtccgctcgccgaggtcgcgttatggagatactgctgatctcgctcggagtggtcggagcctacgtcctctcgagcttgcgcgtactcaaccagtacgagcgcggcgtcatgttcttcctggggaagtacacgggaacgaaagggcccgggctcatcttcgtgccgaccatcctgtcgcgcatgaagcgcgtgtcgatgcgcgtcgtcgcgatcgacatcccggcgcaggaagtcatcacgcgcgacaacatctcggtcaccgtgaacgcggtgctctacttccgcgtttccgaccccgggctcgccatcctggagatacaggactacctctacgccaccggccagctcgcgcagacgacgctgctctcggtgctcgggcaagtagagctggacgagctgctcgctgaccggcgcaaggtgaacgagctgctcaggcagatcatcgacgagcgcacggacttctggggtgtcgagatctccgccgtcgagatcaaggatgtgcagcttccggaaacgatgcggcgcgcgatagcgcggcaagcagaagccgagcgcgagcggcgcgcgaaggtgatcaacgcgcagggcgagttgcaggcgtccgagacgctggccgaagccgcgcgcgtgatgtcgactcagcccgcgtcgctgcagctgcgctatctgcagacggtcaccgagatcgcgaccgagaacaactcgaccacgatctttccggtgccgatcgacatgctgagcgcgttcttcaagcgggctcccgacgcgtcggcgcccgccgcggcgaacaccgagcgaaacaagccggccgttgcatccgagcccgcgccaccactgcttccgcccgcagacccggctgaggcactgccgcagatccgaatcgactcgtcccgacaacccgccgagtgatcgggcgcacgcgcctaacgtgcgctccgtcgcagccgctcggtgtcgaataacccggtgacgtgggggagcattaaacactcttaaaccaggcggccgtttgtcgccgaacgcgcgcgagtcaccgcgcggcgactccaattcgnttgctgtggatcatcngacaatcggaccgcgcgaaccagcgcggcccccaaccttacttcagcctccgccgcncgctgccggagcggagacccgtgtacgacctgttcggcccattcggttcacgccatcccgaaccgagccgatcccgcctccctcgcacgccgaacgcgcgtcggccgagcgagagccacaactgattgcgcgagtcgcggcgtggatcgcgatcgngatcgggtggacgatcttcgtctcctggtgggccatcgtccttcgccaggagactgcgcgctcgctcggcntcgcgtttggcttacttaccgcagcgctggccgtatgcgtggtcgcgatgctggnatggacgagctacaacattcggctcgcgaggaaggccacncgccgccnatcgaatcgcccggtcgtgatacgctgggagcgtgacacgctcggtcgccggctcgagctgccggcgggcgacgtcgcgtggacggcgccggaggtccgtgtcgtactgaaggatggcgtcaaggcgtacatcgccgtcgacccggaggagctgtgatgacgttcgatctctctncggccgtcgacgtttttcgcgccatctcggactcggtgccgtatcgcgctgcgctcgtcttctacggcgca

SEQ ID NO: 926 - DNA, 4000 bp, Escherichia coli
  misc_feature (30)..(30): n is a, c, g, or t
  misc_feature (261)..(261): n is a, c, g, or t
  misc_feature (508)..(508): n is a, c, g, or t
  misc_feature (589)..(589): n is a, c, g, or t
  misc_feature (592)..(592): n is a, c, g, or t
  misc_feature (717)..(717): n is a, c, g, or t
  misc_feature (1283)..(1283): n is a, c, g, or t
  misc_feature (1989)..(1989): n is a, c, g, or t
  misc_feature (2462)..(2463): n is a, c, g, or t
  misc_feature (2465)..(2465): n is a, c, g, or t
  misc_feature (2468)..(2468): n is a, c, g, or t
  misc_feature (2470)..(2470): n is a, c, g, or t
  misc_feature (2474)..(2474): n is a, c, g, or t
  misc_feature (2482)..(2484): n is a, c, g, or t
  misc_feature (2488)..(2488): n is a, c, g, or t
  misc_feature (2490)..(2490): n is a, c, g, or t
  misc_feature (2492)..(2493): n is a, c, g, or t
  misc_feature (2495)..(2499): n is a, c, g, or t
  misc_feature (2502)..(2503): n is a, c, g, or t
  misc_feature (2505)..(2505): n is a, c, g, or t
  misc_feature (2508)..(2510): n is a, c, g, or t
  misc_feature (2516)..(2516): n is a, c, g, or t
  misc_feature (2518)..(2519): n is a, c, g, or t
  misc_feature (2523)..(2524): n is a, c, g, or t
  misc_feature (2526)..(2527): n is a, c, g, or t
  misc_feature (2530)..(2530): n is a, c, g, or t
  misc_feature (2535)..(2535): n is a, c, g, or t
  misc_feature (2538)..(2538): n is a, c, g, or t
  misc_feature (2540)..(2540): n is a, c, g, or t
  misc_feature (2542)..(2547): n is a, c, g, or t
  misc_feature (2550)..(2551): n is a, c, g, or t
  misc_feature (2553)..(2553): n is a, c, g, or t
  misc_feature (2557)..(2558): n is a, c, g, or t
  misc_feature (2560)..(2560): n is a, c, g, or t
  misc_feature (2562)..(2562): n is a, c, g, or t
  misc_feature (2564)..(2565): n is a, c, g, or t
  misc_feature (2568)..(2569): n is a, c, g, or t
  misc_feature (2571)..(2571): n is a, c, g, or t
  misc_feature (2574)..(2575): n is a, c, g, or t
  misc_feature (2578)..(2578): n is a, c, g, or t
  misc_feature (2580)..(2581): n is a, c, g, or t
  misc_feature (2584)..(2584): n is a, c, g, or t
  misc_feature (2586)..(2586): n is a, c, g, or t
  misc_feature (2588)..(2588): n is a, c, g, or t
  misc_feature (2590)..(2590): n is a, c, g, or t
  misc_feature (2592)..(2593): n is a, c, g, or t
  misc_feature (2595)..(2598): n is a, c, g, or t
  misc_feature (2602)..(2602): n is a, c, g, or t
  misc_feature (2604)..(2606): n is a, c, g, or t
  misc_feature (2610)..(2610): n is a, c, g, or t
  misc_feature (2612)..(2614): n is a, c, g, or t
  misc_feature (2618)..(2618): n is a, c, g, or t
  misc_feature (2620)..(2621): n is a, c, g, or t
  misc_feature (2623)..(2623): n is a, c, g, or t
  misc_feature (2625)..(2626): n is a, c, g, or t
  misc_feature (2628)..(2628): n is a, c, g, or t
  misc_feature (2631)..(2632): n is a, c, g, or t
  misc_feature (2634)..(2635): n is a, c, g, or t
  misc_feature (2637)..(2637): n is a, c, g, or t
  misc_feature (2639)..(2639): n is a, c, g, or t
  misc_feature (2643)..(2644): n is a, c, g, or t
  misc_feature (2652)..(2652): n is a, c, g, or t
  misc_feature (2655)..(2657): n is a, c, g, or t
  misc_feature (2659)..(2662): n is a, c, g, or t
  misc_feature (2666)..(2666): n is a, c, g, or t
  misc_feature (2668)..(2668): n is a, c, g, or t
  misc_feature (2671)..(2672): n is a, c, g, or t
  misc_feature (2674)..(2674): n is a, c, g, or t
  misc_feature (2677)..(2677): n is a, c, g, or t
  misc_feature (2680)..(2680): n is a, c, g, or t
  misc_feature (2682)..(2682): n is a, c, g, or t
  misc_feature (2684)..(2684): n is a, c, g, or t
  misc_feature (2686)..(2688): n is a, c, g, or t
  misc_feature (2690)..(2691): n is a, c, g, or t
  misc_feature (2695)..(2695): n is a, c, g, or t
  misc_feature (2698)..(2698): n is a, c, g, or t
  misc_feature (2700)..(2703): n is a, c, g, or t
  misc_feature (2705)..(2705): n is a, c, g, or t
  misc_feature (2710)..(2710): n is a, c, g, or t
  misc_feature (2712)..(2712): n is a, c, g, or t
  misc_feature (2715)..(2717): n is a, c, g, or t
  misc_feature (2721)..(2721): n is a, c, g, or t
  misc_feature (2725)..(2730): n is a, c, g, or t
  misc_feature (2738)..(2739): n is a, c, g, or t
  misc_feature (2741)..(2741): n is a, c, g, or t
  misc_feature (2743)..(2744): n is a, c, g, or t
  misc_feature (2746)..(2746): n is a, c, g, or t
  misc_feature (2748)..(2748): n is a, c, g, or t
  misc_feature (2751)..(2753): n is a, c, g, or t
  misc_feature (2756)..(2756): n is a, c, g, or t
  misc_feature (2764)..(2766): n is a, c, g, or t
  misc_feature (2769)..(2770): n is a, c, g, or t
  misc_feature (2773)..(2775): n is a, c, g, or t
  misc_feature (2779)..(2780): n is a, c, g, or t
  misc_feature (2783)..(2785): n is a, c, g, or t
  misc_feature (2794)..(2794): n is a, c, g, or t
  misc_feature (2796)..(2797): n is a, c, g, or t
  misc_feature (2800)..(2800): n is a, c, g, or t
  misc_feature (2803)..(2804): n is a, c, g, or t
  misc_feature (2807)..(2808): n is a, c, g, or t
  misc_feature (2810)..(2813): n is a, c, g, or t
  misc_feature (2816)..(2818): n is a, c, g, or t
  misc_feature (2823)..(2825): n is a, c, g, or t
  misc_feature (2827)..(2827): n is a, c, g, or t
  misc_feature (2829)..(2829): n is a, c, g, or t
  misc_feature (2832)..(2833): n is a, c, g, or t
  misc_feature (2836)..(2836): n is a, c, g, or t
  misc_feature (2838)..(2839): n is a, c, g, or t
  misc_feature (2842)..(2842): n is a, c, g, or t
  misc_feature (2845)..(2848): n is a, c, g, or t
  misc_feature (2850)..(2851): n is a, c, g, or t
  misc_feature (2853)..(2853): n is a, c, g, or t
  misc_feature (2855)..(2859): n is a, c, g, or t
  misc_feature (2862)..(2862): n is a, c, g, or t
  misc_feature (2864)..(2866): n is a, c, g, or t
  misc_feature (2868)..(2874): n is a, c, g, or t
  misc_feature (2879)..(2880): n is a, c, g, or t
  misc_feature (2883)..(2883): n is a, c, g, or t
  misc_feature (2885)..(2885): n is a, c, g, or t
  misc_feature (2887)..(2887): n is a, c, g, or t
  misc_feature (2889)..(2891): n is a, c, g, or t
  misc_feature (2893)..(2893): n is a, c, g, or t
  misc_feature (2895)..(2899): n is a, c, g, or t
  misc_feature (2901)..(2901): n is a, c, g, or t
  misc_feature (2906)..(2906): n is a, c, g, or t
  misc_feature (2908)..(2908): n is a, c, g, or t
  misc_feature (2910)..(2910): n is a, c, g, or t
  misc_feature (2915)..(2917): n is a, c, g, or t
  misc_feature (2919)..(2919): n is a, c, g, or t
  misc_feature (2921)..(2921): n is a, c, g, or t
  misc_feature (2923)..(2928): n is a, c, g, or t
  misc_feature (2932)..(2936): n is a, c, g, or t
  misc_feature (2938)..(2939): n is a, c, g, or t
  misc_feature (2941)..(2941): n is a, c, g, or t
  misc_feature (2943)..(2944): n is a, c, g, or t
  misc_feature (2947)..(2947): n is a, c, g, or t
  misc_feature (2950)..(2955): n is a, c, g, or t
  misc_feature (2957)..(2958): n is a, c, g, or t
  misc_feature (2960)..(2964): n is a, c, g, or t
  misc_feature (2970)..(2970): n is a, c, g, or t
  misc_feature (2974)..(2974): n is a, c, g, or t
  misc_feature (2979)..(2979): n is a, c, g, or t
  misc_feature (2981)..(2982): n is a, c, g, or t
  misc_feature (2985)..(2986): n is a, c, g, or t
  misc_feature (2988)..(2988): n is a, c, g, or t
  misc_feature (2990)..(2993): n is a, c, g, or t
  misc_feature (2996)..(2996): n is a, c, g, or t
  misc_feature (3008)..(3009): n is a, c, g, or t
  misc_feature (3011)..(3011): n is a, c, g, or t
  misc_feature (3014)..(3014): n is a, c, g, or t
  misc_feature (3016)..(3017): n is a, c, g, or t
  misc_feature (3019)..(3019): n is a, c, g, or t
  misc_feature (3021)..(3022): n is a, c, g, or t
  misc_feature (3024)..(3025): n is a, c, g, or t
  misc_feature (3029)..(3029): n is a, c, g, or t
  misc_feature (3036)..(3037): n is a, c, g, or t
  misc_feature (3039)..(3039): n is a, c, g, or t
  misc_feature (3041)..(3041): n is a, c, g, or t
  misc_feature (3043)..(3046): n is a, c, g, or t
  misc_feature (3049)..(3049): n is a, c, g, or t
  misc_feature (3053)..(3053): n is a, c, g, or t
  misc_feature (3055)..(3059): n is a, c, g, or t
  misc_feature (3062)..(3062): n is a, c, g, or t
  misc_feature (3067)..(3068): n is a, c, g, or t
  misc_feature (3071)..(3071): n is a, c, g, or t
  misc_feature (3073)..(3077): n is a, c, g, or t
  misc_feature (3079)..(3079): n is a, c, g, or t
  misc_feature (3083)..(3083): n is a, c, g, or t
  misc_feature (3085)..(3089): n is a, c, g, or t
  misc_feature (3096)..(3096): n is a, c, g, or t
  misc_feature (3098)..(3099): n is a, c, g, or t
  misc_feature (3105)..(3106): n is a, c, g, or t
  misc_feature (3109)..(3109): n is a, c, g, or t
  misc_feature (3111)..(3111): n is a, c, g, or t
  misc_feature (3113)..(3116): n is a, c, g, or t
  misc_feature (3118)..(3119): n is a, c, g, or t
  misc_feature (3121)..(3122): n is a, c, g, or t
  misc_feature (3126)..(3126): n is a, c, g, or t
  misc_feature (3128)..(3129): n is a, c, g, or t
  misc_feature (3132)..(3132): n is a, c, g, or t
  misc_feature (3134)..(3134): n is a, c, g, or t
  misc_feature (3136)..(3137): n is a, c, g, or t
  misc_feature (3140)..(3142): n is a, c, g, or t
  misc_feature (3147)..(3154): n is a, c, g, or t
  misc_feature (3158)..(3159): n is a, c, g, or t
  misc_feature (3162)..(3163): n is a, c, g, or t
  misc_feature (3165)..(3165): n is a, c, g, or t
  misc_feature (3167)..(3168): n is a, c, g, or t
  misc_feature (3170)..(3171): n is a, c, g, or t
  misc_feature (3174)..(3174): n is a, c, g, or t
  misc_feature (3180)..(3183): n is a, c, g, or t
  misc_feature (3186)..(3187): n is a, c, g, or t
  misc_feature (3189)..(3189): n is a, c, g, or t
  misc_feature (3191)..(3192): n is a, c, g, or t
  misc_feature (3194)..(3194): n is a, c, g, or t
  misc_feature (3196)..(3201): n is a, c, g, or t
  misc_feature (3203)..(3203): n is a, c, g, or t
  misc_feature (3206)..(3206): n is a, c, g, or t
  misc_feature (3210)..(3210): n is a, c, g, or t
  misc_feature (3212)..(3212): n is a, c, g, or t
  misc_feature (3214)..(3215): n is a, c, g, or t
  misc_feature (3219)..(3221): n is a, c, g, or t
  misc_feature (3223)..(3224): n is a, c, g, or t
  misc_feature (3226)..(3227): n is a, c, g, or t
  misc_feature (3229)..(3229): n is a, c, g, or t
  misc_feature (3231)..(3232): n is a, c, g, or t
  misc_feature (3234)..(3236): n is a, c, g, or t
  misc_feature (3242)..(3242): n is a, c, g, or t
  misc_feature (3245)..(3245): n is a, c, g, or t
  misc_feature (3247)..(3247): n is a, c, g, or t
  misc_feature (3251)..(3252): n is a, c, g, or t
  misc_feature (3256)..(3258): n is a, c, g, or t
  misc_feature (3262)..(3262): n is a, c, g, or t
  misc_feature (3265)..(3266): n is a, c, g, or t
  misc_feature (3271)..(3271): n is a, c, g, or t
  misc_feature (3273)..(3274): n is a, c, g, or t
  misc_feature (3278)..(3280): n is a, c, g, or t
  misc_feature (3282)..(3282): n is a, c, g, or t
  misc_feature (3285)..(3285): n is a, c, g, or t
  misc_feature (3287)..(3287): n is a, c, g, or t
  misc_feature (3289)..(3291): n is a, c, g, or t
  misc_feature (3294)..(3295): n is a, c, g, or t
  misc_feature (3297)..(3299): n is a, c, g, or t
  misc_feature (3302)..(3302): n is a, c, g, or t
  misc_feature (3304)..(3305): n is a, c, g, or t
  misc_feature (3307)..(3308): n is a, c, g, or t
  misc_feature (3311)..(3312): n is a, c, g, or t
  misc_feature (3315)..(3317): n is a, c, g, or t
  misc_feature (3319)..(3319): n is a, c, g, or t
  misc_feature (3321)..(3328): n is a, c, g, or t
  misc_feature (3331)..(3334): n is a, c, g, or t
  misc_feature (3336)..(3336): n is a, c, g, or t
  misc_feature (3343)..(3343): n is a, c, g, or t
  misc_feature (3347)..(3347): n is a, c, g, or t
  misc_feature (3351)..(3353): n is a, c, g, or t
  misc_feature (3357)..(3357): n is a, c, g, or t
  misc_feature (3359)..(3359): n is a, c, g, or t
  misc_feature (3361)..(3362): n is a, c, g, or t
  misc_feature (3368)..(3369): n is a, c, g, or t
  misc_feature (3372)..(3373): n is a, c, g, or t
  misc_feature (3376)..(3377): n is a, c, g, or t
  misc_feature (3379)..(3379): n is a, c, g, or t
  misc_feature (3381)..(3381): n is a, c, g, or t
  misc_feature (3383)..(3384): n is a, c, g, or t
  misc_feature (3387)..(3387): n is a, c, g, or t
  misc_feature (3390)..(3391): n is a, c, g, or t
  misc_feature (3393)..(3393): n is a, c, g, or t
  misc_feature (3395)..(3396): n is a, c, g, or t
  misc_feature (3398)..(3398): n is a, c, g, or t
  misc_feature (3400)..(3400): n is a, c, g, or t
  misc_feature (3403)..(3404): n is a, c, g, or t
  misc_feature (3408)..(3408): n is a, c, g, or t
  misc_feature (3410)..(3410): n is a, c, g, or t
  misc_feature (3412)..(3413): n is a, c, g, or t
  misc_feature (3416)..(3416): n is a, c, g, or t
  misc_feature (3418)..(3418): n is a, c, g, or t
  misc_feature (3422)..(3422): n is a, c, g, or t
  misc_feature (3424)..(3424): n is a, c, g, or t
  misc_feature (3426)..(3427): n is a, c, g, or t
  misc_feature (3430)..(3434): n is a, c, g, or t
  misc_feature (3436)..(3437): n is a, c, g, or t
  misc_feature (3439)..(3442): n is a, c, g, or t
  misc_feature (3445)..(3445): n is a, c, g, or t
  misc_feature (3448)..(3452): n is a, c, g, or t
  misc_feature (3454)..(3455): n is a, c, g, or t
  misc_feature (3457)..(3458): n is a, c, g, or t
  misc_feature (3461)..(3461): n is a, c, g, or t
  misc_feature (3463)..(3464): n is a, c, g, or t
  misc_feature (3466)..(3467): n is a, c, g, or t
  misc_feature (3469)..(3470): n is a, c, g, or t
  misc_feature (3472)..(3472): n is a, c, g, or t
  misc_feature (3475)..(3476): n is a, c, g, or t
  misc_feature (3479)..(3481): n is a, c, g, or t
  misc_feature (3484)..(3485): n is a, c, g, or t
  misc_feature (3487)..(3488): n is a, c, g, or t
  misc_feature (3490)..(3491): n is a, c, g, or t
  misc_feature (3493)..(3494): n is a, c, g, or t
  misc_feature (3496)..(3497): n is a, c, g, or t
  misc_feature (3499)..(3500): n is a, c, g, or t
  misc_feature (3502)..(3503): n is a, c, g, or t
  misc_feature (3505)..(3508): n is a, c, g, or t
  misc_feature (3510)..(3512): n is a, c, g, or t
  misc_feature (3515)..(3515): n is a, c, g, or t
  misc_feature (3517)..(3517): n is a, c, g, or t
  misc_feature (3519)..(3521): n is a, c, g, or t
  misc_feature (3524)..(3527): n is a, c, g, or t
  misc_feature (3529)..(3530): n is a, c, g, or t
  misc_feature (3533)..(3536): n is a, c, g, or t
  misc_feature (3538)..(3544): n is a, c, g, or t
  misc_feature (3547)..(3548): n is a, c, g, or t
  misc_feature (3552)..(3555): n is a, c, g, or t
  misc_feature (3557)..(3558): n is a, c, g, or t
  misc_feature (3560)..(3567): n is a, c, g, or t
  misc_feature (3569)..(3572): n is a, c, g, or t
  misc_feature (3574)..(3583): n is a, c, g, or t
  misc_feature (3586)..(3587): n is a, c, g, or t
  misc_feature (3589)..(3591): n is a, c, g, or t
  misc_feature (3596)..(3599): n is a, c, g, or t
  misc_feature (3604)..(3605): n is a, c, g, or t
  misc_feature (3608)..(3608): n is a, c, g, or t
  misc_feature (3614)..(3618): n is a, c, g, or t
  misc_feature (3620)..(3620): n is a, c, g, or t
  misc_feature (3624)..(3626): n is a, c, g, or t
  misc_feature (3631)..(3633): n is a, c, g, or t
  misc_feature (3635)..(3638): n is a, c, g, or t
  misc_feature (3644)..(3649): n is a, c, g, or t
  misc_feature (3651)..(3656): n is a, c, g, or t
  misc_feature (3658)..(3660): n is a, c, g, or t
  misc_feature (3662)..(3666): n is a, c, g, or t
  misc_feature (3669)..(3672): n is a, c, g, or t
  misc_feature (3677)..(3682): n is a, c, g, or t
  misc_feature (3685)..(3686): n is a, c, g, or t
  misc_feature (3688)..(3688): n is a, c, g, or t
  misc_feature (3693)..(3695): n is a, c, g, or t
  misc_feature (3699)..(3701): n is a, c, g, or t
  misc_feature (3704)..(3707): n is a, c, g, or t
  misc_feature (3711)..(3713): n is a, c, g, or t
  misc_feature (3716)..(3716): n is a, c, g, or t
  misc_feature (3718)..(3719): n is a, c, g, or t
  misc_feature (3726)..(3730): n is a, c, g, or t
  misc_feature (3732)..(3732): n is a, c, g, or t
  misc_feature (3734)..(3736): n is a, c, g, or t
  misc_feature (3738)..(3738): n is a, c, g, or t
  misc_feature (3742)..(3746): n is a, c, g, or t
  misc_feature (3748)..(3750): n is a, c, g, or t
  misc_feature (3752)..(3765): n is a, c, g, or t
  misc_feature (3767)..(3780): n is a, c, g, or t
  misc_feature (3782)..(3782): n is a, c, g, or t
  misc_feature (3784)..(3785): n is a, c, g, or t
  misc_feature (3788)..(3790): n is a, c, g, or t
  misc_feature (3793)..(3801): n is a, c, g, or t
  misc_feature (3806)..(3807): n is a, c, g, or t
  misc_feature (3809)..(3809): n is a, c, g, or t
  misc_feature (3812)..(3813): n is a, c, g, or t
  misc_feature (3816)..(3817): n is a, c, g, or t
  misc_feature (3820)..(3820): n is a, c, g, or t
  misc_feature (3823)..(3825): n is a, c, g, or t
  misc_feature (3827)..(3827): n is a, c, g, or t
  misc_feature (3830)..(3830): n is a, c, g, or t
  misc_feature (3833)..(3837): n is a, c, g, or t
  misc_feature (3839)..(3846): n is a, c, g, or t
  misc_feature (3848)..(3851): n is a, c, g, or t
  misc_feature (3853)..(3857): n is a, c, g, or t
  misc_feature (3859)..(3865): n is a, c, g, or t
  misc_feature (3867)..(3867): n is a, c, g, or t
  misc_feature (3869)..(3871): n is a, c, g, or t
  misc_feature (3874)..(3881): n is a, c, g, or t
  misc_feature (3883)..(3884): n is a, c, g, or t
  misc_feature (3886)..(3892): n is a, c, g, or t
  misc_feature (3894)..(3896): n is a, c, g, or t
  misc_feature (3898)..(3900): n is a, c, g, or t
  misc_feature (3904)..(3904): n is a, c, g, or t
  misc_feature (3906)..(3909): n is a, c, g, or t
  misc_feature (3911)..(3912): n is a, c, g, or t
  misc_feature (3914)..(3914): n is a, c, g, or t
  misc_feature (3918)..(3920): n is a, c, g, or t
  misc_feature (3922)..(3922): n is a, c, g, or t
  misc_feature (3924)..(3925): n is a, c, g, or t
  misc_feature (3928)..(3929): n is a, c, g, or t
  misc_feature (3931)..(3932): n is a, c, g, or t
  misc_feature (3934)..(3935): n is a, c, g, or t
  misc_feature (3938)..(3941): n is a, c, g, or t
  misc_feature (3943)..(3943): n is a, c, g, or t
  misc_feature (3945)..(3945): n is a, c, g, or t
  misc_feature (3947)..(3953): n is a, c, g, or t
  misc_feature (3955)..(3957): n is a, c, g, or t
  misc_feature (3959)..(3959): n is a, c, g, or t
  misc_feature (3961)..(3961): n is a, c, g, or t
  misc_feature (3963)..(3964): n is a, c, g, or t
  misc_feature (3967)..(3967): n is a, c, g, or t
  misc_feature (3969)..(3969): n is a, c, g, or t
  misc_feature (3971)..(3974): n is a, c, g, or t
  misc_feature (3977)..(3979): n is a, c, g, or t
  misc_feature (3982)..(3982): n is a, c, g, or t
  misc_feature (3986)..(3986): n is a, c, g, or t
  misc_feature (3989)..(3989): n is a, c, g, or t
  misc_feature (3997)..(3997): n is a, c, g, or t
  misc_feature (3999)..(3999): n is a, c, g, or t
gtattttctttcatcgttgtattcttctanttttttctcagaatccctcttatctattattattatcgtgggatatcctgaaatttcatatttatctattctatccttgcaacttttcatattatattttttaaattctatattattactatactcgctactaagtttatcccatactttcgatttgctaaaatcttcacagtgtctacagccgtccatataataatactcgattctatattttttatcatcatctgaagngcttttaaaagtctccattattttatttttattatacgctaataaaataacaattgctaataataaaaagaatattattgaaatcataataaatatatcgcttttgaaaaaactgctttttacagccatattctaattgtataatcctctaaattattattagataataatatcgttattattggatatttcattatattcgcttttaattttatcggtttcttttatgatatcatattcatcattntcaaaatgtattataattgaattataaaaatacgtcatatttatatcaatattcgcattaatcttatcttcaatgtacctnttnataaaattgataaaatattttttttctattaaaaatatccttacatcaagagtattataatctattgtcatgtcatactcttttaacacatagttatcataattattatcctttagtatatttanatacttgtcttgactactatcgtcgcatacaattatagttctatatacaagatagtttgaatatagttcgtctaatttattaattatctcgctcttcattaatactttattaactattattgtttttgccttatgtatattataacttagatatattcgcgatattatattattatttaatcaatatataagattatttacaataataaaatataatggacgaacaaatcattaagattaatatagagaattttagatatatctataattccatagatataccgcaaaatattttggataaagcagttgatataaaaaatacgtattcgtgctttaattcttattatgaccctaaaatgatatgggctaaaaaaatatataataataaagataagtataataaacctaagaataaatcaagatttcatattataatacccgactttactaagaaatctgaacttaaaaggtgtttgataggtaatttaaataaacttagtattaaaaacaaagataatatatatgaaaaaataaaggaaatcatcagtcttaataataatatagangatgtatttatgataatatggaattatattaaaacaagtgataatgaaatatatattaatttattaagtctatttgataagggatacttagaaacaatgatagataatctttgggataattatataaataataaagaatgggaccctcccaaatatatatatgaaaacaatcttctaatattgaatgatgaatacgaaatgtattgtgaatatactaaatggaagcgtggaataaataatattaataagatatggattaaatataaacaagaacaccttataatattactaaataatattgctgattatatccttattatatataatacctctatctataaatatattatagatattttattagaacaattatataaaatattatctgttataaaatataaatctataattgataaaattaaaagtatcgatattcaaaacttagataattctacaaaattttttatttataatattattgaattataaaaaaattatttctatataatagtatagagtaagaaatagtacaatgaaagaaagcgaaaataacttatctttttatagtagtgccataatccaagcaatttttgctatattattattaataattctcagttatatttataaactcgagaatatggggtgcgaatgttcagaacatcccaacaaagattttatcaagaacttcactattatagctctnggttattttataataacatctataatatctcttaaaagtgtagctaaaagtatgggatatgtcgtagttcaattattatcaatcgctacattcgtattcttcttaatgtttgtagtatatatatattatgcgtttgattatgttagatatttaactaatgaaaaatgcaaatgttcggaagatttaagtcgcgatattatatctgtaggtactatgatatccctcttcctcttcttaactcttctattcactattataataatacctatattattaagtacgctaagcaatcttttatctaaaatagaggtatttgaagaagaagttgaagatacaatccgtaatcccatgaaatctctacgaaagacgccagaaagaatagtcaaatctgttaaagaagtcggtagttttgttaataaatctgctaaaaaaatatcaaatcttagaaaaaatagataaaaatagataataanntnttntnatanattatatnnntttntntnntnnnnnttnntnttnnntttttngnncttnngnnccnttttnatntntnnnnnnccnntntatnntntntnnttnntnttnnttntnngtnantnantnnannnntttntnnnttantnnnagtntnntntnntnatnntnngntntgannatttttanttnnntnnnntatntnttnntnttnttntntntnnntnnattntgntnnnntngtttnanttnnngtanattnnnnnntatttganngnanngnancgnnnttnaaagaacnnnatnnatnnntaannatnnnaaataatcncnnatnatnnttnntnnnnccnnnatttnnngncnttnntgntnnttnttnnnnannantnnnnnttncnnntnnnnnnnctgcnncantntnannntntnnnnntnattcngnantagannntnanannnnnncaannnnngnnantnnttnttnnnnnnanntnnnnnttgttnaatnaaacntnnacnnantnnnnganaaagaaatgaanngnctnanntngnntnncatnttctttnntntngnnnnatntttntnnnnnaantcttnnaanannnnntnatantnnnnnatatttncnnttactnnctntnannnncnntnnaatntnnttnanannggnnnatatnnnnnnnnaatnnatnnantnncnnaantaaaannnnttnncntnntntnnnnnnanctnacantncnntctnnntnntnntncnntnnnattctnttntnttcnnttcnnntctnttnnatatntnnattnnnantgnantnnnaanntnnnttnanncnnttnnatnnnantnnnnnnnnttnnnntnttatttntctntttnnntttntntnntttttnnttnnttnntnangnnttnaannantnntntnttnntaantntnnttntntttntntnnttnnnnncnncnnnntcnttnnnnncnncnnctncnncnncnncnccnnctnnntcnncnncnncnncnncnncnncnnnntnnnctncntnnnctnnnncnnctnnnncnnnnnnnccnncttnnnntnnannnnnnnntnnnntnnnnnnnnnnttnntnnnttttnnnnctttnnaancttttnnnnntntttnnnctttnnncnnnntttttnnnnnntnnnnnntnnntnnnnnttnnnnttttnnnnnnctnncnatttnnntttnnnttnnnntaannntancnnttttttnnnnntnannntntttnnnnncnnnannnnnnnnnnnnnnannnnnnnnnnnnnntnannttnnnttnnnnnnnnntttcnntnttnntannaantcnnnanttnttnnnnntnnnnnnnntnnnntnnnnngnnnnnnnanannnaannnnnnnntnntnnnnnnntnnntnnntaantnnnntnnantaannntntnnttnntnnannttnnnnantnannnnnnntnnnantntnnttngntnnnnaannnttnttanatntttattantnt

SEQ ID NO: 927 - DNA, 4000 bp, Escherichia coli
  misc_feature (1)..(1): n is a, c, g, or t
  misc_feature (3)..(4): n is a, c, g, or t
  misc_feature (6)..(6): n is a, c, g, or t
  misc_feature (10)..(10): n is a, c, g, or t
  misc_feature (13)..(14): n is a, c, g, or t
  misc_feature (16)..(20): n is a, c, g, or t
  misc_feature (22)..(29): n is a, c, g, or t
  misc_feature (31)..(33): n is a, c, g, or t
  misc_feature (36)..(37): n is a, c, g, or t
  misc_feature (40)..(40): n is a, c, g, or t
  misc_feature (42)..(42): n is a, c, g, or t
  misc_feature (44)..(44): n is a, c, g, or t
  misc_feature (48)..(48): n is a, c, g, or t
  misc_feature (359)..(359): n is a, c, g, or t
  misc_feature (541)..(541): n is a, c, g, or t
  misc_feature (548)..(548): n is a, c, g, or t
  misc_feature (965)..(965): n is a, c, g, or t
ncnntnaaantannannnnngnnnnnnnntnnnaannaantnantttnaaaaaattaattatttcttttgatcaatttcttttgaacgtttttcaacaagtttgacaatatgatctaccattttttcattttcaattttatgatcttgcttgcctgcccaatataccataccagaacctgctccaccacctgtgaaaccaacatcagtcataagtgcttcgcctggtccattaacaacacatccaataatcgataatgacataggagtttttatatgttccaatttcttttctaattcagatactgtttttatgacatcaaaaccttgcctggcacatgatggacatgaaataatattnacgccacgatggcgtaatccaagtgattttaaaatttcaaatccaactttaacttcttcaactgggtctgcagataaagaaacacgcaatgtatcacctattcccatccataaaagattacctaaaccgattgcagattttattgttccacttgtaaggcctccagcttcagtaattcctangtgtatnggcgcatctgttgcttccgctaaaccttgatatgctgcagctgacataaatacatcagatgcttttactgatatcttataattctgaaaatcgttttcctctaatatcctgatgtgatttaatccactttcaatcattgcatctggacaaggctcgccatatttatctaataactgcttttcaagggatcctccattaacaccaatgcgaatagaacagccatgatcttttgcagctttaataacctctttgatacgttcactcgatccaatattacctggatttattcttaggcatgctgcaccagcttcagcagcttcaattgcgcgtttataatgaaagtgtatgtcagcaattaatggaacttgactttcttttacaatttcatgcatcgcttttgttgaggcaatatcaggncaactcaccctaaccatatctgcaccagcatccgcacaagagtttatttgatttacagtggcgcgaacatcatgagtgagtgtgtttgtcattgtttgtactgatatgggagaatccccacctacaggaacatttccaacataaatttttctagattttctgcggtaaatattccgccacggccttatagaattcaaactcatgcaaatcttccagattgtgataaaacttacaatacaatttatagtaacaggatcaacagactattgttcaatagattgtactatgatctttgtatttatgggtggctcgagtggcaaagttagactattttcaacaattgtataattttctaatatctttttggcctgcaaatttaccttttttgcaacacctgtggcagttcctaatgggccatagaaatcattgcctatcattaaataaacaaaaccagaattacccgctcgtaaaaaagcagattgtgctgatttaggaacttcgtatctttggccagtatctaaaatattctcaaataatatatttccatttggttcataaatacgtatccaagcaggtttctgagcaacaacataaattgtaggaggttctgtcctagtaacttgtggagtttttttaaattcagcagtatctaaatctttatttttttcggttaaaggtttagtattctcaacataaacacctgatatagatgggtctatcgcagatattggtccgtctcttggcgtcataacaggcaatattaattctgtaggacgataaaattcttcaaggtcagaattacttacaatattaaaattattattatcgatatcttcaaagaaatttttatcatttatagaagtagaagaattagcctgaattgaaggtgattgattaataggagatagatttactttttgaacttcatttaaaactgtaatacccccatatcccaatcctaatatcaaaaataataatgctgttagtgaaaataaacctgaaaaagaaaagtgattaaataaaccactatttattttcttctttcttatttgaggatttagtattggttcatctaaaagtttagttggctttactactttatttctttttgttccatcaatctccgactgtaggccaataaagccactttctttacaaaattgatcaaagcattcttcaggatttaaattcagatgagttgcataagatcttacataccctgcaataaaacttggtgcaggaaatgcattaatatctgcattctctataccaagtaaaaattcaattcgaagccttgtttctttttgtacatcttcgagagttttacccaaagtagcacgttcaccacgcaatttatcacccagtgtaacagtatatgaatcataaccttttaactcaagcttatcagggtgaaagccaggtattattttaccaattttttttcgtgttaaagacaaattgattcgctattcatgtatatgaaatgttgaccaaacatacatataaattttacaatttgcactgctcaattaaaattctatttaagcggtgatttttagcctactcaattcacagtgtgaccacaattcatccattgcatttactagtatatctaccatttcttgagtatgaaccggtgaaggtgtaaacctaagtctttctgtaccacgtggaacagttggaaaatttattggttgcacataaattccataatcatttaacaaccggtcagaaatcattttacatttaactggatcaccaacgtgtattggcacgatatgactgccatgatcatcaaaaggtaaccctaagccacgaaatcgtagttttaattgttttgcaatatcttgatgtttttttctaatttctgtgttttcttttaagagacgcacagatttagtagcagccgcagcaagcgctggtggtaatgaagaagtaaaaataaaacccggggcataagatcttatagcatctacaaagcgaggacttgcagcaatatagccacctattacgccgtaagctttcgcaagtgtaccattaaatatatctattcgacttgatagatttaacatttcacaaacaccaccacctttagctccgtacataccaaccgcatgaacttcatcgatataagtcaaagcattaaactcatctgccaagtcacatatttcttcaattggagcaaaatcaccgtccattgagtataatgactcaaaagcaataatttttggcctacttggatcaatggtttcaagcaactgacgtaaatgtttcacatcgttgtggcgaaaaatttgtttttcacaatttccatgccttatgccttcaatcatagatgcatgatttagctcatctgataatattactaaatttggaaaaagttttggcaatgctgataaagtagcttcatttgcattgtaagctgacgtgaataacaatgctgcgtctttttgatgaagctcagctaattctttttcaagttctttgtgaaatactgtattaccagaaatatttctagtaccaccagatccaacccctgcactatcaatgctcttttttaaagctgatatgacttcagggctttgccccattccaagataatcattaccacaccaaactgttatttcagtttgtgttccgtcagtttggacccagtttgcttttggatattcaccatttatgcggctaatatcctgaaatactcgatatcttccttcagcgtgcaaagcatttaacgctttatctatttgatgatcatagttcattctgtagtccaatttaattataattttttcttaaactaattaccttgaaaaattaagtcccaaaacgccgcagttatataattttttaaatctgtacatatctttcataccaaatgtttcttaattatacaataagaattcaataaatggaatacgttttgatgaaatttatttatttttaaggaaataattagttattctattaattgcagataaaagttcaggaggaatttctgactttccactcacccagttatataaatcatgatc

SEQ ID NO: 928 - DNA, 4000 bp, Escherichia coli
  misc_feature (419)..(419): n is a, c, g, or t
  misc_feature (443)..(443): n is a, c, g, or t
  misc_feature (454)..(454): n is a, c, g, or t
  misc_feature (553)..(555): n is a, c, g, or t
  misc_feature (1985)..(1985): n is a, c, g, or t
  misc_feature (2833)..(2833): n is a, c, g, or t
  misc_feature (2838)..(2838): n is a, c, g, or t
  misc_feature (2846)..(2846): n is a, c, g, or t
  misc_feature (3091)..(3091): n is a, c, g, or t
  misc_feature (3292)..(3292): n is a, c, g, or t
  misc_feature (3807)..(3807): n is a, c, g, or t
  misc_feature (3812)..(3813): n is a, c, g, or t
  misc_feature (3822)..(3822): n is a, c, g, or t
  misc_feature (3829)..(3829): n is a, c, g, or t
  misc_feature (3831)..(3831): n is a, c, g, or t
  misc_feature (3834)..(3836): n is a, c, g, or t
  misc_feature (3842)..(3843): n is a, c, g, or t
  misc_feature (3845)..(3845): n is a, c, g, or t
  misc_feature (3848)..(3854): n is a, c, g, or t
  misc_feature (3856)..(3856): n is a, c, g, or t
  misc_feature (3858)..(3859): n is a, c, g, or t
  misc_feature (3863)..(3864): n is a, c, g, or t
  misc_feature (3867)..(3867): n is a, c, g, or t
  misc_feature (3869)..(3869): n is a, c, g, or t
  misc_feature (3871)..(3871): n is a, c, g, or t
  misc_feature (3873)..(3873): n is a, c, g, or t
  misc_feature (3877)..(3878): n is a, c, g, or t
  misc_feature (3880)..(3880): n is a, c, g, or t
  misc_feature (3882)..(3885): n is a, c, g, or t
  misc_feature (3887)..(3887): n is a, c, g, or t
  misc_feature (3889)..(3890): n is a, c, g, or t
  misc_feature (3892)..(3893): n is a, c, g, or t
  misc_feature (3895)..(3897): n is a, c, g, or t
  misc_feature (3899)..(3899): n is a, c, g, or t
  misc_feature (3902)..(3905): n is a, c, g, or t
  misc_feature (3907)..(3909): n is a, c, g, or t
  misc_feature (3911)..(3911): n is a, c, g, or t
  misc_feature (3913)..(3914): n is a, c, g, or t
  misc_feature (3916)..(3916): n is a, c, g, or t
  misc_feature (3919)..(3919): n is a, c, g, or t
  misc_feature (3921)..(3924): n is a, c, g, or t
  misc_feature (3926)..(3926): n is a, c, g, or t
  misc_feature (3928)..(3928): n is a, c, g, or t
  misc_feature (3932)..(3933): n is a, c, g, or t
  misc_feature (3935)..(3938): n is a, c, g, or t
  misc_feature (3940)..(3941): n is a, c, g, or t
  misc_feature (3946)..(3946): n is a, c, g, or t
  misc_feature (3966)..(3966): n is a, c, g, or t
  misc_feature (3975)..(3975): n is a, c, g, or t
  misc_feature (3981)..(3981): n is a, c, g, or t
  misc_feature (3993)..(3994): n is a, c, g, or t
  misc_feature (3996)..(3996): n is a, c, g, or t
  misc_feature (3999)..(3999): n is a, c, g, or t
tggtagacgaggcaatgaccatcaccgaccgtattttcacggtacaggacgcaagcggtgttcccgcttttcttgacccgtttatcgaagccgtagtaaaaacccctacaaagtaaccaccggcgccagcgtaataccccatgcggggcatgcgtggtgtcctcttcattaaccttcatgccctgcaagggtaaaggctgaggaagaatatcacggagcgttgtcagcttcacgggcaatgcaatactggctacggggcctccccgcctaggcttgttgctctctttctttctgagttttgatgatcttcaaccggagcttgatcgcgtcattcaggcttttgacaatacggtcattggaatccggaaaatgcagtttttggttgaactcatccagtgagtgggtttcaagcactttgncaaatgcttcatccacaaaaggcntggtcatctgnaccacaccctcaaaataaatcgaaagcttttcgtacttgtcccagttttcaagaatgaggcttttgatcgtgtccccggcaggctccccatcctccgannntcttcccgccggagtcgaggtgcccatgattttataaacatcgattttgaattcgtcttccatatttatcctgctctcttaaggaaaaacttttcctcaacggttaacaattttaacggacttcatttccaccctttcatcagggttgtccttggggtcacggggtacaccaacgatcttgtcgacaacatccattcccttaatcaccttgccgaaagcggtgtactgattgtccagaaaatacgaggctttgactacgacgaaaaactgcgaaccggcactgttgggctcctgtgaccgcgccatggatataattccccgatcatgaggtgtgtcattgaactcagcatcgatggagtagcctggcccacccgttccgtgcgtggagcggtcctcactcttggagttggtatctccgccttgaatcataaaaccgggaatcacccggtggaacgtggtgccatcgtaataacccttattggccaggtctttaaagtttttggtatgccccggtgctttatcttccaggaactcaaattcaatgtttcccattgtcgtttctattactgctatctcattactttgcacatcggtcatctatacacctatgaaaaatgggtaggaggccatcagcatcttcagaaaatggaagaaaccaccctcgtccctgttatcgtttttaagcggatgcgttatcaagaactataaaagaacaacatccgctgatttaataagactacatagcaaaacccgcccaaggaacaacttagcggtttacaattttaacagatttcatttctaccttgttattaggattatcccggcggtcacgcggaacattgacgattttatcaacaacatccattcccttaatcaccctgccgaaagcggtatactggttgtccagaaaatgtgaggctttaaccacgatgaaaaactgggaaccggcactgttagggtccgatgaccttgccatagacagaatccctcgatcatgaggtgtgtcattgaattccgctttgatcgtgtaacccggcccacccattccgtgcatggagcggtcctcactcttggagttggagtctccaccttgaatcataaaaccgggaatcacccgatggaatgtggtgccatcgtaataacccttcttggccaggtctttaaagtttttggtatgccccggtgctttatcttccaggaactcaaactcaatgtttccaagcgtcgtctcaatcacagcaatctcaccgccgaacgccgaggttccggtcatcagaacccccatcaggcacacggcaattcctttaacaaacaaattcatgaaacctccagataaaaaagggataatagtcagaactattaatttgtttcccggtctttctcaaaagcttgcgggataattggattcgatcaagatgaattttaagggntgtattctagcaggttgccgggaaagtctcaataattgtcatgacccttaaatccgcattcctcatttgcaattaccttttggctggactggccctggcctgcctggttttgagcgagatttattctcccctaacaggtctgatattcttcgctggcctaatcctctgcttttccttggaacagtcggaacgcattccattccagcccgcgacgcggattctaaactctaactggggtttcttactgctaccttttttatattttgcgttcgacctgcgcctgctggaattggtcaccgggtttctggtttaccttttgtttacccggttcgtctttaaaacagagttcaacgattatttattcggttacctcatagcaatcgtctgcctgctgattggggctattttcgaacaaggtctggcctttggaataatctttctcgctttcaacctggttttaagctggtgcctgattttttataccctgatgtcggaacagaccggaagtagtagcgccaatttcaaagcagcaggaaagaacgaaactccgggcactgccttgctaagttggacaacgggtttggtcattctcagtttcgccatgaccgctgtgatctttatttcttttccccggttcggcctgggtttcatctccctgaatacctcctcttctcctatcagcggattttccgataccgtcactttgggggatgtgggaaaaatcaagcagaacccggcagtggttatgcgtgtggaatacacacggggtggaaaaaactataagccggaatcccgaattttatggagaggggtggtgctggatcatttcaacggcaggacctggaccnccacnttggacanggaatttgaaacccctaaccggcccggaacaggactcagcctttttaaggtgtccaatccaaaagaggtggtacaacaaaatgtgtatatgggaccgttcgacgccccttatttgtttactcacggagtaccgctgtttatagatggcaatttcatccatgtgcagatggataaaaatttcgtgtttaaaaccggcgattcccgttcgggtcccagaaaatatacgttgatttcggaaatttcanatcccgatatcagctacagcctcgatatgcctcatagcgagcctttactgtttccgaacaggtttctccaacttcccagtgtcagtcccaaaatccatgacctggccgaccgcttgacccagggcgtccgctctgacagggatcgggcacaaaacattttgcaccacttcgcggatttcagctacacgctggaaatggagnacgatccgggcaaaaccgcgctggaacattttttatttgaaagaaaggccggccattgtgaatatttcgcttccgccatggtaattcttctccgatccgccggggttcccacccgcctcgtcaacggttttgtcggggttgagtggaacgaatggggaaactacctgatcatccgtcagagccatgcccattcctgggtcgaggcttttattccgggaaaaggctggacggtgtatgaccccactcctccggaccccgctctggttaccccaagcctactccacccactggcaaaatccctggacttcctcagaatgagctggcagagatacgtcgttcgctattccgtacacgaccaggtgcaggtcgtacaatttttccgggccggtggccgtgaccttgtgcaaaaactcaaaggcctgctggcagatctgaactggcaaaccctggttaaagggcagttcagcccggttattctggccctgatcctgatacccatattgctcctcgtcctnaaacnncgctatggngccttcncnccnnncccgcnncnttnnnnnnntntnnatcnnganangntnaganngntnnnnangnnannannngnaannnngnnntncnngnccncnnnngnanttcnncnnnncnncctgncttctgccaaacacgacccnatacgccgnatcacngaattttatgannancanc

SEQ ID NO: 929 - DNA, 4000 bp, Escherichia coli
  misc_feature (1945)..(1945): n is a, c, g, or t
  misc_feature (1947)..(1947): n is a, c, g, or t
  misc_feature (1955)..(1955): n is a, c, g, or t
  misc_feature (1959)..(1959): n is a, c, g, or t
  misc_feature (1967)..(1967): n is a, c, g, or t
  misc_feature (1983)..(1983): n is a, c, g, or t
  misc_feature (1988)..(1988): n is a, c, g, or t
aaagacatgggcggagacggttacggattggactggggtgaccattcaaaacagccgtcagataattgataacgccttgtccttattgaaagaaaaggaaggtgaatccacggtgtacgtatataataccttggctaccgaccggaatgaattggtggcggtggaagttcccgcctcatggagaaactcagattgggtggttcttgataagcgagggaagaaacagccggctcaatggctgacggaagacggcgtttcaaaactcttgtttcgtgcgcaagtcccctctgccggttatgcctcttatgcgatccggaaggcagaggataaacagtccggaaccttgaaggctgagagacagaaagacggtacgtttcgcatggaaagtgatttatacaccttggtgctaaacccctctaaaggaggtgtaatagaaagcttgaaagcgaaagccgtacgaggcaaggaattcgtggataaccggaatgaacgtgggttcaatgagcttcggggatattttatcgatgagggtggtttcctttccagtatggatcaaccggctgaggtgagcgtgttggagcaagggcccttattcgtgaaggtagctgtgaaaggcaagattggaaagtattcatttacccaaacgatccggttaacgcagggagagcctcgcatcgatatgagtgttaagctggattggataggaagccctcgtattggtgagccgggtatcgaattccgtgcggataatcctcgtaagtcattctatgacgaccgttacaaacttctggtatatctgcctatccagatcgccaaccaacagatttataaggatgctccgttcgatgtttgcgagagccggttggagaatacctttttcaatcgttgggatagcatcaagcataatatcatcttgaattgggtggatgtagcgagcaaggataactcttgcggtctgtcattattcacggatcatacgaccagctatgcgcatggtaaggatttcccattggccttgaacgtacaatacgccggtaaaggcttgtggggccgggattatatcatagaccgtccgaccgagatctcgtatgccttgatccctcatgccggaacttgggagaaaagccgtatttggacacaaagcgaacgacgcaatgagcctttggtcgcaaccttggacggcgatgctaccttgacatccggttcccttttccggatagagaataatgcctacgagttggtctccatggtctataaaggtaatgacctttacatccgcctattcaatgcccaaagcgatgcctcccctaaaacgataaccttccaaggacaagacgtgaaagcgagcttggtggaattggataaccgtctggttgaggacttaaccgtcaccgagaagaaaggcgccagttcaatgcgtctctctatccctcgttacgggataaggacattaaaagtaagctgtaagaatatctaatgtagagacggggcatgccccgtctctctttatccctaattaatccccgtttctcttgcctctttcggtggaaagatgttattttgcatcccgaattaaaagaataggcgttatgttgaaattcttcaagacatggacactccctatctccatgttagcgggtgcgatagggtattttgttttcgccaatgttacttttctggagcctacaaagccgttcatgtacactttaatagcgtatctgacgccctttttgatttttgcgcagttgctcttaaccttctgtaagatctctgtccgggaattgatgcccagcccttggcatggttggctattgcttatccaagcggtttccagtttggtgcttgccgccttattgctctggctgccaatgagagaggaataccgggatgtgttcgagggagcgatggtctgcctgatttgcccaaccgctacggcggccgccgngnttacgggnaaantagggggnagcgcctctagtctgnctacntataccttattatcgaatctattggcagcgattgtcgtgccgctggtcttcccattagtggaaccgcatgccgagattactttcttcgccgcattcttgaagatcttgggaaaagtctttccattgctgttattcccgtttttcctcgctttgttcttgcgtagattcataccacctatccatcgcttccttgcggggcttcgagacatggccttttacctctgggccgtcgctctagctatcgtgaccgggcagaccgtgaaatccttggtcaatagcgaggcggagatttatgtagaaatcctgatcgctttaggcggcttgataacctgtatcgcgcagttttattggggaaagcgcatcggcaagaaatacaatgaccgtattagcgctggacaagccttgggacaaaaaaataccgtgttagctatctggatgtcttacacctatttgaaccccttgtcttctgttggcccgggaagctatgtactgtggcaaaatatttttaacagttatcagctgtggaaaaagagaaataaagaattggaaaattaaatatcgatagctgatatataataatttgaccacagaatattttcgtcttcttttttgcgtattcactattttttctataaattgccactgtttatcagtgaggttggttgaatattgttccataacttaatgttttagtaaccactaggttttaaataatatatcggttaattaactgatattcaatatgatatataattatatagtaattgttttaattcatttttaaacagtttcttaatgtctgaaacgattgttgacttgaattttcttgaggctggagttcaatgtttcccaatgtatcactatgaggaacgtaaaattgagagtaaaactttgtttgatgatgccgaggacaccattcagaataattatattcgtcgtgatgccatctccgatttcatttcagaacgttgtcgcaaagcctacggtccacatgtgagtaaagaagatattttttactatgtttacggcattctgcacagcacggaatatcgcaccgcctttgccgccgaccttaaaaagatgttgccccgtattccattagtggatgaagcccttgatttttggagttttagcaaagcaggaagaaacttagcggaattgcatttgaactatgagaatcgtccttcggcaaccggagtcattgtgacctataataccattccgcagagcgaaatagaaaaagtaatgcaatcaggcgagatggagacaatcaattatcaagttgaaaagatgcgctttccctccaaaacggataaaagcaaaattatatacaacagccagataacgattgaaaatataccagccacagcttatgaatacatagtaaatggcaaaagtgctatcgaatggattatggagcgttatgccgtcatcactcacaaagatagcggcatcactaataatcctaatgactgggcaacggaacatgacaatccccgctatatattggatttgctcctcagcgttattttattaagtatagagatgatggagatagtgaatggattaccgaaattaaccttttaaatatggcaaaagaacgttcagcaatagcaacaatcaaaggatattattatcaatttgactattttatccttcagttactaaaatgcaataatgaaactgattccatttgtattgaaggcatcgaggatgttgatttaaaaacagttgatgaaagtactgctattcaatgcaaatattatgcaggaacagaatataatcattctgttatagctcaaccattgcgatatatgttagatcattatctatcaaaagctaataatggtataaaatataagatttatgggtattacaaatcaggtcaagataaacttatattacctattaatatagaattttttaaaagtaactttataagtctaaaagcatttaaaggtctttcgatagaagataaacaaataatatcatttttatcaaatttggagata

SEQ ID NO: 930 - DNA, 4000 bp, Escherichia coli
  misc_feature (93)..(93): n is a, c, g, or t
  misc_feature (109)..(109): n is a, c, g, or t
  misc_feature (128)..(128): n is a, c, g, or t
  misc_feature (134)..(134): n is a, c, g, or t
  misc_feature (218)..(218): n is a, c, g, or t
  misc_feature (231)..(231): n is a, c, g, or t
  misc_feature (301)..(301): n is a, c, g, or t
  misc_feature (409)..(409): n is a, c, g, or t
  misc_feature (655)..(655): n is a, c, g, or t
  misc_feature (1108)..(1108): n is a, c, g, or t
  misc_feature (1219)..(1219): n is a, c, g, or t
  misc_feature (1306)..(1306): n is a, c, g, or t
  misc_feature (1992)..(1992): n is a, c, g, or t
  misc_feature (2241)..(2241): n is a, c, g, or t
  misc_feature (3083)..(3083): n is a, c, g, or t
  misc_feature (3085)..(3086): n is a, c, g, or t
  misc_feature (3088)..(3089): n is a, c, g, or t
  misc_feature (3091)..(3091): n is a, c, g, or t
  misc_feature (3093)..(3093): n is a, c, g, or t
  misc_feature (3095)..(3099): n is a, c, g, or t
  misc_feature (3101)..(3102): n is a, c, g, or t
  misc_feature (3104)..(3104): n is a, c, g, or t
  misc_feature (3106)..(3106): n is a, c, g, or t
  misc_feature (3150)..(3150): n is a, c, g, or t
  misc_feature (3529)..(3529): n is a, c, g, or t
  misc_feature (3968)..(3968): n is a, c, g, or t
tcacaagctgcgatttttcgagtcgtaaacgctcggcgctttcccgaacgatcgcttccaccacgcgctcatcgccgatcgtctggccctgcnccgcgccgtcgcgcancagacatttagcgcctggngcaacnctgatgttcccttgtgtctccaccacggtcgcgagcacggcagccgcgccttgattgttgatttcgaccaattgttccgcaaanggagtcatttttngacagcggtttcctggtccgactctttccaccatggatcgataaacacgttcataatgccgccgcaaacngccgggctgtcggaagaaatgtcgtccaacagatcgacgcgaacggttcttggtttgcgagttcggatgacttcaatcgcttcgcgcttcacatccgcctcgccacanccaccgccaatggtgccgagaatttctccccaggcggtaaccaccatttttgcgccgacttcgcgcggcgtcgatcccttagttgaaacgatcgtggccacagccaaggtttcgcccttgtcgagaaattctttgacttgatgatagatagagtcctgctttttactttcagaatcgccatccgtgtaacaagcaccgggtccagccatattacttcctccgaatcgtagctaaatttctcgccgncgatcgacgattgtcagatccacgaggaaatttcctcgccatcttcaatcctcgattttccattctcgccgtctccgtcacgccaccattttctgcaacgtccggcctaaggacactagactattcacgttgtgcaccgaaagaaacaaatccagatacggcagcgccgcttgcatgcctttgcagagcggttcgtagttttcactcgccagtaaaggattcagccagatgacttttttgcagcgccgcttgaggtcttgcatctcgcgctcgagcacgctgacatcgccgcggtcccagccgtcgctgataatcaccactaccgtgcgatgcgtcaccatgctgggcgcgaaattgcggttaaacgtgtgcagcgaacggccgatattggtgccccccgaccagcccaggatgctcccggaaatcttctctaaagcgttcacgatatctttngtccgaatcaggtgcgtaatgcggctcagcgaggtgctgaagacaaacgtctcgacgccccatagttcattttgcagcccatacatgaactgaatcaaaaaccggctgtancaatccatcgagccgctcacatcgcaaagcagcacgaccttggtttttttaatgcgcttttttcgatgcaccaggtcgatgatttcnccgccatatttcatgctccggcgcatggtccagcgcggatcgacggtgtttcctttacgtccaagtttttttcgccggctgatctgagtcgcaattttggttgcgattagaaggatcgcgcgcgcgatggcgcggctctcttccacgcccatttcgctgaagtctttgcgattcatcagctcctgcggactgtaggttgggatggaaaattcctccaagttctccagcggcagattttccttggccagcgactccgcagaagcttcttcgagaccgccttcttcgtcaccgccttccggggcttgagattcgctcggggttccttcgatctgcattgtttccatcggcatgcgctcatagctgagctcgcgccaaaaacaatcgaacaacatgtcgaaggtcggaaaatcttctttctgcgagatcatattggcgcgcagcagcgtacgaaaatcagacttttccgcgagttcgacgtgttccaccgagcgcgatgcatccagcacctgactcaggctcaccttgacgcccaattcctttagcgcccgggcgaacgccataacattcggcaaggttcctttaccacgcgccgaggagacgctactaaccgccgcagcgaccgtttcgggagtcaactccatgcttatcagctcaccatttccggcgacaccttgagcagcgcgtcnaggtttagctgtcggttatcgacctgatcgcgcaaatggtgcaaatcctcgcgatacttgaacacacatcccatggtttccaccactgtcttatcgtccaagttcttgcggttgagcgcgatcaacgcggaggcccaatcgagagtttccgcgaccccgggccgcttataaaaattcatctcgcgcactttctgcatgaatgcgcaaatttgctgggccattttggtttccacctcgggaaacttcgtngtgatgatctcgtattctttttcaaaggtcggatattcgatccaatggtagagacagcgccgcttgagcgcgtcatgaatttcccgcgtgcgattggaggtcaaaaatacgaagggacgatgtcttgccgcgatcgtaccgagctccgggatggtgatctgaaagtcagacagcacctcgagcaaaaaggcctcgaactccatatcggcgcgatcgatctcatcgatcaggagcaccggagcgttcgcgccattggattgaatcgcctcgagcagcggacgtttgatcaaatagtcttggctgaagatttccgtttccactttttgcttgtcgccatgctccacttcttcgagcttgatgcgcagcatctgcttgggataattccactcataaagagccgtgttggcgtcgagcccttcgtagcactggagacgaatcagcttcgtgtccaaaactttcgccaaaactttcgcgatttcggttttaccgacaccggcttctccttcgagaagcagcggtttgcccatgaccaaagaaagatagacaacggtcgccaatgcgcgatcgcaaacgtatttttcttttaaaagaatctcctggacgctctcaatagtcagttgatttggattcacgcttgcctcaccccatgataattgcttgaacttcgggcccggaaacctgcttgaacgtcaaagccgcacacgtcgagttaacagcaaacccaatcacgatacgccctttgatacccgtgatcaacgtccgaccggcggcgatgaatggcgccgttgagcagccaattcatcataacaaaccgaggttgaataggaaaatcgacaagacgnannannancngnnnnncnntngnattggcggatcaccggttcgaaagtctcaatgctggtttctgangcggagcgctctaattactcgcgacgtatgcttgcttgaattgagcgaggtcggtaagggagttcttcaactgcgtcgccgatcgaacatccgcgaatcttccaactcgcacgcggtgccagatcttgccctgattttcaaaaagcatcacgtaggagtcgtagccggatttacgtaaaaactcagccatcgtttgggcgtccttggccgtggccaacgcagcgacttgcacggcccactcacgcgtcgatctaggagtcacgaacggcggaggagctggagccgccaaaggaggagttgctggccgtgacggcgcggttgggcgcgccggttcgaccgggcgggtcaacgatagtgcatatgccggctgtgcgggggnaacgttctcgggttctcgcgacgattctggaggcatgaacgttcccggcggttgcggcaaattaaaaggaaccggtgaggccgaattgatctggcgcaaaggtacaaccggtttctgcggtgctactggcacagcgctgggagcaggcgccggggcgggagccacatcgcctgacggcccgggtaaagccggtgcctggggctgctccaacggttgctgctggagcttttgtctttcccgggcgatccgatcgagctcattgcgcacggtggctagcgactttttaaaatcttctgtgacttgctgaccctgatcacgagtgtaaattacatggggagtgatcagcatgatcaactccgtccgagtgatatcgtcactgttcgtagcgaaaaaacgtccgatcaccggtatgtccataatatagggaatcccggtccgngaacgagcacggttatccgcgatgattccacc

SEQ ID NO: 931 - DNA, 4000 bp, Escherichia coli
  misc_feature (1)..(1): n is a, c, g, or t
  misc_feature (228)..(228): n is a, c, g, or t
  misc_feature (440)..(440): n is a, c, g, or t
  misc_feature (858)..(858): n is a, c, g, or t
  misc_feature (929)..(929): n is a, c, g, or t
  misc_feature (933)..(933): n is a, c, g, or t
  misc_feature (1350)..(1350): n is a, c, g, or t
  misc_feature (1374)..(1374): n is a, c, g, or t
  misc_feature (1376)..(1376): n is a, c, g, or t
  misc_feature (1379)..(1379): n is a, c, g, or t
  misc_feature (1767)..(1767): n is a, c, g, or t
  misc_feature (1985)..(1985): n is a, c, g, or t
  misc_feature (2045)..(2045): n is a, c, g, or t
  misc_feature (2055)..(2055): n is a, c, g, or t
  misc_feature (2076)..(2076): n is a, c, g, or t
  misc_feature (3691)..(3691): n is a, c, g, or t
nttatatttctatgagaaatttgaagcctctcgcaagagccgccttgccgcttcgaagacctacctttagctaaaatctaatcgcagcaagcactatggaggttctcttaagcccagaaggattattgtccttacttaccctgacttttttagaaattgttttaggaattgacaacattatcttcatttcattgatttcgaatgatttggaggccgctcagcaaccantagcacgccgactaggtttggggctcgcgctaggttttcgggtattaatgctccttggtattacgtggttgataggattgactgaaccaatattccatttaggagagcaccctgtatccggtagagatgcaatcctatttttaggtggtgtgtttttattggccaaatcctcctcagaaattgtgaaaaagacagaagggaagggtcatggngatcgcagcaagaaacacaaatccttgctaggtgtgatcattcaaataggcttgttggatattgtgtttagtttcgacagtgttttaaccgctataggaatgacgcacgaattggtcattatgattgtagctgtaattatttcaatggtaataatgctagtgtttgcgaggccgattgcagagtttattgagcgtcacatgagtctgcaaatccttgctttagcctttcttatcatgattggtacggtgctcattgctgagagcgcccacatagagattccgaagccctacatctattgttccgtaggatttgcgctcatggttcagctgttgagtattcgggctgctgagcgcaataaataattattgaaatcggccgaccagtctgaaatagtccttgagcacttcaatatttgcnttttcattgccttgagtaccataaagaagtaacgaatcctgaccttcgatgataaatgggcggtggtaatntagngcgttttgaaagagtaaggcggccaattggtagtgctgttcaaaatccattttatccaaatagatctttacttcaacagcgtccacacgaatggttaccgtatctctaaaaaactttcttgcgcttggttctgctacaatataggcttgatctgcccgccaattattgactatcgaaaaattcaaaaagggcattgtcgtgtcctttaagcattttaaagaacggtgcgtcttaaacccttgtgaggtaagttcagctctttcgtcggtacggtatttatagatacgtgtgttgttaaagaaaatttcgtcactttctaagacggaataatccgcaggtgcctgccaatcgataagtttgtgctcgtaaggccaaatgatgctaagcaatacgatgacgccaatgaaggcgagggcntaggtatagagtttcttttccacngnaangcaacaatatctgtcccggcttgtttacttattagctcaaagaaaataattcatgtctacatcttctagtactgttgcagtggttggtgcgggaatagctggtctcagtgccgcgattcgcttaagaattgctggaaaagaggttattgtatttgagcaaaactcctacacaggtggtaaggtgacggcttttgaaaaggagggttttcggttcgatatggggccatctttattcacgctaccacatttagtcgacgaattgttcgaattggccgggaaaaatccgcgtgaatattttaattaccacacgcatgatgaggtgtgccggtacttttgggaggatggaacaaagctcactttattcccttccattgagaaaaatgttgcngctgtgtcatcagtatttggaccttctgaagggggaaagttgttcgattattttgaaatggcgcgtagaaagtatgacttaacagcgccgttcttcttagaaaaaagtttgcatagtgcgcgtactttcttgacgccgaaagttttgaaggtgttagcggaaattccaaaacttggattgttttctaccttgaatgaagaaaatgaaaaggtgtttancgcgccgaaattggttcaattatttaatagatacgccacatacaacggatcatcaccctnccaaacgccngggatcatgcagatgatcacncatttagagcatagtctgggcacacattttccggtagggggtatgcacgaaatatcccaaagtctaacccgtttggcggtagaattgggtgttcgttttgaactggacacaagagtagaggagtttattatcgagaatcatgagattacggggttggttgctggtgaaaagatttggaccattgaccaattggtctgtaattctgatgtgaagtacgcttacaaacacctcatgccaaaacaggtgaaaaggcctaaaaagacccttgcgcaagaacctagttctagcgcgctcattttttattggggactttctgagcaattccctgagatggatttacataacatcattttcagtgaagattacagagaggaattcgagaatattcgaacgaacggcccattctgggaggacccgacggtctatatacatatctcaaaccgattagagcctggggatgctccagaaaataaagactgttggtttgtaatggtgaatacaccttacgatcaaggccaagattgggaggctatcgttccgttggtacgcgaaaaagttttggagcgtatctcaaaagcattggggactgctgtagaaccactgattgaagtcgaagaggtattgcgtccacaggatattgaaaaacgtacttcaagcgttggaggcgcgttatacggaaccagttcaaacgaaagaatggcggcatttttacgccattctaataaaagcaactccattaaagggttgtacttttgtggaggatcagcacaccctggtggtggcgtaccgctttgtttacttagtggaaaaattgctgctcaatggttggtaaatgatgagtaatattttgaaaatcaacgaaatcgttaaaaattacgctggatggattttagtgatctttcacgtcgtaggattatttttgctgggtggcgaatggcgtgatgaattagtatacctcaccccgtttaatttattgctgctcgcgggtttgtttcttttgaccaccgaacgtcctttggtaaaatgggcctattaccttcctatactcttgggatttttgatcgaattaattgggactaatacgggttttccatttggcgtatattcttacggttcggcattaggtccaggttttttaggcaccccaataatgatcggcgtattgtggtgggtgcttattcgttcattctatgatttaacagggttcaggtttaaccatgtatggataaggagtattcttaccggtttagccatgcttgcgatggatattttgatcgagcccgtggcgatagaattgaccttttggcaatgggaagcggttgcagtaccttttgagaactacctcgcgtggttcgttttgagtacactttttgcccgtttaactgcatcaggagatgcacgtaatcctttgagtatctgggttattgttgtgctttcggtattcttttttgttttaggctcgttgtacgcgatgcagtaaaaaaggaaacccccgccaaaggcgagggttaacgttcagaattaggccagggtacgagcctaccggtctttcagtttttttaactctagctccagcgcttctagtttctcttcaatggattcctccatttcttcnaggttctcttcgatagattcctcaaagtcatcagcatcgtaatattcaatagtcgcgcagtcggtgcaggataaaccctctggcgtcatttcccattggtgtcccaacatatcaccgtcgtacatatcttgaacgttgcgtatgtcgtacatgatgttttcaatgctctcatctaaatagaccgtcgcacctacaggtaaacgcagcgtgaccttcaaatcttgtcctctgtacaaagattctttaggcactgtgaagtattcgcttagtcgcaatgcttctccttcttgtgccgtagggtagtcaaag

SEQ ID NO: 932 - DNA, 4000 bp, Escherichia coli
  misc_feature (50)..(50): n is a, c, g, or t
  misc_feature (236)..(236): n is a, c, g, or t
  misc_feature (274)..(274): n is a, c, g, or t
  misc_feature (504)..(504): n is a, c, g, or t
  misc_feature (535)..(535): n is a, c, g, or t
  misc_feature (1990)..(1990): n is a, c, g, or t
  misc_feature (2059)..(2059): n is a, c, g, or t
  misc_feature (2374)..(2374): n is a, c, g, or t
  misc_feature (2467)..(2467): n is a, c, g, or t
  misc_feature (2509)..(2509): n is a, c, g, or t
  misc_feature (2983)..(2983): n is a, c, g, or t
  misc_feature (3056)..(3056): n is a, c, g, or t
  misc_feature (3058)..(3058): n is a, c, g, or t
  misc_feature (3076)..(3076): n is a, c, g, or t
  misc_feature (3100)..(3100): n is a, c, g, or t
  misc_feature (3160)..(3160): n is a, c, g, or t
  misc_feature (3199)..(3199): n is a, c, g, or t
  misc_feature (3214)..(3214): n is a, c, g, or t
  misc_feature (3235)..(3235): n is a, c, g, or t
  misc_feature (3238)..(3238): n is a, c, g, or t
  misc_feature (3244)..(3244): n is a, c, g, or t
  misc_feature (3261)..(3262): n is a, c, g, or t
  misc_feature (3265)..(3265): n is a, c, g, or t
  misc_feature (3289)..(3289): n is a, c, g, or t
  misc_feature (3299)..(3299): n is a, c, g, or t
  misc_feature (3301)..(3301): n is a, c, g, or t
  misc_feature (3304)..(3304): n is a, c, g, or t
  misc_feature (3316)..(3316): n is a, c, g, or t
  misc_feature (3322)..(3322): n is a, c, g, or t
  misc_feature (3340)..(3340): n is a, c, g, or t
  misc_feature (3346)..(3346): n is a, c, g, or t
  misc_feature (3352)..(3352): n is a, c, g, or t
  misc_feature (3371)..(3371): n is a, c, g, or t
  misc_feature (3376)..(3376): n is a, c, g, or t
  misc_feature (3379)..(3379): n is a, c, g, or t
  misc_feature (3383)..(3385): n is a, c, g, or t
  misc_feature (3387)..(3390): n is a, c, g, or t
  misc_feature (3394)..(3396): n is a, c, g, or t
  misc_feature (3398)..(3400): n is a, c, g, or t
  misc_feature (3403)..(3404): n is a, c, g, or t
  misc_feature (3406)..(3406): n is a, c, g, or t
  misc_feature (3408)..(3415): n is a, c, g, or t
  misc_feature (3417)..(3418): n is a, c, g, or t
  misc_feature (3421)..(3421): n is a, c, g, or t
  misc_feature (3424)..(3424): n is a, c, g, or t
  misc_feature (3426)..(3426): n is a, c, g, or t
  misc_feature (3428)..(3430): n is a, c, g, or t
  misc_feature (3432)..(3432): n is a, c, g, or t
  misc_feature (3434)..(3434): n is a, c, g, or t
  misc_feature (3436)..(3439): n is a, c, g, or t
  misc_feature (3441)..(3441): n is a, c, g, or t
  misc_feature (3443)..(3446): n is a, c, g, or t
  misc_feature (3448)..(3448): n is a, c, g, or t
  misc_feature (3450)..(3450): n is a, c, g, or t
  misc_feature (3453)..(3461): n is a, c, g, or t
  misc_feature (3463)..(3465): n is a, c, g, or t
  misc_feature (3467)..(3468): n is a, c, g, or t
  misc_feature (3470)..(3470): n is a, c, g, or t
  misc_feature (3472)..(3474): n is a, c, g, or t
  misc_feature (3476)..(3483): n is a, c, g, or t
  misc_feature (3486)..(3489): n is a, c, g, or t
  misc_feature (3491)..(3501): n is a, c, g, or t
  misc_feature (3505)..(3505): n is a, c, g, or t
  misc_feature (3507)..(3510): n is a, c, g, or t
  misc_feature (3512)..(3512): n is a, c, g, or t
  misc_feature (3515)..(3519): n is a, c, g, or t
  misc_feature (3521)..(3522): n is a, c, g, or t
  misc_feature (3524)..(3524): n is a, c, g, or t
  misc_feature (3526)..(3526): n is a, c, g, or t
  misc_feature (3528)..(3531): n is a, c, g, or t
  misc_feature (3533)..(3535): n is a, c, g, or t
  misc_feature (3537)..(3537): n is a, c, g, or t
  misc_feature (3539)..(3542): n is a, c, g, or t
  misc_feature (3544)..(3544): n is a, c, g, or t
  misc_feature (3547)..(3552): n is a, c, g, or t
  misc_feature (3554)..(3554): n is a, c, g, or t
  misc_feature (3556)..(3556): n is a, c, g, or t
  misc_feature (3560)..(3563): n is a, c, g, or t
  misc_feature (3565)..(3565): n is a, c, g, or t
  misc_feature (3567)..(3568): n is a, c, g, or t
  misc_feature (3570)..(3570): n is a, c, g, or t
  misc_feature (3572)..(3574): n is a, c, g, or t
  misc_feature (3576)..(3576): n is a, c, g, or t
  misc_feature (3579)..(3583): n is a, c, g, or t
  misc_feature (3585)..(3585): n is a, c, g, or t
  misc_feature (3587)..(3589): n is a, c, g, or t
  misc_feature (3592)..(3593): n is a, c, g, or t
  misc_feature (3595)..(3596): n is a, c, g, or t
  misc_feature (3598)..(3600): n is a, c, g, or t
  misc_feature (3603)..(3604): n is a, c, g, or t
  misc_feature (3606)..(3609): n is a, c, g, or t
  misc_feature (3611)..(3613): n is a, c, g, or t
  misc_feature (3615)..(3617): n is a, c, g, or t
  misc_feature (3619)..(3620): n is a, c, g, or t
  misc_feature (3622)..(3627): n is a, c, g, or t
  misc_feature (3630)..(3635): n is a, c, g, or t
  misc_feature (3637)..(3637): n is a, c, g, or t
  misc_feature (3639)..(3641): n is a, c, g, or t
  misc_feature (3643)..(3643): n is a, c, g, or t
  misc_feature (3648)..(3651): n is a, c, g, or t
  misc_feature (3653)..(3657): n is a, c, g, or t
  misc_feature (3659)..(3659): n is a, c, g, or t
  misc_feature (3662)..(3662): n is a, c, g, or t
  misc_feature (3665)..(3666): n is a, c, g, or t
  misc_feature (3669)..(3670): n is a, c, g, or t
  misc_feature (3672)..(3674): n is a, c, g, or t
  misc_feature (3676)..(3676): n is a, c, g, or t
  misc_feature (3678)..(3680): n is a, c, g, or t
  misc_feature (3683)..(3683): n is a, c, g, or t
  misc_feature (3687)..(3688): n is a, c, g, or t
  misc_feature (3692)..(3692): n is a, c, g, or t
  misc_feature (3695)..(3695): n is a, c, g, or t
  misc_feature (3697)..(3697): n is a, c, g, or t
  misc_feature (3710)..(3710): n is a, c, g, or t
  misc_feature (3738)..(3738): n is a, c, g, or t
  misc_feature (3742)..(3742): n is a, c, g, or t
  misc_feature (3759)..(3759): n is a, c, g, or t
  misc_feature (3761)..(3762): n is a, c, g, or t
  misc_feature (3764)..(3764): n is a, c, g, or t
  misc_feature (3769)..(3769): n is a, c, g, or t
  misc_feature (3771)..(3771): n is a, c, g, or t
  misc_feature (3801)..(3801): n is a, c, g, or t
  misc_feature (3804)..(3804): n is a, c, g, or t
  misc_feature (3825)..(3825): n is a, c, g, or t
  misc_feature (3837)..(3837): n is a, c, g, or t
  misc_feature (3870)..(3870): n is a, c, g, or t
  misc_feature (3876)..(3876): n is a, c, g, or t
  misc_feature (3881)..(3882): n is a, c, g, or t
  misc_feature (3895)..(3895): n is a, c, g, or t
  misc_feature (3901)..(3901): n is a, c, g, or t
  misc_feature (3919)..(3919): n is a, c, g, or t
  misc_feature (3939)..(3939): n is a, c, g, or t
  misc_feature (3941)..(3941): n is a, c, g, or t
  misc_feature (3944)..(3945): n is a, c, g, or t
  misc_feature (3947)..(3947): n is a, c, g, or t
  misc_feature (3950)..(3951): n is a, c, g, or t
  misc_feature (3953)..(3953): n is a, c, g, or t
  misc_feature (3956)..(3956): n is a, c, g, or t
  misc_feature (3959)..(3959): n is a, c, g, or t
  misc_feature (3964)..(3965): n is a, c, g, or t
  misc_feature (3972)..(3972): n is a, c, g, or t
  misc_feature (3976)..(3976): n is a, c, g, or t
  misc_feature (3978)..(3978): n is a, c, g, or t
  misc_feature (3982)..(3982): n is a, c, g, or t
  misc_feature (3987)..(3987): n is a, c, g, or t
  misc_feature (3992)..(3992): n is a, c, g, or t
  misc_feature (3994)..(3994): n is a, c, g, or t
  misc_feature (3999)..(3999): n is a, c, g, or t
tttgtggggctacctagttctacaaggtaacatcggtattatctggcctntattcggcgtatctaaccaattactaggtaccatgacattggctgtaggtactacagttatcatgcgacttggccgcaaacgttatgcatgggtaacaggtattccttgtatcctcatggctatcgttgctatcgctgccgactttgaaaacgtatttaacagctatgtcccagctggtaaatggnttctagtggcattcagtgctgctatgttcctcatgatncttatcgtattagtagaagctgtacgcagctggattcgcttgtccaatattcctcaagactatcgcactcaagaagaaattgaagctgaaagccttgtaaaatacggtaaacaagtaaaagcataatatttgtttttataacgcataaagtgcactcacctttgtgagtgcacttttagtttataaatttgctgctttttttataaaatagtaaaatatacatataaatntatgtgatattcatttatggttatttgtatntgtgtaatagagaaagtattggagcgtattatgaatattagaatggctataatggcagcaattattggttctactacagtttttactgtacatggtgcagatgtatcgattccaggggcaaaccctaaaatgcctgcagtggtgtatgctgataatatcgtagatcaggctaaggtagagaagacagtaaaacaactcgaatctgcgttagataaaaagtttgcctcagagctatctgtagatgacaaaaatagagtaaaaagaaatatcttaaataaaggtgctctagattataaagcacataattataactcctccatttatgtattatctggagaaaatcgttccattcagtttagcttgcctaccacatctaataggagtttggtggcgaatagaggtgaaggatttacaaaatatgctatgtctaatctaggtatgattggtattgaggttgagccagtaaagaatacaggcatttgggctgaatctggtaaaagttatgatgaacttaccgtagaggatatgaaggctgctttctcaaaacacaatccaggttctagtaatgcttttattgatggtggaaagtttacgtatccaggtattgaaaatggtacgtgggatgtagcaacttcacagggtcgtgctggaaaaaatacaattagtacgattaattttacacttaaaaataagccaaattatatgtaccatattggtattgtgaattctgataaaaatgctaactataagcgtgatttaggcttattagcaaattatacaataccttcaattatggaaaagcctatgattactatacctactacagtagaaactcttggtgattttacatatcataaaattaatggtacagttctaaaacaagatatggttaaagacagtggctctattcgtgtgtacgaaacagagggtttagcacatctgttattggttgaccccattaaaaagggcatctctagaaatgaggttttatcaatggcattagtaaatcatgtctttcctaaacaggatgaaaaagttggaaaagtaaatgtttatactgtatggcataacaatacaccaggtatactattggatgttcagtatccttctcgaaaggctatggaaatatcttatattacacgaaatgacaagaatttatttattcaaactattattgctaatcagcataagaaagatattagtcgagacgatataattaacttgcttattgatgtgaaaatgaatggtgaaacattagactctaccagcgtgatttctcctttgccagaatatgatttctaataatattaaaacaaatatattaataaaaacacgaggtaatcgtctcgtgttttcttttttgtaatgctttatagcactattattaacaggtgctaggtaaaacttacatcctcaacatgatataatagttctatgaaacattacgtgcgttcntattggacaaaatataaacaattgtataagaaaggcttaaaaggcattgctgcttttcttgccattggngcgattatagtctttgtgctcgctacgatagcaagccgtgggatgggcgttatttttaacgaggtaatggctcgtcaaacgatgatgagagggactgtaacggtagagagtttaactgcaacaccgtgggggacattatcctttactgacttggtatggaaggatccagaaggccgagagttgctcacagttccagatggaaagattcgcgttaatatgtgggacgtaataacacgaaattttaaggcctctgctataaacggaatcgagctaaatgatgcgaccattgtagtcgatttagacgataacaaccgncttgactttgtgcctgcttcacctgatgtaaacaagccactcaatgaggtagagccgcgacctaaacctccgaaaaagacgactcaagagcgncaggaggaactgggcaagaaggttcgtaactttaattggganggtcaacatttaaatcttacgattacattgagaaataaccagctggaaatctttcagaaaaatcgtcactatgtaatgaggaacgtgaattctaagatacatcttgatagtaaccgtgctattcgtattgatatggaaacgggtaagttcggtggcacagccattggtgatggtcttacactaaaaggtcgtgttgatctaaaggatgtattaaagcatcgcatgcctcagttagacttgcagtttgatgtaaagggtgtggacccatcatcactcggttttggcgataatatccacgatgcaatgaccttgctgacaaaggtaacaggtgattttaatcgtccattggctaaaggtcgtgtaacgatgcctgttttacgaattcctgcgcttacctttgaaaatgtagtaggcgatgtaacgtaccaagacggcattttgaactttgaaaatgtaaatgccaatgtatacggnggaaagctagaggcaaagggcatatataacttagatactcgggcttatacgattacagggatagcaaaggatntngatagtagtgaggctctnaaaacacctgaatttgttgtaccngtgtcggctaatttgaactttaaaagcgagggccagcctcgtgacatggaggtatggggnaatttctggtctggagaaggccactatatgctcattccnattaaaaatattacngggaactttcacaataaaggncgncatttntcctttagtgatgtganngtnaatacgaatattacgaccatttcnacagatgcgntncgnatcgataatggncagctnaccatggggccactcaanattacntcccangggggcagtaattttatcntctangangaannntnnnntgannngnnngannanannnnnnnnannatnaangngnnnangnannnngntnnnnanantannnnnnnnncnnngnnancnnnannnnnnnntannnncnnnnnnnnnnntgangnnnnanaannnnntnntnangnnnngnnncnannnntngannnnnnanangatnnnntngnnancnnnanaannnnntnannnatnnannannnatnntnnnnannntnnntnntnnnnnnttnnnnnngntnnntnataannnncnnnnntnatnatnnttnntnnnanannnttntgtnntttngangntttttatgaaagnatcaaaacaattctctatcgttttggcngcanctgtacttgcttttggngnngntacantngcaccacaacaagcagacgcttcttatggntanaaatatactgattcccaacgnccaccagtatcnactccaacaggttatgttaatccagccatgggntctacngtaanngttacagatcctncacctnctacaaataaattgactnctcctaaagctagtactacnantgnnancannantgngantaatnntgcaccnaaanantctnattanaatgntnttgcng

SEQ ID NO: 933 - DNA, 4000 bp, Escherichia coli
  misc_feature (1412)..(1412): n is a, c, g, or t
  misc_feature (1459)..(1459): n is a, c, g, or t
  misc_feature (2227)..(2227): n is a, c, g, or t
  misc_feature (2408)..(2408): n is a, c, g, or t
  misc_feature (2424)..(2424): n is a, c, g, or t
  misc_feature (2451)..(2451): n is a, c, g, or t
  misc_feature (2540)..(2540): n is a, c, g, or t
  misc_feature (2645)..(2645): n is a, c, g, or t
  misc_feature (2717)..(2717): n is a, c, g, or t
  misc_feature (3224)..(3224): n is a, c, g, or t
  misc_feature (3447)..(3447): n is a, c, g, or t
  misc_feature (3470)..(3470): n is a, c, g, or t
  misc_feature (3524)..(3524): n is a, c, g, or t
ggtgactccggttttatcaaaggaacagcttggcgcatcatgtttgatcccattaaagctctatttgcatcatcgttttctaaaaaagggatcagtgacgcagctaccgagacaagttgttttggagacacatccacatattcaattacgtctggcttagcaagaataaaattaggtgattttctacatgacaaaagttcttctacaaaattcccattttcgtttataggtgaattagcttgagctatagtatacttttcttcttctacggcagacaaatattctattttatctgtaactttcccatctactacttttctataagggctttcaataaatccgtatttattgattctagagtatgtcgctaaactgtttattaatccaatattaggaccttctggcgtttctataggacatatacgtccataatgagtcggatgaacatctctaacttcaaatccagctctttctcttgtaaggcctccggggcctagtgcagaaactcttcgcttgtgtgttatttcagatagtggatttgtctgatccataaattgagataattgtgatgttgcaaaaaaatctttcatagctgcagatattggtctaggatttattaaatcttgaggcatggcagattctacctctaacagagttgacattttttcttttatgactctttccatccttagaatgccaattctaaactgattttctactaattcacctaccgatcttactctacgatttcctaaatgatctatatcatctacttcacctttgccgtctcttaaatcaagcatatgtttaatgattgctacaatgtcctcgtttcgtagaattgttattgtatcactacattgaaggtgtagtttgctatttattttaactctaccaacatccgaaagatcatagcgctccgaagtaaaaaacaacttattaaagatttcgttagcaacttcaaaagatggcggttctcccggtctcaaaactttgtaaatatcattgattgcttcttctttagaattatttttttcaatatttaaagtatcaagtaagtatgaccctttatttatgggatctacatcagctattgtaagtgtattaatatttagttctaatatattatctaaattttcttttgaaatcgatgagccagtttttaaaaaaatttcatcagttaatggatttgacaaattattttttatatatttgtctaaaaaataatcagacgaaaccaaaatatttttcaaaccttcatcataaatttttttagctataacaaaattaattttagatcctatttttaatactttctttccattggtagaatttataagatcgtttcttaatttaatcggacgtttataatcatctggattaaattttgttttccatttttttgttttttnatcaaaattaaaagttttgaaatcataaaataaatctaatatttctntctttttatagcctaaggcatagagtaaagttgtgactggtagttttctttttctatctattctaaaatatagtatatccttaacatcgtactcaaagtctagccaagaccctctatttggtatcactctacaattaaatagcaatttaccgctggcatgtgtttttcctttatcatgatcaaaaaatactccaggacttctatgcatttgatttacaacaactctttcaataccattaattacaaaagttccgctaggagtcattaatggtatatctcccatgtaaacttcctgttcttttgctgaaagaacttgttttgtattattttcttgatctatatcgtatataactaaacgcaaggttggttttaaagctgaggaataggttaaatctctttgtcgacattcttcaacagaaaattttgatttttctaaacgaaaagacaaatattccaaagtcgctttatcagacaattcttcaataggaaaaatgctattgaaaactttaactaaacccttttgtaaactagattcagaatttttttttgaagataaaaattgattatatgattttttttgaacctctattaaattaggaatagataagatttcttttaatttcccaaaattttttctgatacttttttttccagtaaaagataattgcatgcacaacatttacatcctgcgatgtaaattaaaaatttaaatttaaaaaaattactttaattctactttagctccagcaacctctagctttttctttncttcttcagcatctttctttgctacgccagattttatttcttttggtgctgcctcaactaaatcttttgcttcttttaagcctaatcctgtaaacgctctaacttctttaataacgttaatttttttatctccaaatgctgtaagaaatactgtaaattctgatttttcttctgctggtgntgctgccacgggagcngctgctactggtgctgcagctgtaacnccccatttgtcttctaattgttttgataattccgcagcttctactactgtaagttttgataattggtctacaattttatttaattctgncatggatatcctgatttaagtttttctactctttgcgagcgccaaaatagcaatttttgcgccaggtgcaagtaaaatacttattattttttgtgcaggtgttgntaaaatacctacaattttggctctagcttcatccaaagttggtagtgtggcaattttttccacatcttccanagtaagaggctcttcctgcatgattccaccaataatttttaaatttgaattacttttagcaaacttagttaaaatttttgcagaagttattgcatcatccgaaaatgcaacggctgtaggcccggaaaacaaattttctaattttttaaatttgctcccctctaaagctaattttgtaattctatttttggtaattttaaaaagaattccatgttttctcatttcctctcttaatttatcaatttgatttactgtaagaccttgataatgagttacaaaaacagagcttgtttttttaaagaaacttttcatttcttctatataagtcttttttttatctttgttcatcatgacggttatttgcttaattttaatttataagaaattcccatagtagatgttaaaaaagcagataaaataaaatcgcctttaataccgcttggtttttcttttaatatagtttctaaaatagaattatagttttctttaatttttatatcagaaaancttttctttccaattgaagcaccaacattaccatctttatcatttttaatttctatttgaccagactttatagctttgacgatagattttatattattagttacagttccgagttttggattaggcattaagccctttggtcctaaaatttttcccaattttcccatcttaggcatcattgctggtgttacgacaagtttatcaaagtttatttttccattantaatatcattaactaaactatcngcacctgacaagtcagcaccagcatctttagcctcctggactttactatcctcncagaggactgctaacttaattttttttgcattaccattaggtaaattaactaaagttcttaaggaaaattcttcctttttttgttttaagtttaaattaaaagaaacatcaatagattcatcaaattttgttgtgcagttttttttaaccattttaatagcttcttcaattgtttcaatttttttatctttcgaaacttctaataattttttaaatctttttgatgcttttaatttcattaatcctttacctcgatgcccatggatttagctgatccacaaataatttttgtagcttcttttaaatcaaaagcattcaaatctttcattttttcctgagctattttttctgcctgtttcgtagtaattgaaccaactataactcttccgggttcttttgatccgccctttagcttcgcggcctcctttataaaatacgaagcaggaggagatttaataacaaaatcaaatttttta

SEQ ID NO: 934 - DNA, 4000 bp, Escherichia coli
  misc_feature (11)..(11): n is a, c, g, or t
  misc_feature (47)..(47): n is a, c, g, or t
  misc_feature (394)..(394): n is a, c, g, or t
  misc_feature (550)..(550): n is a, c, g, or t
  misc_feature (820)..(820): n is a, c, g, or t
  misc_feature (1150)..(1150): n is a, c, g, or t
  misc_feature (1352)..(1352): n is a, c, g, or t
  misc_feature (1694)..(1694): n is a, c, g, or t
  misc_feature (2641)..(2641): n is a, c, g, or t
  misc_feature (2700)..(2700): n is a, c, g, or t
gcgatttaganacagctgtcgaccagttgcttgaggatatagccganggaaagaagtatatgaaggtgtatcgtcaaatgaaaatgtataatgatgcagatacaaaccctgtgttatataagaaataaaagacgataaactaaatataaactgctcattagaaaaggccgttggaaagaagaaatgaagccttcggcccagtgttttcatgaaacatcttctccttatccgcttttctgcccttggtgatgtagccatgttggtgcctgttgtggcctcgttgatgaaacaatatcctgatattcatgtgacggtgttaagcaaaccctttgcccgttcgctgtttgaaggactctctcctaacgtgagttttatgagtgccgaccttaaaaangactatcaaggactatcaggtttgaatgcactctatcgcagattggctgccaaaaactttactgcggtggccgatatgcatgatgtgctcagaacaaaatacctgcgtttacgattccatttgtgtggatttcatgtcgcacatattgataaacancgcaaaggaaagcagttattgtgtagtgaaaagaataaggtgaaggtgcaacaacccacttcttttgagaattatgcagccgttttagcgaagttaggctatcccgtgagccttgaatttcactctatttttggtgagaaaggggggaatctgcgtcagcttatgcccctcatcggtgagaaaaagaagtttcagcgttggataggaatagccccctttgcagctcataaggggaagatttatccgttagagaagatggaacaaaccatngaacaactgataaaggcctatccctcatgccgcattttcttctttggaggcggtggaaaggagcgcgaaacactcgactcatgggccaaacgctatgccaattgcacgaatgcttcggcagttctcggtggaatgcgcaacgaattgatactcatgagccatttagatgtgatgataagtatggatagtggcaacatgcatttggcctcgttggtgggcacaaaggttgtaagcatctggggagccacgcatccttacgcagggtttatgggctggaatcaaagtgaggagaatgccgttcagttggatatggcgtgtcgtccatgctcngtttatggcaataaaccctgtttgcgcggtgattatgcctgcatgaacgacattcgtccagagatgattgtagcgaaaatcaaacagcttttcaattgaaacagcttagaaagactttccaaatcctaaataaggaaacacaaatacctttttaaccgagtggctttcgctgaatccaaagataggagagatgcctgcacgnaacatgaaaccatggggtgcttgacggcgataaccaatgttagtaaagagataatagaagccaaaactgcggttttctttgatatgtttgtcaaaaactaacttataagaattatcgggttgttgtactaaattatacgaatcatactcgtatctgccgaaaaccaagctgagatttgcacctacaccaagctctaatttcttgtttttacgaccaataagatagtttaatcgtggcacgaaagaaacgatattaaagtgattaatgtcgttgatgaagttatcagatgacagatatgcccatgccaatcctaccgaatagccaaatcctttgttggccttnaagcgcgaatcaaagtgaatacccagcatgtttgaaggtcccatgagttcaacagagaggttttttacgggcttgttcaatgagtctgaaggcgtctgtgcattcatgttcaagactgaaagcatcagtgcgatagcaataaatgttatttttttcatttcgtttagtgttgatatttattataaaagaggtataagaaacctctttttagcatcaaaattatcggttgcaaagataagatgaaatgacgaaataaaagaaaacgtaaatgaaaaaaagtggagtaaagagcgaatttaattgttaacgcacgtcaatttattacacacttagggggtgtttgtgcagcgtttgacgcttttttgtatgaaaagtttgggaaattgaaaataaattagttcctttgcacccagtttttcatttagaaattaattataaacattttaaaaagtaactattatgtcagaaattgaaagcaaggtaaaggctattatcgtagacaaacttggtgttgacgaggctgaagttaagccagaagcaagcttcactaacgatcttggtgctgactctttggacactgtagagctgattatggaatttgaaaaagagtttggtatctctattccagacgacaaagcagagaccattcagactgtaggtgacgccattaagtacatcgaagagaacgcaaagtaatagctttacttaagttattttgcaaataatacgattagggattagtgattaaggattgggttacaacctgttgtgcccagtcactaatccctaatccctaatcttttttatttatattatggaattaaagagagtagtagtaacaggcctcggtgctgttacacctgttggaaacactcccgaagaaacctggaaaaacttgcttgagggcaagagtggtgctgcaccaattactcatttcgatacaacgntgttcaaaacaaagtttgcctgcgaggtaaaagatttgaatttgaacgattatatcgancgtaaagaggcacgaaagatggaccgttattgccagttggctatggttagtgctgcacaaggcatcaaagatgctggtcttgaccttgagaaagaagacctaaaccgcattggtgtggtttatggtgtaggcattggaggaatcaaaacgttccaggatgaagtggtatattatggacaacatgaagatcaaggacctaaattcaatcctttcttcattccaaagatgatagcagatatagcatctggtcagattagtatacagtatggattccacggaccaaactataccacgacgagtgcatgtgcatcttcaagcaacgctttggctgatgcattcaatcttatccgtcttggtaaggccaatatcattgttagtggtggtgccgaagcagccatttgtgagactggtgtcggtggtttcaacgccatgcacgccctttctacacgcaatgatgacccagaacacgcaagccgtccattcagtgcgagtcgtgatggctttgtaatgggcgagggagctggctgtcttgtgctcgaagaattagagcatgcaaaggctcgtggggctaagatctatgcagagatggtaggcgaaggagcaagtgccgacgcacatcatatcaccgcttctcacccagaaggtcttggcgctaaactcgtaatgcaacgcgctttggaggatgctggcctcaaacctgaggatatcgactacatcaacgtacacggaacatctactccagtgggcgatatttcagaggcaaaagctattaaggacgtctttggtgaacatgcttataagctcaatatcagctcaacaaagagtatgacgggccaccttcttggtgctgccggagctgtagaagccttggcttgtgtgctgagtgtgaagaacgatatcgttcctccaaccatcaaccacactgaaggtgacaacgatgaagcattggattacaagatgaacttcacgtttaacaaagctcagaagcgcgaagtgcgtgccgcattaagcaacactttcggcttcggtggacacaactgctgcgttgttttcaagaagtatgctgaataaaatcattgatagaataaagcttcctttccgtaaggagaaggagctttattcgtctttatacactattttaggcttttatccacgcgacatcagctattataagcttgcgttgatgcataaaagcatcatgaaacgcaatgcaaaaggtaagcccgttaacaacgaacgactcgaatttttgggcgatgccatccttgatgccattgttggtcacattgtctatcaacac

SEQ ID NO: 935 - DNA, 4000 bp, Escherichia coli
  misc_feature (1)..(3): n is a, c, g, or t
  misc_feature (10)..(10): n is a, c, g, or t
  misc_feature (14)..(17): n is a, c, g, or t
  misc_feature (170)..(171): n is a, c, g, or t
  misc_feature (183)..(183): n is a, c, g, or t
  misc_feature (341)..(341): n is a, c, g, or t
  misc_feature (418)..(419): n is a, c, g, or t
  misc_feature (438)..(438): n is a, c, g, or t
  misc_feature (443)..(444): n is a, c, g, or t
  misc_feature (810)..(810): n is a, c, g, or t
  misc_feature (923)..(923): n is a, c, g, or t
  misc_feature (1227)..(1227): n is a, c, g, or t
  misc_feature (1419)..(1422): n is a, c, g, or t
  misc_feature (1450)..(1450): n is a, c, g, or t
  misc_feature (1468)..(1468): n is a, c, g, or t
  misc_feature (1725)..(1725): n is a, c, g, or t
  misc_feature (2252)..(2252): n is a, c, g, or t
  misc_feature (2260)..(2260): n is a, c, g, or t
  misc_feature (2263)..(2263): n is a, c, g, or t
  misc_feature (2344)..(2344): n is a, c, g, or t
  misc_feature (2349)..(2349): n is a, c, g, or t
  misc_feature (2359)..(2359): n is a, c, g, or t
  misc_feature (2396)..(2396): n is a, c, g, or t
nnnatggggnggcnnnnacaagttccccggaccttcgtcaggtgtgaacatggtgaagctctgggtgaaaacttccgccaagaagcctgactcgtgcgcgttaaaataacgcgtgattaaagtgaagcgtttttgtatataaaaatagatgtcattctgtacatgtgttnntctcaaagaaantcgccactttcctttccctattctataaatgccctcgcattaagatacccgcgcatacgtatactattaacgcacacactctctctctgcttctgctttttctgtcgctctcgacgtttttgagggaacgatttattgtttacgacgacgatgcgtantacgatggcggcgagaggaagacaaagaaagcgtgcgtcggcctttttcttctccgtcttgtgcatcgcggtgatgnngatggtcgaagcgcaaacnacgannacgaaagtgaaactcaaatcgccggcaaaatctatgctcaaagcgtacgaaatcgtgcgcgtggaagatgtaattcgcgagaacgagaacgtcgacgtggttaaatcgttcgcgatacgcgcgttcggggaacgattcgaggtcgaattggtgtcgaccaaaaccgcctctactaaggggctgttgcgcgaaaattttcaagtgcttcgattcgacggaaagacgctcgaggaagacgaagagactcgagagttggcgaaaagagcggcgactaagtgccagtataaaggcttcgtgaaatcgggaggaggagacgagggtggtgggtctgccgcgaatgctcgtccttctcgagtgtcggcgaangtgtgcgccaaggaggggttcgcgcacgtcgcgctgctcgcgaagaatatgagtttgagtttaatgatgccgcacgagagttttcgggaggaggtggaggaagcgaagagagngaggaagagaagaaagaagagaaggaagattttgaacaacgctttagatgagaacgaaggggaagaagagagcgctgaaaatgaggatgaggatgagagtttggaaagcgtggattttatcgcgtttaacgccgcggacgaagtcgccgagcacttgattggcacacaaagagaccggattaaatttatgccttcaaaaggagacgaagaagaagaagcaaacgacgacgataacaaaaaacgacgaaagttgcaagcgattgattacgcaaacactcgagttatcgaggtgtacgcgcacaangacgaaacgcgagtgtcgaagtacaatacggcgttcgattgcgtgatggaaaccatctcgattatgaattacgtctctgcgttgtatgaaaatgcgttttacccggacattgaaatcgtactcaaagtaatcggatatacggataaaggtgctacagatccgtggggtacagttcaaaaaggcgtgtcgatnnnntgccccgcgtgcgcgactgatgaggtanatagcgacgacttactcnagaaagcagattattggaaatattcttctggaatctccacgttggctgatgccgacgtgctttcagtgctatccgggcataattttgatggtggaaccatcgggttagcgtatacaggtggcgcgtgcaaaggatatggggtaaacgtgaacgaggtgaaccctgcgaattctttgcgatactccgccgcgacggttgcgcacgaaatcggacacaatctcggatttttgcacgacggcgatgatgacgattgtccngataccggtttaatcatggctgcaaaagctggctacgaactcgaaacggaatggagcacgtgtacggtggccaaatatagcgcctcgtatttcgcatacgggtgtttggcgcaaggcagcgaagcggtgtgcgggaacggtatcgtcgaggaaggcgaggagtgcgattgctttggtaatgactgttccgacgcggatgtgtatggaagtgaaaacacgtgttgcaacgcggcgacttgtatgctcaaccccggtatagcatgttcgagctatcacgacggatgttgcgatagttcttgcgttataaaatcgagcggttcagtatgtcgagacgcggtgtccacgtgcgacgtccaagaaacatgcgacggcgcttccaagtcgtgcgtcgcggacggttggaaaccatacggtacaaagtgccaccatggtacgcatccgaacgatattgggagttgctacaaaaatgagtgccgaaaccaacatttttggtgccaacaaatcgattcgacctcccatggcggatnttgcgtgnctnaaaaagtttcgtttccggaaagcgtatgctcgacaactgcgttcaggtgctacggttccgcctcgtcgtgtaacgggccanacgantattccattnaacccgagaaagggtacccgtgctccagcgttccttngacaaccgacggcgtctttgcgaaagtttgcgacgggtacggcggttgcgttgcgccagacgagttgaacaatttacgaggtccatacatcacgtcttcggtgcctgtaggaagcgagccgaacgttaattttgacgtgaatgaaggatttagaaagctcccatcttacaaagttgttgtcgcatattttgcggctatggtgctgatattcgcagaagtgttgttgtattgacctttttagtttgaggaacgagttgaaatatatgttagaaagtttgtatttttgtagcgattaaacatctctctcttctctctctatctcaacaaaaagcgcatgacgtctgataacgcgatgataccttccaacgctcccgttttttcatccactacgactagacgtttcacgcctggtaatcctaatgcctcgaccgccgctcgcaaggtatccgaacgcgtacaggttgaaaatccgccggcgtacgtgctgatattattattacctttcgaaggcgaccctccaccggaatgaaatgggctgtcgctcataccgctggcgttgaatttcggactcggaggtttgttatttaaaacattgctcggcatcgtgttcattgatgatccgtccatggaggcatcgttaccaccaccgcctaacaacgacgatggtgcgtacccaccgccgcccgaagccattctcgagttttgcaacgctctagctatcgtaaattcgtccatgtttacgttcaaatacgcgttgttcgaggctaatttcacaatgtcacttctcgcgtagacgtcaatcaaaccacctctcccgctgtcgtccacgactggtaagcacgagacaccattcatcatcgtaaacgcttccgccaatgttgtctgaggatagacacacctcaaaggcgctagtctttgcaactcttccggaagattagcgaagaactgttcatccgacgccgcttctaccgcgtccgcttgaccgaacgagtttgtcctccgaagtaaggaatcgctcggcgaccgtcttccgccaaactctttcgtccacgtgccaatgggtaaagcaccaagcggctgcgaaaagagcggcaaggaggaaggtacgcctctaaagtgtctgtgcaaacacgcgaaaatctccgcgagattggtcacgtgaagaagctgcgcggcgttccgattcctacttcccattttgttgttgttattgctatctttgttatcactagtatcacccccaccaccatcgccaccaccaccaccgctactacccgatgacttcttgctctggctgccgccgctttgctggccgccgccgccgccgtacgaaacaaccgggacggagtacatgttgttctttaacaaaaccaaagcgaccaggtgtaacgaatcttccggtcgaaccgaaagtaaactcgaattctccacgctcgcgccgcattcttcccgcgctttcgcgacggtaaacctatctaaatcttcttccgtaacttgcttcacgtctttgaacgcctccgagagcactcgcaacaaatctataaactcgccggcggaaatcatcccggcgaaatccccttttgccggattccaaagcggcgccg

SEQ ID NO: 936 - DNA, 4000 bp, Escherichia coli
  misc_feature (61)..(61): n is a, c, g, or t
  misc_feature (249)..(249): n is a, c, g, or t
  misc_feature (497)..(497): n is a, c, g, or t
  misc_feature (1031)..(1031): n is a, c, g, or t
  misc_feature (1039)..(1039): n is a, c, g, or t
  misc_feature (1181)..(1181): n is a, c, g, or t
  misc_feature (1784)..(1784): n is a, c, g, or t
  misc_feature (1991)..(1991): n is a, c, g, or t
  misc_feature (2033)..(2033): n is a, c, g, or t
  misc_feature (2153)..(2153): n is a, c, g, or t
  misc_feature (2268)..(2268): n is a, c, g, or t
  misc_feature (2351)..(2351): n is a, c, g, or t
  misc_feature (3305)..(3305): n is a, c, g, or t
  misc_feature (3421)..(3421): n is a, c, g, or t
  misc_feature (3596)..(3596): n is a, c, g, or t
  misc_feature (3785)..(3785): n is a, c, g, or t
  misc_feature (3957)..(3957): n is a, c, g, or t
ttaaaacaaaatctgaattaattaaaatttttagtgaaaataatgtagattattttaaacntagtgttttttcttgtggttctggggtaactgcgtgtgttttaggactagcatattctcttataaatgatagatattttcctgctatttatgatggatcttggtctgaatacggcaaataaaaaacaatataaatgaaaaaaacaactaaaattacttcgttaattataatttttttcttaataatanccgcaataatagtgggtcgtcagatgatggcatcgcattttaaaaaaaaatttagtaaaaaaccccctcctggaataatagttgcagtagttaaaaatgaaaaattttcaaataaaattgaatcttttggtacagctctttcaaaaaaaactacttcatttagaataaaaaaagaggaattattaaaaccaataaattttgatgaagaagttaaaaaaggagatgtaattgcccatttaaaaagtggnaatattattgctccctttcctgggacacttggaaagagaggtatctctgaagacactttaggttcagagaaatcaataattttgacattagatgatacttctataatttttagtgatttaaaaattcctgaaaactatgcaagtaatataaaaaaaggattaccagttgaggtggaattctctggatataaaggtaaaatttatgaaggagaagtagaaacggttgccaatcgtattgatgctcagacaagaactatgcttgtaagagttaagattataaataaaaattccgagttaattcctggtgctctattagaggttagaatcaaatataatgaaagagagacatttagtattcctgatacaagtacattgttagaaggaaacaaaatttatgtgtacaaagttttagaagataacactattaataaattagaagttgaaacaggtattagaaatgatgggaatcttgaacttatttcaggtctttctcaaggtgataaaattgtagctgaaggcttatctaaagtgagncccggagnaaaaataaaaccaataattaaaactgattgaaattaataaatcattatgtttattaccgatcttagcattagaagacccgttgtatcttcagttttttcgttgatattagttgtatttggaatatttgttttttggaaattncctgtacgagagttaccttcaggacttcaaccacctgtagttcaaattcaagtagattatcaatctgcatctgcgccaataattgaccaagaaataacgcagataatcgaagatgtaataggaggggcagaaggaattaaaaacattgactcctcatctgaaaatggaagaagtacaataaacattgaatttgatactggtatagatttagattcggcggcaaatgatattcgcgaaagagtttctcgtatagttgataatttgcccgatgaagctaaagcaccacaaattttaaaacaagctgctggattcacgacaacaatgtggctttctttatcctctgcaacatggagtgatttagagcttggagattacgcaagaagatatttggttgataatttttctaatatcaaggatgttggaagaatattggtcggaggacttagagaactaagtattagggtttggattgacccaataaaattagctgctaatgatcttactattcaagaagtagaacaggcattaagaaaagaaaatgtaagtttgcctgctggtactttggaggcaaaaaatatagatttgactattaatttagacaantcatataaagatattgattcattaaaaaaattaccaattaaaaaagcaaaaagtagtgtaattcgattagaaaatgttgcgaaattagaatttggtccagtctctcaaaagactttatttaaagctcaaagcattgatggtttaaatctaaaaacagttggaattggaatttatgcccgaagtggagcatctacagttgaattatcngaacttgtaaagaaaagagttaaggaagttcaaaaaacactncctgacggacttaagctagatgtttcatttaatagggcaacttatattaatgctgcaatctttgaagtttataaaacattaattattgcctttgttttagtagttttaataatttatttntttcttggaaatttaaaagcagttattgtacctgccgttgcactcccagtaagtcttattgcttcttttttgggaatttatttatttggtttatcaataaatatttttgttttgntaagttttattttagcaattggaataattactgatgactctgtaattatgacagatgctatttatcgacgaatagagaatggngagactccattagttgctgcttcaaaaggatcaaaacaaattacatttgctatcattgcaacaacacttgttttgttagctgtttttataccattaatttttattgagggaatttctggaactttatttagagaaaccgctatagcactttcttttgcaatagttgtttcttcttttgttgcactaactctttctccaatgcttggttcaaagtttttaaataaaaaaatgaaaaaaaatataatagttttaaaatttgaaaaaatttttaattcattttcaaatttttattctgaaacattgagctattggattaataaaaaaaaaacaattattacatttattattttaataataataagctctgcactactatataattttagtccaaaagaacttttgccgcttgaagaccgcggagtttacttggtaattggaaaaactgatgaagggagttcttttgaatatacaaaaaaaagagctgaagatgtcgaaaaaagattaattccttttctcaaaaataaagatgaatcttaccagagaattattatgcgtgtacctggttttggaagagctagtaaatcttataatagttttataattattgcattacttgatgagtggaaagatcgaaaaaaaagtgcacaaactataatgagaaatgctattggaaaaattgtaactgtaccacaaactcttgcttttccaatttcacctcaatcaataagagtttcaaattatcaaaaaccagtacagatggttgtgcttggcaagagttacaaagaattagaaaaaattcaaaataatatgattaaagaattaagaaaaaataaaaatttagcggcaattgaatctgattattcaagaaataaaccagaaatggaacttattattaataggaaaaaggcaagtgatttaggtatttcaatccaatctattggtaaaacaataganactctatatggtggaaaaactgtaactaaatataataaattaggtaaggaatatcctattattcttcaacaagacattagcaatcgaaaaaatagtgaaagtttaagcaaaatatntgtaagatctgaaacgactggaaaattaatatctttatccagtctagtggaatttaatgagaaaggttctgcaaaaattttatctagatataatagacaaagagccataactatatcggcaagacttgttggtgattatacacttgctgaagctcttactttcttcgaaaaaacngctcaagaaaatatccctcaaacacaattagaatggaaaggaaaatctgaagaattgaaagaagtatcaaatgaactatttattatttttgcactagcaattttaactgcttatttagtaatggcagctacatttaattcttttattcatccattaataattatgcttacagttcctctttctgtgttnggaggtttaatctttatcttattatttaatagttcaataaacattttttcgcaaattgccctggtaatattaattggcatatcaacaaaaaattctattttaattgtagattggactaatcagttaagaacccaaggtaaaaaaatagaagacgctgtcaaagaagcatgtngtttgagatttcgtgcaataataatgacatctttaagcacaat

SEQ ID NO: 937 - DNA, 4000 bp, Escherichia coli
  misc_feature (1991)..(1991): n is a, c, g, or t
attattccttttggagtaggttcctcttttgaaggccatcttaatgctccctttggcggcatatctattgatatgaataatatgaataaaataattaaagtttatccagaagatcttttagtcgttgttcagcctggtgtaactagagagcagcttaacacacatctaagagatactggattattttttcctattgatccaggtgcaaatgcctcaattggaggtatggctgctacaagggcttctggaacaaatgctgtaagatatggaaccatgaaggacaatgtgattgcattggaagttgttactcctgatggtcaaataattaaaacagctaataaagcaagaaaaagttctgctggttacgacttaactcgtttaatagttggctctgagggaactctaggaattgctacagaaattactctaaaattatatggcatcccagaagtcatagcaggtggaagagtcagtttcccctctgtcaaagatgcaacagatacagttattacaacaattcaggccggaatacctgttgctagaattgaatttatggatgtagctcaggtaaaggcggttaataattattccaaaactaatctaccagaggcacctcttttgttagtagagtttcatggaagtgagtcatcggttaaagaacagtcagagttatttggagaaatttcatccgattttggtggtgttgattttgaatggacctctaacaatgaagatagaaataaactctggaaggcacgtcatgatgcatattggtcatgtagagctgtgagaccagaggcttctctttattcaactgacgtatgcgtacccatttcaaaactgtcagattgtataaccgaaactattgaggatttagaaaataataatttaattggacctatagttagtcacgcaggtgatggaaattttcatgttgcgttgctcatagataaaaataataaagatgagttagataagctagagaatttccttgtaagaatatccgagcgggcaataagaatggatggtacttgtactggtgagcatggcgtaggccaaggtaaaagaaaatatatgctaaaagaattaggaaatgctgttgaaattatgaagcaagttaaaaatgcctttgatcctgataaaattatgaatcctggcaaactgtttttgtaatattgctattttataaataatgatttaactacttcttacctattaatcttcataaatcataattattaaggaatatgtttagaattcaatggttacttacgtaattataagttttttaatgatggttacacctggtccgggtgtgttatctttggcaggtgtgggtgctggttttggctggagagttggaattatgtacttgatcggtttgtttttagggacaaacggtgtcgcactattggttgtacttggttttaagcaatttctttttaatattgatggagttgagttaactttcttatttttgtcgttatcttacttatcatttttatcatggagaatagctacttcagataataaaactggttttaaacaaagttttaaatcaccaaagttatatgaaggagtgtttctacaatttgtaaacccaaaggcttatgtcgttcaaggacatttatttgttgttttatccttaggtatattgccttataatttagaaatcattactaaatttatcattgtaaattctatatggatcccaattcattttttttggttatggttaggaataagtttaaaaaaatggtctttggcctctaataaacaaatatgggttaatagaggtatggggcttgctctttttgctgttgtagttttatcagggataatggaattaaattcgaacatataattgattaattattaatcacatagtgttttttgaaaaataaagtgtataaaaattaaacatttttaatgatacctagctcacaattggtaattcgaatcttcttatctgaaagattcgttataatacncacagttcaataaactcccccgttaattgatcttataaaaaactaattattcctccctaatattagttttattcacggtgcagaggatctccttaaaatcctcaccatcaataagtagcccttcctcctgagatatcaaagacacctgcagtagtaaaactattttccttacttgcaagataagcaattaaagaagctatttcctctactgtaacaaatctatttcttggaattttagaaatcatataatcaataaactcttgtgatacttgatctaaaattcttgttttggccgtggcaggagtaatacaattaactgctatatcttggtttgctgtttcttttcctaatgatttagttaatccaattacggctgctttggaagctgaatatgcaggagcatttgggttaccttctttacctgctatagatgcaatattaataattctcccataccctttttcacgcattttttttactacatatttgttacagtaaaaaacaccgttcacatttacatcaaaaaccctagtccattcatcaactggataatcccaagttgaaaaagttggacctgctataccagcactacatactagaatatcaattttattaattagacttattgttttttcagtagcttcctcaactgctttattatcagtttggtctactttcaaaaaatcacaatttaattttttagcagcttctgatcctaattgctcgtcaatatcccaaatcataactttgcaaccatcaccaattaatctttgtgcagtagccaacccaataccttgagcacccccagttataaccgcagtttgtccatcaaaattagccataaattctccccatttttctttaaaataatagatttataaaaattaaataatcatagatattcttaattatattttatatgtttaatttattcattactagaaaaaacaattcctaaggaacagttttatggacattatacacatagttattattggaattctttcttgcatcgcaatggatttatggcaaagactgctaaagataatgattaatgtaagcccgtctgattggtcagttgttggaaggtggtttatattgtcaataactaaaggaaaagtatataatccaaatatagataacgagtctcctataaaaaacgaattatcaataggctgggttgttcattattctgtagcaattttgtactcattagttttttttatattgtataaatatgaggtatttaatgcctcttatattgatggaattatcttcgggttaattagtgttgtagttccatggtttttctttatgcccattctcggaaagggttttttagcttcaaaaactccagcccccttaatggcttgctctctagcggttggaagtcatgttataattggtttggctataggtttatgttttcaaatttttgggtattaatagctttatggatttttgaaaaatgtcagagactaaattaagagaaaatatatgtcagtttgctacttctttatttgatagaggaataacacatggttcaacaggtaacatttcagttagattaaatgattatgaaattttagtaacaccctcgggatcttcttttggaagattagatcctaatgaaatagtaaaaatttcaaaatctggagaattttctggagtcctacctcctactaaagaattaccacttcatcaggcattttatgagacacgaggattaaagtctggtgcagttgttcatttacattcaactcattcagttgccttgtcaatgttaccagaaattgatgaagacaatgtactgccatcatatacaccttactcaataatgcttttaggaaaagtaaagttactccctttttttgtaccaggggacccagctatgggagatgcaataagaggattggcaggaaaaagatctgcagttttattagccaatcatggtccggttgtatcaggtaaagatcttgaagcatcagtaaatgctatagaagaattag

SEQ ID NO: 938 - DNA, 4000 bp, Escherichia coli
  misc_feature (135)..(135): n is a, c, g, or t
  misc_feature (1933)..(1933): n is a, c, g, or t
  misc_feature (1989)..(1989): n is a, c, g, or t
  misc_feature (2158)..(2158): n is a, c, g, or t
  misc_feature (2248)..(2248): n is a, c, g, or t
  misc_feature (2255)..(2255): n is a, c, g, or t
  misc_feature (2259)..(2259): n is a, c, g, or t
  misc_feature (2377)..(2377): n is a, c, g, or t
  misc_feature (2497)..(2497): n is a, c, g, or t
  misc_feature (2545)..(2545): n is a, c, g, or t
  misc_feature (2547)..(2547): n is a, c, g, or t
  misc_feature (3032)..(3032): n is a, c, g, or t
  misc_feature (3185)..(3185): n is a, c, g, or t
  misc_feature (3461)..(3461): n is a, c, g, or t
  misc_feature (3469)..(3469): n is a, c, g, or t
  misc_feature (3522)..(3522): n is a, c, g, or t
  misc_feature (3569)..(3569): n is a, c, g, or t
  misc_feature (3608)..(3608): n is a, c, g, or t
  misc_feature (3671)..(3671): n is a, c, g, or t
  misc_feature (3673)..(3673): n is a, c, g, or t
  misc_feature (3675)..(3675): n is a, c, g, or t
  misc_feature (3683)..(3683): n is a, c, g, or t
  misc_feature (3690)..(3690): n is a, c, g, or t
  misc_feature (3699)..(3699): n is a, c, g, or t
  misc_feature (3701)..(3701): n is a, c, g, or t
  misc_feature (3704)..(3704): n is a, c, g, or t
  misc_feature (3706)..(3707): n is a, c, g, or t
  misc_feature (3714)..(3714): n is a, c, g, or t
  misc_feature (3717)..(3718): n is a, c, g, or t
  misc_feature (3720)..(3720): n is a, c, g, or t
  misc_feature (3722)..(3722): n is a, c, g, or t
  misc_feature (3749)..(3749): n is a, c, g, or t
  misc_feature (3754)..(3754): n is a, c, g, or t
  misc_feature (3756)..(3756): n is a, c, g, or t
  misc_feature (3772)..(3772): n is a, c, g, or t
  misc_feature (3791)..(3791): n is a, c, g, or t
  misc_feature (3794)..(3794): n is a, c, g, or t
  misc_feature (3816)..(3816): n is a, c, g, or t
  misc_feature (3822)..(3822): n is a, c, g, or t
  misc_feature (3829)..(3830): n is a, c, g, or t
  misc_feature (3854)..(3854): n is a, c, g, or t
  misc_feature (3879)..(3879): n is a, c, g, or t
  misc_feature (3881)..(3881): n is a, c, g, or t
  misc_feature (3886)..(3887): n is a, c, g, or t
  misc_feature (3889)..(3889): n is a, c, g, or t
  misc_feature (3891)..(3892): n is a, c, g, or t
  misc_feature (3895)..(3895): n is a, c, g, or t
  misc_feature (3897)..(3897): n is a, c, g, or t
  misc_feature (3907)..(3907): n is a, c, g, or t
  misc_feature (3915)..(3915): n is a, c, g, or t
  misc_feature (3923)..(3923): n is a, c, g, or t
  misc_feature (3925)..(3925): n is a, c, g, or t
  misc_feature (3927)..(3927): n is a, c, g, or t
  misc_feature (3939)..(3939): n is a, c, g, or t
  misc_feature (3941)..(3942): n is a, c, g, or t
  misc_feature (3945)..(3945): n is a, c, g, or t
  misc_feature (3952)..(3952): n is a, c, g, or t
  misc_feature (3954)..(3954): n is a, c, g, or t
  misc_feature (3958)..(3958): n is a, c, g, or t
  misc_feature (3960)..(3960): n is a, c, g, or t
  misc_feature (3962)..(3962): n is a, c, g, or t
  misc_feature (3965)..(3966): n is a, c, g, or t
  misc_feature (3968)..(3968): n is a, c, g, or t
  misc_feature (3975)..(3975): n is a, c, g, or t
  misc_feature (3992)..(3992): n is a, c, g, or t
tcccaaaggtttatcggaggctgagatgagcgacacgaacatgatcgagactatgcaaagcgctgccgagcagctctcccctgtgctttggaatgcgcactgggaagctctccaagatgccgagcgacgtatgcncgggcttgcccacgaaaagtatccgatgctgcgtccactcgtcgcacgcgcgtgcttgcgtgaggtcctcacggctgggggtgagcttccgaatgggtggcgggtagccggttcgccgcaacgcatgggacagctgctggtggaatcggatggagtctgcgcgcgctttttgaaagagtcttcaactgtctttcctggcggggttccggctgccggtcggaatggggcgcgtcaggccttctggcagccgtcccttcttgaggttgaagacgagggtgctcccgcgttgaatcttctgctcctctgggactatgtggacccgggcagggttgaggagggcttcacattgcgtctcgttcatccgaaagggaagggtgcgttcggcagtcaaacaccgattgatgcaagtattccgctgagtgatgacattggggtcttgaaggcgctgcgattcgtcgataatcaagaaaatccgttggaggacttctttgctcagatcgacgcggaggaggctatagctgatgggttcggtgaataggtgttatgggaggcgtctgtcggcccttctggatttggaagggatgacacagggagaactggcttctcgtttgggtatgacgcagggagccgtctcgaaaattgtgcacggtgtttctccattttccgaggagctggtgacgagactagctctggagttcgatgttccgccttcgttttttgctcgtgctccgcgtgtgtcggatgcggctgccgcaacgttccgaaagaagtcttcaacgcgggcgcgtgaggaacgccgaatcggtgtactcgtgcagcttgcgggtgatctgtggcgcgtgacgtctcttgagtcggggtatcgcacattcgttcctcctcagatgagcgggttggatgctgaggatgcggctgcggcgatccgggaagtcgctggcttgcgtgcggacgcgccggtcggttccatgacaaggctggtggagcgtatgggcgttgcagtcgtggccaacttggatcctgagcgttcttatgggacggacatggctggggtgtctcacccgtccgctagtgaggacaggcctctggttggcactttggctcccaaacgtggagatgtgcagcgtctgactattgcgcacgagttggctcacctgctctttgatcacgatatggctagggcaccccgtgcgaggtcacctcaggaactgaaggcatttgattttgctggtgcgcttcttttgcccgaagctcctcttcgtgagcttgttcatgagcgttctatgctgactgacttattgcgaattaaggcacgttttggagtgtccttaatggcaatcattaagcgtgccagtaggctccatctaatctctgacatgcgggcaaagagtctgtatgggcagattaatgctcgcggttggaggttcgatgagcctgtcgaggtccccatagagactcccgctctgtttttgcaggctgctgagcgcgtttggccgggtttgccggtgcggaggatcgcagaggaaacgggtgttccttcttgcttcatcatgccctggattggcgtcagtcacatgtccggcgcgagggaagaaaggcaggaaggggcgcaggtgatcaatcttgcggcgcgccgcgcagtaatggcgtctaccgggggaatgtaaccctgtgggtgcaggccgctagcgcgtggccgtgtgtatgtcttgggctcgtgactgaggtttccgtgagtttgcggttgctgagttgcccctgggattaggctgtggtttctcggccgcccagggcgacgttncgcagcatcgccccgtaggcgcgcgagtcacggctcatgcgctcgcaatggccccnccccggccacacgaccaactccgcgtcgggatagaggcgcggaaccgtgcgccgtgccagtcgcaggtccgagtctttctgcccgtacgcgaacgtgcagcggcgctgaacgtcgggggacaggtgcggcagtgtgacccgcgagcagtcgcgcacgatcgcccgaatnctctcctcgctcatcgcagcaaggctctcggccatggggcgggcgacctcttcgccgaaaagccgcgcgagcttgcgaactcctgcctcngggtcgngcanggccttgcggtgctttgcgaccatgatgtggctcaggattgcgccgcccgtcctcgagatcggccctcccgagtagaagctcacgccttcgatgaagaggcggtcaaacgacagatcngggaagcgcagtagctcgaagaacacgacgccgccgagcgacgccccgaatcccagagccagacggcggatcccgtggtccaccagccaggagtggatcgccgccgcctcggccgccgcngacacgtagggggccgaggcctcgtccccgtgggcggacaggtccggnangaggaaacgcagcccgtcgcccatgtggtcggcgactgcggccttcatgcgcgaggcagacgacagcattgggtgaataaggaggacggtgggggagtcgtcggcgctggagccgtagacgtgcatgttcatggcgttgccctcgtgcggtgtccttgtggtgggaacggacctactcgtagtttcgagggtctagcgaacccatgaaatgatctcggttcatggaggtcgtccagagccgcgcttcggtttttatacttccaaacgttcgcctgtcggaggggtcgtaccactttgccgcttcaatctttgcggcctgtagtttgtgtgcttcatcaagggcaggggcgaggtcggtatcccgcgaggcgagggtaacgacgtcgtagctgcctgatcgggcgagcctaacgagtgcgagggcgcacataacgtcaatgcccttttctctgcgagatgatcggatcggaatcttatttccctcnatccattcccagttgtacttgagtgggcgcagagttaccgagacggcattgtgatgtccgtactcccattgtgattgttgctcaaggttgcggcggtaaccgtcagggtcgtcgtcggggattgggatgccgcggaagacttcgactcgtganacttcaacctcatgttggccatccttgttacgtgccttcgcaagttgcttcgcgaaccgaaacgggtcgatcaggctctcctcgatagggcggccgggcagaaagagttgggcggctgtgaggtgaacgttctgatagtcgatgacgacggccatacgcacagtcattgtgacgcctccggatagagtaaaccccgccaatccctggggatgacggggagctatggcaggaagcatagcagctgtgcatgccgttatgcaagacaatgtgccgtgnatctgttnaagggtagcgcgtggatgcccgcaaggtagctcccgagaaactcaagacgatnatccggcacccgatcaaactcgcgggcgacgcctaacagtccgaatngcagcggcccggtccgcaccgagctgtcaggtggtcccngcccgcgcgggcgcggacctactagccttcgtgcgggaatgcgggtaatgttggtctgttcanancntaaccaanggagaanatgatgctngnggngnngaccccnacnntngngggtacgccgattaagcgctacatcgncatgntntccggcgagacgttcnccggtgtcaatgtcttcanggnctttggcgccagcctgtccaanatgttnggcggcnncgcctcccagtacgaggaggagancggcaacgccgccgcaacggccgtnancgagnngngnncangngcgcaggcgntgggtgcnaacgcggncntnggcgtgaaggtngnntanttcacgncnggcngngncanngntatgctngccgcaattgcgacggnaaccgccg

SEQ ID NO: 939 - DNA, 4000 bp, Escherichia coli
  misc_feature (70)..(70): n is a, c, g, or t
  misc_feature (237)..(237): n is a, c, g, or t
  misc_feature (405)..(405): n is a, c, g, or t
  misc_feature (416)..(416): n is a, c, g, or t
  misc_feature (473)..(473): n is a, c, g, or t
  misc_feature (487)..(487): n is a, c, g, or t
  misc_feature (491)..(491): n is a, c, g, or t
  misc_feature (495)..(495): n is a, c, g, or t
  misc_feature (500)..(502): n is a, c, g, or t
  misc_feature (504)..(504): n is a, c, g, or t
  misc_feature (510)..(510): n is a, c, g, or t
  misc_feature (513)..(513): n is a, c, g, or t
  misc_feature (515)..(515): n is a, c, g, or t
  misc_feature (524)..(525): n is a, c, g, or t
  misc_feature (534)..(534): n is a, c, g, or t
  misc_feature (540)..(540): n is a, c, g, or t
  misc_feature (545)..(546): n is a, c, g, or t
  misc_feature (554)..(555): n is a, c, g, or t
  misc_feature (558)..(558): n is a, c, g, or t
  misc_feature (575)..(575): n is a, c, g, or t
  misc_feature (582)..(582): n is a, c, g, or t
  misc_feature (585)..(585): n is a, c, g, or t
  misc_feature (588)..(588): n is a, c, g, or t
  misc_feature (597)..(597): n is a, c, g, or t
  misc_feature (600)..(600): n is a, c, g, or t
  misc_feature (602)..(603): n is a, c, g, or t
  misc_feature (822)..(822): n is a, c, g, or t
  misc_feature (1021)..(1021): n is a, c, g, or t
  misc_feature (1024)..(1024): n is a, c, g, or t
  misc_feature (1027)..(1027): n is a, c, g, or t
  misc_feature (1036)..(1036): n is a, c, g, or t
  misc_feature (1038)..(1038): n is a, c, g, or t
  misc_feature (1210)..(1210): n is a, c, g, or t
  misc_feature (1267)..(1267): n is a, c, g, or t
  misc_feature (1269)..(1269): n is a, c, g, or t
aagcaatcccccctcataagcgtcatcatgccactctacaacgcagagcgattcgtcggcgaaagcatcngcaacatcctcggacaaaccgtcggggatttcgagctgatcgttatcgacgacgcctcgacggactcctcgtacgacatcgcaagccgttatgccgcgcaagacgcacggatcgtcctgatgcgcaacgacgcgaaccacggcgccgcctatacccgcaaccggggnctggagacagcgcgcgggagtttcattacgttcatggatgccgacgaccgctgttcgccggaacgtttcgcccgccagacagcattcttcggacagcacccgcagatcgacctgtgcggcagttactatacgatgttcgggccggacgatgcccgggaacagaagatncaggatcccancacgcacgaaggaatccggatccagatgcttttcggctgcccgttcgcaatgtcggnggtcatgatgcgcngcgnggcnttccnnngntcgggngtncngttccgggnnaccatggcngaagantaccnnttctgggnnganctttccgggcacatgcncatggcnaanatnccggaacanctntnnttctaccgcaggtgggaaaaccaactttcgaccagccagttagaccggcaaaccctcagcgcgcaagctatccagcgggatctgctgcgcacaaccctcggcatgacgctcaccgacgaggaatcgcggatatacacgcagatgaacctccgggtcgggacactgcggcgcgacgaacttacgacctaccgcggcctgctcaaacgactctaccgcgcnaactccgaacgcagggcctacgatccgaaactgctgcgcaaacggctggtttaccgttacaagctcgcctgcaaatgtttctatccctcgtggaccgtaaaaatcaggaaacgcctgctgtggctcgaactccggtgatatgaaaaaagtcagcatcataatcccgttgtacaacctcgaaaaactgatcgggaaatgnatngcntcggccctngngcaggatttatctcccgaggagtacgaaattctggtcatcgacgacgggtcgacggacgggtcgctcgcagccgccgaaaaggcggcgcaggggcaccccaacgtacatgtatataccaaacccaacgaggggctgagccgcacgcgcaactacggcaccgaccgcgccgcnggcaggtacgtcatgtatctcgacgcagacgattacctcgaaccgaatgtcctcggncncctggtggaaaccatggagtgcggagggctcgacatgctgtgcttcgaaatagctggaatcgacgaaaacggcaacgacgtcccactctggagcgacgggatttccgcaggaaacggctccgacgtgcagcgcggagtcgatttcctgcaacgcgaccggttcctgccgatggtatacgcctacctctactcgcaggagatgctcgacgccaactcgctgcggatggctccgatctggcacgaggacgaagagttcacaccccgcgcgttgtattacgcacggcggatccaatacctccccgtccgggtttacaactacctgcaacgcagcgattcgttcatgggcaattacaagccgcaaagtcgcttagacctcgtacgcgccatgaaaagcctgacctgtttcgcctcccgcatcggggcggaagacccctcaggcgcccgcctgatgcacctgcatgtgggcaagaccctaagcctggcatgcaaacagaccgtggtgaggcaactcggcaacgcccgcgaaatgctccgggaagcccgccggcaaggcatcatgccgctccaattccgccgccgggacttccggcatttcctgataaaccgcctgccgggcctgtacgtcctctactacaagctgcacaagcgccaaaaataactgcaaactattgccgggacggcagttccgcagatgaaaaaatattgcggcggggagtgatgtccccgccgcaatattttgcggttttgaaagaaatcattacttttgtaagatttacgtacacaaccccgaaataactgaaatcacatatggaaatagttgcaagtttaatcaaacttttcttcggctcgaaagccgacaaagaccgcaagcagatcgagccttacctccagaagatcaaagcggtgtacccttcgatagaagccctttcgaacgacgaactgcgtgacaggagcgaagcgctgaagaaacagatcgccgatttcatcgcccgggacgaggccgacatcgtggaactgaaggccaagcttgaactgcccgaaacctcgctggaggagaaggagcgtatctcgaagcagatcgacgagacgaccaaacgcatcgacgagaagatcgaggagaaactcgacgagatactgcccgaagccttcgccatcatgaaggatacggcacgccgcttcgcgcagaacgacgaggtggtcgtcacggccaacgatttcgaccgggatctggccgccgagaaggatttcgtccgtatcgagggcgataaggccatctacgccaaccactggatggcgggcggcaacgacctgaaatgggacatgatccattacgacgtacagctgttcggcggcgtagtgctccacaaaggtaaaatcgccgagatggcgacgggtgaaggaaagacactcgtggcgacgctccccgtattcctcaacgcactggccaagaagggcgtgcacctggtcacggtgaacaactacctggccaagcgagactcggagtggatgggcccgatgtaccagttccacgggctttcggtagcctgcatcgacgacacgcagcccaactccgacgcccgccgcaaggcatacatggccgacatcacgttcggtacgaacaacgaatacggcttcgactacctgcgtgacaacatggcctcgtcgccggccgatctggtgcagcgcaagcaccacttcgccatcgtcgacgaggtcgactcggtgctgatcgacgacgcccgtacgccgctcatcatctccggcccggtacccaaaggcgacgaccagctcttcgagcagtactgcccggccatcgaccatctctacaacctgcagaaaaacctcgtgacgggcctgctggccgaggcacgccggcttatctcggagggcaagaacgacgagggcggcgtgaagctctaccgtgcccacaagggcctgcccaagtacaagccgctgatcaaatacctctcggaaacgggcgtcaaggcactgatgcagaagaccgagaacacctacatgcaggacaacaaccgccgtatgccggagatcaccgacgacctgttcttcgtcatcgacgaaaaactcaattcggtggaactgaccgacaagggacacgaggtgctgtcgaaatatttcaacgaggacgggttcttcgtgctgcccgacatcggcgccgaggtggccgagctggagaagagcaacctctcggacgaggagcgtgcgcagaagcgcgaccaggtggtcaacgactattcgatcaagtcggagcgcgtgcacacgatccaccagctgctgaaagcctacgccatgttcgagaaagacgtcgaatacgtggtgatggacaacaaggtgaagatcgtcgacgaacagacggggcgtatcctcgacgggcgccgctattcggacggcctgcaccaggccatcgaggccaaggagcacgtgaaggtcgaggctgcgacgcagacctttgcaacgatcacgctgcagaactatttccgcatgtaccacaagctggccggtatgaccggtacggccgaaaccgaggcttcggagttctggagcatctacaaactcgacgtcgtggtgatcccgacgaaccgcccggtgatccgcgacgaccgccaggatttgatttacaagaccaagcgtgagaaatacaacgccgtgatcgaggagatcgtgaagctggtcgaggcgggacgccccgtactggtgggcaccacctcggtcg

SEQ ID NO: 940 - DNA, 4000 bp, Escherichia coli
  misc_feature (82)..(82): n is a, c, g, or t
  misc_feature (139)..(139): n is a, c, g, or t
  misc_feature (928)..(928): n is a, c, g, or t
  misc_feature (1003)..(1003): n is a, c, g, or t
  misc_feature (1225)..(1225): n is a, c, g, or t
  misc_feature (1231)..(1231): n is a, c, g, or t
  misc_feature (1479)..(1479): n is a, c, g, or t
  misc_feature (1626)..(1626): n is a, c, g, or t
  misc_feature (1791)..(1791): n is a, c, g, or t
  misc_feature (1797)..(1797): n is a, c, g, or t
  misc_feature (1991)..(1991): n is a, c, g, or t
  misc_feature (2012)..(2012): n is a, c, g, or t
  misc_feature (2469)..(2469): n is a, c, g, or t
  misc_feature (2497)..(2497): n is a, c, g, or t
  misc_feature (2516)..(2516): n is a, c, g, or t
  misc_feature (2591)..(2591): n is a, c, g, or t
  misc_feature (2594)..(2594): n is a, c, g, or t
  misc_feature (2600)..(2600): n is a, c, g, or t
  misc_feature (2622)..(2622): n is a, c, g, or t
  misc_feature (2630)..(2630): n is a, c, g, or t
  misc_feature (2684)..(2684): n is a, c, g, or t
  misc_feature (2690)..(2690): n is a, c, g, or t
  misc_feature (2693)..(2693): n is a, c, g, or t
  misc_feature (2720)..(2720): n is a, c, g, or t
  misc_feature (2732)..(2732): n is a, c, g, or t
  misc_feature (2756)..(2756): n is a, c, g, or t
  misc_feature (2789)..(2789): n is a, c, g, or t
  misc_feature (2807)..(2808): n is a, c, g, or t
  misc_feature (2816)..(2816): n is a, c, g, or t
  misc_feature (2820)..(2820): n is a, c, g, or t
  misc_feature (2855)..(2855): n is a, c, g, or t
  misc_feature (2873)..(2873): n is a, c, g, or t
  misc_feature (2876)..(2876): n is a, c, g, or t
  misc_feature (2942)..(2942): n is a, c, g, or t
  misc_feature (2951)..(2951): n is a, c, g, or t
  misc_feature (2963)..(2963): n is a, c, g, or t
  misc_feature (2990)..(2990): n is a, c, g, or t
  misc_feature (2996)..(2996): n is a, c, g, or t
  misc_feature (3003)..(3003): n is a, c, g, or t
  misc_feature (3041)..(3041): n is a, c, g, or t
  misc_feature (3044)..(3044): n is a, c, g, or t
  misc_feature (3053)..(3053): n is a, c, g, or t
  misc_feature (3095)..(3095): n is a, c, g, or t
  misc_feature (3107)..(3107): n is a, c, g, or t
  misc_feature (3131)..(3131): n is a, c, g, or t
  misc_feature (3134)..(3134): n is a, c, g, or t
  misc_feature (3158)..(3158): n is a, c, g, or t
  misc_feature (3161)..(3161): n is a, c, g, or t
  misc_feature (3194)..(3194): n is a, c, g, or t
  misc_feature (3200)..(3200): n is a, c, g, or t
  misc_feature (3203)..(3203): n is a, c, g, or t
  misc_feature (3230)..(3230): n is a, c, g, or t
  misc_feature (3236)..(3236): n is a, c, g, or t
  misc_feature (3266)..(3266): n is a, c, g, or t
  misc_feature (3272)..(3272): n is a, c, g, or t
  misc_feature (3278)..(3278): n is a, c, g, or t
  misc_feature (3287)..(3287): n is a, c, g, or t
  misc_feature (3290)..(3290): n is a, c, g, or t
  misc_feature (3317)..(3317): n is a, c, g, or t
  misc_feature (3323)..(3323): n is a, c, g, or t
  misc_feature (3341)..(3341): n is a, c, g, or t
  misc_feature (3356)..(3356): n is a, c, g, or t
  misc_feature (3374)..(3374): n is a, c, g, or t
  misc_feature (3407)..(3407): n is a, c, g, or t
  misc_feature (3419)..(3419): n is a, c, g, or t
  misc_feature (3446)..(3446): n is a, c, g, or t
  misc_feature (3452)..(3452): n is a, c, g, or t
  misc_feature (3542)..(3542): n is a, c, g, or t
  misc_feature (3548)..(3548): n is a, c, g, or t
  misc_feature (3563)..(3563): n is a, c, g, or t
  misc_feature (3581)..(3581): n is a, c, g, or t
  misc_feature (3607)..(3607): n is a, c, g, or t
  misc_feature (3678)..(3678): n is a, c, g, or t
  misc_feature (3680)..(3680): n is a, c, g, or t
  misc_feature (3689)..(3689): n is a, c, g, or t
  misc_feature (3698)..(3698): n is a, c, g, or t
  misc_feature (3719)..(3719): n is a, c, g, or t
  misc_feature (3722)..(3722): n is a, c, g, or t
  misc_feature (3764)..(3764): n is a, c, g, or t
  misc_feature (3824)..(3824): n is a, c, g, or t
  misc_feature (3828)..(3828): n is a, c, g, or t
  misc_feature (3860)..(3860): n is a, c, g, or t
  misc_feature (3886)..(3886): n is a, c, g, or t
  misc_feature (3955)..(3955): n is a, c, g, or t
  misc_feature (3982)..(3982): n is a, c, g, or t
  misc_feature (3988)..(3989): n is a, c, g, or t
caatgacccattgattgacaaccgcgactcaaagaaacgctatcgtgcagatgttctcattgaagatcagatagcaaagtangatgaaaagattgaaaaagaagttgctaaagctgctaaaaagtttggtgacagcttngaagaaggcaagttccgcgagaccaacatacgtgttttggaaaaccaaaagaagcgcgatgcattgcatgaacgctatactcaggccatgcaaggccccgatttggaagctctaaaacaaatcattattgacgaaggaattgtagatcccatcagtggtacaaagaattggacggacgttcgccaatttaacttgatgttttctactgaagttggttctctaagtgaccagacaaacaaaatctatttgcgtccagagacagcgcaaggcatctttgttaattatctaaacgtacagaaaacaggtcgcatgaagcttccttttggcatctgtcaaatcggcaaagcattccgtaacgagatagtagcgagacagtttgtattccgtatgcgcgagttcgaacaaatggaaatgcagttcttttgtcagcctggtactgagatgaaatggttcgaatattggaagaaacaccgtttagcttggcacgaagctcttggtatgggcgacgagaactaccgctttcatgaccatgaaaagctggcacattacgccaacgcggctactgatatagagttccatatgccgtttggtttcaaggaggttgaaggcattcattcgcgtactgactttgatcttagtcagcatgagaagtttagtggtcgttcaattaaatactttgatcccgataagaacgagaattatactccgtatgatgtagagacttctatcggtgttgaccgcatgttcctttctgttctctgtcatagttacacggaagagcagcttganaatggcgagactcgtgtggtattgaagcttccagaggctttagcaccagtgaaatgtgccgtattcccactcganaagaaagacggactgccagaacttgctcaacagattgttgacgacttgaagttccatttcaacacacactatggcgatccaaaggattctatcggtaaacgttatcgccgacaagatgcagttggtacaccattctgtgtcactgtagaccacgatacgccaaaagatcacaaggtaacactgcgctatcgtgacacaatgaagcaggaacgagtagacatngacgcnctacgtggcatcatggaagagcgtgttagcatctcaagtctactgaaaaaacttaatgtaaaagaatgaaacgtaacctattatatatcctgttgctcatgattaccacctgtgtggtaacgtcatgtaaggaagaaggcgactcaaacaacgagttttctaattggcaatctcgtaataacgagtacttcaataaagtctataaggaagctcaaacggcttcatcgacaaactcaaatatcaagatnttacgtagttggtccttaggaaatgaacttcaaaagcctgaagatcacatcgtggttaaggtgttagagaatggtacagggacaaaaacaccagtctacaatgatagtgtttatgtgcatgttcaaaagcgattgattccttctgcnacttatcctgacggcaaaatctttagtcagagctggacaacagaagtctttaatcccagtgttagcgcccctattgagattgcagtaaatgcacaatgcgatggttttgcaaccgctttgcaacacatgcacgtaggagacagatggcgagtatatgtaccttangccctnagtgaaagcaatgcagaaggtcaatacgacctccccagccattcaatgcgcatctatgatgtcacacttgcaggcataaaggcagagaaatagacgataaaacaccgctataaagataggatatataatataaggtgtaatcaacatgcacatgagtcaacttgacttatgtgcatgtttgcattaaaacaaancacgtgtgtacgtacacaatngcttgatttaagtcaaaaaacgacattatttccataatttcgcgttcaaaaatatggcagaaagagaaatcgttcctatctttgcatcgtctaaaagaggtaaaagattgagataacgacaaaggttttaggttagacagacaaagagattaagtttagaataggtatttggttttaggtaaaataaaagatcttcaaaggtattataaggtaaaagattcagggaaacaggatttagagagtcactacaaaaaggacataggttagtcttgaaaggtaaatgaaaagattgtttcagaatagataacacataaagagaaagtaaaagaaaacttgatagatttgagagacagacggtttcataggaatatggaatcgttttttttgtgatttacccgaaaatctattaattttgcatcattaaaataaggtatgttaggaaacaaaaagagtgaancgctattagcaaacatccgtaatggccngcccatgccacagaatganaaactcaaactgattgtaagtttgagtattccctctatattagcccagatcactacagtcatgatgttcttcatngangcctcnatggtgggacatcttggggcanaagcctcngcaagtataggcttagtagagtctacaacatggctaatgggtagtgtaatgagngctgcntcnatgggcttttcggtacaagtttcccanttcattggtgcnaatgacttcttcaaagcacgtcangtctttcggcatggactgctttgtggtctcgcntttagcctcattatagcnnctataggnacgncaattcactccgtacttccattgtggttagggggnggaaatgacattaatcangangcctctcaatactatttggtgttctcattaaccatgcctttcatcctacttttccatctttcggcntccatgatnaagtgttctggnaacatgcaattaccgagtttaatgagngttttnttgtgtnttcttgacgtgattttcaactacttgttcatctatatnttncatttgggngtggtaggtgcggcaatcggcacctcaatggcatatatttcnacttcacttccnatagcttggatggccacaagacgnaanaaaatattagcacttcagcttganaangtgccatttaaatgggtttgggactatgtaacnaaagcnatncgaatcagtcttcccatggcaattcantcggtnttaatgagcggagcacagattgttagcacnctaatngtggcnccattaggnaanattgccatcgcttctaactcctttgcnatcacngcagaaagcctttgttanatgccaggttatggnataggcgacgctgcaacnactttagtgggccagacttatggtgctggacgnaaggacctttgnaagagttttgctcacatgaccgtaggnttaggnatgcttgtcatggcttttatgggactgattatgtatatttttgctcccgaaatgattggactcctaagccctgttgaatctatccgcacnctcggnacaacgattttacgnatcgaagcctttgccgancccttctttgcagcgtcaattgtggnatatagtatatgtgtaggcgccggtgataccctacgtcctgccatcatgaatcttgtttcaatgtggtgtntncgactaacncttgcggcntggcttgcccgagattatggnctnaaaggtgtctggacagcgatggcaatcgaactaaccttccgnggatcaatcttcctttatcgcctattccgaggcaattggttgaaaggaataaaagaaaanccgncaatacaaaccgcataatacatcctaaaatanatattattatgaaaagaatctttttntttttcacggtaatgttgctttcgtcactctcttttgcaacctccgttgacagcacaaatgccgtgacnatgctcgactatgaacaggcgttgaangacgannatgcccgaatc

SEQ ID NO: 941 - DNA, 4000 bp, Escherichia coli
  misc_feature (2200)..(2200): n is a, c, g, or t
  misc_feature (2245)..(2245): n is a, c, g, or t
  misc_feature (2290)..(2290): n is a, c, g, or t
  misc_feature (2326)..(2326): n is a, c, g, or t
  misc_feature (2335)..(2335): n is a, c, g, or t
  misc_feature (2608)..(2608): n is a, c, g, or t
  misc_feature (2852)..(2852): n is a, c, g, or t
gccctgacctcggcgtttctaatatttgccaaccgcactgatcgggcctggggtgccggcatgcgttaccttgtgatccaggtgctttcgggcgtgctactgctcgccggagcgctgatgctgtatcggcacagcggctcgctggcctttaaccatatcggtttgaatggcgcgggaagcttcctgatctttatcgcctttggcatcaagtgcgcctttcccctgctgcacaactggctcacggatgcctaccccgaggccaccccgaccggcacggtttttctcagcgcctttaccaccaaggtcgcggtctacgctctggcgcgtggctttgccggcaccgaggccttggtctacatcggcgcgaccatgacctgttttccgatcttttacgccgtgattgaaaacgacctgcgccgcgtgcttgcctacagcatgatcaaccagatcggcttcatggtcgtgggcattggcctgggtacggcgctggctatgaatggtgcgatcgctcacgcctttaacgatgtgatctttaaaggcctgctgatgatgtcgatgggcgccgtactgcacatgactgggcgcatcaatggctctgatctgggcgggctgtacaaaagcatgcctattaccgccggcctgtgcatcgtcggcgcagcatcgatctcggcctttccgcttttcagcggcttcgtcagcaaatccatggttatggtcgcggtgctggaagaaggtcacccgggggtctggctggcactgctattcgcatcggcaggtgtatttcaccatgccggtatcaagattccttttttcgcttttttctcccacgacagtggtatccggaccaccgagccaccgctaaacatgctggccgcgatgggtctggcggctgtgctttgcgtctttatcggctgttatccgtgggtactttatgaactgctgccattctcgacgggctatgcgcctttcgacggcagccatatattggcgcagatccagttgttggttttttcagccgctgcgtttgcctggctcaaggtttcagggatttacccgcctgaactgcgttccaccaatattgatgtcgagtggctgtatcgccgcctggcgccacgttgggtgcgccactgcactcaaggattaactgccgtcagcgacactctgggccaggccacacaaaacgccagccgtgtcgtgatgcgctcggttgtgcgtcactatggccccgagggcgctctggcgcgatcctggccgaccggctcgatggtattgtgggtggcggtgctgctcgcggcgagcttgatactgtactacctgtaagatcaattaccgacaaccttcgtttataacgatccaatctgatgaatacccctcacaacaacccagtcgatgaagcgattgcttcaagacgctcgatacgggcctttttgccaacgccggtcgagcgggcaacgatccgtgcgatcctcgccaccgcgtcgcgggcaccctcaggtaccaatacccagccgtggcaggtatatgtcctgaccggcaaggccttggccggtatcagtaaaaaaatactatcggtgtacaacaatccggatgaggtggcgcaacacacttctgaatacgcctattaccccaacaaatggatctctccttacctcgaacgccggcgcaaagtcggctgggacctgtatggcctgctgggcatcaccagggacgacaagacggcaatgcaccaacagcatggacgcaactatgtattttttgatgcgccggttggactgattttcagcatagacagagtactggagaagggcagttggctggactacggtatgttccttcagaacatcatggttgctgcccgggcccgtggcttggatacctgcccacaagcagcctttacaccatttcaccgggtgattcattcgtatctcgaaatgaatgataacgaggctctggtgtgtggtatgtctttgggctacgccgataacgccgcggtcgagaaccaattgacgactgagcgtgaagcggttgacgactgggtcagttttatcgactgagtacagtcagcccgaaggtttccggctttgagacagctcagatcgtgctgccctgcaggctttccttgaagtgacgccggcacatcgagatataggtctcattaccgccaatctgaatctgatcaccggcccgcatcggcctgccntcaccgtcaaaacgcaccgtcatgatggctttgcgaccgcagtgncacacggtcttgatctcacgtaattcgtctgccaatgccagcagnaactgcgcaccttcgaacagttctccaagaaaatcngtacgcaanccataggcgagtaccggtatatccaacgtgtcgacgacttcggtaagctgtccgacctgctgggcgctgagaaactgagcttcatccaccaacacacaatgcacggcttgttcctcaccttcgcgaaccaccaactggcgcaggtcgacttcgggacccacatcgatcgcatcggcctcaagaccgattcgtgaacgaacccggctttcccctgcccgattatcgatgcgcggtttcagcaccagcgtgttcatgccacgctcggcatagttntagctcgactgcagtagattcgtcgtcttgccagcattcattgccgaatagtagaaatagagcttcgccaccgtgttcgcctgttcgttaacccatcagcggggattgtagaacatcaccggtagcctcccatcaccaaggatgccgtgctgtctggcgctccatgtataacgatacgagcccgccaagaaaaactatactgtgcccgtgtttttgattaaaggtgaagcgtaaatgaaaaagntccgttattcggcatggctgctccgcgtgctactgggcggcttacttgcactaccggctattgctgaagaagataccaagccggtaatgattacgggcgaactcaaaagtttctccatgactcataacggcgaaactgtcacggtgatgcgcaaccaggaccggtccaatcgcattgtcgaactctaccagccgacctaccgcggcaagatccagcccatgcacccctttgcaccacatcaggtaactacaatcggggctctggagatgatcggctttatgcagcagttggaatcaggggacgaaggtctgctgattatcgactcgcgcacgcgcgactgggcgcggcgcggcacgcttgcgggatcgatcaatatcgctttcaccgagttcaaggatgaggaacgcgcactggaaatcatggaagagtggtttgatgttctgaacacaggtctctcacttgatttttcaaatgcaaagaccctggttctattttgcaacggcatctggtgcggtcagtcaccaacgacaatacgcaccttattgcgaatgggatacccggccgcaaagatccattactttcgcggtggcatgcaaaactggcaatcactcgggctgacggtggtttcgccttgagcacgacgcaactcaccctggcagagattttttcaatagctcaagttgccctgactcaagccggcgccaacaaagaaaacgcggacgctgttgccaatacagtaatgcgggctgagcgtgatggctctcattcccacggactgttccgcataccgggatatgttgcctcgttgcaaagcggcaaagtcaacggtaatgccgacccaaagctgcactcgcgcaccgcggttgcgctacattgcgatggtgatctgggctatgcaccactcgcccatcagcgctgcctggagccactggctgaggctgcccacgaaaacggtgtggcaatactgtcgattacccgaacacatcattttgccgccttgtggcccgaaactgaggcattagcggagcgcggactaactgccatcagttgcgtttcctacatgcccagtgtggcgcctttcggcgcgagcaagcctctttatgggaccaaccccttatctttcgcctggccgcgcgccgacgccctac

SEQ ID NO: 942 - DNA, 4000 bp, Escherichia coli
  misc_feature (1992)..(1992): n is a, c, g, or t
  misc_feature (2047)..(2047): n is a, c, g, or t
  misc_feature (3211)..(3211): n is a, c, g, or t
aaaggcggcagtcaagaaatcttgcgtcgccgcgatgagaatttcaccattcttcggagtgcaaaggttgtgatggactcccatgagctcgagtgcctcggctcgcgcttcttcggtttgaggacaatggatgttcatctcgtcaccgtcgaaatcagcgttatacggcgtacacacgcattcgttgaatcggagtgtacggcacggcatgacgcgagctctgtgagccatgattgacattttgtgcaaactcggttgtcggttaaagagcaaaatatcgccgtcatgaatgtgacgttcgacaatgtcaccaaaacgcaactcactcgcaattttgcgtcggtcaccatacttcaagtattgcataccaccgcccacaaatttgacaaagttggcaccagggtgcgtagacatgccgtttcgcacacgctctctgagcatggcaatgttgtgcttgttgacgacttcggggtacgtcatcgtctttgctatgtgaatgggcacgcccacttcatcgatgcgaaggtttggatccggtgaaatgaccgttcttgcgctgaagtcgacacgcttaccgctcaggttaccccggaaacgcccttgcttacccttcaatctttggacaaaacctcgaagcggcttgcccggaccttggtactgcagagacagtcccgggagctcgctgttgatgtacatggcgcactgaatctgtaaaaagtcccagttttccatgaggttgttgatggccaaacctttctccaaaccttgtcgcagaacgttgttcacttcaataatctgaatcagcttcatggtgatatcatcctcgtttgaccccgaaatgccatccatctccacggacggacgaatgcagcacggtggcacggcgaggtgcgtgagcaacaagttttcagggcgattcgcaatgtccagaagctcgcaatccttatcgctgatgcgctgcatgattcccaaaactctaatcgggttcaagtcatcctgaactcgcggcagcgacgctctgagagactcgttgtactttaacgccgtctcaaattctttcatgaattcctccaagagcgccggatttttgctatacttttcgtgaacaatcttgagcgtctgccccgcgcgcttgaccgccccgttgtaatctccgcagtgcggacacaaacggcaccgcttgcacttgtcggcaaactttttattcaacgccctcctctggttgatctccagctttgggcttctgtacctcttcaaaaacaccgccgcgtcgtcctcattcatcaaaacccccgagcaatttttacacacgcactgtaaaatcgaaatgatattcttgaagtacccgatgtggaaaaccggaagctcgagcttgatgtacccaaagtgccccgcgcagtccaccatactcccccgacacgtcgcgcactccccacctcgtttatccgtcgtccccattcgcggatctagaataccattcggcatcggcgttcgctgcggcatctgatacaagttcctctcgcacacgtgaaacaccccggctcgaccgatctccgcgtcgctcatcagcgagaacctcacgctgcgaatcttcctcggcgtcgtcgccggcacgaacggcgtcttcgtaaactcaatcgccgccgcatcccgcgacgacgtcgccatatcgtctctaaacgtcggcatcgcgtcgcttcgtcgtatccaccggctccgagcgatacaaaagtcgtctcgagtgaaaaagcgctcttcacccggcggcggcagggcaaacctctcttcaacaagaatgcgtcacgagaacgacagacgacgccctctcgcgcgtcccgcgtcggcgcgcgcgcccttctcagagctcgcgggtcgcgcgcggcgtcttacgttcgctcggtcgcgcgcgcggacgaccgaccgactctcgtcttcggtgtgtgacgaccgggcggcgggcgcgtcctgggaacgaacgacgaagcgctccanccagcgcgcccgcgaacgaccgagtccatcgacgacgagtcaaacgacggttcancgttcacgtgtccgaagtgtgcgtgttgaccgtgtgtgactcaaaaaggagtgggatgggtacggatggacttcatttttggaacgcgaagacgcgaaggcgatgggaacggatcggagcgcgagaggtcggcgcggtgtggcgctaacgcgttggagatatcgattcacaacgtgttttcccggggtgtggtggcacccgcgggtgactagtgtacgcggcatgtttctataaaggcatccgagtcggcgcgttgacgctcgggttggacgaaatccgcgctggtgatggcggtggtttgtacggcgagcatcgggctcatgatgacttgttgtgggaatctctggaagacgttaaagtcgatcaccttgttgacggcttttctgctgagcacaggttcgaggaagagagagtacgaatcgcgccccaggatgtaggcgtgcgatcctcgcaaatcgcactgcgctcgagtgacggtgcaaaaggcgtccgatttcgtcaattcagcgttgtagcggcatccgcagccgtaaggacatgcggtaaaaccgacttcaaactcccacgctctgtaacctaatctaataatggtaaacgccgcatcgctcgcttgctctgagttggtgagaagctccgcgacggatcgaatcgcctcgtgggccttgtatttcgggtgctcctccgcaactggatcgatgaaagacgcgtctgcttcgacgacaccgatgtggtggtggttcgcttgctttgcgtgcgccaccacagcgccatgcgagagagtcgcacgcctgaaatgagtcacatgagagtcgagcccgaggcacgcgtccaccttggtgccgtccacgacgtgaactttatctctccaatcaatcggaacgcagagagacttgcaacttcctctcgcgcagatgagataaagcgccttcgccatctgtatcatgcgtttaccgatgagaccagagcccatggttgagtttgaagggcagaattggacatccttgacaaatgcttgttccgcgcacttcgcagccaaatcgacgccgtaggacgcacgcgtttgtctcttgttcaccagagtccctagttccgccgctcgagaagttttgtaatgcgaaatgcctaaattgatgacttgtcgagataagcatccgtgattctcgntcaagcagactcgatcgcgagcttcttgcaactctgcgacaaagccgtcggcttgcgcctcaaacttggtggagcactcttgctcgtcgccttccgcgcactttggagctttcctcggatgcgcgtgcgtatccttcaaagcgtcgttgtaagacgcgctcgactgaagttttggtatgacccaatcgtggatggtttctcgccactgcaaaaactctgaaattctttgattttcgtgccacattcgtagtagacgagcctccgccgctcggtagagtctcgcatcaatcgagttcaatctgttgaatctcttcttgaagccttgactatcgatgtagctgactaattccgcggggagcgccgtcgttaagtcgtcctggaacaacatgcgtttgaagccgtacttgtccaggttgccaaaaccaacctctggcggcgaaagcagttgccgcacggaaatgattctgtagagcatttgcttcatgagcaaacgagccgtgagctcgtgcgtcggcgtaacaaccaaatcgtacatgttcaacacgctgaggatgtcttcgttcgtcaccgacgacggggtcactttgccatccttgtctactcgatccatctttgtcagcagtttggttggcgcgagcaatttgaactgcaagtttgatacatgcgctcgtcttccaaagttgccaaacgcaaactccttgaagttttctacgctaggagaccacccccgtctcgcgatgccgtactgcatgtaggcttcgacgactctatgcaacgggtctcgaacac

SEQ ID NO: 943 - DNA, 4000 bp, Escherichia coli
  misc_feature (910)..(910): n is a, c, g, or t
  misc_feature (2050)..(2050): n is a, c, g, or t
gtaacaacgccggtttctttatccacgcggcggtaaggtgcctcaatgaagccgtacttgttgatcttggcgaaagatgccagataggagatcagaccgatgttggaaccttcgggcgtctcaatcgggcacagacggccatagtgggtataatgaacgtcgcggacttcgaagcctgcgcggtcacgggacagaccgccggggcccaaagcggacagacggcgcttatgggtcagctcagacagcgggttgttctggtccatgaactgagacagtgggctggaaccgatgaactcacggatggcagccacgaccgggcggatgttgaccaggctctgcggggtgatctcgccggattcctggttctgcagggtcatgcgctcgcgcacaacgcgctccatacgggcaaagccgatgcggaactggttctgcagcaattcgccaacgctgcgcacgcggcggttgcccaagtggtcgatttcatcggtcacgccgatgccatggtcaaggcccagcaggtagttgacggaagcaaagatatcgtcaacggtaacggtgcggctgatgagcttatcatgattcttggtcagcagttctttctgctcttccggatcggaggtagcatccagaatcttacggatttcggcgaaggaagcgcgctcgttgatgccgcattccttcacgtcaaagctgaagaaactctgggcatcgacacagccgttggagaacacgatcacattgaccggatcctggcccttgcgctccacgataacagtaacgcgggaaacaccggcgttatcaatttcaacagccttttcgtggttgatgcgctcgcccttggcggccagcagttcgccggtcagcggggcaatgatgtcctcggcagtcttatagcccgcaatacggcggnacaggcacagcttgttgttcatcttgaagcggccaaaacgagccaggtcgtaacggcgcggatcaaagaacagcaggttgatgtggctgcgggagctttccaccgtcggcggctcgccggggcgcagcttgcggtagcactccagcagggcttcctctgtggaatgggtgatatccttttccagggtggcgttgattttgggttcagaatcgccgaagtactggcggatctgctcatcggtgccaagacccagtgcgcgcaggaaggtagtaaccggcagcttgcggtttttatcaatgcgcacataatatacatcggaagaatcggtttcgtattccagccatgcgccgcggttggggttcatggttgcggtgaaaaggtccttgccggtacggtccttgctggaagcatagaacacgccgggcgaacgaaccagctggctgacgataacacgttctgcaccgttggagatgaaagtgccggaatccgtcatgagcgggaaatcgcccatgaaaatttcctgttccttcacttcgccggtgcttttgttcaacaggcgcgcagtgacataaagcggcgcagcatacgttgcgtcacgctctttacattctttaatggtatatttggggtgcttgtccagacggtaatcgacaaattccagcgagagattcccggtgtaatcctcgatcgcgtcaatgtcgtggaacacttcgcgcaggccctcgtccaggaaccagttataagagtttttctggatctcgatgaggttgggcatgccaatcacttcgttgatgcgggaaaagctcattctggaggttcgaccgttttgtacgggcttgacctttaccataaaatgcgaccactcctattccgttcagatttgtttttggcaaaagcgctccgccgaagcaatgattttcttggaacattcgtcgtttttaacaaagtttgaaaaaacgcgaaaaaatcaaaattcctttagggcgctctattccattttgtgatactatgccagtataccagccaaaaagctgattgtcaagggctcttttggcattttgcgtgtttttttatcaggcaattgaacgcccggatgcgtgtcacatttcttttggcaaagtgctatttttgcatttcttntgccacttgacaaatccttgaaatgccgctaattggcacaatgcccaattaccttgtgtgttttttgtatgggttgcagcctgcgttttttctgcattttcccggtttttacgctttgcaaacaaaaagtgcccttcccgccgttatccgtgtgcagggtgggcactcgtctgtttttggtgttatgcgtttgatgccgggcccgccacacgggtatttacaccagctccacccggtatttttgcagccagtaattcagctgcacaaaccaggcaatggtctgcggggtggtcatcagctggccataccagggggtcgcagtctcggcagcggtcaacagctgttccagcgctgccctcttggcaatacgcagcagcggggcatccgggtcctgcatcgcactgcgcagcatggcgctgacagcgttcaaatacgccgggttccatgttttagggtaggggctcttttttcgccacaacacttccgtgggcagcacgccctgcatcgcctggcgcagcaggcctttttcgtggccctcgtaatccttatattcccacggcacgctgtacaggtattccgcaatgcggtaatcgcagaacggcacgcgcacttccagcccgctgtacatactcattcggtccttgcggtccaaaagggtctgcataaaccagttaaagttcagggcaaacatctggcgcatccgttgttccaggggatccagaccggggcggatggaagtttgctccagcgtggcgcggtagccttcatcaatatacgccgccgggtcaatgccgccgaacacctccggcttaaaaaagctgaccctgtatgccgtgctctgcgcccaagggaagccataccgctcccgcacggtcttatccctgtaccaggggtaaccgccaaatatctcgtccgcgcactcgccggaaagtgccacggtggctgttttacggatctcacggcagaacagcagcagcgaggagtccacatccgccataccgggcaggtcgcgggcgtccaccgcttccagcagggcggcggccagtgcttcgctgtccagcgttacccaggtatgctgcgcgttcaagaactggttcatggtgcggatatacggcgcatccgggctgggctggaaatgggtggcgtggaagtactttttgttatcctgataaccgaccgagaaagtctgcagcgttttgccccgcgccgtaaagtgggaatccgcgattgccgaaatcaggctggaatccagcccgccggaaaggaaggttgccaccggcacatccgataccagctgccgcgtgacggcatccatcaccaggtcccgcactttggctgcggtgtgggtaaaatcatcggggtgttcgtggtcggtcagctgccagtagcggcgcacggtgaggcgcggcgcaccaacctgtggcacagtgtattctgcgcagcagccgggcttcaattcctgcacattgcggaacaccccgcaccccggcgtgcggccggggccgagcagcagcacatcggccagcccatgggcatccacctgcggcgggatctccgggtggcagagcagcgttttcagctcggaagcaaagatcaggctgtccccgcgcagggcatagaacagcggcttgaccccgatgcggtcccgcgccagaaagagcttttgcgcccgctgctgccacacagcaaatgcaaaaataccgttcagcttttccagacagtccggcccccactgggcaaaagcatgtaacaaaacctcagtatcggaatggcttacaaagcgatggcccagagccgcaagctgggcgtgcagctccggcgtgttgtacagctcgccgttgtacaccagaatgtatttctccccgccctgatccagcaccatgggctggcagccgttttccagatccaccacagccagccgcgcatggatcagcgccgcatggccgtgca

SEQ ID NO: 944 - DNA, 4000 bp, Escherichia coli
  misc_feature (635)..(635): n is a, c, g, or t
  misc_feature (698)..(698): n is a, c, g, or t
  misc_feature (728)..(729): n is a, c, g, or t
  misc_feature (742)..(743): n is a, c, g, or t
  misc_feature (797)..(797): n is a, c, g, or t
  misc_feature (806)..(806): n is a, c, g, or t
  misc_feature (824)..(824): n is a, c, g, or t
  misc_feature (827)..(827): n is a, c, g, or t
  misc_feature (845)..(845): n is a, c, g, or t
  misc_feature (848)..(848): n is a, c, g, or t
  misc_feature (850)..(851): n is a, c, g, or t
  misc_feature (860)..(860): n is a, c, g, or t
  misc_feature (862)..(862): n is a, c, g, or t
  misc_feature (920)..(920): n is a, c, g, or t
  misc_feature (929)..(929): n is a, c, g, or t
  misc_feature (931)..(931): n is a, c, g, or t
  misc_feature (933)..(934): n is a, c, g, or t
  misc_feature (938)..(938): n is a, c, g, or t
  misc_feature (941)..(941): n is a, c, g, or t
  misc_feature (944)..(944): n is a, c, g, or t
  misc_feature (959)..(959): n is a, c, g, or t
  misc_feature (965)..(965): n is a, c, g, or t
  misc_feature (968)..(968): n is a, c, g, or t
  misc_feature (983)..(983): n is a, c, g, or t
  misc_feature (989)..(989): n is a, c, g, or t
  misc_feature (992)..(992): n is a, c, g, or t
  misc_feature (995)..(995): n is a, c, g, or t
  misc_feature (1005)..(1005): n is a, c, g, or t
  misc_feature (1015)..(1015): n is a, c, g, or t
  misc_feature (1025)..(1025): n is a, c, g, or t
  misc_feature (1028)..(1028): n is a, c, g, or t
  misc_feature (1030)..(1030): n is a, c, g, or t
  misc_feature (1037)..(1037): n is a, c, g, or t
  misc_feature (1051)..(1051): n is a, c, g, or t
  misc_feature (1055)..(1055): n is a, c, g, or t
  misc_feature (1058)..(1058): n is a, c, g, or t
  misc_feature (1070)..(1070): n is a, c, g, or t
  misc_feature (1073)..(1073): n is a, c, g, or t
  misc_feature (1079)..(1079): n is a, c, g, or t
  misc_feature (1097)..(1097): n is a, c, g, or t
  misc_feature (1100)..(1100): n is a, c, g, or t
  misc_feature (1106)..(1106): n is a, c, g, or t
  misc_feature (1112)..(1112): n is a, c, g, or t
  misc_feature (1129)..(1129): n is a, c, g, or t
  misc_feature (1151)..(1151): n is a, c, g, or t
  misc_feature (1157)..(1157): n is a, c, g, or t
  misc_feature (1163)..(1163): n is a, c, g, or t
  misc_feature (1168)..(1168): n is a, c, g, or t
  misc_feature (1175)..(1175): n is a, c, g, or t
  misc_feature (1187)..(1187): n is a, c, g, or t
  misc_feature (1205)..(1205): n is a, c, g, or t
  misc_feature (1394)..(1394): n is a, c, g, or t
  misc_feature (1442)..(1442): n is a, c, g, or t
  misc_feature (1444)..(1444): n is a, c, g, or t
  misc_feature (1457)..(1457): n is a, c, g, or t
  misc_feature (1475)..(1475): n is a, c, g, or t
  misc_feature (1502)..(1502): n is a, c, g, or t
  misc_feature (1547)..(1547): n is a, c, g, or t
  misc_feature (1565)..(1565): n is a, c, g, or t
  misc_feature (1598)..(1598): n is a, c, g, or t
  misc_feature (1607)..(1607): n is a, c, g, or t
  misc_feature (1611)..(1611): n is a, c, g, or t
  misc_feature (1619)..(1619): n is a, c, g, or t
  misc_feature (1622)..(1622): n is a, c, g, or t
  misc_feature (1640)..(1640): n is a, c, g, or t
  misc_feature (1682)..(1682): n is a, c, g, or t
  misc_feature (1742)..(1742): n is a, c, g, or t
  misc_feature (1745)..(1745): n is a, c, g, or t
  misc_feature (1759)..(1759): n is a, c, g, or t
  misc_feature (1764)..(1764): n is a, c, g, or t
  misc_feature (1877)..(1877): n is a, c, g, or t
  misc_feature (1946)..(1946): n is a, c, g, or t
  misc_feature (1948)..(1948): n is a, c, g, or t
  misc_feature (1950)..(1959): n is a, c, g, or t
  misc_feature (1962)..(1964): n is a, c, g, or t
  misc_feature (1967)..(1967): n is a, c, g, or t
  misc_feature (1970)..(1971): n is a, c, g, or t
  misc_feature (1973)..(1975): n is a, c, g, or t
  misc_feature (1978)..(1978): n is a, c, g, or t
  misc_feature (1983)..(1987): n is a, c, g, or t
  misc_feature (1993)..(1993): n is a, c, g, or t
  misc_feature (2006)..(2007): n is a, c, g, or t
  misc_feature (2020)..(2020): n is a, c, g, or t
  misc_feature (2034)..(2034): n is a, c, g, or t
  misc_feature (2249)..(2249): n is a, c, g, or t
  misc_feature (3260)..(3261): n is a, c, g, or t
  misc_feature (3263)..(3264): n is a, c, g, or t
  misc_feature (3266)..(3279): n is a, c, g, or t
  misc_feature (3282)..(3286): n is a, c, g, or t
  misc_feature (3288)..(3293): n is a, c, g, or t
  misc_feature (3295)..(3297): n is a, c, g, or t
  misc_feature (3299)..(3314): n is a, c, g, or t
  misc_feature (3316)..(3316): n is a, c, g, or t
  misc_feature (3318)..(3326): n is a, c, g, or t
  misc_feature (3328)..(3333): n is a, c, g, or t
  misc_feature (3336)..(3338): n is a, c, g, or t
  misc_feature (3340)..(3341): n is a, c, g, or t
  misc_feature (3343)..(3344): n is a, c, g, or t
  misc_feature (3346)..(3348): n is a, c, g, or t
  misc_feature (3352)..(3352): n is a, c, g, or t
  misc_feature (3355)..(3357): n is a, c, g, or t
  misc_feature (3359)..(3366): n is a, c, g, or t
  misc_feature (3368)..(3369): n is a, c, g, or t
  misc_feature (3371)..(3371): n is a, c, g, or t
  misc_feature (3373)..(3375): n is a, c, g, or t
  misc_feature (3377)..(3377): n is a, c, g, or t
  misc_feature (3379)..(3380): n is a, c, g, or t
  misc_feature (3382)..(3383): n is a, c, g, or t
  misc_feature (3385)..(3390): n is a, c, g, or t
  misc_feature (3393)..(3394): n is a, c, g, or t
  misc_feature (3396)..(3402): n is a, c, g, or t
  misc_feature (3404)..(3410): n is a, c, g, or t
  misc_feature (3412)..(3412): n is a, c, g, or t
  misc_feature (3415)..(3415): n is a, c, g, or t
  misc_feature (3417)..(3417): n is a, c, g, or t
  misc_feature (3419)..(3420): n is a, c, g, or t
  misc_feature (3422)..(3425): n is a, c, g, or t
  misc_feature (3428)..(3428): n is a, c, g, or t
  misc_feature (3430)..(3442): n is a, c, g, or t
  misc_feature (3444)..(3448): n is a, c, g, or t
  misc_feature (3451)..(3452): n is a, c, g, or t
  misc_feature (3455)..(3455): n is a, c, g, or t
  misc_feature (3457)..(3457): n is a, c, g, or t
  misc_feature (3459)..(3459): n is a, c, g, or t
  misc_feature (3463)..(3477): n is a, c, g, or t
  misc_feature (3481)..(3482): n is a, c, g, or t
  misc_feature (3487)..(3487): n is a, c, g, or t
  misc_feature (3493)..(3506): n is a, c, g, or t
  misc_feature (3508)..(3510): n is a, c, g, or t
  misc_feature (3512)..(3513): n is a, c, g, or t
  misc_feature (3516)..(3516): n is a, c, g, or t
  misc_feature (3518)..(3520): n is a, c, g, or t
  misc_feature (3522)..(3525): n is a, c, g, or t
  misc_feature (3528)..(3529): n is a, c, g, or t
  misc_feature (3531)..(3534): n is a, c, g, or t
  misc_feature (3536)..(3536): n is a, c, g, or t
  misc_feature (3538)..(3541): n is a, c, g, or t
  misc_feature (3543)..(3543): n is a, c, g, or t
  misc_feature (3545)..(3547): n is a, c, g, or t
  misc_feature (3550)..(3553): n is a, c, g, or t
  misc_feature (3555)..(3559): n is a, c, g, or t
  misc_feature (3561)..(3561): n is a, c, g, or t
  misc_feature (3563)..(3565): n is a, c, g, or t
  misc_feature (3569)..(3572): n is a, c, g, or t
  misc_feature (3574)..(3578): n is a, c, g, or t
  misc_feature (3581)..(3582): n is a, c, g, or t
  misc_feature (3585)..(3587): n is a, c, g, or t
  misc_feature (3591)..(3597): n is a, c, g, or t
  misc_feature (3600)..(3605): n is a, c, g, or t
  misc_feature (3607)..(3607): n is a, c, g, or t
  misc_feature (3609)..(3609): n is a, c, g, or t
  misc_feature (3611)..(3611): n is a, c, g, or t
  misc_feature (3613)..(3625): n is a, c, g, or t
  misc_feature (3627)..(3633): n is a, c, g, or t
  misc_feature (3637)..(3640): n is a, c, g, or t
  misc_feature (3642)..(3645): n is a, c, g, or t
  misc_feature (3648)..(3652): n is a, c, g, or t
  misc_feature (3655)..(3655): n is a, c, g, or t
  misc_feature (3657)..(3660): n is a, c, g, or t
  misc_feature (3665)..(3667): n is a, c, g, or t
  misc_feature (3669)..(3675): n is a, c, g, or t
  misc_feature (3677)..(3680): n is a, c, g, or t
  misc_feature (3683)..(3686): n is a, c, g, or t
  misc_feature (3689)..(3690): n is a, c, g, or t
  misc_feature (3692)..(3696): n is a, c, g, or t
  misc_feature (3698)..(3709): n is a, c, g, or t
cacctactgtaagcgctattgctgatctttcaaaatcatcaacaacatgtaatcttgtacccgttgctatccaaagctgattatttaaatattctatatcatttaatactgacgatgataaaggggagttagaagaattaaatgttgctagagaatcgtttttcgcatcgaacctgtaatagttagaaccagcgatgtaataaatgactgagtcattacctgctgcgatatctgttattgcagccgaaggggctgatgaagaataattagttatcgttcctgttacagggttcatcgaggaaagaccatgtgttccattcgcatgacctaaccaaagaacattgtcatttgaatcgtatttcaaacttttaatattgttatggggaagccctgcacttgtttggtattgcgtgaatgtggttccattaaaaattgataagccggaagttgttgcaatggcgactgctccgtttggcattctttcaaaatcattatgagagtttgttggaatcccggttgtattaaatgatttatacgcagtagcagttgagccatcataatagaccacgccactagagaatccgttcgacactacaaatgaagaatctgtgagggcctctcccaagaaataagangatgtcaatccttgggcagaaccgtagtttgtcattgaactgccattccattttgacatgccngaactggtaagtatccataggttaccgtcnncatcctgacttanntcacgaatactgtttgcaggtaatccagaattttgatccgttaattgggctatnccttgtggncccttcatgaaaataccnttngagtatccagatactatngangnncccattgcngngaggtgcaatggttgattcgaaggcatccctgtgttttctctttcaaaattagaatangttcctgangnanntaanacntgnagtccgttattattncctgcngcntgattgttcgagacnagatanacngangagtcattgncagaataaanggcttgtganagnangttttcngctaacccgttcanagantangaatgcgaaacngtnccatcngtcttaaatgttgttaanccntaggcngtacanataaataaattacctgntggatcttcaacgaatgatctnatgtcntttganactantccaatngtgttggatacnttatattttgtccaattngatccgtcaaattcagaaattccaaataacgttccaatccataatgatccattcgagtcctcgtaaagcgatcttacgtcgttgtttgccagaccattagatgtgctttgtttggtgtatgttgtgcttgagaagactccagattgatctgtaattattgccaaaccatcttttgtagcaacggcaacngagctgtctgataaaactattaagtcctgaatcgaagatgctggcaanangcttgaaggaacntatgaccagttaagtccngtcttgatcgaaacaccagattcagtncctacccaaactcttcctgaagcatcttcagcaatggctcttacngaatcaccctccaaaccngtaaactgttctgtaaacagactggcttccatnagtgagttnatgnacgtgtanccngaagttgttcccacgtanatacctgaaattgttttttcaatagtcaaaacttcttgagangccaatggaaaatccgaggatttaacgaaattaaatgttgagccattgtagagaactaanccnttttcggttcccanaaganattcactagaatcaagctcaataatagcattgtatgccgaagatggaataccgctgttttgtgaatttaaattcgtccaacaatccgattgtgctgacgcgttgattgatacngttaatgcaagcattaaagcgtggcgagtagtcataacttgatggtttaatttttatccctaagacaantnannnnnnnnnnaannnccnaanngnnnttnagtannnnngaaaantacaaattttttnntaaaaaatgtccnaaacttatcatggncgacatagacttatcgtggtatccttttttatgatatcgtaataccgctcaatgttacgaagatgggctatctttaataattcaatacaacatgtcaacaccttgtatcaggattacatcattacagcactgtcgctattagtaattgccctcatcatcgggggtattacggtcagacgctacaacatcccctacctctactttttggctggtanagtgctcaacgcaacctatttaacagacattgcgggtaacgaaatcgtcaaagtaatgtacccttggtttataccattattctttttgattggacctggactttacgggtcatactgttccgttgaggaacggaaagatcggtggcatattattcattacctacctgtcttcttaggttacgtcattttaatccttgaactcggttttttcaacgattacttttataatactgtgcaacttgcacatgacctaaagtgggagagcaccagtgtcttttggccattctcagataaatggattattctagcacagccctttcatacacttctttatgttgtgtttagtgtaagaaagctcaatacgtccaaagcacggcttcctttatttgttttacctattgtccagggtatttcattaatcccgctattggatattaattatcattttttaactggtgactttttaatttttgccaatgaccaggttcttaggtatgcgatgtttggccttgtgttccttattttctgggatgtcgtgaacattcgtccgcgaatgcaaaaacaagaagaagaaaaactcaaggcctacgaggcaaaaaaagaggcagcgcggcaggaggcgttaattcaagaggcgcccaaagaaatctatccaaacgcagggaaagtaaccaatgccgaaatagttctatacatcgaaaggctcattcaaggcgatgaagaattccccttcaataaacattcgaagaagtccgatttcatcaagcacagtccattcaaaaacacagactgggaaagtttcttttccgcgacgagcacaaatttcggtttctttaaaaagtatgcgcgcatccaccgtgcccttcgactcatagaggaaggttacctggacaatcaaagtgtagagacgctcgctaaaaccgtgggctattcctcaagagcacccttctacctggcctttgagcagattatgggggaatctctaaccgcctaccgagagatctagatcanntnnannnnnnnnnnnnnnaannnnnannnnnncnnntnnnnnnnnnnnnnnnnanannnnnnnnnannnnnntgnnntnnanntnnnatanacnnntnnnnnnnnannanannntntnnannannnnnngcnnannnnnnngnnnnnnncnctntntnnannnnaanannnnnnnnnnnnnannnnntannacncncncccnnnnnnnnnnnnnnngggnnttttntgtgtnnnnnnnnnnnnnntnnnannccncnnntnnnncanntnnnngngnnnnanannnttnnnncnnnnntntnnnaaannnntnnnnntcnncannntttnnnnnnntcnnnnnngngngngnnnnnnnnnnnnnannnnnnntttnnnncnnnnaannnnnaanannnnaaaannntnnnnnnngnnnncgnnnncannannnnngnnnnnnnnnnnngcgcaagatgcctcagtagaaacacaagccattggcgtcgtgatcgatgcacacgcattggtagatgtcgttgatgacgagatcgtgtttgacttcagtaatgacgatcccgtggaggccggaggtgcttttgtgcttggtgcgaacaagcaatcgagcacctttttaaattactcattaatgttgagtaatgcaggaatggcagacggttctatttctgtgcgtattgccaatatgaacgaagggatgagcctttcacttttagccgatgggaaccagcctgcaggttta

SEQ ID NO: 945 - DNA, 4000 bp, Escherichia coli
  misc_feature (881)..(881): n is a, c, g, or t
  misc_feature (884)..(884): n is a, c, g, or t
  misc_feature (900)..(900): n is a, c, g, or t
  misc_feature (905)..(905): n is a, c, g, or t
  misc_feature (963)..(964): n is a, c, g, or t
  misc_feature (967)..(967): n is a, c, g, or t
  misc_feature (986)..(986): n is a, c, g, or t
  misc_feature (1004)..(1004): n is a, c, g, or t
  misc_feature (1007)..(1007): n is a, c, g, or t
  misc_feature (1022)..(1022): n is a, c, g, or t
  misc_feature (1043)..(1043): n is a, c, g, or t
  misc_feature (1067)..(1067): n is a, c, g, or t
  misc_feature (1069)..(1069): n is a, c, g, or t
  misc_feature (1073)..(1073): n is a, c, g, or t
  misc_feature (1076)..(1076): n is a, c, g, or t
  misc_feature (1082)..(1082): n is a, c, g, or t
  misc_feature (1084)..(1084): n is a, c, g, or t
  misc_feature (1097)..(1097): n is a, c, g, or t
  misc_feature (1099)..(1099): n is a, c, g, or t
  misc_feature (1106)..(1106): n is a, c, g, or t
  misc_feature (1115)..(1115): n is a, c, g, or t
  misc_feature (1121)..(1121): n is a, c, g, or t
  misc_feature (1127)..(1127): n is a, c, g, or t
  misc_feature (1153)..(1153): n is a, c, g, or t
  misc_feature (1163)..(1163): n is a, c, g, or t
  misc_feature (1169)..(1169): n is a, c, g, or t
  misc_feature (1181)..(1181): n is a, c, g, or t
  misc_feature (1196)..(1196): n is a, c, g, or t
  misc_feature (1199)..(1199): n is a, c, g, or t
  misc_feature (1207)..(1207): n is a, c, g, or t
  misc_feature (1219)..(1219): n is a, c, g, or t
  misc_feature (1226)..(1226): n is a, c, g, or t
  misc_feature (1260)..(1260): n is a, c, g, or t
  misc_feature (1268)..(1268): n is a, c, g, or t
  misc_feature (1280)..(1280): n is a, c, g, or t
  misc_feature (1298)..(1298): n is a, c, g, or t
  misc_feature (1301)..(1301): n is a, c, g, or t
  misc_feature (1325)..(1325): n is a, c, g, or t
  misc_feature (1363)..(1363): n is a, c, g, or t
  misc_feature (1374)..(1374): n is a, c, g, or t
  misc_feature (1388)..(1388): n is a, c, g, or t
  misc_feature (1409)..(1409): n is a, c, g, or t
  misc_feature (1981)..(1981): n is a, c, g, or t
  misc_feature (1985)..(1985): n is a, c, g, or t
agtttgacttcacagtaacgttgtctgtgtcggtcagatacatgtgcgcagcacctggcctgaagaatgtgtttgcttcaatcgaagcgccactcatattttccaagtacaaagatccgccagtgccgccagagacaccacctatcatgttccccttcaggacccagccagtatttgttccgtccgtggtgtcgccagtgtatctgacagaatttgatcccgagaagccggtcacatagctattttgcaatttgaagttatcaatatcattgccgctgaaatccaatccaccattgtatgaatgcaagcgcaacccatctagtacaacattgtcagacgcgactgttatcttaccatcaatccaagtctctaacgctccgcctgtaacaccccgtgccacattatccgtatcgtacaaagtctgaacggtagaagcagctgtagataagcccgttgttatattgccggaaatatcaacggcaagcgatttgccaacgtttgcaccagcgatcgtaacggacgccacacccaaggcatcggcatctagcgtaacattctcactgtaacgccctgaactcagtgagattacaattgtatcggctgaactgctgacttttgcttgtgcagctgtaagcgcggcagaaattgaaccaccagcggccactgtttcagtgattgttgtgccgctagctccaccgccaccgccagcaataggtataacgacatcaccaggaatatctacaccgtcaggtatatctacaccatcgggtatatctggaacagaaatagttccatcttcactaatcaccaccacctggattgttgtatccacatctgacacatcaagttctgccgtgaagtcaaaacccgcatcatccccnagngactcgatgtacacgncaagntctgctgtcgcctcagcaattagcgtatcgattgcagctacatcgacgaccacacccnnagnaatcgacgcaacaaaatcntcctggactgcctgctgngtngcagcgatatctttnagcgaggttgcaacttcgatnttggcgttaacagtctcagcgacngncgcnatnttgtcnancaccgctgccaantnatcaaanccgggcgcntccgcnaatacntccgtcgtggaggaaacagtttctangatcgccttnatttcncttgctttggtnaatacctcggacttnccnccggcagnccccgccgcggnaattttngtcgaaacttccgccatcacggcagctgacgcanctgaaccnccagctgcgganaccattgaaatcaagttngcnacctgcgcagcggctttgctcatnccggcggatcctgtcgctacgaagtctgtcgccatcangtctgcacctncagataggccaagncccttcgcaacttgcgcttgngcttcagccgcagaaacgggggcgccacccgacgctacagctttttggacaacggcatccacaatggtcgtgaggggggttacgactgtagcgccttccggcgcgcgcagctcgcctgtaaatgttttaccagtcgaaatgtccgtaccgccttggacaacaatagacccggatccaaatagtccggagaacgtaccttgctgaccaacttcattgctggtttggacgaagacgtctggattgctcgttagaaagaccttagaattagcgagatatccatcaatcgcccggcccgttacttctgtagccggggtgctgtcgctacccccgcaagctgatagtggtattgcgagcacaagcaacgaaaggccctgctggacccttcgttcatttattgcacggaatttagaaaagagcttgtccagtgaaaattcagaaattttcagttcaaatcctgactcggaaagagtatctccatggttcttagcttcgtcgtaaaccacaacgttcgctgttacgacgttattatttatagcacttttgaacataggcaacctcagaagtttaaaatnattntgatatgataccactatatctatcaagcgcaagtggccccgctgaatccatcaagcgcaagtggccccgctgaatttttgcaagacttgagaccagacatgcgtccctgatatcagcccaaaaaaacaattttcgctacagcgcagtacttagatttacatatctccatacgcaccgcattttttatatttaatcatttaacaacaggaaaataaactgactatttttcgcaaatccgtgcgaatcagttcggttctggtactataggcgtaccaatactcaacaccgccaagcctatcaggttttaaaagcgcagaagccagtcaaaatattgaagctttggacgcattatgaaccactgtatccgatcgtcatgcagtcattatccgtgaattgttgcgccttgtttgttaaaaatcctctggtcacaacaaacaggttcacacaacccgatacacagtgaaaaattataattttactatcaacgacttatataaagtatattttttgcaaatccgtgtacaccggttcgatactgggaccccttcaataaaatcaataacttatctgatgaggcttttgatcgtacacttggtttgcgcaggagaccaatagaaccatcaaagtcagcgaacacattcgactggataccagacctggcagtgcaaagtggcaagcacgggtcgaactggctgatggctcttggcatagattttcaaccaagacagaaagcttggaacgcgccactgaagttgcgatgaagtttttctacacatctgaagatcgtctcaaaaacaacctgccgcaaagcacgcgcaaatttcgtcgtcagtgtaggtgactgccactgtggtgtcgtctattactaaaccagagagatctacgctcgccgagtctagtgtcacgtcgagtgtatcttcagtcccggtacctttgacaatccaggcttcacccgtcacatctgaggcgttcatttccaatgtcacagctccggccgctgtgatagaaactgtttcaaggtcagtgattgagagagttgctcctgtaagatcggctgcagctgcaaacacgagcgtgtcagacccaccgttaccatcaattgtcatgttaccagcgtaacccgtgatggtatcgttaccctcgccacctgtaactattttggagttagccgacattgttgtaacgagtttgccggtcaaagcagaggcatcgatagacttagcggtggcggcggtgctgcccagtgtaagattgacagaaccacttgccacaaatgcggttgtggctgcaccagttaaagtagcaatcgtagcaattccgtcacccgcaacagtggctgatgtatctgaaccgctgatgttaactacctcaaagtcagagacgtcaaaagtggtctggttaccggtatcatcgataatcagatttagcgtttctgttgtaccgttagtggctacggtagaatccaacgtggcggttgttgtcgcagctgttactttcacggttgcattatctgccaagctgtaagtgtcgccaccagtagtcccatcagcaatatcaatcacaatcgaagttgctacctttgataagtcagcggtatcgtccgcattgatccgcactgtcgcggttgcgtcaccagtaaggttattaacaaaagtctctgtggtcgcatcaagcgcagccatcacaagtgtaacgtcttggtcacctgcaaatgtgactttctccggagcgttgcctgcagtcaaagtgtatgtggccgactgtgaattacctgacaaagtaatattctcaacctgatctgttgcagccgtctcaagggacactacgccgttggatgaaactgtcgcaacgtcgttagcaacatcgccgtcaccgtcgacactgatttcgttgtcggttgtgccggaaacgcttgtacccacgttagtttggttaactgttacgccacctgaacccgcgtctgttagagttacgatacgagctgcaccggcctcaatggttgtgttagctgaagt

SEQ ID NO: 946 - DNA, 4000 bp, Escherichia coli
  misc_feature (650)..(650): n is a, c, g, or t
  misc_feature (2002)..(2002): n is a, c, g, or t
  misc_feature (2058)..(2058): n is a, c, g, or t
  misc_feature (2356)..(2357): n is a, c, g, or t
  misc_feature (2361)..(2363): n is a, c, g, or t
  misc_feature (2370)..(2375): n is a, c, g, or t
  misc_feature (2377)..(2380): n is a, c, g, or t
  misc_feature (2383)..(2383): n is a, c, g, or t
  misc_feature (2388)..(2392): n is a, c, g, or t
  misc_feature (2395)..(2402): n is a, c, g, or t
  misc_feature (2406)..(2408): n is a, c, g, or t
  misc_feature (2410)..(2410): n is a, c, g, or t
  misc_feature (2412)..(2413): n is a, c, g, or t
  misc_feature (2415)..(2416): n is a, c, g, or t
  misc_feature (2419)..(2421): n is a, c, g, or t
  misc_feature (2426)..(2428): n is a, c, g, or t
  misc_feature (2432)..(2436): n is a, c, g, or t
  misc_feature (2439)..(2444): n is a, c, g, or t
  misc_feature (2446)..(2447): n is a, c, g, or t
  misc_feature (2450)..(2452): n is a, c, g, or t
  misc_feature (2457)..(2458): n is a, c, g, or t
  misc_feature (2461)..(2471): n is a, c, g, or t
  misc_feature (2473)..(2473): n is a, c, g, or t
  misc_feature (2476)..(2476): n is a, c, g, or t
  misc_feature (2478)..(2489): n is a, c, g, or t
  misc_feature (2491)..(2498): n is a, c, g, or t
  misc_feature (2500)..(2505): n is a, c, g, or t
  misc_feature (2507)..(2509): n is a, c, g, or t
  misc_feature (2512)..(2527): n is a, c, g, or t
  misc_feature (2529)..(2533): n is a, c, g, or t
  misc_feature (2535)..(2542): n is a, c, g, or t
  misc_feature (2544)..(2550): n is a, c, g, or t
  misc_feature (2552)..(2555): n is a, c, g, or t
  misc_feature (2557)..(2558): n is a, c, g, or t
  misc_feature (2560)..(2561): n is a, c, g, or t
  misc_feature (2563)..(2563): n is a, c, g, or t
  misc_feature (2565)..(2585): n is a, c, g, or t
  misc_feature (2589)..(2590): n is a, c, g, or t
  misc_feature (2594)..(2599): n is a, c, g, or t
  misc_feature (2601)..(2615): n is a, c, g, or t
  misc_feature (2618)..(2618): n is a, c, g, or t
  misc_feature (2620)..(2621): n is a, c, g, or t
  misc_feature (2623)..(2626): n is a, c, g, or t
  misc_feature (2628)..(2643): n is a, c, g, or t
  misc_feature (2645)..(2651): n is a, c, g, or t
  misc_feature (2653)..(2661): n is a, c, g, or t
  misc_feature (2663)..(2670): n is a, c, g, or t
  misc_feature (2672)..(2675): n is a, c, g, or t
  misc_feature (2677)..(2685): n is a, c, g, or t
  misc_feature (2687)..(2694): n is a, c, g, or t
  misc_feature (2696)..(2703): n is a, c, g, or t
  misc_feature (2705)..(2714): n is a, c, g, or t
  misc_feature (2716)..(2716): n is a, c, g, or t
  misc_feature (2718)..(2723): n is a, c, g, or t
  misc_feature (2726)..(2734): n is a, c, g, or t
  misc_feature (2737)..(2745): n is a, c, g, or t
  misc_feature (2747)..(2748): n is a, c, g, or t
  misc_feature (2750)..(2751): n is a, c, g, or t
  misc_feature (2753)..(2762): n is a, c, g, or t
  misc_feature (2764)..(2765): n is a, c, g, or t
  misc_feature (2767)..(2770): n is a, c, g, or t
  misc_feature (2772)..(2772): n is a, c, g, or t
  misc_feature (2775)..(2780): n is a, c, g, or t
  misc_feature (2782)..(2788): n is a, c, g, or t
  misc_feature (2791)..(2791): n is a, c, g, or t
  misc_feature (2793)..(2796): n is a, c, g, or t
  misc_feature (2798)..(2799): n is a, c, g, or t
  misc_feature (2802)..(2802): n is a, c, g, or t
  misc_feature (2804)..(2806): n is a, c, g, or t
  misc_feature (2809)..(2815): n is a, c, g, or t
  misc_feature (2817)..(2817): n is a, c, g, or t
  misc_feature (2820)..(2820): n is a, c, g, or t
  misc_feature (2822)..(2822): n is a, c, g, or t
  misc_feature (2828)..(2828): n is a, c, g, or t
  misc_feature (2830)..(2831): n is a, c, g, or t
  misc_feature (2833)..(2835): n is a, c, g, or t
  misc_feature (2837)..(2842): n is a, c, g, or t
  misc_feature (2845)..(2847): n is a, c, g, or t
  misc_feature (2851)..(2851): n is a, c, g, or t
  misc_feature (2854)..(2854): n is a, c, g, or t
  misc_feature (2856)..(2857): n is a, c, g, or t
  misc_feature (2859)..(2859): n is a, c, g, or t
  misc_feature (2861)..(2861): n is a, c, g, or t
  misc_feature (2863)..(2865): n is a, c, g, or t
  misc_feature (2867)..(2870): n is a, c, g, or t
  misc_feature (2874)..(2878): n is a, c, g, or t
  misc_feature (2880)..(2895): n is a, c, g, or t
  misc_feature (2899)..(2903): n is a, c, g, or t
  misc_feature (2905)..(2919): n is a, c, g, or t
  misc_feature (2921)..(2923): n is a, c, g, or t
  misc_feature (2926)..(2931): n is a, c, g, or t
  misc_feature (2933)..(2934): n is a, c, g, or t
  misc_feature (2936)..(2938): n is a, c, g, or t
  misc_feature (2940)..(2943): n is a, c, g, or t
  misc_feature (2945)..(2953): n is a, c, g, or t
  misc_feature (2956)..(2956): n is a, c, g, or t
  misc_feature (2958)..(2964): n is a, c, g, or t
  misc_feature (2966)..(2969): n is a, c, g, or t
  misc_feature (2971)..(2976): n is a, c, g, or t
  misc_feature (2978)..(2978): n is a, c, g, or t
  misc_feature (2980)..(2981): n is a, c, g, or t
  misc_feature (2983)..(2988): n is a, c, g, or t
  misc_feature (2990)..(2997): n is a, c, g, or t
  misc_feature (2999)..(3000): n is a, c, g, or t
  misc_feature (3004)..(3006): n is a, c, g, or t
  misc_feature (3008)..(3011): n is a, c, g, or t
  misc_feature (3013)..(3030): n is a, c, g, or t
  misc_feature (3032)..(3035): n is a, c, g, or t
  misc_feature (3037)..(3038): n is a, c, g, or t
  misc_feature (3040)..(3044): n is a, c, g, or t
  misc_feature (3046)..(3054): n is a, c, g, or t
  misc_feature (3056)..(3065): n is a, c, g, or t
  misc_feature (3067)..(3071): n is a, c, g, or t
  misc_feature (3073)..(3074): n is a, c, g, or t
  misc_feature (3077)..(3078): n is a, c, g, or t
  misc_feature (3080)..(3082): n is a, c, g, or t
  misc_feature (3086)..(3087): n is a, c, g, or t
  misc_feature (3089)..(3097): n is a, c, g, or t
  misc_feature (3099)..(3105): n is a, c, g, or t
  misc_feature (3107)..(3131): n is a, c, g, or t
  misc_feature (3133)..(3135): n is a, c, g, or t
  misc_feature (3138)..(3143): n is a, c, g, or t
  misc_feature (3145)..(3153): n is a, c, g, or t
  misc_feature (3155)..(3156): n is a, c, g, or t
  misc_feature (3158)..(3174): n is a, c, g, or t
  misc_feature (3177)..(3177): n is a, c, g, or t
  misc_feature (3179)..(3182): n is a, c, g, or t
  misc_feature (3184)..(3185): n is a, c, g, or t
  misc_feature (3187)..(3191): n is a, c, g, or t
  misc_feature (3193)..(3194): n is a, c, g, or t
  misc_feature (3198)..(3200): n is a, c, g, or t
  misc_feature (3202)..(3203): n is a, c, g, or t
  misc_feature (3205)..(3207): n is a, c, g, or t
  misc_feature (3210)..(3210): n is a, c, g, or t
  misc_feature (3214)..(3216): n is a, c, g, or t
  misc_feature (3221)..(3221): n is a, c, g, or t
  misc_feature (3223)..(3223): n is a, c, g, or t
  misc_feature (3226)..(3234): n is a, c, g, or t
  misc_feature (3236)..(3236): n is a, c, g, or t
  misc_feature (3238)..(3255): n is a, c, g, or t
  misc_feature (3257)..(3259): n is a, c, g, or t
  misc_feature (3261)..(3267): n is a, c, g, or t
  misc_feature (3269)..(3270): n is a, c, g, or t
  misc_feature (3273)..(3277): n is a, c, g, or t
  misc_feature (3279)..(3280): n is a, c, g, or t
  misc_feature (3282)..(3283): n is a, c, g, or t
  misc_feature (3285)..(3286): n is a, c, g, or t
  misc_feature (3288)..(3292): n is a, c, g, or t
  misc_feature (3294)..(3294): n is a, c, g, or t
  misc_feature (3296)..(3297): n is a, c, g, or t
  misc_feature (3299)..(3305): n is a, c, g, or t
  misc_feature (3308)..(3313): n is a, c, g, or t
  misc_feature (3315)..(3319): n is a, c, g, or t
  misc_feature (3321)..(3325): n is a, c, g, or t
  misc_feature (3327)..(3335): n is a, c, g, or t
  misc_feature (3337)..(3340): n is a, c, g, or t
  misc_feature (3342)..(3352): n is a, c, g, or t
  misc_feature (3355)..(3357): n is a, c, g, or t
  misc_feature (3359)..(3366): n is a, c, g, or t
  misc_feature (3368)..(3370): n is a, c, g, or t
  misc_feature (3372)..(3372): n is a, c, g, or t
  misc_feature (3374)..(3375): n is a, c, g, or t
  misc_feature (3377)..(3379): n is a, c, g, or t
  misc_feature (3381)..(3384): n is a, c, g, or t
  misc_feature (3386)..(3386): n is a, c, g, or t
  misc_feature (3388)..(3390): n is a, c, g, or t
  misc_feature (3393)..(3394): n is a, c, g, or t
  misc_feature (3396)..(3399): n is a, c, g, or t
  misc_feature (3401)..(3415): n is a, c, g, or t
  misc_feature (3419)..(3420): n is a, c, g, or t
  misc_feature (3422)..(3434): n is a, c, g, or t
  misc_feature (3436)..(3445): n is a, c, g, or t
  misc_feature (3447)..(3454): n is a, c, g, or t
  misc_feature (3456)..(3463): n is a, c, g, or t
  misc_feature (3465)..(3468): n is a, c, g, or t
  misc_feature (3470)..(3475): n is a, c, g, or t
  misc_feature (3477)..(3478): n is a, c, g, or t
  misc_feature (3480)..(3484): n is a, c, g, or t
  misc_feature (3486)..(3487): n is a, c, g, or t
  misc_feature (3489)..(3493): n is a, c, g, or t
  misc_feature (3495)..(3497): n is a, c, g, or t
  misc_feature (3499)..(3508): n is a, c, g, or t
  misc_feature (3511)..(3515): n is a, c, g, or t
  misc_feature (3517)..(3530): n is a, c, g, or t
  misc_feature (3532)..(3534): n is a, c, g, or t
  misc_feature (3536)..(3540): n is a, c, g, or t
  misc_feature (3543)..(3543): n is a, c, g, or t
  misc_feature (3547)..(3548): n is a, c, g, or t
  misc_feature (3550)..(3553): n is a, c, g, or t
  misc_feature (3556)..(3558): n is a, c, g, or t
  misc_feature (3560)..(3573): n is a, c, g, or t
  misc_feature (3575)..(3575): n is a, c, g, or t
  misc_feature (3577)..(3578): n is a, c, g, or t
  misc_feature (3580)..(3583): n is a, c, g, or t
  misc_feature (3585)..(3588): n is a, c, g, or t
  misc_feature (3590)..(3591): n is a, c, g, or t
  misc_feature (3593)..(3599): n is a, c, g, or t
  misc_feature (3602)..(3602): n is a, c, g, or t
  misc_feature (3604)..(3605): n is a, c, g, or t
  misc_feature (3607)..(3611): n is a, c, g, or t
  misc_feature (3613)..(3613): n is a, c, g, or t
  misc_feature (3615)..(3617): n is a, c, g, or t
  misc_feature (3619)..(3620): n is a, c, g, or t
  misc_feature (3622)..(3622): n is a, c, g, or t
  misc_feature (3624)..(3624): n is a, c, g, or t
  misc_feature (3626)..(3627): n is a, c, g, or t
  misc_feature (3629)..(3631): n is a, c, g, or t
  misc_feature (3634)..(3635): n is a, c, g, or t
  misc_feature (3637)..(3639): n is a, c, g, or t
  misc_feature (3642)..(3649): n is a, c, g, or t
  misc_feature (3652)..(3666): n is a, c, g, or t
  misc_feature (3668)..(3676): n is a, c, g, or t
  misc_feature (3678)..(3678): n is a, c, g, or t
  misc_feature (3680)..(3686): n is a, c, g, or t
  misc_feature (3688)..(3692): n is a, c, g, or t
  misc_feature (3694)..(3696): n is a, c, g, or t
  misc_feature (3698)..(3699): n is a, c, g, or t
  misc_feature (3701)..(3713): n is a, c, g, or t
  misc_feature (3715)..(3732): n is a, c, g, or t
  misc_feature (3734)..(3735): n is a, c, g, or t
  misc_feature (3737)..(3739): n is a, c, g, or t
  misc_feature (3741)..(3749): n is a, c, g, or t
  misc_feature (3752)..(3762): n is a, c, g, or t
  misc_feature (3764)..(3803): n is a, c, g, or t
  misc_feature (3805)..(3825): n is a, c, g, or t
  misc_feature (3827)..(3842): n is a, c, g, or t
  misc_feature (3844)..(3848): n is a, c, g, or t
  misc_feature (3850)..(3853): n is a, c, g, or t
  misc_feature (3856)..(3869): n is a, c, g, or t
  misc_feature (3872)..(3885): n is a, c, g, or t
  misc_feature (3887)..(3909): n is a, c, g, or t
  misc_feature (3911)..(3932): n is a, c, g, or t
  misc_feature (3934)..(3938): n is a, c, g, or t
  misc_feature (3940)..(3948): n is a, c, g, or t
  misc_feature (3950)..(3956): n is a, c, g, or t
  misc_feature (3958)..(3961): n is a, c, g, or t
  misc_feature (3963)..(4000): n is a, c, g, or t
ctttccatgccgatgatacttatgttccgcttgaaaagcaaaagcttatgatgaaaaccattcttcatcttcatgccaaagctaaggatatagttgctcagaatattccgctttccaagattcttaaccttggtctgtttgataagcttacaaagatgaagtatgatattcctaacagcaagcctgaaatgtttgacgattacattaaggaaattgacgaaaagcttgctgcaatttcttaataaggagggaacgcaataatgattatagattatgtaggcgttaaagaaattaacggctctcttatagttatggacggtgttaagggcgtttccaacgaggaaattgttgacattcgtcttgataacggtacaatgcgtcagggtcgtgtcgttcagattgagggcgaaagaatagttgttcaggtttttgagggtacaagaagaatcagccttaaaaacacaagaacaagacttacaggtcatcctatggagatgcctctttcccctgaaattatcggccgtgtacttgacggtgcgggcaaacctattgacggactcggagatattttccctgttaaaaaggctaatatcaacggtactcctatcaaccctgtttcccgtgtttatcctaaaaactacatcaacacnggtatttcaaccattgatacgcttatgactcttatcagaggtcagaagctgcctatcttctccggctcaggtatgaaacataatgaccttgccgttcagattgtaagacaggctaaaatcagcggtgcaaacagctctaacttcggtgttgtatttgccgcaatgggtgttcaaaaagatgttgcagaatactttaagaagagctttgaagaaagcggcgtactttcaagagttgtaatgcttttgaacctttcaaacgatcctatcattgaaagaactcttacaccgagatgtgctcttacaattgctgaatatcttgcatttgagcttgatatgcacattctcgttattatgaccgatatgacatcttatgccgaggctcttcgtgagttctcgtcatcaaaaggtgaaattccgggcagaaagggttaccccggctatctttattctgaccttgcatcactttatgagcgtgcaggtatgattaaaggtcacaacggttctgttacacagattccgattttgacaatgcctaacgacgatattactcatcctatccccgaccttacaggttacattacagagggacagattgttcttgaccgttcacttcagggacagggattgtatccgcctgttaatgttcttccttccctttcccgtcttatgaaggacggtatcggtgagggttatacaagagccgatcaccagcctcttgcaaaccagcttttcgcttcttatgcaaaggtaattgacgcaagatcgcttgcatctgttatcggtgaagaggagctttctcctactgataagaagtacattgagtttggcagattgtttgaatcaaagttcgttaatcagggctttaatgaaaacagaagtattgaacagagtcttgaccttggttgggaattgctttcaacattgccgagagcagaacttgaccgtgttgacgatgctttacttgatcagtactataagggtgacaaataatcgtttgaagaaaggagtgtgagcatttatggcagtacagacagtacctaccaagggtaatcttatgaatactaagaaatcccttgcactcgccaaaaacggctatgaactgttggacagaaagcgtaacattctcatcagagaaatgatgacgcttatcgaccatgcaaacgcaatccagcagaaaattgatgacgcttatgcagaggcttacacagcacttcaaacggcaaatgttaccaacggcttttgtgaagatatttctaacgctattccctatgagaacggcttgaagcttgattcaagaagtgttatgggtgttgaaattccgattctcactattgaggaacgagaggaccatnactacctacactacggtctgcgcacaacaaattcggcaattgataaggtttatacnaaatttaccgaagttaaaaatcttacagttgagcttgccgagattgagaacagcgtttaccgccttgccgattcaatcaagaaaactcagaagagagcaaacgctctcaagaacattatgattccccgttttgaggaaacagttaagttcatttccgacgcacttgacgaaaaggatcgtgaggaattcagccgactcaaggtaatcaagaagaaaaagcaaaaagatgctgctttgaaaaaagctaaagaattaagtgctgaaagcgcataaattatcagcccgaccgtaatttggnngggnnnttttaannnnnnannnnaanaaaannnnnggnnnnnnnntttnnncnanncnnttnnnttttnnntttnnnnnttnnnnnntnnttnnnttttnnttnnnnnnnnnnnanttncnnnnnnnnnnnntnnnnnnnnannnnnnannnaannnnnnnnnnnnnnnnannnnnannnnnnnntnnnnnnntnnnnannannantnnnnnnnnnnnnnnnnnnnnntttnnttgnnnnnntnnnnnnnnnnnnnnnttntnngnnnnannnnnnnnnnnnnnnncnnnnnnnannnnnnnnncnnnnnnnncnnnnannnnnnnnncnnnnnnnntnnnnnnnntnnnnnnnnnnanannnnnnaannnnnnnnnaannnnnnnnnannannannnnnnnnnntnnannnnanttnnnnnnannnnnnnttngnnnnannaanannnaannnnnnnanaananaaaaanannannnannnnnnttnnntttnttntnntntncnnntnnnntttnnnnnannnnnnnnnnnnnnnntttnnnnntnnnnnnnnnnnnnnntnnnttnnnnnntnntnnntnnnntnnnnnnnnntgnannnnnnntnnnntnnnnnnanannannnnnnannnnnnnntnnaaannncnnnncnnnnnnnnnnnnnnnnnncnnnngnntnnnnngnnnnnnnnngnnnnnnnnnntnnnnntnnccnnannncacnncnnnnnnnnncnnnnnnncnnnnnnnnnnnnnnnnnnnnnnnnnannnaannnnnntnnnnnnnnncnntnnnnnnnnnnnnnnnnnatntnnnntnntnnnnntnntttnnntnntnnnaanttannntttananaannnnnnnnnantnnnnnnnnnnnnnnnnnntnnngnnnnnnncnnttnnnnntnngnncnnannnnntntnncnnnnnnnaannnnnncnnnnntnnnnncnnnnnnnnnannnntnnnnnnnnnnngannntnnnnnnnntnnntncnntnnnannnncntnnnttnngnnnncnnnnnnnnnnnnnnnaaannannnnnnnnnnnnncnnnnnnnnnnannnnnnnnannnnnnnnannnnannnnnnannannnnnanntnnnnntnnncnnnnnnnnnnttnnnnnannnnnnnnnnnnnntnnntnnnnncanattnngnnnnaannncnnnnnnnnnnnnnntncnncnnnncnnnntnncnnnnnnnttnanntnnnnnantnnntnnanantnntnnnttnnannnttnnnnnnnnaannnnnnnnnnnnnnngnnnnnnnnntngnnnnnnngnnnnntnnntnntnnnnnnnnnnnnngnnnnnnnnnnnnnnnnnntnntnnntnnnnnnnnnaannnnnnnnnnntnnnnnnnnnnnnnnnnnnnnnnnnnnnnnnnnnnnnnnnnannnnnnnnnnnnnnnnnnnnntnnnnnnnnnnnnnnnnannnnngnnnnttnnnnnnnnnnnnnnaannnnnnnnnnnnnngnnnnnnnnnnnnnnnnnnnnnnnannnnnnnnnnnnnnnnnnnnnntnnnnncnnnnnnnnntnnnnnnngnnnncnnnnnnnnnnnnnnnnnnnnnnnnnnnnnnnnnnnnnn

SEQ ID NO: 947 - DNA, 4000 bp, Escherichia coli
  misc_feature (55)..(55): n is a, c, g, or t
  misc_feature (137)..(137): n is a, c, g, or t
  misc_feature (334)..(334): n is a, c, g, or t
  misc_feature (349)..(349): n is a, c, g, or t
  misc_feature (367)..(367): n is a, c, g, or t
  misc_feature (466)..(466): n is a, c, g, or t
  misc_feature (589)..(589): n is a, c, g, or t
  misc_feature (614)..(615): n is a, c, g, or t
  misc_feature (741)..(741): n is a, c, g, or t
  misc_feature (754)..(754): n is a, c, g, or t
  misc_feature (867)..(867): n is a, c, g, or t
  misc_feature (1924)..(1924): n is a, c, g, or t
  misc_feature (1987)..(1987): n is a, c, g, or t
  misc_feature (2150)..(2150): n is a, c, g, or t
cttgacgaaatagacgaacttgacgactttgagtacattgatgaataagcccganttacattattatgagcttgcaagcaatgtcgttgccttctcatctacacggtacggaggcgtgagcaaaggcaattatgctnctttcaacattaataaatattgcggtgatgtgccagaagacatagaacaaaaccgcagaaacttagccaacagtttaggaattgatattgacaagcttattgttccacaccaaattcacggtgattgttcacaaatcattgcccacgaatattttaatttgcctgcaaacattcgtgaacaaattatagaaggtgtngatgcggtaatgacnaatgagccagacgtttgnatcggagtatcgactgccgattgcattcctgttctattatacgataccaagcaccatgctgccgccgcaatacatgcaggttggcgtggaacagcgaancatatagtgcagaaaaccatcagggagatgggcattgtctaccaaaccaaaccgcaagaactgcgagcagtgattggtccaggcatctctttgcagaacttcgaagtaggcgatgaagtctangaacagtttgccaatgcgcaattcnntatggaacgaattgccaaacgctttcgtgttttgcaaactaaagagggagaactccctttgaaatggcatttagatttgaagctttccaaccgtatagatatggaaacaatgggtattctgccgcnaaatataattgangagaaaatctgtacctacgataatacaagcgattacttctctgctcgtaagctcggaataaactctggacgtatctataacggaattatattgaggtaagaagtatttccttncccatttattctattgttttgccacgaccgtaaaactattcttggcgtgccaaacggtttctgttatatattcaaagtacctctaatatattaaggtgtaagcaaaccgcttacactaagccgctgagctgtgctttcaattcttttagctggtcgcgtaccgacatcaggctctcaagcactttctgactcttatcggcaccactgcggttctcttgcaacatttttcttgctgcagctatcttaaatccacgcacttttacaagattgtagataatctttatatgctcaatatctttaacggtatactgtcggacacggtttcctgtggtcttggggcggagatggggaaattctgtttcccagtaacgaagtaaactttccgacacacctatcatctgtgccacctccttaatggaataatatagtttgcgcgaattatctgccatagcttaatcaatctacaattcgtttgcaaaaatagtgaaaagtcagtatctttgcaacacttttagatgaattttataaaataaagtatatgaaaatgatgactgcgaatgaaatccgcgactctttcaagaagttctttgagtcgaaaggacatgtcattgtaccgtccgcgccaatggttatcaaggacgatccaacgctaatgtttaccaacgctggtatgaaccagtggaaagatataatacttgggacgaaagatccggagccacgccgccgtacagactcacagaaatgtttgcgtgtaagtggcaaacacaacgacttggaagaggttggacacgacacttaccaccatacaatgtttgaaatgctcggcaactggagctttggagactacttcaaggaaggtgccatcgactatgcgtgggagtatttggttgatgttctgaagttaaatccagccgatctgtatgttacagtgttcgaaggcagtcctgaagatggtattcctcgcgatgacgaagctgccaaatactgggctaaacacctaccggcagaccacattatagatggaaacaagcacgacaacttctgggaaatgggcganacaggtccgtgcggtccatgttcggagatacatgtagactctcgcagcaacgaagaaaaggcncaaatacccgggcgtgaacttgtaaacaaagacaacccgcaggtgattgagatatggaacatcgtcttcatgcagttccaacgcaagtccgacggttcgctctcacccctttcaatgcacgtcatcgacacgggtatgggcttcgaacgccttgtacgcatgntgcagggaaagaactcaaactacgacaccgacatcttccagcctaccattaaggagatagaacgcctgagcggaaagaagtacggcttcactacgccatcgggcaagaacggagaagcgaagaccgaacaagagaagatagacattgcaatgcgcgttattgccgaccacatgcgtgccgttgccttctcgattgccgacagccagttgccgggcaacgcgaaagcaggctacgttatccgccgtatcttgcgccgtgccgtgcgctatgcctacactttcttgaaccagaaagaggcgtttatttacaagttgctcaacacgtttatccacgaaatgggtggtgcttatcccgaacttacggctcagcgcgagcttattgtccgagttattaaggaagaggaagactcgttcctgcgcactttggagaagggtatcaaccttttaaccaacacaatggacgaaatgaaagcgcaaggaaagaccgaactcagcgggaaagaggcgttccgcctgttcgatacctacggtttcccactcgatttgactgaattgatttgtcgcgaacacggcttcagtgtagacgaaaggcagttcgaggaagaaatggcacagcaaaaggcacgtgcccgcaatgctgcagctgtggaaaacagcgactgggtggtactgcgcgagggcgaacaaaagtttgtcggctacgactacaccgaatacgaatgccacattctgcgttacagaaaggttacccagaagaagaatactttctatgaattggtgttggaccacacgccattctatggcgagatgggtggacaggttggcgaccagggagtcttggtaagcgaagacgagaccatcgacattgtggatacgaagcgagagaataaccaaagcattcatatagtaaagcaactgccaaagaatgtggaggcagactttatggcgtgcgtagacaccgacaagcgcgacgcatcggctgccaaccatactgcaacccacttgttagactatgcgctgaaacaggtgctgggggagcattgcgaacaaaagggttcgtacgtcagtccagacactttgcgtttcgatttctcacacttccagaaggtaaccgacgaggaactacgccaggtagagcgtcttgtgaacgacatgatacgtcaggacttcccatgcggagagtatcgcgacacaccgttggaggaagctaaggaaatgggagcggtggcactgttcggcgaaaagtatggcgacaaggtgcgtgtcattaagtttgggccgtcgtgcgagttctgtggcggcattcacgctacgtccacagggcgcataggcttcttcaagataatcagcgagagcagcgtggctgcaggtgtccgccgtatagaagcgcttaccggcaagcgatgcgaggagactatctacctgctcgaagacaccgtacgcgatttgaaggcgatgttcaacaatgcaaaagacttgcgtggcgttgtagagaaatacattcaggagcacgatgcaatgaggaaacagatggagaacttccgtcagcaaaccgttgcccgcctcgcaaacagcttggtggaaggtgccgaaaccgtgaatggagtgaaagtagtgaaggctgtgctgcccgtggaacctgcttcggcaaaagacatcgtctttaaagtgcgtgctgcaatccccgaaaagctcgtctgcgtattgggttccacctacgaaaacaagccgttgctctccattatgctgagcgatgacatggtgaaagaccacgacttgaacgccgggacgattatccgcgaagctgcaagactgataaaaggcggcggaggcggacagccacactatgca

SEQ ID NO: 948 - DNA, 4000 bp, Escherichia coli
  misc_feature (2344)..(2344): n is a, c, g, or t
tgctactttaactgaaggtaagttaaatgttgtaaagttagtcagttcatctgtttgatttgcaagtttactccaactaacacctccatttgtagaatactgataaaataaccttgctggcttgtatggttccatatgggttacagttgtatcttcaaacttgaattctacttgacccttattttcgagacatgttaactgtgttgttgtaagagtaactggttggacgtcgttgctatcacaatcagggtcggcagctactgtaatagttgaataatttccagtaaagttttgcatatatttttgtgatgtgttacttgaataatatctatatctaatttgatactcgtgtgatgagtcaagcaagataacaccagagacagactggcttgtcatgttaaagtaatgcggcttccagtatccaaaatatgtagcttcatcaccaccaaaaccaccataattatggtttttgggccagtaattactttgttctgaatactgcatttgtccaaaaggtttccaggaatttccatcatgtgaaatctcaacttgaaagtgaacatgcgtggcattgcttacgctactacgtctcttgagtttcaattcaaatttatcagggccatatgcactacaagatacataatcagtttggaagtaaatagggtcatcacttgaatcgccgactgaaaccccacagtcaatagttattggtgttgcttcaacagcagtgtagtaagaaccacctgtagtaccttctatatgatacttaattgttactatgtctccatcgccataggttccaaacagattgataggacttgtcccagaagtacccataagcgtagccgttctctcaactgaatatgctccgtcatttacttttatttgatagattatgtaattagctctagtggtgtttccactataagtaattctaattgtttgttcattgttataacaggtgctcgctgcgtgtaattgggagaaactatgagatgtaatatcgtttgcacaatcaacaagaagagttcctgtagtagtaaagcttccactagtaacaggtgaagtagcagcatacctatacctcatggcaatagttgttccctggggaactgtatcttgaatagtaaaagttttaacttcaccaggaagtagcatcttgtaaatcactgcattgccattactggcatcatagaatgcctcattccatgtggtgcccaaatcagttgagtactgtacgtgaaaataacctgatgcccaaccgttgttgcccactgtaatagatggtttagaaccaccagagacacaagtacctaaaccaatagtcgctgtagttgcgcctactgtaggacagttcactgttcttactgctgagtagtacagttttgagttagtaaaattaccacttgtgtaagaaaacttaaacttatactgcactgttcctgcgtggttgacagttgaagaatctgtatatgaggtgcctactgcaagattagtctcaatatcagtccaggtacttccaccatccgtcgtttttgcaaggtacagataatactgcgtaccagcaggtcttgtgacagtaaatgttgcagttgcaaatcctcctgtttctaaagtattttgacactccccaatagtgacaagatcgctgtacgtatcatcagtagaatcagtagttgtcgctgtcccccatccagtagtggtgatgactggatcacaatttgttgtacgttgttcaacagttttattgtaatttccaaaaacaatccaatctgttgaggcaagttcatctgcactgtatgtaactttatatctaattttcattatggagccagataatgcccgagttgaaagataaatataatctttattgccgctttgctcctgatttatatagtttgttgtttgaactgccgtatagccatctgttgccagacttccagtaacactattgtcagtaactgcattattatcgttataactatccgtattattgaccttgtagaataagtcatttttagtccacgtagaaccattatcaagagagatttcaaatgcataccacaatgctgttctattgatgtcgctatagtttgagttatataatacccaacccatccactgtttattatcaacacagctgtttactacattggatgcttccgtttcatactgatacgactgatttgctgggttaatatttaaatcacaatcgtgatgcctactaattccatttgatggggaagttaaatattgatattcgtaaatacttgaattccatgaagggttttcagtgtaggacttctgaatcctccaatgcatatacgagtctgcttcgtttgtntatgtttttgctcctgctgtataggttaaagtttgaccagcggcaatggaaaatgttgttgtatcagtactgaggtagccagacgagctggtggaggaggagccggcgcctacttttgaaggagtcaccttaaaatacactgtctctgactcgttgttggtaagaattaaagtagaggtttggcctgcagaactacacgctgtcacttcataacttgctgtaactgatggggtgcagtcgttgtattgatggtttgtgtacttataagggtacccagatgtattagaccaatcaggattctcaatataagaaccttgtacaatccactgcatataaccttcagtatcatcagggtatagttttctcatgtttgggctatttgtagcatcatatgttagagtttccccagcagggactgaaaaagttattgcactggaccaatctatgtagtttgaagagttttgattgacattattagatgtagttaaagtaggtgccgctttgaagtacaacgtctgtgcttcattattagttacagaaagtgttgagtatcttccaacagaggaacaggtactaaaagttgctgactgtgtaaaatcggcaacacagttggcttgtttactaaagactgcccatgcagcgtttgctgtggaatctgtagggtttgcctcagcaacacgatatctgaaatatcctgttgaagatgaggaaatggttactggtgatgaaaaagtaagggattgagcatcggcaatggcctgtccgtctacgacctctgtccaggtaacattatctgtagaaaactctacatcaataaaaccaccgtaactatcgttgcttgcattaaagttagttactgtaagccttattgttgcgttaccagagccatcacagatttgagaagtgctttgattgattaaagaataattactactgctatttgttgattctccaccattgccccaccagttgcaatctacagcgctacttgcagtccatcgaatccaggaatctcctgattttagataatttccacgatatcttgaagtgaatgttccttcaacattacttgaactatgtaaatctgttggataataaacaaggtaactagttccgtacaccattttaaattctggtgtaactccgtgatatacatctgttgtaaatgtatatgttccaccagcactgataggtctattttgatcctgccatgaaaattgagaacttcctcttgtgttacgtcttgctacagcaaactccattgacgtatttccagtatttgttactgtcaccgtatatgacatcttgtcttggttacatgtactgttcgtggttgcagtaatagtacctgtatatgttttacaatcaatagttctactcgcagctgatgtgaacccagtcgtagctgatgggtttgcatctgccacaatatactgaaaataaactgtctgagcatttgctactggggatggcatactgatagtctctggtgttcctgagacaactaactcaccatctataaaggttatccaagtaccacttgagccaatcttgtactgcacatcaaaatatgcattaactgttcctgtgttggttagggtgactgtaggtgttgaagaaccaccactacaagttcctggagccgtatcaactgta

SEQ ID NO: 949 - DNA, 4000 bp, Escherichia coli
  misc_feature (2867)..(2867): n is a, c, g, or t
  misc_feature (2879)..(2879): n is a, c, g, or t
  misc_feature (2891)..(2891): n is a, c, g, or t
  misc_feature (2909)..(2909): n is a, c, g, or t
  misc_feature (2911)..(2911): n is a, c, g, or t
  misc_feature (2913)..(2914): n is a, c, g, or t
  misc_feature (2920)..(2920): n is a, c, g, or t
  misc_feature (2924)..(2925): n is a, c, g, or t
  misc_feature (2927)..(2934): n is a, c, g, or t
  misc_feature (2939)..(2940): n is a, c, g, or t
  misc_feature (2942)..(2942): n is a, c, g, or t
  misc_feature (2944)..(2945): n is a, c, g, or t
  misc_feature (2947)..(2947): n is a, c, g, or t
  misc_feature (2949)..(2949): n is a, c, g, or t
  misc_feature (2951)..(2951): n is a, c, g, or t
  misc_feature (2953)..(2954): n is a, c, g, or t
  misc_feature (2959)..(2959): n is a, c, g, or t
  misc_feature (2963)..(2963): n is a, c, g, or t
  misc_feature (2965)..(2965): n is a, c, g, or t
  misc_feature (2967)..(2967): n is a, c, g, or t
  misc_feature (2969)..(2971): n is a, c, g, or t
  misc_feature (2974)..(2975): n is a, c, g, or t
  misc_feature (2978)..(2978): n is a, c, g, or t
  misc_feature (2980)..(2980): n is a, c, g, or t
  misc_feature (2983)..(2983): n is a, c, g, or t
  misc_feature (2985)..(2986): n is a, c, g, or t
  misc_feature (2988)..(2989): n is a, c, g, or t
  misc_feature (2992)..(2993): n is a, c, g, or t
  misc_feature (2996)..(2998): n is a, c, g, or t
  misc_feature (3002)..(3006): n is a, c, g, or t
  misc_feature (3009)..(3012): n is a, c, g, or t
  misc_feature (3014)..(3014): n is a, c, g, or t
  misc_feature (3016)..(3017): n is a, c, g, or t
  misc_feature (3021)..(3021): n is a, c, g, or t
  misc_feature (3025)..(3025): n is a, c, g, or t
  misc_feature (3027)..(3027): n is a, c, g, or t
  misc_feature (3029)..(3030): n is a, c, g, or t
  misc_feature (3033)..(3035): n is a, c, g, or t
  misc_feature (3037)..(3038): n is a, c, g, or t
  misc_feature (3041)..(3041): n is a, c, g, or t
  misc_feature (3044)..(3044): n is a, c, g, or t
  misc_feature (3047)..(3054): n is a, c, g, or t
  misc_feature (3060)..(3061): n is a, c, g, or t
  misc_feature (3065)..(3066): n is a, c, g, or t
  misc_feature (3069)..(3070): n is a, c, g, or t
  misc_feature (3076)..(3076): n is a, c, g, or t
  misc_feature (3080)..(3081): n is a, c, g, or t
  misc_feature (3085)..(3086): n is a, c, g, or t
  misc_feature (3088)..(3088): n is a, c, g, or t
  misc_feature (3091)..(3091): n is a, c, g, or t
  misc_feature (3093)..(3095): n is a, c, g, or t
  misc_feature (3098)..(3098): n is a, c, g, or t
  misc_feature (3101)..(3101): n is a, c, g, or t
  misc_feature (3103)..(3103): n is a, c, g, or t
  misc_feature (3105)..(3106): n is a, c, g, or t
  misc_feature (3109)..(3112): n is a, c, g, or t
  misc_feature (3115)..(3115): n is a, c, g, or t
  misc_feature (3117)..(3117): n is a, c, g, or t
  misc_feature (3120)..(3121): n is a, c, g, or t
  misc_feature (3123)..(3123): n is a, c, g, or t
  misc_feature (3125)..(3125): n is a, c, g, or t
  misc_feature (3129)..(3134): n is a, c, g, or t
  misc_feature (3137)..(3137): n is a, c, g, or t
  misc_feature (3141)..(3143): n is a, c, g, or t
  misc_feature (3145)..(3146): n is a, c, g, or t
  misc_feature (3148)..(3148): n is a, c, g, or t
  misc_feature (3150)..(3150): n is a, c, g, or t
  misc_feature (3153)..(3157): n is a, c, g, or t
  misc_feature (3161)..(3162): n is a, c, g, or t
  misc_feature (3169)..(3169): n is a, c, g, or t
  misc_feature (3172)..(3177): n is a, c, g, or t
  misc_feature (3185)..(3186): n is a, c, g, or t
  misc_feature (3189)..(3191): n is a, c, g, or t
  misc_feature (3193)..(3194): n is a, c, g, or t
  misc_feature (3196)..(3197): n is a, c, g, or t
  misc_feature (3199)..(3199): n is a, c, g, or t
  misc_feature (3203)..(3203): n is a, c, g, or t
  misc_feature (3205)..(3207): n is a, c, g, or t
  misc_feature (3209)..(3209): n is a, c, g, or t
  misc_feature (3211)..(3219): n is a, c, g, or t
  misc_feature (3221)..(3221): n is a, c, g, or t
  misc_feature (3225)..(3227): n is a, c, g, or t
  misc_feature (3229)..(3229): n is a, c, g, or t
  misc_feature (3231)..(3233): n is a, c, g, or t
  misc_feature (3236)..(3240): n is a, c, g, or t
  misc_feature (3242)..(3244): n is a, c, g, or t
  misc_feature (3246)..(3251): n is a, c, g, or t
  misc_feature (3253)..(3253): n is a, c, g, or t
  misc_feature (3256)..(3256): n is a, c, g, or t
  misc_feature (3260)..(3261): n is a, c, g, or t
  misc_feature (3263)..(3269): n is a, c, g, or t
  misc_feature (3278)..(3284): n is a, c, g, or t
  misc_feature (3287)..(3288): n is a, c, g, or t
  misc_feature (3290)..(3294): n is a, c, g, or t
  misc_feature (3296)..(3296): n is a, c, g, or t
  misc_feature (3299)..(3300): n is a, c, g, or t
  misc_feature (3302)..(3302): n is a, c, g, or t
  misc_feature (3307)..(3307): n is a, c, g, or t
  misc_feature (3310)..(3310): n is a, c, g, or t
  misc_feature (3314)..(3314): n is a, c, g, or t
  misc_feature (3316)..(3318): n is a, c, g, or t
  misc_feature (3322)..(3322): n is a, c, g, or t
  misc_feature (3324)..(3324): n is a, c, g, or t
  misc_feature (3328)..(3329): n is a, c, g, or t
  misc_feature (3334)..(3334): n is a, c, g, or t
  misc_feature (3337)..(3337): n is a, c, g, or t
  misc_feature (3341)..(3342): n is a, c, g, or t
  misc_feature (3344)..(3346): n is a, c, g, or t
  misc_feature (3349)..(3350): n is a, c, g, or t
  misc_feature (3353)..(3353): n is a, c, g, or t
  misc_feature (3355)..(3358): n is a, c, g, or t
  misc_feature (3360)..(3363): n is a, c, g, or t
  misc_feature (3365)..(3365): n is a, c, g, or t
  misc_feature (3367)..(3370): n is a, c, g, or t
  misc_feature (3373)..(3373): n is a, c, g, or t
  misc_feature (3375)..(3375): n is a, c, g, or t
  misc_feature (3377)..(3377): n is a, c, g, or t
  misc_feature (3379)..(3380): n is a, c, g, or t
  misc_feature (3382)..(3384): n is a, c, g, or t
  misc_feature (3387)..(3387): n is a, c, g, or t
  misc_feature (3389)..(3390): n is a, c, g, or t
  misc_feature (3392)..(3392): n is a, c, g, or t
  misc_feature (3394)..(3395): n is a, c, g, or t
  misc_feature (3397)..(3400): n is a, c, g, or t
  misc_feature (3402)..(3403): n is a, c, g, or t
  misc_feature (3405)..(3406): n is a, c, g, or t
  misc_feature (3408)..(3409): n is a, c, g, or t
  misc_feature (3411)..(3412): n is a, c, g, or t
  misc_feature (3414)..(3416): n is a, c, g, or t
  misc_feature (3419)..(3419): n is a, c, g, or t
  misc_feature (3421)..(3421): n is a, c, g, or t
  misc_feature (3424)..(3424): n is a, c, g, or t
  misc_feature (3426)..(3426): n is a, c, g, or t
  misc_feature (3428)..(3428): n is a, c, g, or t
  misc_feature (3436)..(3436): n is a, c, g, or t
  misc_feature (3438)..(3438): n is a, c, g, or t
  misc_feature (3440)..(3442): n is a, c, g, or t
  misc_feature (3444)..(3444): n is a, c, g, or t
  misc_feature (3446)..(3448): n is a, c, g, or t
  misc_feature (3453)..(3457): n is a, c, g, or t
  misc_feature (3460)..(3460): n is a, c, g, or t
  misc_feature (3464)..(3471): n is a, c, g, or t
  misc_feature (3476)..(3478): n is a, c, g, or t
  misc_feature (3480)..(3480): n is a, c, g, or t
  misc_feature (3484)..(3488): n is a, c, g, or t
  misc_feature (3490)..(3493): n is a, c, g, or t
  misc_feature (3497)..(3500): n is a, c, g, or t
  misc_feature (3502)..(3508): n is a, c, g, or t
  misc_feature (3511)..(3513): n is a, c, g, or t
  misc_feature (3515)..(3515): n is a, c, g, or t
  misc_feature (3520)..(3520): n is a, c, g, or t
  misc_feature (3522)..(3523): n is a, c, g, or t
  misc_feature (3525)..(3525): n is a, c, g, or t
  misc_feature (3530)..(3545): n is a, c, g, or t
  misc_feature (3550)..(3555): n is a, c, g, or t
  misc_feature (3557)..(3563): n is a, c, g, or t
  misc_feature (3565)..(3567): n is a, c, g, or t
  misc_feature (3570)..(3574): n is a, c, g, or t
  misc_feature (3576)..(3593): n is a, c, g, or t
  misc_feature (3597)..(3598): n is a, c, g, or t
  misc_feature (3600)..(3602): n is a, c, g, or t
  misc_feature (3604)..(3607): n is a, c, g, or t
  misc_feature (3609)..(3610): n is a, c, g, or t
  misc_feature (3613)..(3613): n is a, c, g, or t
  misc_feature (3615)..(3616): n is a, c, g, or t
  misc_feature (3618)..(3618): n is a, c, g, or t
  misc_feature (3621)..(3623): n is a, c, g, or t
  misc_feature (3627)..(3627): n is a, c, g, or t
  misc_feature (3630)..(3634): n is a, c, g, or t
  misc_feature (3638)..(3639): n is a, c, g, or t
  misc_feature (3643)..(3646): n is a, c, g, or t
  misc_feature (3648)..(3648): n is a, c, g, or t
  misc_feature (3650)..(3650): n is a, c, g, or t
  misc_feature (3652)..(3652): n is a, c, g, or t
  misc_feature (3654)..(3659): n is a, c, g, or t
  misc_feature (3661)..(3661): n is a, c, g, or t
  misc_feature (3664)..(3666): n is a, c, g, or t
  misc_feature (3668)..(3668): n is a, c, g, or t
  misc_feature (3671)..(3672): n is a, c, g, or t
  misc_feature (3675)..(3675): n is a, c, g, or t
  misc_feature (3677)..(3678): n is a, c, g, or t
  misc_feature (3680)..(3680): n is a, c, g, or t
  misc_feature (3687)..(3687): n is a, c, g, or t
  misc_feature (3689)..(3694): n is a, c, g, or t
  misc_feature (3696)..(3698): n is a, c, g, or t
  misc_feature (3700)..(3703): n is a, c, g, or t
  misc_feature (3708)..(3709): n is a, c, g, or t
  misc_feature (3712)..(3712): n is a, c, g, or t
  misc_feature (3714)..(3718): n is a, c, g, or t
  misc_feature (3720)..(3720): n is a, c, g, or t
  misc_feature (3724)..(3726): n is a, c, g, or t
  misc_feature (3728)..(3728): n is a, c, g, or t
  misc_feature (3730)..(3730): n is a, c, g, or t
  misc_feature (3732)..(3734): n is a, c, g, or t
  misc_feature (3737)..(3752): n is a, c, g, or t
  misc_feature (3754)..(3754): n is a, c, g, or t
  misc_feature (3756)..(3764): n is a, c, g, or t
  misc_feature (3767)..(3771): n is a, c, g, or t
  misc_feature (3773)..(3778): n is a, c, g, or t
  misc_feature (3780)..(3781): n is a, c, g, or t
  misc_feature (3783)..(3783): n is a, c, g, or t
  misc_feature (3786)..(3790): n is a, c, g, or t
  misc_feature (3793)..(3793): n is a, c, g, or t
  misc_feature (3796)..(3796): n is a, c, g, or t
  misc_feature (3798)..(3799): n is a, c, g, or t
  misc_feature (3801)..(3803): n is a, c, g, or t
  misc_feature (3805)..(3814): n is a, c, g, or t
  misc_feature (3816)..(3821): n is a, c, g, or t
  misc_feature (3823)..(3833): n is a, c, g, or t
  misc_feature (3835)..(3842): n is a, c, g, or t
  misc_feature (3844)..(3845): n is a, c, g, or t
  misc_feature (3847)..(3851): n is a, c, g, or t
  misc_feature (3853)..(3861): n is a, c, g, or t
  misc_feature (3863)..(3865): n is a, c, g, or t
  misc_feature (3868)..(3870): n is a, c, g, or t
  misc_feature (3872)..(3872): n is a, c, g, or t
  misc_feature (3876)..(3877): n is a, c, g, or t
  misc_feature (3880)..(3881): n is a, c, g, or t
  misc_feature (3884)..(3887): n is a, c, g, or t
  misc_feature (3892)..(3893): n is a, c, g, or t
  misc_feature (3896)..(3899): n is a, c, g, or t
  misc_feature (3902)..(3902): n is a, c, g, or t
  misc_feature (3904)..(3904): n is a, c, g, or t
  misc_feature (3906)..(3907): n is a, c, g, or t
  misc_feature (3909)..(3911): n is a, c, g, or t
  misc_feature (3913)..(3915): n is a, c, g, or t
  misc_feature (3917)..(3917): n is a, c, g, or t
  misc_feature (3919)..(3920): n is a, c, g, or t
  misc_feature (3922)..(3925): n is a, c, g, or t
  misc_feature (3927)..(3928): n is a, c, g, or t
  misc_feature (3930)..(3930): n is a, c, g, or t
  misc_feature (3933)..(3935): n is a, c, g, or t
  misc_feature (3939)..(3941): n is a, c, g, or t
  misc_feature (3945)..(3945): n is a, c, g, or t
  misc_feature (3947)..(3947): n is a, c, g, or t
  misc_feature (3949)..(3951): n is a, c, g, or t
  misc_feature (3953)..(3953): n is a, c, g, or t
  misc_feature (3955)..(3956): n is a, c, g, or t
  misc_feature (3959)..(3962): n is a, c, g, or t
  misc_feature (3965)..(3965): n is a, c, g, or t
  misc_feature (3967)..(3969): n is a, c, g, or t
  misc_feature (3972)..(3973): n is a, c, g, or t
  misc_feature (3975)..(3977): n is a, c, g, or t
  misc_feature (3983)..(3983): n is a, c, g, or t
  misc_feature (3986)..(3987): n is a, c, g, or t
  misc_feature (3991)..(3994): n is a, c, g, or t
  misc_feature (3998)..(3998): n is a, c, g, or t
  misc_feature (4000)..(4000): n is a, c, g, or t
ttaaaagttctttttcagttgttaactttgaaatattccataaataaattatacctttatgcttatgtttgtgatcattattattacttttatttgacttatcagaatttttcttttttgaattaataccaatattatccttgtgatcatttttattgtaagccattaaatcatttttatcatgatttttatttttttttatcgtaatatttttagtatcatctttaattttatttttaccactaattacagtattatcttcattattaatttcattattaatttcatcgttggatttaatattgatacttgaatttatgtttaaatttatatttgaattagttttaatgaaagattcatcattaatatatatattactgcttgaatcagtttcaatattagatctaatattattatctgtattaatggttgattgagttttgatgtttgattcacttttattacttgaatcaatatttgaactagtttcaatattaaatttaatattagtatccgtttcaatgtttgaattcgtttcattaattgctgtattatcatcagtaaagaattccttagtaatttcaatattggattcattatcaggtttatcatcatttttaacgattgtttcattatcaatgtcagtattgttattatcatttttaatacctttcataatttttgtatcattttttgccattgtattaatatctattgtatttatttctttttctttattttcaatattatattttatattattttgtttttctttattttggtctttcacatctaaattatcattattaggtttaggtatatttgtcttaaggatacaagagctatcaattttttcattgatattagattttagattattattatttaatttaatattcgtttttaaatttttattattaatatttgaattaattttggaattaaaatcaatttcaatattaatgtttttattactttcattgcttgctattgctttttcatttatttcattatgaacattttctactacgtcatttacaacttttaaatcattttttaatttagaatcttctttaacaattattaatttattaatttcttcaatactatctattgtaatatttctatcattttcaatcttattaccatttctactactcttagtttctaaattaaatatatcaataacattttcttcaatagtatttgtttcattatcagggatggaatttatttcattagaagatgttttatcttttttaacagaagtttctgaaataatattatcaatattagcatttttactattaatttcttcattttctttatttattatatcttcatttttattccttaaagaattttttttttgattcttatctgtatttttatcgtttaaatcatttttatctttaattacgtttaattttgtttttctgacagaataaatattgtcaatctccttagtaaaattggtttcaattagttttgattgtgattttggggaagatggttcacttaatgatttttttaaattattcttagtatttggattattctgtacaagattatttaatgaatttgctcttgatatacttcgaaaagattcctctaaattttttatcctgcttataattttattattagatgatatatatttttttatattatttttatcattttttttcttatttctatttttattcttattcttaaatttcttggataatttaccaatcttcatattacttatcacttgaatttttatatataatttatatttctttaatcaattaaaataattataccttattacttttaaacttgtattttaatttatttattactattttttttaatactaaattaagaagttatgagctttctttaaatttctttaaaatataaaatttatttaatttaatattgtattatcttcataacataaataatatatatataactttaaaaaaaaaaaaaaaatcaaaaatcaaaaatcaaaaaatactttatttatatatttaataattaattaactttaaatttttattaaattttaaatgaaaaaattattcaacaatttaaaaaatatttttttatatatgtatactttattctctaaaaaatataattggactaaattctattaaaaaacattattttcgttttatatgtttttttaatgttaatttaaagaactacaaaaccattttgaaacactaattatcgaagcaaaaattttagtgtttattaaaaaaaataataaaaagtactattataataaataaaatgaaaatgatcttttataatatttttaagcattaaaaaataattaaaaaaaaaaagaaaaattattgtatctttaaaataaaaataattaaaataattaaaatttgatataaaatgcttttaaataattgatataaacttgaaatatattatctgaaatatattaatactcaaaaaaatatttattattttaattaagaataaatttcaacaaatttcaagtttaactgtaaagatattattagtaatatgtataataccaaagacggaaattatatttattcataaacaataatattaatattaatattgtaatatcatttatattttataaaaattaattttataaaaaaaaatgtttaatttcatttaaaaaaaaatttttttataaaattaattttaaactagtaaaatcaatttaaaaataaaatttttaatgagatataaaaaaggtataaataaataaataaataaataaataaataaataaataaataaataaataaataaataaataaataaataaataaataaataaataaataaataaataaataaataaataaataaataaatanataaataaatanataaataaatanataaataaataaataaananannaataantaannannnnnnnnaatannananntnantntnnattantatnantnannntanntantnatntnnannatnnttnnnaatnnnnntannnntnannaaanttangnannaannnanntantanttnnnnnnnnatatanntatnnttnnaaatanttanntatnnantanannnatnaananannaannnnatntnaannananaaannnnnnttnaatnnnanntnanttnnnnnaaanntatattnaannnnnnatatttannatnnntnntnnantttntnnntntnnnnnnnnntntttnnntntnnntannnnnannnannnnnntntanaatnnannnnnnnaataaaaannnnnnnatnnannnnntnttnnanttaanatntatntnnntaantntttnntttantanatanntnnnttnnatntnnnnannnntntnnnnaananananntnnntanannantnncnnnnanntnnanntnnannnatnanttnananatatatananannnanannnatttnnnnnaanaaannnnnnnnaaaannnanaaannnnnannnnaaannnnannnnnnntannnanaattntnntnaaatnnnnnnnnnnnnnnnnttatnnnnnntnnnnnnnannnatnnnnntnnnnnnnnnnnnnnnnnntaanngnnntnnnntnngtngnntngtnnntggnatnnnnntttnnttannnntntntntnnnnnnanttnnntnaannaantnntnataaaantnnnnnnannnannnnaaaanntanannnnnanttannnananannntannnnnnnnnnnnnnnntntnnnnnnnnntannnnnannnnnnannanatnnnnnatnganannannntnnnnnnnnnnannnnnngnnnnnnnnnnnannnnnnnnannannnnnannnnnnnnnannnaannnanaatnnaannaannnntaaannaannnntantnanntnnntnnnanannannnntnnanttnnntttnnnttananannnantnnatnnnnaantnnnttnnannnaaattnaanncaannnnaaanan

SEQ ID NO: 950 - DNA, 4000 bp, Escherichia coli
  misc_feature (140)..(140): n is a, c, g, or t
  misc_feature (193)..(197): n is a, c, g, or t
  misc_feature (206)..(217): n is a, c, g, or t
  misc_feature (220)..(226): n is a, c, g, or t
  misc_feature (229)..(231): n is a, c, g, or t
  misc_feature (234)..(234): n is a, c, g, or t
  misc_feature (236)..(241): n is a, c, g, or t
  misc_feature (244)..(246): n is a, c, g, or t
  misc_feature (248)..(260): n is a, c, g, or t
  misc_feature (262)..(263): n is a, c, g, or t
  misc_feature (265)..(266): n is a, c, g, or t
  misc_feature (268)..(271): n is a, c, g, or t
  misc_feature (274)..(274): n is a, c, g, or t
  misc_feature (302)..(302): n is a, c, g, or t
  misc_feature (319)..(319): n is a, c, g, or t
  misc_feature (325)..(325): n is a, c, g, or t
  misc_feature (362)..(365): n is a, c, g, or t
  misc_feature (396)..(396): n is a, c, g, or t
  misc_feature (558)..(558): n is a, c, g, or t
  misc_feature (560)..(560): n is a, c, g, or t
  misc_feature (1992)..(1992): n is a, c, g, or t
cccatgtccccggcgagtcgccacggcagcgcgttctccctcccgatccctccctcgcgcgtcgccgcgacgacgacttgaaactttccatcgttcatcgcgctcgcgcggtctcgtttcattcctcgcgccgccgtcgncgtcgtcgtcgtcccgcgtcgcgtcgcgttcgaattcaaagtcgcgttcgcgnnnnncgtcgtcgnnnnnnnnnnnnttnnnnnnnccnnncgncnnnnnnccnnncnnnnnnnnnnnnnanngnngnnnnccnccgcgcgtcgcgtcgcgcgcgtcgtcgntcgcgcgcgtcgtcgtncgtcgncgtcgcggtccgacgcgcgcgttcgaattttcaaacnnnngacggaaagacgccgctgactgtttgcgcanacgcgtcgcagaaacaagacttgggtacaacacggagcatcgcgcggtttagggtttagggttgcgtctcgcgcgcgacgattccgcgcggcgtcgacgccgcacacgcgcgcgcgcgatgcggcgcgcgccgccgccgccggacgacgcgcgacgcgcggngncgacgccgatggtcccgctcgcgcgcgccgcggtgacgcacgcgccgatcggcgcgggcgggacgacgatgggcgcgccgccgcggttcggcggaggcgcgccgccgcgcggcgggccgggcgcgatcgggatgggaccgccgatcgcgggcggcgcgccgttcggcgcgccgccgatgggcggcggcgcgccgttcgggatgggaccgccgttcgggatgggcgcggcgacggggatggggacgggaccgccgccgatgggcggacgaccgacgccgggacagtttcgagggatggcgatcacgcacccgagcggactgtcgccggatttgttgcggatgttcgcgccgagggcgccgctgaagtggtgcgcgccgccggcgaaaccgaaaaagacgcagcggatgcagggggtggcggcgtgcgtgaaggagtttgaaacggcgtcgaagacggcgacgcagaagcggaaggcgtcgaagaagaggaatgaggacgcggacgagggcgagattgaggtggacgaggacgatgatgggcgaaaaccgagcggggtgtacgtcgtggtgaccaaggaggaacgcgcggcgcgcaagcgcgccgccgccgaacggaaatctcgcgagttgatcgaggcgggtttggacggatatcgtccgaacgaaaacccgaacgcgacgagcgatccgtatcgcacgctgtttatcgcacggttggcgtacgacgtagatgaagacaagctcaggcgcgaggcggagtactacggcgccgtgtccgacgtcaagttggttcgcgacgagaaggggaaatctcgcggctacgccttcatcgagttcgagcgcgagggcgacatgcgcgcggcgtacaggggcatggatgatcgtcgcatcgaagatcgaagggtgatcgcggacgtcgagcgtgggcgcacaaataaagggtggttacctcgccgtctcggcggcggcgtcggtcgcacgcgtgcggggtcaaaacgtgaaaacgtcgaggcgcgcggtcgcgatcgaacgtatgatgatcgtcgcgaacgcgagcgtagagagatgccgcgctcgccgccgcgctcgccgccgcgcggcggtcgcgccgcgccgccgccgccgcgctcgccctcctctgaggaagagggcgaactcggcgagcgcgcgccggcgcctccaccgccgcccgaggatagaagacgcgatcgttcgcccagtcgcgacagacacgacgacagatacgacggccgaagtcgtggtcgtttcggcgacgatagatacgatcgcgacagataccgcgaccgcgacggctcgcgagaacgcaaacgcggccgcgactcgcgctcgccgtccccgcgcgatcgcagggacaagcgcgatcgcagagactaccgttagcgcaccgatgcgtcgcgcgccgtaaacaccgnaataacaacatttagacgatttagtttacccaatcttcgtttggcccgtcgaacaccagtccggaagcggcattcgtcgactcgccgctcagcatcaccgcgagacgtccgacgaacgcctctcgcgcgtcaccgccgacgtgcgcgtgaactctcgcaggtccgtgcgacgcgtcgccgcgatcgcgtcgatcgtcgcgtcaatcgtccgtctcggtcgtgatgagcaattgttggtaaaaggtctgaatccaccgccctcgcggcgtgtcgaccaccgcgcgcgatatcgagcgcgcacacgcctcacgatgcgcgtttgacgcgcgcggcatgtgagacccatcccaagaaagcgaccctgggatgggcaaaggcgccgcgcgacaacgcgctcgcgaacaaccgactcgagcgtccgtcagatacgcgtcgacggtgtagaaatccgtcggtgtcccttgtgacgctcatagtgatgtcaaacgcgcgcaaataatcggtggcgtgtgcgcgcgtgcaagaggtggatgcgttggataagtgaatgatcaaagcaagtgcagctgaaccgacgacggaacgaagctaacgatggaaagcgaagcgaagcgctcctcgagggtcgactgaccgatgcataactcgcgtgatcgcagcatggtcactgaatcaacatcaggacgctcgaaggttcgtatcggcggtcaatgcgagccgttttggcgacatttcaacactgccgaatgggagccagaatggcgagcgctcgtgggcgtgttggagcacgagcatgtgtccgtagattggcggcttgcgatcgaacgtttgcggcacgacgtgcacgaaaaatccgcgaacttgaggttgagtgcttacaaagattggctgggtcacttggaggatatgcttcatcacgaaagaagcgaacagctgcgtgacgttctccaagagctcctcgaacatggcaaatgggacgttatggacgcgttattcgtgaacgcgacgacccaacgtgacgcgggcgagtcgtgtttatgcttacgcgttttgcgagggctttgtctattcatcccgaagatgcgcgagaagtttgtcggggagaaaatggaatcgctgttggcgcgtttactcgacgagacagaggatcagaagaacaaagtggaaattctcgagttattgctcgtcgtcgtcgctgatgatcagaattctcagcgcgacttcatgagacgtaacggcgtgtcgacggtatgcgcgatgtacacgtccgacgcgagctcgagtgagttgctagagggggcaaaaacgttcatcagcgtcttcatcgagtacatcctccccggcggcaaaaaagcagcgctgagtagcgctctcaccgctgaagcgcgcgaaacggttgcggaattgatcggagcgcacacaaaagatgtatacgtagttaagctatagcggattagggaatagtgattcattagaggttgtcatgatattgcattatgtacagatacagcgcgatgcatgcgatgctgcgacggcgtaaccggagttactcgtcttcggggtaaatggacgtgcagtcttcgtcgaacaaatcgcacgacgtcacaggattcttcagatcatttgcgtcgtcgtcgtctcgacgtgcgggcgttcgcgcggggaccttcgggcggttcgccggtccaaagttagcggtacgcaggacgtacgccgagctgatggcgtcgtagagctcctcgcccatgctactgtcggtcacttcgcattcgacatcgacgaggacgcagtgagagtcttggtctaaccaagcgcgctcgtgaacgatgtgcttgatcgaagcacccacgtcggcaatcttgttgcacacgccagcgataccacccggtctgtcgggaacgacgcacgcgaagcgcacgagtcgcccgtccgagaccaagccgcgctcgagcactttaccgagcgtgctcgtatcgatgttaccaccgcacatggcgaccactacttt

SEQ ID NO: 951 - DNA, 4000 bp, Escherichia coli
  misc_feature (3)..(4): n is a, c, g, or t
  misc_feature (6)..(7): n is a, c, g, or t
  misc_feature (9)..(12): n is a, c, g, or t
  misc_feature (14)..(18): n is a, c, g, or t
  misc_feature (20)..(20): n is a, c, g, or t
  misc_feature (24)..(24): n is a, c, g, or t
  misc_feature (26)..(26): n is a, c, g, or t
  misc_feature (28)..(28): n is a, c, g, or t
  misc_feature (30)..(30): n is a, c, g, or t
  misc_feature (34)..(38): n is a, c, g, or t
  misc_feature (41)..(41): n is a, c, g, or t
  misc_feature (43)..(45): n is a, c, g, or t
  misc_feature (48)..(53): n is a, c, g, or t
  misc_feature (55)..(57): n is a, c, g, or t
  misc_feature (59)..(59): n is a, c, g, or t
  misc_feature (61)..(64): n is a, c, g, or t
  misc_feature (66)..(66): n is a, c, g, or t
  misc_feature (69)..(69): n is a, c, g, or t
  misc_feature (71)..(72): n is a, c, g, or t
  misc_feature (76)..(76): n is a, c, g, or t
  misc_feature (80)..(80): n is a, c, g, or t
  misc_feature (86)..(86): n is a, c, g, or t
  misc_feature (88)..(90): n is a, c, g, or t
  misc_feature (93)..(94): n is a, c, g, or t
  misc_feature (96)..(97): n is a, c, g, or t
  misc_feature (99)..(103): n is a, c, g, or t
  misc_feature (109)..(109): n is a, c, g, or t
  misc_feature (113)..(114): n is a, c, g, or t
  misc_feature (117)..(118): n is a, c, g, or t
  misc_feature (120)..(121): n is a, c, g, or t
  misc_feature (124)..(124): n is a, c, g, or t
  misc_feature (127)..(128): n is a, c, g, or t
  misc_feature (130)..(130): n is a, c, g, or t
  misc_feature (132)..(133): n is a, c, g, or t
  misc_feature (137)..(137): n is a, c, g, or t
  misc_feature (142)..(145): n is a, c, g, or t
  misc_feature (147)..(147): n is a, c, g, or t
  misc_feature (149)..(149): n is a, c, g, or t
  misc_feature (151)..(151): n is a, c, g, or t
  misc_feature (153)..(153): n is a, c, g, or t
  misc_feature (155)..(156): n is a, c, g, or t
  misc_feature (162)..(162): n is a, c, g, or t
  misc_feature (165)..(166): n is a, c, g, or t
  misc_feature (168)..(168): n is a, c, g, or t
  misc_feature (171)..(172): n is a, c, g, or t
  misc_feature (174)..(174): n is a, c, g, or t
  misc_feature (178)..(179): n is a, c, g, or t
  misc_feature (181)..(181): n is a, c, g, or t
  misc_feature (183)..(184): n is a, c, g, or t
  misc_feature (186)..(186): n is a, c, g, or t
  misc_feature (188)..(191): n is a, c, g, or t
  misc_feature (199)..(204): n is a, c, g, or t
  misc_feature (208)..(209): n is a, c, g, or t
  misc_feature (211)..(211): n is a, c, g, or t
  misc_feature (214)..(215): n is a, c, g, or t
  misc_feature (217)..(219): n is a, c, g, or t
  misc_feature (221)..(221): n is a, c, g, or t
  misc_feature (224)..(228): n is a, c, g, or t
  misc_feature (230)..(231): n is a, c, g, or t
  misc_feature (233)..(233): n is a, c, g, or t
  misc_feature (235)..(239): n is a, c, g, or t
  misc_feature (242)..(242): n is a, c, g, or t
  misc_feature (244)..(246): n is a, c, g, or t
  misc_feature (248)..(250): n is a, c, g, or t
  misc_feature (258)..(261): n is a, c, g, or t
  misc_feature (265)..(266): n is a, c, g, or t
  misc_feature (270)..(273): n is a, c, g, or t
  misc_feature (276)..(277): n is a, c, g, or t
  misc_feature (281)..(283): n is a, c, g, or t
  misc_feature (285)..(285): n is a, c, g, or t
  misc_feature (288)..(288): n is a, c, g, or t
  misc_feature (290)..(293): n is a, c, g, or t
  misc_feature (295)..(296): n is a, c, g, or t
  misc_feature (298)..(299): n is a, c, g, or t
  misc_feature (301)..(305): n is a, c, g, or t
  misc_feature (309)..(309): n is a, c, g, or t
  misc_feature (312)..(312): n is a, c, g, or t
  misc_feature (314)..(316): n is a, c, g, or t
  misc_feature (318)..(318): n is a, c, g, or t
  misc_feature (320)..(323): n is a, c, g, or t
  misc_feature (325)..(326): n is a, c, g, or t
  misc_feature (328)..(330): n is a, c, g, or t
  misc_feature (333)..(334): n is a, c, g, or t
  misc_feature (343)..(343): n is a, c, g, or t
  misc_feature (345)..(345): n is a, c, g, or t
  misc_feature (348)..(348): n is a, c, g, or t
  misc_feature (351)..(352): n is a, c, g, or t
  misc_feature (354)..(354): n is a, c, g, or t
  misc_feature (357)..(358): n is a, c, g, or t
  misc_feature (361)..(361): n is a, c, g, or t
  misc_feature (367)..(367): n is a, c, g, or t
  misc_feature (369)..(370): n is a, c, g, or t
  misc_feature (372)..(372): n is a, c, g, or t
  misc_feature (375)..(375): n is a, c, g, or t
  misc_feature (379)..(379): n is a, c, g, or t
  misc_feature (381)..(381): n is a, c, g, or t
  misc_feature (383)..(384): n is a, c, g, or t
  misc_feature (386)..(386): n is a, c, g, or t
  misc_feature (389)..(389): n is a, c, g, or t
  misc_feature (391)..(393): n is a, c, g, or t
  misc_feature (397)..(398): n is a, c, g, or t
  misc_feature (401)..(401): n is a, c, g, or t
  misc_feature (403)..(407): n is a, c, g, or t
  misc_feature (409)..(412): n is a, c, g, or t
  misc_feature (414)..(414): n is a, c, g, or t
  misc_feature (418)..(418): n is a, c, g, or t
  misc_feature (425)..(425): n is a, c, g, or t
  misc_feature (427)..(428): n is a, c, g, or t
  misc_feature (431)..(432): n is a, c, g, or t
  misc_feature (434)..(436): n is a, c, g, or t
  misc_feature (440)..(442): n is a, c, g, or t
  misc_feature (444)..(446): n is a, c, g, or t
  misc_feature (448)..(450): n is a, c, g, or t
  misc_feature (453)..(453): n is a, c, g, or t
  misc_feature (455)..(457): n is a, c, g, or t
  misc_feature (459)..(459): n is a, c, g, or t
  misc_feature (461)..(463): n is a, c, g, or t
  misc_feature (467)..(468): n is a, c, g, or t
  misc_feature (471)..(471): n is a, c, g, or t
  misc_feature (474)..(476): n is a, c, g, or t
  misc_feature (478)..(478): n is a, c, g, or t
  misc_feature (481)..(481): n is a, c, g, or t
  misc_feature (486)..(487): n is a, c, g, or t
  misc_feature (491)..(492): n is a, c, g, or t
  misc_feature (494)..(495): n is a, c, g, or t
  misc_feature (498)..(498): n is a, c, g, or t
  misc_feature (500)..(501): n is a, c, g, or t
  misc_feature (503)..(504): n is a, c, g, or t
  misc_feature (507)..(508): n is a, c, g, or t
  misc_feature (511)..(511): n is a, c, g, or t
  misc_feature (513)..(514): n is a, c, g, or t
  misc_feature (518)..(518): n is a, c, g, or t
  misc_feature (521)..(521): n is a, c, g, or t
  misc_feature (523)..(524): n is a, c, g, or t
  misc_feature (527)..(528): n is a, c, g, or t
  misc_feature (530)..(534): n is a, c, g, or t
  misc_feature (539)..(539): n is a, c, g, or t
  misc_feature (541)..(543): n is a, c, g, or t
  misc_feature (549)..(549): n is a, c, g, or t
  misc_feature (553)..(553): n is a, c, g, or t
  misc_feature (555)..(556): n is a, c, g, or t
  misc_feature (559)..(562): n is a, c, g, or t
  misc_feature (564)..(566): n is a, c, g, or t
  misc_feature (568)..(568): n is a, c, g, or t
  misc_feature (570)..(570): n is a, c, g, or t
  misc_feature (572)..(572): n is a, c, g, or t
  misc_feature (574)..(575): n is a, c, g, or t
  misc_feature (577)..(578): n is a, c, g, or t
  misc_feature (581)..(581): n is a, c, g, or t
  misc_feature (583)..(584): n is a, c, g, or t
  misc_feature (588)..(588): n is a, c, g, or t
  misc_feature (591)..(593): n is a, c, g, or t
  misc_feature (595)..(596): n is a, c, g, or t
  misc_feature (598)..(598): n is a, c, g, or t
  misc_feature (600)..(600): n is a, c, g, or t
  misc_feature (602)..(605): n is a, c, g, or t
  misc_feature (608)..(608): n is a, c, g, or t
  misc_feature (615)..(616): n is a, c, g, or t
  misc_feature (619)..(619): n is a, c, g, or t
  misc_feature (623)..(624): n is a, c, g, or t
  misc_feature (626)..(626): n is a, c, g, or t
  misc_feature (633)..(637): n is a, c, g, or t
  misc_feature (639)..(640): n is a, c, g, or t
  misc_feature (642)..(643): n is a, c, g, or t
  misc_feature (649)..(649): n is a, c, g, or t
  misc_feature (651)..(654): n is a, c, g, or t
  misc_feature (656)..(657): n is a, c, g, or t
  misc_feature (660)..(660): n is a, c, g, or t
  misc_feature (664)..(664): n is a, c, g, or t
  misc_feature (668)..(669): n is a, c, g, or t
  misc_feature (672)..(672): n is a, c, g, or t
  misc_feature (674)..(675): n is a, c, g, or t
  misc_feature (678)..(679): n is a, c, g, or t
  misc_feature (683)..(684): n is a, c, g, or t
  misc_feature (686)..(688): n is a, c, g, or t
  misc_feature (690)..(691): n is a, c, g, or t
  misc_feature (694)..(696): n is a, c, g, or t
  misc_feature (698)..(698): n is a, c, g, or t
  misc_feature (704)..(704): n is a, c, g, or t
  misc_feature (710)..(710): n is a, c, g, or t
  misc_feature (712)..(719): n is a, c, g, or t
  misc_feature (721)..(723): n is a, c, g, or t
  misc_feature (725)..(725): n is a, c, g, or t
  misc_feature (727)..(728): n is a, c, g, or t
  misc_feature (730)..(731): n is a, c, g, or t
  misc_feature (735)..(737): n is a, c, g, or t
  misc_feature (739)..(739): n is a, c, g, or t
  misc_feature (744)..(744): n is a, c, g, or t
  misc_feature (746)..(747): n is a, c, g, or t
  misc_feature (750)..(752): n is a, c, g, or t
  misc_feature (754)..(755): n is a, c, g, or t
  misc_feature (757)..(761): n is a, c, g, or t
  misc_feature (764)..(766): n is a, c, g, or t
  misc_feature (768)..(768): n is a, c, g, or t
  misc_feature (770)..(774): n is a, c, g, or t
  misc_feature (776)..(777): n is a, c, g, or t
  misc_feature (780)..(780): n is a, c, g, or t
  misc_feature (783)..(784): n is a, c, g, or t
  misc_feature (786)..(792): n is a, c, g, or t
  misc_feature (794)..(796): n is a, c, g, or t
  misc_feature (799)..(800): n is a, c, g, or t
  misc_feature (803)..(805): n is a, c, g, or t
  misc_feature (809)..(809): n is a, c, g, or t
  misc_feature (815)..(815): n is a, c, g, or t
  misc_feature (817)..(819): n is a, c, g, or t
  misc_feature (824)..(825): n is a, c, g, or t
  misc_feature (828)..(828): n is a, c, g, or t
  misc_feature (838)..(839): n is a, c, g, or t
  misc_feature (841)..(842): n is a, c, g, or t
  misc_feature (845)..(846): n is a, c, g, or t
  misc_feature (851)..(852): n is a, c, g, or t
  misc_feature (855)..(856): n is a, c, g, or t
  misc_feature (860)..(865): n is a, c, g, or t
  misc_feature (867)..(867): n is a, c, g, or t
  misc_feature (870)..(888): n is a, c, g, or t
  misc_feature (890)..(890): n is a, c, g, or t
  misc_feature (892)..(893): n is a, c, g, or t
  misc_feature (896)..(896): n is a, c, g, or t
  misc_feature (898)..(898): n is a, c, g, or t
  misc_feature (903)..(903): n is a, c, g, or t
  misc_feature (906)..(906): n is a, c, g, or t
  misc_feature (908)..(909): n is a, c, g, or t
  misc_feature (912)..(912): n is a, c, g, or t
  misc_feature (915)..(915): n is a, c, g, or t
  misc_feature (920)..(921): n is a, c, g, or t
  misc_feature (923)..(924): n is a, c, g, or t
  misc_feature (928)..(928): n is a, c, g, or t
  misc_feature (930)..(930): n is a, c, g, or t
  misc_feature (932)..(932): n is a, c, g, or t
  misc_feature (935)..(935): n is a, c, g, or t
  misc_feature (937)..(937): n is a, c, g, or t
  misc_feature (939)..(940): n is a, c, g, or t
  misc_feature (942)..(942): n is a, c, g, or t
  misc_feature (944)..(945): n is a, c, g, or t
  misc_feature (947)..(949): n is a, c, g, or t
  misc_feature (952)..(952): n is a, c, g, or t
  misc_feature (954)..(954): n is a, c, g, or t
  misc_feature (958)..(960): n is a, c, g, or t
  misc_feature (962)..(962): n is a, c, g, or t
  misc_feature (964)..(966): n is a, c, g, or t
  misc_feature (968)..(968): n is a, c, g, or t
  misc_feature (970)..(972): n is a, c, g, or t
  misc_feature (976)..(976): n is a, c, g, or t
  misc_feature (978)..(983): n is a, c, g, or t
  misc_feature (987)..(987): n is a, c, g, or t
  misc_feature (989)..(989): n is a, c, g, or t
  misc_feature (992)..(993): n is a, c, g, or t
  misc_feature (997)..(997): n is a, c, g, or t
  misc_feature (999)..(999): n is a, c, g, or t
  misc_feature (1004)..(1006): n is a, c, g, or t
  misc_feature (1009)..(1010): n is a, c, g, or t
  misc_feature (1013)..(1014): n is a, c, g, or t
  misc_feature (1016)..(1018): n is a, c, g, or t
  misc_feature (1020)..(1021): n is a, c, g, or t
  misc_feature (1024)..(1024): n is a, c, g, or t
  misc_feature (1027)..(1027): n is a, c, g, or t
  misc_feature (1031)..(1032): n is a, c, g, or t
  misc_feature (1035)..(1035): n is a, c, g, or t
  misc_feature (1037)..(1037): n is a, c, g, or t
  misc_feature (1039)..(1044): n is a, c, g, or t
  misc_feature (1046)..(1052): n is a, c, g, or t
  misc_feature (1054)..(1055): n is a, c, g, or t
  misc_feature (1058)..(1058): n is a, c, g, or t
  misc_feature (1060)..(1061): n is a, c, g, or t
  misc_feature (1063)..(1063): n is a, c, g, or t
  misc_feature (1067)..(1067): n is a, c, g, or t
  misc_feature (1071)..(1071): n is a, c, g, or t
  misc_feature (1074)..(1074): n is a, c, g, or t
  misc_feature (1080)..(1089): n is a, c, g, or t
  misc_feature (1093)..(1093): n is a, c, g, or t
  misc_feature (1097)..(1099): n is a, c, g, or t
  misc_feature (1101)..(1102): n is a, c, g, or t
  misc_feature (1106)..(1106): n is a, c, g, or t
  misc_feature (1108)..(1109): n is a, c, g, or t
  misc_feature (1112)..(1114): n is a, c, g, or t
  misc_feature (1117)..(1118): n is a, c, g, or t
  misc_feature (1120)..(1123): n is a, c, g, or t
  misc_feature (1128)..(1131): n is a, c, g, or t
  misc_feature (1134)..(1136): n is a, c, g, or t
  misc_feature (1138)..(1138): n is a, c, g, or t
  misc_feature (1140)..(1140): n is a, c, g, or t
  misc_feature (1143)..(1143): n is a, c, g, or t
  misc_feature (1145)..(1149): n is a, c, g, or t
  misc_feature (1152)..(1152): n is a, c, g, or t
  misc_feature (1155)..(1158): n is a, c, g, or t
  misc_feature (1161)..(1162): n is a, c, g, or t
  misc_feature (1164)..(1164): n is a, c, g, or t
  misc_feature (1166)..(1166): n is a, c, g, or t
  misc_feature (1169)..(1169): n is a, c, g, or t
  misc_feature (1176)..(1176): n is a, c, g, or t
  misc_feature (1178)..(1180): n is a, c, g, or t
  misc_feature (1183)..(1183): n is a, c, g, or t
  misc_feature (1185)..(1190): n is a, c, g, or t
  misc_feature (1192)..(1202): n is a, c, g, or t
  misc_feature (1204)..(1204): n is a, c, g, or t
  misc_feature (1206)..(1207): n is a, c, g, or t
  misc_feature (1209)..(1212): n is a, c, g, or t
  misc_feature (1217)..(1217): n is a, c, g, or t
  misc_feature (1219)..(1222): n is a, c, g, or t
  misc_feature (1224)..(1224): n is a, c, g, or t
  misc_feature (1226)..(1226): n is a, c, g, or t
  misc_feature (1230)..(1237): n is a, c, g, or t
  misc_feature (1239)..(1243): n is a, c, g, or t
  misc_feature (1250)..(1250): n is a, c, g, or t
  misc_feature (1252)..(1253): n is a, c, g, or t
  misc_feature (1255)..(1255): n is a, c, g, or t
  misc_feature (1259)..(1260): n is a, c, g, or t
  misc_feature (1264)..(1266): n is a, c, g, or t
  misc_feature (1270)..(1270): n is a, c, g, or t
  misc_feature (1274)..(1277): n is a, c, g, or t
  misc_feature (1280)..(1280): n is a, c, g, or t
  misc_feature (1282)..(1284): n is a, c, g, or t
  misc_feature (1484)..(1484): n is a, c, g, or t
  misc_feature (1973)..(1973): n is a, c, g, or t
  misc_feature (1988)..(1988): n is a, c, g, or t
  misc_feature (1998)..(1998): n is a, c, g, or t
  misc_feature (2000)..(2000): n is a, c, g, or t
  misc_feature (2241)..(2241): n is a, c, g, or t
  misc_feature (2279)..(2279): n is a, c, g, or t
  misc_feature (2334)..(2334): n is a, c, g, or t
  misc_feature (2392)..(2395): n is a, c, g, or t
  misc_feature (2404)..(2404): n is a, c, g, or t
  misc_feature (2424)..(2424): n is a, c, g, or t
  misc_feature (2433)..(2433): n is a, c, g, or t
  misc_feature (2436)..(2436): n is a, c, g, or t
  misc_feature (2466)..(2466): n is a, c, g, or t
  misc_feature (2509)..(2510): n is a, c, g, or t
  misc_feature (2561)..(2562): n is a, c, g, or t
  misc_feature (2565)..(2565): n is a, c, g, or t
  misc_feature (2568)..(2568): n is a, c, g, or t
  misc_feature (2570)..(2570): n is a, c, g, or t
  misc_feature (2573)..(2578): n is a, c, g, or t
  misc_feature (2580)..(2580): n is a, c, g, or t
  misc_feature (2582)..(2582): n is a, c, g, or t
  misc_feature (2585)..(2585): n is a, c, g, or t
  misc_feature (2587)..(2587): n is a, c, g, or t
  misc_feature (2591)..(2592): n is a, c, g, or t
  misc_feature (2594)..(2594): n is a, c, g, or t
  misc_feature (2604)..(2604): n is a, c, g, or t
  misc_feature (2607)..(2607): n is a, c, g, or t
  misc_feature (2609)..(2613): n is a, c, g, or t
  misc_feature (2615)..(2615): n is a, c, g, or t
  misc_feature (2617)..(2618): n is a, c, g, or t
  misc_feature (2623)..(2626): n is a, c, g, or t
  misc_feature (2628)..(2630): n is a, c, g, or t
  misc_feature (3232)..(3232): n is a, c, g, or t
  misc_feature (3567)..(3567): n is a, c, g, or t
  misc_feature (3888)..(3888): n is a, c, g, or t
  misc_feature (3890)..(3895): n is a, c, g, or t
  misc_feature (3903)..(3903): n is a, c, g, or t
  misc_feature (3905)..(3905): n is a, c, g, or t
  misc_feature (3914)..(3914): n is a, c, g, or t
  misc_feature (3917)..(3917): n is a, c, g, or t
  misc_feature (3919)..(3920): n is a, c, g, or t
  misc_feature (3929)..(3929): n is a, c, g, or t
  misc_feature (3933)..(3933): n is a, c, g, or t
  misc_feature (3936)..(3937): n is a, c, g, or t
  misc_feature (3939)..(3939): n is a, c, g, or t
  misc_feature (3944)..(3945): n is a, c, g, or t
  misc_feature (3950)..(3950): n is a, c, g, or t
  misc_feature (3952)..(3952): n is a, c, g, or t
  misc_feature (3955)..(3955): n is a, c, g, or t
  misc_feature (3961)..(3962): n is a, c, g, or t
  misc_feature (3966)..(3966): n is a, c, g, or t
  misc_feature (3975)..(3975): n is a, c, g, or t
  misc_feature (3978)..(3978): n is a, c, g, or t
  misc_feature (3981)..(3981): n is a, c, g, or t
  misc_feature (3994)..(3994): n is a, c, g, or t
  misc_feature (3997)..(3997): n is a, c, g, or t
  misc_feature (4000)..(4000): n is a, c, g, or t
aannannannnntnnnnntngtgntnangncgannnnnccngnnncgnnnnnnannnanannnngnacnanngggncgangaggangnnnttnntnntnnnnncttttnttcnnctnntnntanttnnantnnttgntattnnnncnancnancnncgccgncgnngnggnngntggnncntnncncnnnngcgacggnnnnnntttnnangtnntnnnangannnnnannanannnnnatnannntnnnacgaccgnnnngagnnggannnntgnnattnnngnaancnnnngnngnnannnnngtgnagntnnngnannnngnngnnncgnnggcgccggngnagncgnngnagnnganggagantnngnggngttngnanntntanannntgtnnttntnnnnnannnntntaanaaataananncannannngtannncnnngnnnccncnnnanannnactnnctnctnnntntgnttatnnggannannagnannanncgnnggntnnggangtngnnganntnnnnnaacanannncgccgncggngnngannnngnnnancncncnncnntancnncagnacnnncnncncncnnnntcntcttccnnctnttcnncnaattctnnnnncnntnngctcgntnnnntnnttnttanttcnntcncnnccnncgcnncnnncnnttnnntntctttnttttcntnnnnnnnnannngngnnannggcnnnanccccncnnctnnngnntnnnnngcnnncnannnnnannatnagnngnnnnnnncnnnccnnccnnngacnaccatngnnnccacnncgncgacaaaganncnnctnnttttnncanntttnnnnnntnccnnnnnnnnnnnnnnnnnnncncnnctntngctgntgntnntgntgntgttnntnntatnantnctncntnncncnncnnnccncncgcnnntnannnangnnncgtncnnnnnnttcncntcnntcancnccaannnttnnctnngnnncnncgncgncggnnggngngnnnnnngnnnnnnncnnccncnncncggnaagngangaaagnnnnnnnnnntttntttnnncnnctcnanntcnnnaanngnnnnaagannnnccnnntncnccncnnnnnacnccnnnnagnngntnttnttgttcntnnnganannnnnnannnnnnnnnnngnannannnnttttntnnnntntnttcnnnnnnnntnnnnngggaatngnngnaatnnacgnnntcgncgtnnnntgntnnngatgatgatgatgatgatgatgcgcgttcgcgtttgaagtactcacgttcgaaatgatggacgagttcgcgaagtgctcgctgaggtatcgagcgactaagattcgaaacgtggtggcttcttcttgctcctcgtcgaattcgttcgtactggttgatgttgttgttggaagaattaacgtcgtccgctcttcttcttcntcttcttcttcttctactcctaaagcgtgcgtaccctcgaaatactcgtcacctcctccgcttccgattccaccacctccgcaattgttgttaaactgaaacaccttctccaccatcctcctcgctttcttgaacctggtcagcaccaccccgatcaacctcgccgccatcaccctctcggcgaacatctcctcgatctcctccgtcccgttttgcaccgccgtgaccgaagtcaactccacgctcgtctcgtccgccgctcgtaaaacgtccaacgctaacgtcaacgctcttttcaacacgtccgcggaaacggactttagacctttcgaagggtcgttcgaacattggctaaacgcggatactaatatctgcaatctgtgcaacacgtgcatccgaacgcctttctgggtgcacaacgcgcgttctctcgtcacgtacactcgtctcaaatactgcgccgttaaagaaggaatcgtcgtctgcaangtaaacgcgctttgnccccattttntngtcaacgcgtgcgtccacatctgcgcgtcttttgacatctcgagtaaacttttgttcgttctcgccagcgcggagaaggattcgaaatcgttccaatcgatcaacaagcgagcgaagatgtgggagacgagtatgtctttcggcaagcgttctaaaaggaagaactgacgactcgttcggtgttcagtatgtcgtttcgaggaaggcacggatggagaagacatcacgtcatgttgttttngcgcaaatgtgtgacgttttccgtcacttgttttccantaaagagatacgaatggtcgtcctcttttgcgcgcggttgtgcgcttgttttccnacaaccgcgcgctctggagcgccagaacgtgattctaacgcgaggaggagaagtcacnnnngcaaatttngcatcgctcgagcggcaacnacgagaagnacnagaacaacatcaaaagcagacgcgaacgcngagcaaccacctttcccgacggcgaaaagaaagacatcgacannaataacgaatccagcggcatatacgaccttatccgtgatacgaaaacgcgnnggngantncgnnnnnncncntcngnttgnngncgtgccgtcntcngnnnnnangnnggcgnnnngnnntttcgtggcggagttgaaagcgttgattcgagaggcgttcgtgttgaacaagaaggagatagcgaaggacgaaaaggaacgaacgggggtgacgaaatattcaatgtcggaaacgttcgacagttcctcggactttggggaggaattcgaggatcagagtttagaggaggaaatcgagcgacaaggcgaattgcttttggaatatttagagcgcatgaagttatcgaacgcgaaaatctgggagcgagagaaacggttgccgaaagtggaaagtccgtggattatcgaagggccgtattatctcttgtgcaaggttttagacctgtggtttccggagaataaaccggtgcagaggttttggtttttagagacggtggcgaggatgccttacttttcgtacacgaccatgttgacgctgtacgaactcttagggtggtggcgacgaagcagcgagttgaggaaagttcacttcgcggaggagtggaacgagtaccatcacttgttaatcatggaaagtttgggaggcgacaggcgttggagtgaccgctttctcgcgcaacacgcggcgctggtgtactattttgggttagtcgtcgtttggntgctctcgcccaagctcgcgtataattttagcgagaagattgaaacgcacgcggtggcgacgtacgcgcagttcacggaggagaacaaggaattgttagaatcgttgccggcgccagaggtggcgaagaaatattacgaggcggaagatttgtacttgttcgatgagtttcaaacgacgacgatgttaaacaccggcgaaatcgtttccttaaaattgaacagtcgcagcagcgacgaaggggacccattggacccgttatccgtgcgtcgtccaaagattgaaaccttatacgacgtcttttcaaacatttgcgaagacgaaaaagaacacgtngggaccatgaacgcttgccaaatcgagggtgttacgttagggaccgcgaacactatcaacgcgttgactgcgttagcaatcggcggcaccgtggcgtccaagtttgcctctcgattcgcggaagaatccgccattaccgacggattggacgatatcatcggcagcgggaagtttatggatttattcaccgccttgacggatttcttttccgtattccacttgccgttcttttagaaaaagaaagataacaagaaagaacaaaaagataccacacgcaataaaacagaaggagaagaagaaaaagaagaagaagatactacntnnnnnngtagtagntntactatcancantnntaacaacancaanaannancaacnngaagngnggncgcaannaaanaaaaaccanccntcntactacaaaaaanttngcn

SEQ ID NO: 952 - DNA, 4000 bp, Escherichia coli
  misc_feature (1426)..(1426): n is a, c, g, or t
  misc_feature (1429)..(1429): n is a, c, g, or t
  misc_feature (1438)..(1438): n is a, c, g, or t
  misc_feature (1459)..(1459): n is a, c, g, or t
  misc_feature (1476)..(1476): n is a, c, g, or t
  misc_feature (1513)..(1513): n is a, c, g, or t
  misc_feature (1522)..(1522): n is a, c, g, or t
  misc_feature (1527)..(1527): n is a, c, g, or t
  misc_feature (1834)..(1834): n is a, c, g, or t
  misc_feature (1992)..(1992): n is a, c, g, or t
  misc_feature (2113)..(2113): n is a, c, g, or t
  misc_feature (2363)..(2363): n is a, c, g, or t
  misc_feature (2620)..(2620): n is a, c, g, or t
  misc_feature (2774)..(2774): n is a, c, g, or t
  misc_feature (3234)..(3234): n is a, c, g, or t
attcctgcatccatgacatttccatctcttcatccagccaatcagatgttatttctagagttccttctccagctttgtcgactccaaatgcaagagttctcatctcttccgagcttgcttctgttccaggaacatatttcccatatatatctctgtgaaggactgttctggaggtgctaaatcctaaagccccagcctctatagcctcagtaacaagttctgacattttgctgatctcttcatcagatgcgtctacttgattctggcatctttcataacccattacataacttctcaagggaccatgccccatcataaacccaacatccataacgaattcttttttgtcgatggcatctaaaaattctggaaaagtttcccaatcccaatcaattccttcgtgcagagctgaacctgggatatcttcgacaccctccattaattgaataaggaagttttcatctccaggtcgcacaggtgcaaatcccacgccacaatttcccatgaccgcagttgtcacaccatgccaacttgaaggagtaagatatggatcccaggatacctgtccgtcgtagtgagtatgaatatcaacccagccaggcgttaccaaatttccttttgcatcaaactcttttttgcccgagctctcaatcttcccaactaatgtaatttttccatcatcgatagcaatatcaccaaagaatggttttttacctgatccatctaaaatcttgccgttacgtattacaagatcatgtaaattatttgtttccatagtattaatttaactctaagttcatcatgaatatagctataacttaaaccatttttgtattaagtttgtatctgtaggatccttattttataggggtttcagagtcacccttcattccccttcagtaacaacagatttagtaataacaaacacagcgagaacaacgctcaccagaactggcttttttactccactagccaaaactggacctgtgaccactgcaaagatcctcaggcagcaaccgctgttagctcaagtttcccttgccattgctctaacaggtctctgttatcacgatcccacggatgaaagtccattctgaaaaagtccttgtatgctggcacatgagtgcggacaaacccggtcttgccaaacaaaaacttggacagactctttagcgttgaccacttccacatctgtttgtcatggcgcagtatcttaaacgtcactcttaaggtatcgatgagcaaggtaaccatcgcaaggcgcatcacacgcgtgcgcatttcgtgggtgccgccaatatgctcatacacatcaaaagccacagacttatgctcaagctcctcgagggcatgccactgccaaagctcgccaataggaccatcaatattcttcaaaacgcgtccttctagcaagctctctccaaanctngcggtaaantgctccactgacaccgttgangccaatatgacccgtgncgtaatacgcgggtcattgttgcccttctcgatgctntttaaaaanacgcnctctaaatcatcgtaatcataaccccgctgttcacagagtattttgttgtagtttcggtgctcgcggctatgtataccctcctgcttgtaaaacccttttacatcattaagaagtttttcatcggtaatgcgatcttggtaatgtcgaacagaatcaataaaattgcgctcaccgctagggaaactcatactcatggcattgaatactgccgttaaaaacgggtcgttgtctgcccaatccgtggccagagacttttccagttcaaaattcatgtttctgggttgaattgctacaccatcaggggtnttagagattggtcttactgcagtcatcaatacatcctcacttctgtagatgtgataataataccctcaagatgctcacaggcagggacatattcggtcattgatagggatattttcgttcacaagtgttactatttgcactcgcaccaattaaatcgncgtcaccgaggccaatactatggctcagcgccagccccttcagccgtttttctttcgactgttaactcttcttgcagaggatggttatacccaagaacaactatttttatcccctgaagcncagcaaataggcgtactagacataaaccagataaagctaaccgagatacccaaactattacaggcggccgccagcatcaccaatgacccaacattaatgatacgcctaggtgagcgaaccgacataactagcttaggtgcctttggtttcgctctgatgagctgtgctaaccttggagaagcgctaaaactgctcattcgatatcatgccatcactggcccaggaccgtcttttcaactacgaccccacnatttaggcgttatcctgcgcatcgagctagaactaggtaatcctattcaaaaacgtctcattacagagcttgccttttctgaactacgcgctgttggcgagattttgattaatcaaaaaatcacaaaaggcgaattgcatttgaattaccctccaccgccagatataccgaattatgccgccctatttcccgtgccagtgacctttaaccagccctatagtcaactggtcatcccgtgggacattgttaacaccaangtcaccaccgccaaccctgcagggcatgtgatatttcagcaacagtgcgaagatctgttgcgcggcttgaatagaatagagaacttctctgcggctataaggcgcatactcatcaatgccgcgggtgaatttcctgatattaatcaggtcgcanataagctacacgtaagtgaaagcacccttaggcgacgccttggcaatgaatcaaccaactttcgggcaatctgtgacgaagtacgtaacctgctggcctgtgaatacctctccaccaccaaacttactgttgcagaaattgccagccttttggattattctgagccagtgagcttccgtcgtgccttcgtgcgatggaatggtatgacgccaagtgatttcagggctcgaagctaactcttctgcgcttgaccacctaaaagatcaaataataaaagtaggcgccccaactaaagcacattaacagtgatgtcaccgtcactaatattcctgtgcaggcctggttgtttaccctagggttccaagacttggggttgctgttggttttgtctatccaagcttttgggtataaacgcaaagtacttatgtaaatgagcaaaaatacattaactagggttagnaccacgctggtaaacaggatattttccattactactccttaatcactcttcagcgttagctaaatcaagtaaaaatgcatactgcttagccctatctagataacttttgtaccggccagattttccgccatgccccacttccatgtcggtatctagtaacaaacggttattatcagttttcatgtctctaagcttggcaacccactttgcaggctcccagtattgcacctgagaatcgtgcaggcctgttgttaccaacaagtgcgggtaattttgcgctttgacttgatcgtagggtgaatacgctaacatgtagtcatagtaagctttatctttggggttaccccactcgtcaaattcaccagtggttaacgggatagactcatctaacatggtagtcacaacatctacaaaaggcaccgcagcaatcacaccatgatagagctcaggctccatattaatgacgcttcccatcagcaagccaccggcactgccgcccactgcgtagacttttttgctgttgccatagcctctcttaactagggctttggtggcatcattaaaatcagtaaaggtattcattttggtgagctttttgccgtcttcataccaggcacggccaagcattttgctgcctcttatatgagaaatcgcgtataccatccctctgtcgagcagacttaaccgagaaatactaaagtaagggtcaaccgttgacccataagaaccataggcgtaattgagcaaggcgttggtaccatctttt

SEQ ID NO: 953 - DNA, 4000 bp, Escherichia coli
  misc_feature (115)..(115): n is a, c, g, or t
  misc_feature (462)..(462): n is a, c, g, or t
  misc_feature (1987)..(1987): n is a, c, g, or t
taaattaccaaggtcacttctaacatcctgcatgaaattttcaatttcttcagaattcataatttttgtaactaatacttacttatgagatttacatttttagaatttaaattanagtaacatgtattgaagatgtttaaaatgggaatatcaagtaggaatgtagtagaaggaacagcaagagccccacatagagcaatgtacaaagctatgggcttgactgatgatgatcttagcaaaccattcgttggtgtttgtcacacaggaaatgaagccaccccttgtaacatacatttacccagtcttgctcaaaaagcaaaagatggtgtaagggatgcgggtgctacaccaagagaatttagtacaattgcagtgagtgatggaattgcaatgggccatgaaggtatgaagtcttcattaatcagcagagaagtaattgctgattcaattgaattaatggtnagagcccatcaatatgatgcgttagttggcattgctggttgtgataaaagtttgcccggtactatgatggctatggcaagattgaacatcccttcagtttttgtttatggtggaacaattatgccaggaatgttagacggaaaggagctaacagttgttgatgtttatgaagcagtgggctcgtatgatgcagggaagatttcactagaagaattaaagaatatagaagacaatgcatgtccaaatgcaggttcttgtggtggaatgtttacagcgaatacaatggcttcaatttctgaagcaattggaattgcattaccaggtagtgccagtccaccagctgaagatgcaagaagggaggatatagtatatgaaacaggtaaggcgtgtggacgattaatagaacttggaatcaaacctagtgacatatttacaattgatgcatttgaaaatgcaattacgatgttgaatgctgttggtggctctacaaatggtattttgcatttattggcattagcaaatgaggctaagataaaactgagttatgatgattttgaaagaattaggaaaagaactcctcatcttgctgatatgaaacctggcggggaatatgtaatgaatagtttggataaggtaggaggaattccattaattatgaaaaaacttttagataataacctgattcatggtgatgcattaacagttacggggaaaacaataaaagataatcttcaaaacgtaaaaatttcagcggaacaaaaaattgtaagatccatagaaaatccattacataatgttgggacagctgtaatactaaaaggaactttagcacctgatggtgcagtaattaaaactgctggtatggaaatgacaaaatttactggtaaggctaaagtctttgattcagaggagacggcatttgactcggtagcaaagggcgaaattgatgaaggcgatgttttggttattagatatgaaggaccaaagggtggcccagggatgagagaaatgttggctactaccgccgccattgtgggacagggactaggtaaaaaagttgcaatggtaacagatggtagattctctggtggaacacgcggatttatggttggtcatgttgcgcctgaggcatttgttggtggaccaatcgcccttgtcaaaaacgacgatgagataagtgtcaatattgaggataatagtattaatctacaagtttcaaaagatgaacttgaaaaaagaagtaaagagtggagaatgcctaaacctaactacgaatcaggcgcgttatctaaatatgcatttctagttggttctgctgctgatggcgctacaactgatccagataattttcttaaaatgtccaaacatcttcgggataatatgttaacacatatcgattaaacgccagaacatttttgatggctttcaagtttccatttacccgttaactgatgatatggttgactccaatctagattacttgtaccacatttgtagcaagttttcttcataaaatatatcatancagatcgcatttaaatgtaccgtactataccgtaattacacataatggtatcccaaaactgaaatgataaatgtctatttaccaattgcttttgaaattttcaatgcagttttaagaccaatcaactgggtgtgtatagcaattttttgtattcctacacctattgcgctcatacaattctataattttcatagatcaataattgatcgcatgattttctttgatctattactaaaattcaattttttattttctagatttatagacatgaaaactctaattttacattaaaaaacctaatttctatacccaaaaacgcgtattttatcactaattttttttatataaaaatcatggtttaaatacagttcaattttgtctatcagcatgggtggacatatttggacacacacgcactcctaggatagtttccctagattatactggcacccaatttgaaatctacaacaaaatatcacgaaattattcatactcctttctgtttgaatcgttaacaggtcctgaagaactggctgaaacttcaatcatggggtttgatcccgaatttattgtcaagggatattacgacaaggttacaatccaaagtagggatggttctgtcaggacaatttctacagcagatccacttaacacaataaaagacctggtacaggaaaccaatgatcaatcatatcgttatctaggtggcgccgttggaataatcaattatgacacaatcagattatgggaaaatattccaaaacatcataatgtatctgagccaataatggagtttggaatttataacgatggaatactatttgataacaaacaaagaaaatctctatacttctattatgataaaagcagagtagatgagataaagagttctgaaccaaaatttgacaatttcactatatctgacataaaaaataatctggatcaggaaaaattttctgagattgtaagcaaggcaaaaaaatacatctatgatggagatatttttcaagttgttttatcaagaaaattttcatttgaagctagcggtgactatcttaaagtatatcaaaaacttcgttcgttgaatccttcaccatatctataccacctaaaaatgaatgaaaaaactgtgataggttctagccctgaaatgcttttacgtgttactgatgatcaggttgaaacatttcctattgcgggtacaaggaaaattacaactgataaaataaaaaatgaagaaatgagacaggagttaatcaatgacgagaaagagttagcagaacatacgatgctagttgatttgggtagaaatgatgttggcagagtatgtgaatatggtactgtacatgtaaaggagcttatggaagtaaaaaaatttagtcatgttcaacatatggtcacacacgttgttggaaaacttagtaaaaactatgatatgtatgacgcctttagggctgtatttcctgcaggaactgtttcaggtgcaccaaaagtgagggcaatggaaattattgatgaattagagccagaatctagaggtccatatgctggggcagttggatatttttcatttaatggatgctgtgattttgcaattgccattagaagtatttttgtcaatggagaatcaggttttgtacaggccggtgcgggaattgtatttgattcaatttcagagaacgaactgaaagaaactgagcataaggcaaacgcaatgttaactgcattaaaggaggcagcagaatgaagtttcttattattgacaactatgattcatttgtttacaatattgcccagagattaggtgagttaggggttagttcggatgttataagaaatgacaaaattacaattgatgaaataaagaaaagaaattacgatgcaataatcatttcacctggaccaggaacacctgaagataaaaggtattttggaatttgtaatgatgttattcagaaacttggaccaacattaccaattttgggtgtttgtctaggtcatcagggaattatt

SEQ ID NO: 954 - DNA, 4000 bp, Escherichia coli
ctgatgcaattcccgcgaccaaagccgatgctttgagcaaattgtaagcaacaatcaaagatttgattagtgcaattgttgctgtgacaccagctgcaatcttggaaacaacaaagagagtgccaatcacaataccagtggcaatcaattcatctttgagatcaattattgtattgatgacatttcgaaccttcttgccccattcaagggcttttgcttcggattttgtgagactcgctgtaatgcccgcttcacccgtaagaccgttaacaaattcttgaaacgccggaagaacgtcggtcaagataaattgtgtcaatctttgtaccactggtagcaatgccgcgccaatttgttcctgcgcttcatctactgcaattttgattcgctctaatgccttctctgtaccttgcgcttcattatctgcaaagccgccaaaggtctttgtgagggattcaaatactagatcgaagtcttttgatttcaggattgacgcatcgagaccaagacccaatcgacccaatgcgttaagattgccatcgtatgcttttccgagtgcatttgccacggcttccaatggctttcctgtagccgatgaaacatctaatgctaaattcaataatttctgagcttcctcaacgtctttggtcgatcttgttaatctggcaaatgccggacgcagctgatcatctgtgacaccaattgcaatcgatgtggttgtaatatatttttctacgcctttgatttgttcagctgttgcacttgttgtattttcaatggtcaaagcaagtaatcgctgagccttctcatcggctgcggcattctttattgattcaaccgcaaaggctccaatggcggcaccagcggcagcaaatgccagagctgccttcttgccaaaagctgtaaattggtcgccaattgtttcggtgtctttacttgctaccttgatgccctttgtaaattcagcaacgtccgccagtaacgagagcttgagcgttctagatccagcggcagccatttaccagaccttcacaatctttgagaaggtatcttgccattgagcaatgatgtatggctgctcagctttgagagttggatagataaaccatccttttgatccgcgaccttcttttcctgaccaaattggaaattgtttgaatttattagatccgaattcatagccgccccaaagttgttgcgttgtgccgccgccagagaatttctgtgagacaaagccaaatgaaatttcaccaatctttgatgatttggaaactcgtgctcccgtggcaattctgattgaggctaaatcgcgagttatagccctatctacaattttgccttgaagataagttgcaagaccgtttgaaactgtctttgctttatcgatggcttcatcatccatacctttaaatgcgaagataatggttcgcaattcagctttgtcgaaagcgattgcatcctcagccatttctctccttcaatatctcaattgcagtgattacatcttcagccgattcaaattctgatcggcttagtccggtagtaagtgctagatcccaaaggatccgattcatacttccggcggcgtaacttttgggacttgctcatcaccgactgttatttcagcaacggtctcgctccaaatttcgaaagacttgactggcttaccagctgcctcacgtttcatggcgtgatatgccaagaacatgagatctgcaattccaatcttgtcttgcgcttgtgaaatgatgaaacctgtcttggtttcccacttcgcccactctggcggctgcgcagtgtaggtctcgctatttcctgacgtgtattcgatggtaattggtaacttcatgctcccggctcccttactagctaattgttaaaactggtgttgtcacacatgtgaaagcgagtgagactgtctgcgcatctggtgcagtaccgccagctgatggaaggattggctggacatcaaatgcaaatgatgcacctgtgtctgcaacgagtacgactgggagtccagtgtttggtgcatttgttgcagctgtccaaagagcttcacataatgatgaagctgctccccaatccgcaagcatttcaaccgcgaaggatccctgtgtatccgtcgtgaaataagccttgccatcaagtgtttgatatgtattgattgtggaatcgactgttaaagtcgctgatgtagcctgagcatcgaaatcatcgccgtcaatggtgaaggtgatgtctctgccggtgatgattgttgttgccatttgttttctcctctagtcggtgtaatacgttgagacttgcaaatcagctgtcaagaattttcctgcgccgacttccaaaggttgaggtgagctaacatccccgacaacataaccggcgggcatggttgaaattattgaaatcattagatcttcaagattggtcaaagctgccgcgttgcttgaataacccacgactcccgtgacctgaaagtttattttgactttggttgtggatccatttattaaagtgctctctaaataaggtgaatccggaacaagaacaattgagggactcgtcattgtctctgggattccgttatagacatttgctgcaattgtcgaaagtgtcgtttgcaatggtgttcgaatatcttcttcgattgtcatagacacattgtttcgacttcaagaaacggaccgagtaatccaataacacgattgctcaaacttctgcctaaaataaatggtgacggttgaaattgatcgctcatgatttgatttcccggagctgtcacactttggaagacctcaacggatacaacaagaattgctgacttaatgggagcaacgccagagtaaagatctccggctgttgccccatcaatacacgcaagcccactcggaatgattgggatcgtgtagtcgctatctgcctgacccgtggcagatgtaaagacgaaaggtgcaatgcgatcatctgtgacggttactgtcgcgtcgtaaatgccgcatccagtgatgacaacatcttgacccggcacgaaatagttaacgcgctgcgttgtgtagtaagcaattgaatcctcgacgaatatattgaccaccgctgattggtatccggtaagcaatggcagaattgtgagctctgcactctcaatcatctgatcaagatatgcatctgaataaagagatacggaaacgccaagaatcgaccgcagttcccctgctgtgactatttgtggcatttccgttcccttcgtctgctcgaccacatccgggagcgtctgtggtcgatgattagtgattaattaaacgttgttcatccatccgccattgccaatttttgtggcgcaagcaccataagaattgagtgagatttcgacggttccatcggatggcttattgacatcaagacgaaagtttccgctttcgtaccatgtgaacgcatctggctcaagtacgaccattgaatcatcggctgttccagtgaattcacctgagttgtccacatagaaatttaaaccaagtacgactccgcgctgtgattgtccattgacaagaccagcttggttctgtgggaaatacgcattgaatagcggtgtgccgctgtcgttgtagcccatgatgttcgaccattgtccgggcgataccaaaatattacgagcaaatcgttgtgtacctgaatacacttcgacatttgcgtcactgacgtaaccaattaatcccgctgccgtattagcgtaacttcccgaaactctgtttgcatctgtcttgatttgatttgcaacatatttgttttgtgcaaatgccatggcagatcccatgattcgcactaactcgttgaagaaatcgggtgagctgcgatcgatgatttctgtggtgaggatattgcgaccagcgaagcgtgtgattggcactgatatgaaagatgactcaattccggtatttgttaccgcgccaccttctgcaacaggatccacttctgcgatttgtgtaatctttgggatttcaaa

SEQ ID NO: 955 - DNA, 4000 bp, Escherichia coli
  misc_feature (803)..(803): n is a, c, g, or t
  misc_feature (830)..(830): n is a, c, g, or t
  misc_feature (2156)..(2156): n is a, c, g, or t
ttgctgccgtgtacaagaagattacagacgcgagcccgcgtgttccatagactgtgagaatggcgcagcgatccgagttgtattcgttggtggagccctttgggcggcctcgccggtcccgagccgtcgcagagctcctggagacattcatcccctacgccgcgttgaacgtcgtgatggtgatggcggtccagcgcggccacctcgcggtggccttgtcactgtccgtcctggccgcggcgtttctggtgcggctgttcatcatcttccacgattgctgccacggctccttctttccttcccgtcgcgcgaaccggatcgtgggatacatcaccgggctgctcaccctgacgccgttcgaccagtggcagcagtcgcacgccgagcatcacgcgaccgccggcgacctggaccgccggggcgttggcgacgtgtggacgctgacgaccgacgagtacctggcggcgtccaggccaaagcggctcttctatcgcgtgttccgcaatccgttcatcatgttcggcatcggcccggccatcctgttcctgtttggcaacagggtgtacggcccaggcgccagcaaacgtgaacgattcagcgtgctcttcaccaacgcgggcatcgttgcggcgctcgtggtcgcatacctgacgatcgggctgtcgacgctgctgtgggtgcagctgcccaccactctgctcgccggtgcggtcggcgtgtggttgttctacgtgcaacaccagtacgaagacgtgtactgggcacatcacgaggcgtgggacccgatgagagcggcgctgganggaagttcctactacaagctgccgaangtgctgcagtggttcaccggcagcatcggcctgcaccacatccaccacgtccagccgcgcatcccatcctacaacctgcaacgctgccaggacgctgtgccggtgttccagaaggtccccccgctgacgcttcgccgcagcctggactcactgcgcctgcggctgctggacgaagcgaatcaacgcatggtcagctggcggcgcgtcacaccaggtgaggctaggccggagtagacatccgggcctcgtccgatgccgttcgaaagtgcagcgggtcccgcaggctctgcaactccctgtagtagtagagggcagtcggtcggcgtcccgcgaatcgcaaagacttgagaaactcgatctcctcggcggtcgcatcgcccctcagggacgggtcccggagaaatgccttgagcccgggttccacgtcaccagggggcgcgagctcgcgctccacgaactcgaaccgcctcggatgccccggcttcagccggcggttgaggacaatctccatcccgaaggtcgggaggtcgatgtcccaggattcgattagcgggtccaggaacgtgaggcagttgtcgtccgagacgttcaagagatctgtttcgaggaactcgatcacgatcacgcgcatctcttcgtaactgcgaccagtgattcgggccaccctccggagccagtcctcgtcgtccaattcctccttggtcacccgcttcaccacgtccaacagcttctgcgtgacgaaacgctcgagcgcgccgaagggttccttcgcgaacatcgtgcgcagggtgggcgccttggcgggatcgcacttccgcagaatcagctcgcggacggcctcgaacagcggtcctggcggatcggccagcttcctcttcaaggcatcgcggcgctgcacgtccgccagcgtggcgagctgcccggccggaagcttcaggagcgtctccatccgggggtagatgtcggagcgttcaggagctggcggcgccttcttccccgtcatcaactgagagatgtaggactccgtcacttccgcggcggccgccagatcccgctgctcgatccccagttccttgaggcgatggcggatgaggagcgggaaatccattggggttggttgactccgaattaacaattttcgattaataactggcctaatagccgccagttctcgcgagcaaaacttgacaaaatatagtaaatcaactgacaatggttaatcaagagccggggcgagagctccgcacgcgtcgccgattcaggctatctctcttgaagaaggcagtcatgtcgaagcttttcaaccgcaaggcattcatcccgttntggttcctcatctgcgttatcttcgcagccatcagcacgcccatgacgtgggcaaccgggctgcttgtggtcgttattggggctgtggtgccggtcatcgcagtcctgctgtggaaggtcccccctccgaccatcgccgaggtgctgaatcgagtggaacgatcgaccacgcgcctctaacgcggctggaacctttatgaagaacacccttctgcttgcgtcgtgcatcgcgggtctcgtcttctcgtcacagcagatctcagcgcaggatctgtccacgtaccgcgactttcacctgggcatgagcctcgcggacgtcgcgaagcgagccgagatcgcgccggaggctcatgtggtcctggagcgccccgcgctgatccaggagctgacgtggcagccgcaacgatggctcgcatcgacgcgcagtgactccctgaagaaggtccagttcagtttctacaatgggcagctctttcgattgctcgtgacgtacgaccgcgacaagaccgaaggactgaccgtcgaggacatgaccgccgcgatttcggcgacctacgggctcgcgctgttgcgcacgacgccgccagcgccggcagcgggggcgggtgcgcctggctcggcacctctcgacaacggcgacaagttcctggcggcctggggagattcggagcactcgatcgacctcttccagtcgtcttatcagatggtgtttggcctcgtggtccggtccaggccgatggatctgctcgcgcaggcggccacggcggaaggggctcgactcgatgcggaacaggcgccccagcgcgagatcgagcgtcagcagaaatcgaccgacgacaagcgtgtccggaccgcagcggcccgggaatccaacaagcagacgtttcgaccctgaggcacggcgatgaggcggctcttgtccagtcaggtcgttatccgggatcccgagggcgggccctgccggcacctggcggtgcgtgtcatcgagttggcgttccgggatctcgccagttctgcaggactacgcagcaatcaggagagcgctcgcctcttcctggcaggatcgtcgatgcttgaccactggtgtgcggtcgcagacctcgatccggcctggatgatcgctcgagcgaatcagctgaagacggcgccaggcgggcaggagccgtcaccaaccatggcaacgagggaggactgacatgctgtcgtggctgaagcggaaaccccgtgcagagcgtgaagagcgcgtcatcgagattcgcaccgagccggccgcgcctcaggggcacgggatgtcgaagacgttcctcgcgctgcacgaatacctcaagaatcgctattcggacgtcgcctttctgacgttcgcgcagatggaagacctgctcaaatcgccgttgcctccggcagccaggcgggatctcgcgtggtggaacggcgacgacgaggccaatttcgagcatgcgaattcctggcggctggcgaatcggacggccgcacccaatctgatggcgcagacggtcaggttcgcacgcgtctgatcggagttccggatgtcaacgacggccactgcggcgcatgccccttcagtcgtgtttccgattgagccggccgacgtgccggtacgcccgctacttggtcacggccaacttcacctgtggcgccggatctcgttctggcccgcggagctcgtgcggctggtggcgctcatctacatgctgccggtcgtgatctacgcgattggcattccggtcgcggctgccatcagcgcggtgctcttctgtgcaggctgggtcgggaaggcactagcaccgtagtggcgtcgcgcggctgagccggggctactccct

SEQ ID NO: 956 - DNA, 4000 bp, Escherichia coli
  misc_feature (1)..(4): n is a, c, g, or t
  misc_feature (6)..(6): n is a, c, g, or t
  misc_feature (8)..(8): n is a, c, g, or t
  misc_feature (13)..(15): n is a, c, g, or t
  misc_feature (17)..(18): n is a, c, g, or t
  misc_feature (20)..(20): n is a, c, g, or t
  misc_feature (22)..(26): n is a, c, g, or t
  misc_feature (28)..(31): n is a, c, g, or t
  misc_feature (34)..(35): n is a, c, g, or t
  misc_feature (37)..(42): n is a, c, g, or t
  misc_feature (44)..(48): n is a, c, g, or t
  misc_feature (50)..(50): n is a, c, g, or t
  misc_feature (52)..(56): n is a, c, g, or t
  misc_feature (58)..(60): n is a, c, g, or t
  misc_feature (62)..(64): n is a, c, g, or t
  misc_feature (68)..(68): n is a, c, g, or t
  misc_feature (70)..(72): n is a, c, g, or t
  misc_feature (74)..(75): n is a, c, g, or t
  misc_feature (79)..(80): n is a, c, g, or t
  misc_feature (82)..(82): n is a, c, g, or t
  misc_feature (84)..(86): n is a, c, g, or t
  misc_feature (88)..(88): n is a, c, g, or t
  misc_feature (91)..(94): n is a, c, g, or t
  misc_feature (97)..(97): n is a, c, g, or t
  misc_feature (102)..(103): n is a, c, g, or t
  misc_feature (105)..(108): n is a, c, g, or t
  misc_feature (110)..(111): n is a, c, g, or t
  misc_feature (113)..(114): n is a, c, g, or t
  misc_feature (119)..(123): n is a, c, g, or t
  misc_feature (126)..(134): n is a, c, g, or t
  misc_feature (136)..(139): n is a, c, g, or t
  misc_feature (141)..(146): n is a, c, g, or t
  misc_feature (148)..(153): n is a, c, g, or t
  misc_feature (155)..(158): n is a, c, g, or t
  misc_feature (160)..(161): n is a, c, g, or t
  misc_feature (163)..(167): n is a, c, g, or t
  misc_feature (169)..(170): n is a, c, g, or t
  misc_feature (172)..(175): n is a, c, g, or t
  misc_feature (177)..(180): n is a, c, g, or t
  misc_feature (182)..(183): n is a, c, g, or t
  misc_feature (185)..(185): n is a, c, g, or t
  misc_feature (187)..(187): n is a, c, g, or t
  misc_feature (189)..(193): n is a, c, g, or t
  misc_feature (195)..(198): n is a, c, g, or t
  misc_feature (200)..(210): n is a, c, g, or t
  misc_feature (212)..(213): n is a, c, g, or t
  misc_feature (215)..(222): n is a, c, g, or t
  misc_feature (225)..(225): n is a, c, g, or t
  misc_feature (227)..(227): n is a, c, g, or t
  misc_feature (230)..(233): n is a, c, g, or t
  misc_feature (235)..(238): n is a, c, g, or t
  misc_feature (240)..(240): n is a, c, g, or t
  misc_feature (242)..(248): n is a, c, g, or t
  misc_feature (250)..(253): n is a, c, g, or t
  misc_feature (255)..(257): n is a, c, g, or t
  misc_feature (259)..(262): n is a, c, g, or t
  misc_feature (265)..(268): n is a, c, g, or t
  misc_feature (271)..(272): n is a, c, g, or t
  misc_feature (275)..(277): n is a, c, g, or t
  misc_feature (279)..(279): n is a, c, g, or t
  misc_feature (281)..(283): n is a, c, g, or t
  misc_feature (285)..(286): n is a, c, g, or t
  misc_feature (288)..(291): n is a, c, g, or t
  misc_feature (293)..(298): n is a, c, g, or t
  misc_feature (300)..(301): n is a, c, g, or t
  misc_feature (303)..(304): n is a, c, g, or t
  misc_feature (306)..(306): n is a, c, g, or t
  misc_feature (308)..(313): n is a, c, g, or t
  misc_feature (315)..(316): n is a, c, g, or t
  misc_feature (318)..(319): n is a, c, g, or t
  misc_feature (321)..(322): n is a, c, g, or t
  misc_feature (324)..(325): n is a, c, g, or t
  misc_feature (327)..(334): n is a, c, g, or t
  misc_feature (336)..(336): n is a, c, g, or t
  misc_feature (338)..(338): n is a, c, g, or t
  misc_feature (341)..(351): n is a, c, g, or t
  misc_feature (353)..(355): n is a, c, g, or t
  misc_feature (358)..(363): n is a, c, g, or t
  misc_feature (365)..(365): n is a, c, g, or t
  misc_feature (367)..(367): n is a, c, g, or t
  misc_feature (369)..(369): n is a, c, g, or t
  misc_feature (371)..(371): n is a, c, g, or t
  misc_feature (373)..(380): n is a, c, g, or t
  misc_feature (383)..(384): n is a, c, g, or t
  misc_feature (386)..(387): n is a, c, g, or t
  misc_feature (389)..(394): n is a, c, g, or t
  misc_feature (396)..(399): n is a, c, g, or t
  misc_feature (401)..(402): n is a, c, g, or t
  misc_feature (404)..(405): n is a, c, g, or t
  misc_feature (407)..(408): n is a, c, g, or t
  misc_feature (410)..(413): n is a, c, g, or t
  misc_feature (415)..(415): n is a, c, g, or t
  misc_feature (418)..(418): n is a, c, g, or t
  misc_feature (420)..(425): n is a, c, g, or t
  misc_feature (427)..(427): n is a, c, g, or t
  misc_feature (429)..(438): n is a, c, g, or t
  misc_feature (444)..(451): n is a, c, g, or t
  misc_feature (455)..(469): n is a, c, g, or t
  misc_feature (471)..(473): n is a, c, g, or t
  misc_feature (475)..(475): n is a, c, g, or t
  misc_feature (478)..(480): n is a, c, g, or t
  misc_feature (482)..(484): n is a, c, g, or t
  misc_feature (486)..(486): n is a, c, g, or t
  misc_feature (488)..(495): n is a, c, g, or t
  misc_feature (497)..(500): n is a, c, g, or t
  misc_feature (502)..(502): n is a, c, g, or t
  misc_feature (504)..(504): n is a, c, g, or t
  misc_feature (506)..(507): n is a, c, g, or t
  misc_feature (509)..(522): n is a, c, g, or t
  misc_feature (525)..(526): n is a, c, g, or t
  misc_feature (528)..(528): n is a, c, g, or t
  misc_feature (531)..(531): n is a, c, g, or t
  misc_feature (534)..(539): n is a, c, g, or t
  misc_feature (541)..(545): n is a, c, g, or t
  misc_feature (547)..(548): n is a, c, g, or t
  misc_feature (550)..(550): n is a, c, g, or t
  misc_feature (552)..(552): n is a, c, g, or t
  misc_feature (555)..(555): n is a, c, g, or t
  misc_feature (557)..(559): n is a, c, g, or t
  misc_feature (561)..(566): n is a, c, g, or t
  misc_feature (569)..(580): n is a, c, g, or t
  misc_feature (582)..(588): n is a, c, g, or t
  misc_feature (590)..(590): n is a, c, g, or t
  misc_feature (592)..(598): n is a, c, g, or t
  misc_feature (600)..(601): n is a, c, g, or t
  misc_feature (603)..(604): n is a, c, g, or t
  misc_feature (606)..(609): n is a, c, g, or t
  misc_feature (612)..(618): n is a, c, g, or t
  misc_feature (620)..(621): n is a, c, g, or t
  misc_feature (624)..(631): n is a, c, g, or t
  misc_feature (633)..(639): n is a, c, g, or t
  misc_feature (641)..(641): n is a, c, g, or t
  misc_feature (643)..(645): n is a, c, g, or t
  misc_feature (647)..(650): n is a, c, g, or t
  misc_feature (653)..(653): n is a, c, g, or t
  misc_feature (655)..(661): n is a, c, g, or t
  misc_feature (664)..(665): n is a, c, g, or t
  misc_feature (667)..(669): n is a, c, g, or t
  misc_feature (672)..(672): n is a, c, g, or t
  misc_feature (674)..(675): n is a, c, g, or t
  misc_feature (677)..(683): n is a, c, g, or t
  misc_feature (685)..(687): n is a, c, g, or t
  misc_feature (689)..(690): n is a, c, g, or t
  misc_feature (692)..(695): n is a, c, g, or t
  misc_feature (697)..(703): n is a, c, g, or t
  misc_feature (705)..(706): n is a, c, g, or t
  misc_feature (710)..(724): n is a, c, g, or t
  misc_feature (726)..(730): n is a, c, g, or t
  misc_feature (734)..(734): n is a, c, g, or t
  misc_feature (736)..(738): n is a, c, g, or t
  misc_feature (740)..(740): n is a, c, g, or t
  misc_feature (742)..(744): n is a, c, g, or t
  misc_feature (746)..(752): n is a, c, g, or t
  misc_feature (754)..(754): n is a, c, g, or t
  misc_feature (756)..(758): n is a, c, g, or t
  misc_feature (761)..(763): n is a, c, g, or t
  misc_feature (765)..(774): n is a, c, g, or t
  misc_feature (776)..(777): n is a, c, g, or t
  misc_feature (779)..(779): n is a, c, g, or t
  misc_feature (781)..(782): n is a, c, g, or t
  misc_feature (785)..(789): n is a, c, g, or t
  misc_feature (791)..(791): n is a, c, g, or t
  misc_feature (793)..(793): n is a, c, g, or t
  misc_feature (795)..(798): n is a, c, g, or t
  misc_feature (801)..(811): n is a, c, g, or t
  misc_feature (813)..(813): n is a, c, g, or t
  misc_feature (815)..(815): n is a, c, g, or t
  misc_feature (817)..(817): n is a, c, g, or t
  misc_feature (819)..(820): n is a, c, g, or t
  misc_feature (822)..(825): n is a, c, g, or t
  misc_feature (827)..(828): n is a, c, g, or t
  misc_feature (831)..(831): n is a, c, g, or t
  misc_feature (834)..(834): n is a, c, g, or t
  misc_feature (836)..(837): n is a, c, g, or t
  misc_feature (839)..(843): n is a, c, g, or t
  misc_feature (845)..(850): n is a, c, g, or t
  misc_feature (852)..(854): n is a, c, g, or t
  misc_feature (856)..(869): n is a, c, g, or t
  misc_feature (871)..(871): n is a, c, g, or t
  misc_feature (873)..(873): n is a, c, g, or t
  misc_feature (876)..(877): n is a, c, g, or t
  misc_feature (879)..(879): n is a, c, g, or t
  misc_feature (882)..(883): n is a, c, g, or t
  misc_feature (885)..(886): n is a, c, g, or t
  misc_feature (888)..(889): n is a, c, g, or t
  misc_feature (895)..(896): n is a, c, g, or t
  misc_feature (898)..(899): n is a, c, g, or t
  misc_feature (901)..(901): n is a, c, g, or t
  misc_feature (903)..(908): n is a, c, g, or t
  misc_feature (910)..(910): n is a, c, g, or t
  misc_feature (912)..(913): n is a, c, g, or t
  misc_feature (915)..(923): n is a, c, g, or t
  misc_feature (925)..(929): n is a, c, g, or t
  misc_feature (932)..(934): n is a, c, g, or t
  misc_feature (936)..(942): n is a, c, g, or t
  misc_feature (944)..(950): n is a, c, g, or t
  misc_feature (953)..(953): n is a, c, g, or t
  misc_feature (955)..(955): n is a, c, g, or t
  misc_feature (957)..(959): n is a, c, g, or t
  misc_feature (961)..(962): n is a, c, g, or t
  misc_feature (965)..(965): n is a, c, g, or t
  misc_feature (968)..(972): n is a, c, g, or t
  misc_feature (974)..(975): n is a, c, g, or t
  misc_feature (977)..(981): n is a, c, g, or t
  misc_feature (983)..(986): n is a, c, g, or t
  misc_feature (989)..(992): n is a, c, g, or t
  misc_feature (995)..(999): n is a, c, g, or t
  misc_feature (1001)..(1007): n is a, c, g, or t
  misc_feature (1009)..(1009): n is a, c, g, or t
  misc_feature (1011)..(1025): n is a, c, g, or t
  misc_feature (1027)..(1030): n is a, c, g, or t
  misc_feature (1032)..(1034): n is a, c, g, or t
  misc_feature (1036)..(1042): n is a, c, g, or t
  misc_feature (1044)..(1046): n is a, c, g, or t
  misc_feature (1048)..(1048): n is a, c, g, or t
  misc_feature (1050)..(1052): n is a, c, g, or t
  misc_feature (1055)..(1055): n is a, c, g, or t
  misc_feature (1058)..(1060): n is a, c, g, or t
  misc_feature (1063)..(1063): n is a, c, g, or t
  misc_feature (1067)..(1068): n is a, c, g, or t
  misc_feature (1070)..(1072): n is a, c, g, or t
  misc_feature (1074)..(1075): n is a, c, g, or t
  misc_feature (1077)..(1079): n is a, c, g, or t
  misc_feature (1082)..(1082): n is a, c, g, or t
  misc_feature (1084)..(1084): n is a, c, g, or t
  misc_feature (1086)..(1090): n is a, c, g, or t
  misc_feature (1093)..(1093): n is a, c, g, or t
  misc_feature (1095)..(1109): n is a, c, g, or t
  misc_feature (1112)..(1114): n is a, c, g, or t
  misc_feature (1116)..(1130): n is a, c, g, or t
  misc_feature (1133)..(1133): n is a, c, g, or t
  misc_feature (1136)..(1141): n is a, c, g, or t
  misc_feature (1146)..(1147): n is a, c, g, or t
  misc_feature (1149)..(1151): n is a, c, g, or t
  misc_feature (1153)..(1155): n is a, c, g, or t
  misc_feature (1157)..(1157): n is a, c, g, or t
  misc_feature (1159)..(1159): n is a, c, g, or t
  misc_feature (1162)..(1163): n is a, c, g, or t
  misc_feature (1168)..(1168): n is a, c, g, or t
  misc_feature (1170)..(1170): n is a, c, g, or t
  misc_feature (1175)..(1175): n is a, c, g, or t
  misc_feature (1177)..(1178): n is a, c, g, or t
  misc_feature (1180)..(1180): n is a, c, g, or t
  misc_feature (1182)..(1182): n is a, c, g, or t
  misc_feature (1184)..(1184): n is a, c, g, or t
  misc_feature (1187)..(1188): n is a, c, g, or t
  misc_feature (1192)..(1194): n is a, c, g, or t
  misc_feature (1196)..(1197): n is a, c, g, or t
  misc_feature (1199)..(1199): n is a, c, g, or t
  misc_feature (1201)..(1203): n is a, c, g, or t
  misc_feature (1205)..(1208): n is a, c, g, or t
  misc_feature (1210)..(1214): n is a, c, g, or t
  misc_feature (1216)..(1218): n is a, c, g, or t
  misc_feature (1221)..(1221): n is a, c, g, or t
  misc_feature (1224)..(1227): n is a, c, g, or t
  misc_feature (1230)..(1230): n is a, c, g, or t
  misc_feature (1232)..(1236): n is a, c, g, or t
  misc_feature (1239)..(1239): n is a, c, g, or t
  misc_feature (1241)..(1241): n is a, c, g, or t
  misc_feature (1243)..(1243): n is a, c, g, or t
  misc_feature (1245)..(1246): n is a, c, g, or t
  misc_feature (1248)..(1248): n is a, c, g, or t
  misc_feature (1251)..(1254): n is a, c, g, or t
  misc_feature (1259)..(1259): n is a, c, g, or t
  misc_feature (1262)..(1262): n is a, c, g, or t
  misc_feature (1264)..(1265): n is a, c, g, or t
  misc_feature (1267)..(1267): n is a, c, g, or t
  misc_feature (1269)..(1269): n is a, c, g, or t
  misc_feature (1271)..(1271): n is a, c, g, or t
  misc_feature (1273)..(1273): n is a, c, g, or t
  misc_feature (1276)..(1277): n is a, c, g, or t
  misc_feature (1280)..(1281): n is a, c, g, or t
  misc_feature (1283)..(1283): n is a, c, g, or t
  misc_feature (1285)..(1286): n is a, c, g, or t
  misc_feature (1290)..(1291): n is a, c, g, or t
  misc_feature (1293)..(1295): n is a, c, g, or t
  misc_feature (1299)..(1299): n is a, c, g, or t
  misc_feature (1302)..(1302): n is a, c, g, or t
  misc_feature (1304)..(1304): n is a, c, g, or t
  misc_feature (1306)..(1309): n is a, c, g, or t
  misc_feature (1311)..(1311): n is a, c, g, or t
  misc_feature (1313)..(1313): n is a, c, g, or t
  misc_feature (1316)..(1316): n is a, c, g, or t
  misc_feature (1318)..(1318): n is a, c, g, or t
  misc_feature (1320)..(1320): n is a, c, g, or t
  misc_feature (1322)..(1322): n is a, c, g, or t
  misc_feature (1324)..(1324): n is a, c, g, or t
  misc_feature (1327)..(1327): n is a, c, g, or t
  misc_feature (1330)..(1330): n is a, c, g, or t
  misc_feature (1334)..(1334): n is a, c, g, or t
  misc_feature (1337)..(1344): n is a, c, g, or t
  misc_feature (1347)..(1347): n is a, c, g, or t
  misc_feature (1349)..(1349): n is a, c, g, or t
  misc_feature (1351)..(1355): n is a, c, g, or t
  misc_feature (1359)..(1359): n is a, c, g, or t
  misc_feature (1361)..(1363): n is a, c, g, or t
  misc_feature (1365)..(1365): n is a, c, g, or t
  misc_feature (1368)..(1368): n is a, c, g, or t
  misc_feature (1372)..(1372): n is a, c, g, or t
  misc_feature (1374)..(1374): n is a, c, g, or t
  misc_feature (1376)..(1376): n is a, c, g, or t
  misc_feature (1378)..(1378): n is a, c, g, or t
  misc_feature (1380)..(1380): n is a, c, g, or t
  misc_feature (1383)..(1385): n is a, c, g, or t
  misc_feature (1387)..(1388): n is a, c, g, or t
  misc_feature (1390)..(1392): n is a, c, g, or t
  misc_feature (1394)..(1394): n is a, c, g, or t
  misc_feature (1396)..(1397): n is a, c, g, or t
  misc_feature (1400)..(1403): n is a, c, g, or t
  misc_feature (1405)..(1406): n is a, c, g, or t
  misc_feature (1408)..(1409): n is a, c, g, or t
  misc_feature (1412)..(1414): n is a, c, g, or t
  misc_feature (1416)..(1416): n is a, c, g, or t
  misc_feature (1419)..(1419): n is a, c, g, or t
  misc_feature (1421)..(1421): n is a, c, g, or t
  misc_feature (1423)..(1423): n is a, c, g, or t
  misc_feature (1426)..(1426): n is a, c, g, or t
  misc_feature (1428)..(1428): n is a, c, g, or t
  misc_feature (1430)..(1433): n is a, c, g, or t
  misc_feature (1435)..(1435): n is a, c, g, or t
  misc_feature (1437)..(1437): n is a, c, g, or t
  misc_feature (1442)..(1442): n is a, c, g, or t
  misc_feature (1444)..(1444): n is a, c, g, or t
  misc_feature (1446)..(1446): n is a, c, g, or t
  misc_feature (1448)..(1448): n is a, c, g, or t
  misc_feature (1450)..(1451): n is a, c, g, or t
  misc_feature (1454)..(1458): n is a, c, g, or t
  misc_feature (1462)..(1462): n is a, c, g, or t
  misc_feature (1464)..(1465): n is a, c, g, or t
  misc_feature (1475)..(1475): n is a, c, g, or t
  misc_feature (3522)..(3522): n is a, c, g, or t
nnnntnanaaaannncnngncnnnnncnnnnttnntnnnnnnannnnngntnnnnngnnnannnaaangnnntnnaaanngntnnncnaannnnccnaaaanngnnnngnngnnaaaannnnnaannnnnnnnncnnnnannnnnntnnnnnngnnnnannannnnntnncnnnncnnnngnngncnannnnnannnnannnnnnnnnnngnncnnnnnnnnccngnttnnnncnnnntncnnnnnnncnnnnannncnnnnccnnnnggnnttnnncngnnnannannnngnnnnnncnncnncnannnnnntnnannanntnntnnnnnnnnangnccnnnnnnnnnnngnnnccnnnnnntngnancngnnnnnnnnggnngnngnnnnnntnnnncnncnncnngnnnntnggnannnnnncnannnnnnnnnnaaaaannnnnnnntttnnnnnnnnnnnnnnnannngnttnnngnnntngnnnnnnnngnnnntngntnngnnnnnnnnnnnnnnggnntnaanccnnnnnngnnnnnanngncnaangnnntnnnnnnggnnnnnnnnnnnntnnnnnnntngnnnnnnncnnannannnnttnnnnnnntnnaannnnnnnncnnnnnnncnannnannnnttncnnnnnnnttnnannnttngnngnnnnnnngnnngnncnnnngnnnnnnntnnaaannnnnnnnnnnnnnnannnnnaaancnnntngnnnannnnnnngncnnnggnnnannnnnnnnnnannancnnaannnnntngncnnnnaannnnnnnnnnntngncnanntnnnngnnaanggntnntnnnnngnnnnnnannngnnnnnnnnnnnnnnancnaannanccnncnncnnaaaaanngnncnannnnnngntnncnnnnnnnnngnnnnnggnnntnnnnnnngnnnnnnnaancngnnnannccnggnnnnnannannnnntnnnnttnnnnccnnnnntnnnnnnnancnnnnnnnnnnnnnnncnnnntnnngnnnnnnntnnncnannnttnggnnnggntttnngnnnannannnttngncnnnnnggntnnnnnnnnnnnnnnnggnnncnnnnnnnnnnnnnnnaanccnnnnnnggcgnnannngnnnananttnngtgtntnttttntnnangngnttnnaaannncnngnannnannnngnnnnnannnggnttnnnnggncnnnnnaananananngnccnnnnaaaanccnanngntncncnaannccnnantnnaaanngnnnaacnccnantnnnnantnggntntntngnttntanaaanaannnnnnnnccncntnnnnnccgngnnncngcnccgngnantncncgnnncnngnnngncnnggnnnngnncnnttnnntnccntngnccncngnnnnantnccccncncnancnnaannnnntttngnnaaaaaaacgnaccatcgacacccaaattgtatcacgccacaaaaacgacggccgcaacaataggtgcaggccatctgggatgacatttgcttcgtcctcggctgatacggtgaaatcttggccatatagcgcataatctagtgccgctgccatgcgcgtattgggatttaatctgctgggcgccccatcctcaagttcggccaatggctgcaacagaatacgcgcgtcaacttgaaagtaatcgcaaatccgtttcatcaggccaggtttgggaaagctttcgccattcaggatgcggttcatctgaacacgattgacatcaagatgttctgccacctcggcaatggtgccaacacgtttacaaagttggcgcaaattgcgcccaaatattaaatgtgttgaaacattttcatcctgaacttgcaccctacactcctaacgtcgacagtaaacaactacctcatgtagacgtccttttgaacatttgcttacaaaactgtactttttactcatttttaatactttagtatacaaaattaaatctttcggatcacccccttatgtggggctttgtttatctggtgcaatcttatccaatttacctgcacaatgctttggtttatcgtcgcgccatggcgataccgatagatacatttttcttggacaccacgtcccaaggcacgttgcaggcccgcattcagcaaatgattgcccaaggcattctaagcgggcggttcaaacgtggtgaaaaactgccgtcgacacgaaaactggcaaatcatttgggcgtcagtcgcatcaccgtatcgctagcctatactgaattgctggcatcagattatgtagtggcgcgtgatcggtccggattttacgtatcagaaaacgcacccgatgcacccaaattcgcaacgcaatccacgccccaagacactgtagactggaccaaagcgattggtcagaaattttctggcggacccagcttgaaaaaaccgcaaaattgggcccagtttcgatacccctttatttacggacaaacggaccccggcctgttcgatcatgcaaactggcgtttatgtgccttgcgtgcactgggtgccaaggatttttccgcattaacggcggattatttcgaccgcgatgatcctatgctggttgaattcattgcgcgccattcgctgccacgtcgcgggattattgcacgccctgatcaaattttggtcaccttgggcgctcaaaatgccctatggctggccacgcaggtattgctgacccagcgccgcactgcaacgattgaaaacccatgttatcctgcgctgcgcgaaatcttggtgcaatcgcgctgccatgttcatccggtcgacttggatcaatttgggatgcagccagatttgatcccgcccgagacatccgtaatctatgcaacgcctagccaccaatgccccacaacattgaccatgcccctgcaccgcaggcaagatttgctgaaacgcgctgccgaattagatgcgatcatcgtcgaggacgactatgaattcgaaatcaaagaaacgggatccacgtcccccgcattgaaatcactggaccaagaggggcgtgtgatctatgtcggcagcttctctaaatcactgtttcctggcttgcgattgggatatttggtcggctctgaggcgtttataaaagaggcccgcgccctgcgtgcatcggtgttgcgccatcccccgggtcatatccaacgcaccgccgcctatttcctaagtttgggccattatgatgcgctgatcaaacggatgacgcggaattttaatgaccgccgttccaaaatattaaccgcaattgatgaatgtggcctgacaattcaaggtcgtccaccacaagggggatcatcgatctggatgcgtgcacctgatcacgttgataccaacgaactggccagccggttgatcgaacacagcgtgctgatcgaaccggggcaggaatttttcgacggacccaatgcgcccacaaatttttaccggctggcattttcatcgatacagccacatttaatttcagacggnattcgccaaatcgctgacgtaattcaagaaactggtcataatctgtaacgaaaactggccctattggaatgtcggttctcgctctagaaatagggccaatataattcactatctttaagactcgggagtcccaaatatgaaaatgacgacagaagaagcgtttgtaaaaacgttgcaaatgcacggcattcgccacgcattcggaatcatcggttccgcgatgatgccaatttccgatttgttcccgaaagctgggatcaaattctgggattgcgcccacgaaggttcggccggcatgatggcagacggatacacccgcgtgactggtgaaatgtctatgatgatcgcacaaaacggtccgggcatcacaaactttgtaactgcagtcaaaacagcctactggaaccacactccgctgctgttggtcacaccacaagctgcaaacaaaacaatcggtcagggcggtttccaagaagta

SEQ ID NO: 957 - DNA, 4000 bp, Escherichia coli
  misc_feature (439)..(440): n is a, c, g, or t
  misc_feature (634)..(634): n is a, c, g, or t
  misc_feature (2252)..(2252): n is a, c, g, or t
  misc_feature (2261)..(2261): n is a, c, g, or t
  misc_feature (2932)..(2932): n is a, c, g, or t
  misc_feature (2955)..(2955): n is a, c, g, or t
  misc_feature (2973)..(2973): n is a, c, g, or t
  misc_feature (3147)..(3147): n is a, c, g, or t
  misc_feature (3156)..(3156): n is a, c, g, or t
  misc_feature (3309)..(3309): n is a, c, g, or t
  misc_feature (3312)..(3312): n is a, c, g, or t
  misc_feature (3321)..(3321): n is a, c, g, or t
  misc_feature (3330)..(3330): n is a, c, g, or t
  misc_feature (3332)..(3332): n is a, c, g, or t
  misc_feature (3377)..(3377): n is a, c, g, or t
  misc_feature (3381)..(3381): n is a, c, g, or t
  misc_feature (3384)..(3384): n is a, c, g, or t
  misc_feature (3390)..(3390): n is a, c, g, or t
  misc_feature (3417)..(3417): n is a, c, g, or t
  misc_feature (3442)..(3442): n is a, c, g, or t
  misc_feature (3447)..(3447): n is a, c, g, or t
  misc_feature (3468)..(3468): n is a, c, g, or t
  misc_feature (3471)..(3471): n is a, c, g, or t
  misc_feature (3477)..(3477): n is a, c, g, or t
  misc_feature (3494)..(3494): n is a, c, g, or t
  misc_feature (3504)..(3504): n is a, c, g, or t
  misc_feature (3507)..(3507): n is a, c, g, or t
  misc_feature (3514)..(3515): n is a, c, g, or t
  misc_feature (3517)..(3517): n is a, c, g, or t
  misc_feature (3519)..(3519): n is a, c, g, or t
  misc_feature (3612)..(3612): n is a, c, g, or t
  misc_feature (3669)..(3669): n is a, c, g, or t
  misc_feature (3699)..(3699): n is a, c, g, or t
  misc_feature (3705)..(3705): n is a, c, g, or t
  misc_feature (3744)..(3744): n is a, c, g, or t
  misc_feature (3780)..(3780): n is a, c, g, or t
  misc_feature (3782)..(3782): n is a, c, g, or t
  misc_feature (3790)..(3790): n is a, c, g, or t
cacgaaaacagttaagctgatcctggttcaacataatctggcatttggtcccggccagggtgagtttaagtttataaagcatgtcgatcttcctggagaaatcgagaaatcttcattggtagaaataaaagatatcgtagaaaatatcgttcttgaagaagttgaatcatctgccgtggagaaaagcttgtttcacgcccttcataatatcaaactgggtggtgcaagcagcgctataatgcttatggagattgaagatatagggggagaaataaaggtcgtacccattaacttgacaaagagtgagacaatacggcttgcaagggaggtaggaggcaggcttattaaatatcgtattatgagtccggatggtttctggccggaaccggataatgagactaccaacgagcaaatactaaactggatagaggatgaggcnntgaatacactgcggcaaaaacagctgctggcgcataaggataaagatctgattgacgcattagacaaggttcataaaaagatgggtgaccaaaagattcaggataagaatgatacaattatgatacatgaaacaccctatcatgatgccgcaattacatggctgaaggagtggagagctacgaggcgtgggaanaaggcaatggaagagctaaactccgaagagtctaaggttagtaagcactacaggcagctgatctccagggctgaacgtaaatatgatgtaatgccatccattgccaaagatattatagccgtaaaacggcttcttaccgtaatgcgttctccattctgggactatagacccaatggacagattgtgattatggatacaggtatcgcaccagtaattttgcatagacatttgtcaacgctggaagtgctttccagtgaggatgttgttgttgccagtgtgttctcaaaacgtattggcggcagctctcctgaaaaaattgaacatctttgtcgaacctacgtggaggctgcttataacctgggcgctaaggttgtgattctctgtaataccatggatgccaatgcaagggttaaactggaaaaagagttttcaatacatattcttgggccaattattcctgcagtagaagctgtgcttagacttgagcaagctaatggaaagaggttaaagagtattgggattgttgcgacaaaggcgacgatagagagcggtgcttacataaatgaaattagagaacatgacaagggtgtcgggatattcagtatagctgcccctctttttgctactatggtggacaagggtgagtgtgatcagactggttttcaggtgactactccgcaaaacacgtctattatagaggagaatctgaaacctcttatggaaaaggacgtcgatgtccttgtgctggggtgtactcattacggtatatttgagtcggtaatacatgaggtttggaagcgctgtactggtaatgagattaacattattgattcttccagagagctttcccgttatgcccactccttccttaaagagaataaaatattgtctttaaggacgaaacagaagggaaagatcacctatatggccagcgcagaagatactccggaattcggacgaaaggtctcagagattacaggatatccggccaatgttgtaccgatagatataggtgaagtggtcggcagattgagcgaagaagaccgatcattccagaaaacagtggccagggaaagcagggaagacatcaatttaagggccggtattattaattctaatctatctgctgaggccaaagttgcagttgctgataaattatatggaataaaagataggggtgttaaccagcctgattgtgagatattatcgctggagctgaaagataagcatgtaaaggagatagtcggtttgactacgcaaaacgaagagctgttaacaattctttctcacatcaaaaacgctacatctcaataaatcaagaaaatcttccctccattttgtagctatctctgagagctccagaaacttaatccttgacagatatatagccggataatatattaggtgaacacgcgttcacctaattatgaaagctaaacttacaaataaacaacataatttcctgtcatttttgacgaagtatatccgggaaaatgggtatccgcctactattcgggagatggtatatcaccttaaactggcgagtaccaacagtgtaaagaagtatctggatatacttgaacgtaagggatacataaagaggataccaaacagtccnagagcaatngaagtgtgtgcggaaacacccgggaaccaggcaaagctgatacccgtagtcggaagggtcagggctggagcgcctcacctcgcagttgaagatattacaggacatctggccatggatgcgtcggtggctcgttgggatgataccttttttctcagagtggagggggacagtatgatagatgcccatatccaggacggtgattttgtattagttaaatcccagcaaaccgcagagagtggtgatatcgtagttgccattattaatgatgaggcgacggttaagaggtttttcaagagagacgatagcatttatctggaaccggctaattcgacgatgaagcctataattattagagaagatcaggccaatgagatgatgatagccgggaaggttgtgacagtgttgaggcagattaaataaatatgattacggagataggtgaacctataaaagcaggagtggtatttggcgctgattgtatcggcggaaagaagataaaaccggtatggtttatatggaaagagaaacaataccgtatcaaggaggtaacgtatacatggacaggcaaagaaggcagtgcttcagtccactatttttctgttacagatggtcaggatttgtatgagatagcctacaatacagagactatggtatggatgcttatggctgtngaagtggaaggataggttaagtnaaaagtgtctgaagtttnaagtgaactaaaattatgaacaacagaacaataatgcatgtagacatgaatgccttttttgcttctgtggagcaacagtctaagccttcactcaggggtaagcctgtagccgtcattggtgcacagcaaaggacagtcattaccacctcttcatatgaggccagggcttatggngttaaggtnggtatgacagtgccggaggcaaagaagctctgtcctgatataatatttgttgcaggtaataataaaaagtatacagacacatgcacgcgccttgtaaatcttttcggggactatacaccgttggtagaggtatattcagttgacgaggcattnctngatataacngggtccctntncctttttggtaaaccggaagatattgccatgcggattaagagaangatnctnaggggntttgggcttacctgctccatcggtgtnggccctaacaagttgctggcaaaantggcnggcaatatgcagaaaccgganggntttacnacaatacatcccggggncgtttctganatncttgaannantnccggtgggtgaactctgtggaataggatcgcggctggagatacaccttggagctatgggtatcaagacgtgtggggagttgggaagatttccngtaaaggagttggtaaataaatttggtgttattggcaacaagcttcatcaaatgggnctgggaatagatgaaaatcctgttgtcccnatcgangatacgccggatgcaaaatctgtcggccatagcatgacncttaagaggaatgtaagtgacggtgaagagatggananatatctgntgcagctttcggaaatggtggggaggcgattgcgccgcggacactacttcggcaggacagtagccatgaccttgaggtattcgaatttccaaacatttacaaaaagatgtaccgtaaaagaatatataaatgacggatttgacatataccttgtcgcactcgatatagtaaaaaagataaggctcaaatatacggtacgactgctgggtg

SEQ ID NO: 958 - DNA, 4000 bp, Escherichia coli
  misc_feature (6)..(7): n is a, c, g, or t
  misc_feature (12)..(12): n is a, c, g, or t
  misc_feature (16)..(17): n is a, c, g, or t
  misc_feature (19)..(19): n is a, c, g, or t
  misc_feature (21)..(22): n is a, c, g, or t
  misc_feature (26)..(27): n is a, c, g, or t
  misc_feature (29)..(30): n is a, c, g, or t
  misc_feature (32)..(32): n is a, c, g, or t
  misc_feature (35)..(36): n is a, c, g, or t
  misc_feature (38)..(39): n is a, c, g, or t
  misc_feature (42)..(42): n is a, c, g, or t
  misc_feature (47)..(47): n is a, c, g, or t
  misc_feature (51)..(51): n is a, c, g, or t
  misc_feature (54)..(54): n is a, c, g, or t
  misc_feature (59)..(60): n is a, c, g, or t
  misc_feature (62)..(62): n is a, c, g, or t
  misc_feature (64)..(64): n is a, c, g, or t
  misc_feature (672)..(672): n is a, c, g, or t
  misc_feature (677)..(677): n is a, c, g, or t
  misc_feature (681)..(681): n is a, c, g, or t
  misc_feature (688)..(689): n is a, c, g, or t
ttaaannaaaantaannantnntttnntnntnttnntnnttnttatntatntanataannantntttttttttttttttttttaattaataattaatagtgaatgattatttttattaaaaaattgtttatagttaggtaaatatggacgtattatctatttaatttttcaatcaattagaatggtattggtttgaaaataaaataataattaatgttaaattgtactaattatttttttatcctaatataaattaaaataagaaaataattataataataaatgataaatattacatatataatatgctatttacaagaagtgaaaaaaaaaaataataataataatcatctttacaaaattattataataataataatatatataagataataattgaaattttttaaacatgagatttaaaaatttttatattttttttaaataattattgtttataaaatttatttggttaaatatgaaatgatttgatatatatatatatatattaaaaaataaataaataaataaataaataaataataataaaaaataaataaattttaaattatataattatttatttacttatttactacattatttttatttaaatctttatttatatacttatgcttatgctttataaataacctttttttatttactttnataanaaanttctatnnaaaaaaaaaaaaaaaaaaagaaaaaaattttgatttatatttataattttttctttaagcttatttactattttatttttcgattcgttttttatatatattttcatttaactttcttccttttttaacttttatttttattgttattttttatattattattattattatttttttatcttattttatttcttaaaagttgaaatggaaattattattggaaccaaatggaccaccattaccaaatggaccaccattaccaaatgggaaaccaccaccaaatgggaatccatggaaaccaaatggattaccaccttgaccaccgtttggatcatttggatcttcaccattatcgaaccgttcacgagtttcatcattacttaaaacttcataagcttcattaatttcactcattttattttctacttgatccttggtcatttcaccatggtatttatctggatggtatatttgagctaattttctgtaagcctttttaatttcacgtttagtggcagttttcttaacacctaagatcttataataatcctttcttgaggccatcttttgcaatctttgagctttttggtatccttctataattctttgatcttgtggactgtattcatgggctgaagaataatctcttaaggcagcatcatattcttctaataacataaatgcttctgcacgattaattaataattcgacatcttgattttcaatatctaaacctttagtacaatatcctttagcagcttcagccttctttaatcttaaattagccttacatgcagcaaagtaaattttatacttcaatttatttgaaccaatagcttctacctctgaaactaaaccactattcaccttatctataatatctgcccatttcttatcactcatacaattatcaatatatttaagagaacgatctaactttttaatttttttgaaaagagccttacattgtttatgctccggatcacgacgtaaacattctttaacttctgttaatgaactttcaatttctccaatggccatatgtaattcaccaaccctaactaatagatcagtgttatctggttgaagtttaacagctctggaataatcaccaatagccatttcagtttcattaatatttaagtaagattcagctcttaattttctaatttctaaattttgtggacaatgttgaataacttctgaaagatattcaatagcttgcttataattcttttttttaaattctgattttgcgttattaagtaattgaccaactacctttatattattaatctaaatgatttttttttttttaaaaaaaaaaaaaagtatatttatagatatggtataataaacaattttattaataaaattaaatatataaataaatattaaataatatataaaaaattcatttatttcattaaaataattataaaaggtaatacaaaataataataataataatattctatacgaaattattaaaataaattcacataaaaataaaaaaagaaataaaacataaagcaattacaataattaaaacaaccataatattaataataataataatataaatttatttaatttttcatatatattatcatatttaatacatacaatttcatctgtttcaccgtctgatggctttaatttcttataatgttcaatatcatctttagccttatcaagttcagctatttgaaagtataatttacctcttttaaggtaagcttgttcgaaatttggatttatcttaataagagatgtgaaatcatcaatagcactttcggttctcccaatattaatatagagaatagcacgtctaatgtaaattaaaaaattatttgggtcatgacttaaagcttcagagtaaacacttaaagcttcatttaaatttccagtgcttactaaatgttgagcagtgttgagatactctgttgtacttttagcttgagcttttgctaaaaagccaaatgcagcaaaagttattagtgataattttgaaaaaatcttcattatgaaatttttctttcttatcgattttattactttatttgattaatttttattttttttttatgcttttttattataaactttataaattgtaattatttatgatatattgaatttatcactttatgttatattgttattgtttatattgttgttttgttattaaataaatgcaaacttctattaatatatatataaataaataaaaaaatttttttattaacttttataacttttcaatatttcttaaataaatttttattattttttataaattaatattatttatttttaattacctgaataaattttttaatttaaaaaaaaaataattatatgtttattttggtatgtttttaaattaatcactttttttttatagatatactttggataaatattataaatatctaaaatttatatatatatatatatatactattaaaattctaaaattagtactttaaatataacgaaaaaaattttattttttattttattttttatttctatttcttgttacttatatcttaaatatataaatatattttttctcctaatatataattttctaatatgttttattctttctaaatattaaccttttttattaaatattaaccttttttcaattaattatatataaaattcctcaatcccttaatttttaaaaatataatttacatttataaaaaattaaaaaattaaaaaattaaaaaagaatgaagaaatataataaagaaaaaaaaaatattaaaccttttatatctttttcattattaaaaaaaaactctaaattatggaataattttaattatttttcatatcaatttatcaatattaatataatataataaaataaatgaaagttaaataaataatatttaaattaaatggataaataaataatatttagataatctctattaattaaactttaattattattaattataatattaattattctgaaaaaaaaagagtccatggaaaaaatatttaaatataaataaaaaaaataactctcattcttttgattaattactaattataatatattatatattcacctttatattacattaaactttaatatgtaatcttaaatataattatatatactttaaatagagtgcctatttaatttaatatattatgaattctttaaatttatttttaaatcaatcgaatatttatatatagaggttaatataaaaaatagcaaaaaagtttattaaatatttatgaatattttatatataatatatagagttttatcctttttt

SEQ ID NO: 959 - DNA, 4000 bp, Escherichia coli
  misc_feature (1978)..(1978): n is a, c, g, or t
  misc_feature (1985)..(1986): n is a, c, g, or t
  misc_feature (3349)..(3349): n is a, c, g, or t
tggtcatctcgatcttcttttcaatcgcttggatttcctgcgaaaaatcgaggtctgactccttggacgactgcaagatatcttccaactgcttctctaaatcaagcaggggcttttcaaaatctaaactctgtttattttttttctgcatgcgaaaattttaaaatgatatgagcgacatggtaaggcggttaatcatcctgagcaagttcttccttccaccccagaattcttgccttggaagtcgcctcctctgccccgtctttatcccctttatttacaaggatacgggcgaggcttacggtaatggtcaaatcctccggactaagctgcagggcttgacggcatgcctgctcggcatcgtctaagttgcctctcgaaaggcagacttccgcaagtgcgcgccacgcttccacacaactggggtgttcctgaagaatcgcccggagttgagtttccgccacttcctcttccccgagtgtaaattggagaacagcctgattaacccgatcttctacagaatccatggtggtttatacgattggtgatcccggtattttggcaacttgaaaaacgcatcgccacatcgtgttgtaagttcttgtgtttacgaccttcatggtgcattaaattacagactttactaatttcagctcacccgccttaccccttccccctatgctttccagcgatccggactttcaacaactcctccttctgcacagccgggaccgcaggctcaagaccttgcagttggatttacaaaaactgccggccgagctcgagcagatggacaagaagatacacgatgaaaaagagtccatccgtatggcgatggaagaatggaaggcacttgagagcaaaaataataccctggaaaaagacattctttcccaccgcgaccaaattgccaggcagcgcaaccggcaactcgaagtaaaaaagaatgaggaataccaggcactggaacatgagattgccaacctggaagccaagatcgacgagttggaaagtgagcaaatcgaaacactcgataaaatagatgatgcccgagaaactgcggaaattgctgaaaagaaaattaccgaacgggtgcatgagttggaaaaggcacgccagcaaagagcggattttggcagggaatccgaagccgatgtcacatcactgatccaacaaataagtgaaacacgagaagaagtagaggcggactttcttacaatctacgaccgagtaagcaaaattgtatcccgcccgccctacatggcgccattggaagaccaaaaatgctccggttgccacctccgcgtatccaatgatgtcgtgtcctctgtgctggtggaaaaaaagcttacccagtgtgaccagtgtggaagaattgtgtacattgaacggtagcgttttacaaaatctgtcgaataagcacagcctcagcggtgcaaaagacagcgggcgatacgacccagattttcattttttaaatttccgagaaacggtcattcgctacattgctttaggtgatgatagaggaaagtccggacatcacagggcaggattccctgcgaaagcggggggtgcttgcttgaaggcaagttcacggccagtgccacagaaaataaaccgcctcactcgtgaggtaagggtgaaatggtggggtaagagcccaccgccgcctgagcaatcatgcgggcatggtaaacccaatccgatgcaagacgaaataggaaaccgggcggcccgtcctatggtttcgggtacgtcgcaccctcgtccgcgagggatcgttcctttacacaaaggagcgatagatgaatgaatgaccttcctcacttttgtggagaagtacagaatccggcttacagtttctcggaattcattttttaacctttaatcctaacttcactttcggaggtttaccggcacagtacggggagttgaaaggcagacatttgcaattgacgattccccgatccgaacattnaatactnngctcttatggcaaacacacaatctgcacttaaaaatattcgcaagaaccgcactaattatctgcgcaatcgctctgcggccagccgtctgaagacactagaaaagaatttcctgtcccaaatagaagagaaaaaccaaagtggggccacagccgctgccaccagctttatctctgcactggatcgtgcgtgcaaaggaaatttgattcaccgcaacaaggtagctaggaagaaatcccgctgcgcttccctgattgctggtctttctgcttaattttttaattctggctcgttgagctagatatggcgggaatcgttctcgtctttctgggagtacccagactcttggcggtcgtgatttaccttatttttcttgaggtatgcctcgtgcacatcttcggcggacatacccatgacttgagcaagtgaaatcaagaagtgaaacaagtccacaatctcgaccttcgcattttgcttatcaaactcctgatattttgcccaccatttccagggcacagaatcggttaattcagcaagctcctgctgcatggcccgcacatagttgagaatccacttcgctcggtcctcgtcgttcatcgcactcatatctactccaatccgtcggtttagctcatcctggagttcaaaaatgttgtctaatttatccataggtgggttcataacatcagtagaaagaatggaggcaagtggtttctcttttttcggttaaacttcctgcttttgtcttgtcgaaaaacccacctcgttggtatggtcattccttttgcttaacttggcaaagcacccaactctatctctgcacccgttgcccccaagtgggcaacccgaatccaacaatattacttccaaacggatacaaaatccgtagttttcatgaaatcaagaattcgttcccgttggcaccgcgcaaatgaaaaaccgctcgaagcccagtccaccacccctacccgtgctcccatgggtgaatttattccgtctgaagatcagccccttgtggatgatttaaccaacgccaagcctcccgcccaaagcgaaacatcccagcccagaagagagcgttcagaatttaaaaaaccacgcaatgatcgcaacgggcagcgccgtgggagaaaccatcgcggagagaacaaaccaggcgatcatgagtccgatggcgaggaaagaccaagaaagagaagacctcatggaaagaagcctcactcttcccgtggtgagaacaaccgtaatcgcaaccgcgacgacaaaaattcttcgtcccgaggcaaccgtcaaaggaacaagggagaatccgaaaaatcaagaggccccagaaagtcgaacgggcaggctaaaagctctccggncaagaaatcggggctgggcggatttatatcaaaacttttcgggggataatgccccccaccccactcctgatcaggtagtcgagtggaagtctttcgtatagaaggaggaaattgcctacatggagaagtggagattagtggggcgaaaaattccgcacttcctctctttgccgcctctttgctcagcactgaagacaccatcctcgaaaatgtgcccaacctgagcgatgttcaattcatggctcaactcttggagcaccttggtgcgagggtcgaaaaaattgatcccaacacctggcgcatttccccgcaaaacataaacccggacccgccctatgaattggtccgaaagatgcgtgcctcgatctgcctgctcggcccactggttggccggttaaaaaaagcaaatatgcctatgcctgggggctgcgtcattgggaaccggcccatcgatcttcaccttaaggcactgtctgacctcggggcagacatacagctgcgtggaggggtggttgaggtggatggagcaaagatggttggcggttctgtctttcttggtggcaggcatggaagcacggtgacaggtacggcgaatgccatcatggcagcggtacttacccccggaagcacccgcttggaaggatgtgcctg

SEQ ID NO: 960 - DNA, 4000 bp, Escherichia coli
  misc_feature (11)..(11): n is a, c, g, or t
  misc_feature (1988)..(1988): n is a, c, g, or t
tcaaaacaggnatgagtgaaaaaaaagcattcaaaatgattgatggaggttatgatgcaacatttaccttggcaaatttgaaaaaagatattacaactatgacaaatgcagctaaagaattagacataaaattaccaatgataacaaaagcagaagaaatttacgaaaatgccgtaaaagaaggattaggagatagagactataccgaaattatagaatatattaaaaaaatcaataatttatgataaattgattcatgaaatgacaagtaacacaaattctataaactatgaaaataagatgagagtgtgagattagattcaaaaatagctattgtcacgggggcatcaagtgaaataggcaaaggtattgtaaaacgatttgtaaatgaaggtgcaaaagtagttttaattgcaagaaatttagatgaattggaaaaagcaagaaaagagattggtcatgaagaacaaacaacatcagtgatatgtgatgtaacagaagaggcacaaacagttcaagcaattaatcaaattatggatacgtatggtaaaattgatattttagtaaataatgcaggtacaattaatgatccaaaacattttcatcaaatggaagattctgaaataaaaaaattacttgatgtaaatttgttaggagtatttcacatgacaaaaagtgtgttaaacaaaatgttagatgtaaaaaaaggaacaattatcaacataggatctatttcaagtgaaagagcaattccacgtgttcatttggcagtgtattcttcaacaaaagctgcaatctcaatgttcacaaaatcaattgcagtagaatatgcaagaaaaaatattagatgtaattgtattaatcctggaataattaattcaggaatgattaaaccatatttagatgatcctcaagcaagaaaaattttagaagaaaaatcaccacttgcaagaataggagaaccagaagatgttgcaaatgcagtactctatttagcatcagatgaagcaaattgggtaacaggtacaattctaaacatcgatggtggaaaatcagctgcagaataagaatacaaattatgtaacatttgagaaactagtaattttttcaatatttgagaacagatttattttttttcaaatatctgcgataagagagtccagttacaagcattacaattccagtaattaatccccacatagcaaaagagttaagatcaaattcagacataatttagaatataatttgaaacatctaaagtttaggatttcaggaatggattaaataatttaccttagaacaagtctgaaacatctaaatagatttgacattgacaagatttatgcctgaatttagatgcgaagattgtggaaaacgtctatttcatgaaaatgagacaacgttagaaattgaaaaaacagttcattcaaaattctgtagaaaaacaaaaggagaaacacatagctttatgcatagagatctagcacatatggaaacttttgatgtagaaagagaaaatgacaccacaggtaatccagtacttaaaaaataaattttaaatcatacctcaaaattatatcctagagaattatcatgaaatttaattggttgaagagtatcattatgatttagttgtagtaggggcaggtccagctgggtcatcagcagcatttgcagctgcaaaaaatggaattaaagtggcgttacttgaaaaagaaaactcaattgcagaaacagttagaacaagtggcgttacgtggattgagagtatcaaggagtttggaattccagaagattgttttaatccaattaaaaatttctcatttgtttcaccaaataatgaagttaccataagtgattcaattgcaactgcagcagtattagatgtaagaaaaacatatcgatggttggcaaaagaagcagaaaaagtaggagtagatgtttttgtaaaaatgaacataaatgaagttataaaaaataaagagaangatattgtaggagtaagcggagtaggaccaaatggaaaagcaatatttcattccaaagtaattattgatgctacaggattttcttcaataatttccaaagcaatgggttttgttacacagtgggaaagatttggagcaggtgcagaatatgaagcaaaagttgaaaatgttgattctgaaacatggtggttgatggtagggcaagagtacactcctgcaggttatgcatggatttttccattagggaataatattgttagaattggagttggagtaggtaaaccagaatcagatgttgatccaactcaaagactaaaagaaataatagaaaaaaagttaggcccaattaaaaaattaggaaaaattactccaatagaattccattatggtttaattccaaatgatgggttatcaagaaaaacggtttttaataatttaattttagttggagattctgcaggacaagcaaatccactagtgttagaaggtatcagatatgcgataaaatttggcagagttgcaggtaaagttgtagcagatgcaataaaaaatgaaaaaacaaatgaaagtgcactatacccatatgaagagaattggagaaaagcaattgagtcaaaaattaaatctgcaggaaaagttcaagatagatggattggtttatcagataaggaatgggatagagaattagatataatcaaagaattgaaaacagaagaatttttggattttattaaagcagagtttgggttatcaaatatgttaaaactagcattaagtcatcccaaattagcagtaagacaacttttcaatttagtaaaagggaaataatttatttaaaaaaaatcatgccgtagcaactacataggtgtagaagctaggcacaattctaggcacagatatggcatggttggtcggtttggacatacataatgaatgaagttgtttgagtcaatgtagattgtagattacaaatcatgtaatagttgttgaaacaatgggagtgttttgttgcttcaagtgactcattataatttctacaagatatgtcaaacaatttcttttcaaaataatttatcaaaaattagttataagcaacgcgtagaatttattcgaatcaatgatcagtatcaagaagattataattaaatgaataattttaaaacatgtggataaagtaagagaaaaatttgatgattgggcagagaatggaaaagcagaatcaatggaaaaagaacatggaaaaaatgtattaaaatttttgaataaaatttcttttaacaaacctttttcatttttagatgttggatgtgggaatggatgggttgtaagatacatatcaaatatttcaacatgtaaaaaaacaatggggatagataaaagtaaaaaaatgatcacacaagcaaataagaaaataaaaaataataaagaaagttttgtctacacagatatagaatcatggaaatatagaggaaaatttgattttgtttttgcaatggaatcaatatactatgcagattccatagaaaaagcaattaagaaaatttacaaattactaaaaccaggaggacaatttttttgcggtacagatttttacacagataataaagcaactacaaaatggagtgatatgatgaaaattcaaatgcatttacattcaaaaaaagaatggaaagaatttttcaaaaatgcaggttttaaaacagaaacaaaacaaatcaaagatttgaaaggtaatgaaaaatggaaaagagaaatgggaactttattcatcataggcacaaaaccttcaaagtaatattcaaatcagattacaaagtaacacaatcatgtgagctggagcacgacatgctgctacggcagaggaaactcctccctccatacaggaaatgtgatctggagatagataatcagagatggttggcaacggagcagaaaataatccaatatggcgcacagtgatggtgaaaacctgaggtttccataaaaggaatgaaacagacgacccacatgga

SEQ ID NO: 961 - DNA, 4000 bp, Escherichia coli
  misc_feature (732)..(732): n is a, c, g, or t
  misc_feature (799)..(799): n is a, c, g, or t
  misc_feature (854)..(854): n is a, c, g, or t
gcttcccgccgtcgtccccgacggcgaccagcggccgccccgcacgacccacccagcccacgcgcacagcgggcgtcccggcgaccagcgcgtgcgcgggaacatccctggtgacgacggcgccggcggcgaccgtggcccaggccccgatgcgcacaggggcgacgcagacggcgcgcgccccgatggaggcgccctcctcgatggtcacgcccacgggctcccagtccgaggccgacttgagcgagccgtccggattgacggcccgcgggaagcggtcattggtgagcgtcaccgccgggccgatgaagacgccgtcggccagcaccgccggctcatacaccagggcgtagttctgcaccttgcaatgacgccccatccgcacaccctcgcctatgtaggcgccgcgccccacgatgcagccctgaccgagcacggcgcgctcccgcacctgcgccagatgccacaccgccgttccctcaccgatgacggcggcctcggacacatctgcggacggtgcgatacgggtggccacggcagctccttatggatcatgatcacgagggaggcgagcgaagcgggcgacgtcgaagtgagacggcacagttattttaagcccgatacggactttcgacgagccgtgtaagaatgccggggtgacgtcgtccccagactcctccatctccccagaacagccgcatcccgacgagctgacggatgcctggctcgtgnttccgctgtacaacgaggctcaggtcatccgcggcgtcatcgaggaggcccgccggaccttcccccntgtcgtcgtcgtcgatgacggctcgcaggacggctccgcggcgcaggccgaggcngcgggagccgtcgtcgtgcgccaccccatcaacctggggcagggcgccgccctgcagaccggcatcagctacgtgctggagcgcaccgatgcgcgctacctcgtcacgttcgatgccgatggccagcactcggccgccgacgccgccgccatggtgcgggccgcgcgcgacgaggacctggcgttcgtgctgggctcccgcttcctcgagggcccctcaccggtcggctggctcaagcgcctcgtgctcgccacggccgccgcggtcgcctcccgcaccaccggcatgcgcatgaccgacgcccacaacgggctgcggatgctgcggcgcgatgccgccgagcgcctcgacctgaggcagaaccgcatggcgcacgccagcgagatcacccgccagctgggcgccaccggcctgccctggagggagtacccggttcacatcgagtacaccgagtactcgaaggccaagggacagtcgctgctcaactccgtcaacatcctcgtcgacctgatcttctcgtgacccgactcgcgcaaggaatccgcccatgagctcccagctgatcatcaaggccgtcctcctcgtctgcgtcgcggggatcggatggatgatgctgcgctcccccggcggggcgcgccatcaggccgggcgcaggctcgccactctggccttcgtgttcttcgccatcgcggccatcgccgtgccctcgctcacggcgcgcctggcccacctcgtcggcgtggggcgggggaccgacctgcttctctacgccctggtggtgggcttcctgatccaaatcctctcgtccttccgccgcaacgccgcacgcgaaaggcagatcacccgcctggcacgacggatcgccctggacacggcacccgatccgcatcaggaagcggctgagcgtcaccccgattcgcgcccaacacgagactcgggtcatagaaccgcatgagctgagcacgtatggtgaccacgtgtccacaccacctgtacgccatgcggcgcgcgagctgcgccatcgagtcctgcgcaacgtcatgctgtgcctgctggcgtgcgtgctcttcgtgaccacgggggcgtgggcggcttatcacaatctccaaggaaagatcggcgtcaagcccatcgacaccattatcggcggggaccgccccgacggccccacggaccactccttcgaggggcgtgcggtcaacatcctcgtcatggggtcggactcgcgcaacggccaggtagtcaatgacgacacggagggcatgcgctcggacacggccatgatcgtccacctgtccgaggaccgcagccgcatggacgtcatctcgatcccccgcgacacgatggtggccatgccgtcgtgcaagcttcccgacggctcggagagcgatccctcctcctacgccatcttcaactccgccttctccaccggggccaacaactcctccaaccccgatgacgtcgcctacgccgcggcgtgcacgatcaagaccgttgagaagctcaccaatgtccgcatggacgagtacatggtggtggacttcaccggtttcgagagcatggtcgactccctgggaggcgtgcccatgtacgtcgaggaggacgtggacgacgagaaggccgacctccacctcagcaagggctgcaacacgctcaacggcgcccaggccctcggctacgcccgtgcgcgctactcgctgggcgacggctccgatatctcccgcatcggccgccagcagcagctggtcggcgcgatcatgcgcaccgccaagtcgaagaacctcctgacggacatgccgactctctacagcttcgccgagtcggccctgtcaacgctcaccgtcagtgaagggctggggggaatcgacaagctcgcagggctggccaatagcgccgccagcatcggcatggacaacatcaacttcatcaccatgccggtcgaggaggacgacatcgaccccaaccgcgtgcagcccagtgcgaaggccgatgacgtctggaaagccctgcacgacgacaagccggtccccgaagaggccgtctccctgtccgccgacggcacctcccccagccaggaggcctcccccaccgacgactccagcgggaccggcgatccgacccagggcaaccagcccaccccggcggctcccgagaatccaggcgccgggtcaggcgattcggggaccgtcgatcctgccacgcagtgcagctgacagttggccccgcacattcagccgcagctcaaccgcacctgacacaggcagtggcacagccgctatgacacgaagaaggggacgacctcagtgactcctcctccggatctgcccccgtccttcggccccggcgcctccggctcatcgaatcgccgcagcggcgagaacggcgagaggcgggcatcatcggcgggatcggccgactcggccaggcgggcggacgccggttcccctcccacgatcaggcgccccccggcgcccgcgggtcggagcgccgcccaggcaccgcagcgccgctccctgcgccaagaggggtcgaagcagggcgccgatgcgggctcggccggccagcgccggccgggcagccatgtgcgtccggggtcctccgccgtcccgatcgggcagcggccctcaggtcccgaacccacccgggcgctgcccaccagaggcgccgcctcatccggagccgcctggaatggtcagccggacgccgggttcgtacggccggacagcccgttccccccgtcgacgcagcccgaaggcaccccggaaggcactcggaggcgccgtccgctgcggtgggtggcggcgattctcgtcctgctcctggtgctcatcatggggcgcgtggcatggctgtggcacgacatcgactccaagctcgatcgcattgaggcgctgtccggggccaaggacacccccggggagacctggctcatcgtcggctcggactcccgcgatgacggaggggtgccccaggacggcaccgagggctcgcgcgccgactcgatcatggtgctccacaaggcgtccaacgggcaggcctcgctgatctccctgccgcgcgacacctacgtggagatccccggctatgacgacgacaagatcaacgcggcctactcatacgggcaggccccgctgctggtggagacc

SEQ ID NO: 962 - DNA, 4000 bp, Escherichia coli
  misc_feature (4)..(4): n is a, c, g, or t
  misc_feature (31)..(31): n is a, c, g, or t
  misc_feature (37)..(37): n is a, c, g, or t
  misc_feature (40)..(40): n is a, c, g, or t
  misc_feature (46)..(46): n is a, c, g, or t
  misc_feature (51)..(52): n is a, c, g, or t
  misc_feature (55)..(55): n is a, c, g, or t
  misc_feature (88)..(88): n is a, c, g, or t
  misc_feature (94)..(94): n is a, c, g, or t
  misc_feature (97)..(100): n is a, c, g, or t
  misc_feature (109)..(109): n is a, c, g, or t
  misc_feature (115)..(116): n is a, c, g, or t
  misc_feature (118)..(118): n is a, c, g, or t
  misc_feature (120)..(121): n is a, c, g, or t
  misc_feature (126)..(130): n is a, c, g, or t
  misc_feature (132)..(132): n is a, c, g, or t
  misc_feature (136)..(137): n is a, c, g, or t
  misc_feature (142)..(142): n is a, c, g, or t
  misc_feature (144)..(145): n is a, c, g, or t
  misc_feature (147)..(148): n is a, c, g, or t
  misc_feature (165)..(165): n is a, c, g, or t
  misc_feature (168)..(168): n is a, c, g, or t
  misc_feature (172)..(172): n is a, c, g, or t
  misc_feature (181)..(181): n is a, c, g, or t
  misc_feature (183)..(183): n is a, c, g, or t
  misc_feature (196)..(196): n is a, c, g, or t
  misc_feature (205)..(205): n is a, c, g, or t
  misc_feature (212)..(212): n is a, c, g, or t
  misc_feature (214)..(214): n is a, c, g, or t
  misc_feature (217)..(217): n is a, c, g, or t
  misc_feature (219)..(220): n is a, c, g, or t
  misc_feature (222)..(223): n is a, c, g, or t
  misc_feature (226)..(226): n is a, c, g, or t
  misc_feature (244)..(245): n is a, c, g, or t
  misc_feature (247)..(247): n is a, c, g, or t
  misc_feature (253)..(253): n is a, c, g, or t
  misc_feature (256)..(256): n is a, c, g, or t
  misc_feature (271)..(271): n is a, c, g, or t
  misc_feature (273)..(273): n is a, c, g, or t
  misc_feature (275)..(275): n is a, c, g, or t
  misc_feature (280)..(281): n is a, c, g, or t
  misc_feature (287)..(287): n is a, c, g, or t
  misc_feature (289)..(289): n is a, c, g, or t
  misc_feature (292)..(294): n is a, c, g, or t
  misc_feature (307)..(307): n is a, c, g, or t
  misc_feature (310)..(310): n is a, c, g, or t
  misc_feature (319)..(319): n is a, c, g, or t
  misc_feature (323)..(323): n is a, c, g, or t
  misc_feature (331)..(331): n is a, c, g, or t
  misc_feature (336)..(337): n is a, c, g, or t
  misc_feature (342)..(342): n is a, c, g, or t
  misc_feature (346)..(347): n is a, c, g, or t
  misc_feature (349)..(352): n is a, c, g, or t
  misc_feature (355)..(355): n is a, c, g, or t
  misc_feature (358)..(358): n is a, c, g, or t
  misc_feature (361)..(361): n is a, c, g, or t
  misc_feature (363)..(363): n is a, c, g, or t
  misc_feature (367)..(367): n is a, c, g, or t
  misc_feature (373)..(373): n is a, c, g, or t
  misc_feature (394)..(394): n is a, c, g, or t
  misc_feature (397)..(397): n is a, c, g, or t
  misc_feature (403)..(403): n is a, c, g, or t
  misc_feature (409)..(409): n is a, c, g, or t
  misc_feature (421)..(421): n is a, c, g, or t
  misc_feature (424)..(424): n is a, c, g, or t
  misc_feature (427)..(427): n is a, c, g, or t
  misc_feature (430)..(431): n is a, c, g, or t
  misc_feature (435)..(436): n is a, c, g, or t
  misc_feature (445)..(445): n is a, c, g, or t
  misc_feature (454)..(454): n is a, c, g, or t
  misc_feature (456)..(456): n is a, c, g, or t
  misc_feature (458)..(458): n is a, c, g, or t
  misc_feature (460)..(460): n is a, c, g, or t
  misc_feature (463)..(463): n is a, c, g, or t
  misc_feature (466)..(466): n is a, c, g, or t
  misc_feature (472)..(472): n is a, c, g, or t
  misc_feature (487)..(487): n is a, c, g, or t
  misc_feature (489)..(490): n is a, c, g, or t
  misc_feature (501)..(501): n is a, c, g, or t
  misc_feature (504)..(505): n is a, c, g, or t
  misc_feature (508)..(508): n is a, c, g, or t
  misc_feature (511)..(512): n is a, c, g, or t
  misc_feature (532)..(532): n is a, c, g, or t
  misc_feature (538)..(538): n is a, c, g, or t
  misc_feature (541)..(541): n is a, c, g, or t
  misc_feature (544)..(544): n is a, c, g, or t
  misc_feature (556)..(556): n is a, c, g, or t
  misc_feature (559)..(559): n is a, c, g, or t
  misc_feature (565)..(565): n is a, c, g, or t
  misc_feature (574)..(574): n is a, c, g, or t
  misc_feature (576)..(578): n is a, c, g, or t
  misc_feature (580)..(580): n is a, c, g, or t
  misc_feature (582)..(583): n is a, c, g, or t
  misc_feature (586)..(587): n is a, c, g, or t
  misc_feature (592)..(592): n is a, c, g, or t
  misc_feature (601)..(601): n is a, c, g, or t
  misc_feature (610)..(610): n is a, c, g, or t
  misc_feature (613)..(614): n is a, c, g, or t
  misc_feature (616)..(616): n is a, c, g, or t
  misc_feature (618)..(618): n is a, c, g, or t
  misc_feature (622)..(622): n is a, c, g, or t
  misc_feature (631)..(632): n is a, c, g, or t
  misc_feature (634)..(635): n is a, c, g, or t
  misc_feature (637)..(637): n is a, c, g, or t
  misc_feature (640)..(640): n is a, c, g, or t
  misc_feature (642)..(643): n is a, c, g, or t
  misc_feature (652)..(652): n is a, c, g, or t
  misc_feature (655)..(655): n is a, c, g, or t
  misc_feature (658)..(658): n is a, c, g, or t
  misc_feature (660)..(661): n is a, c, g, or t
  misc_feature (664)..(664): n is a, c, g, or t
  misc_feature (667)..(667): n is a, c, g, or t
  misc_feature (670)..(670): n is a, c, g, or t
  misc_feature (673)..(673): n is a, c, g, or t
  misc_feature (675)..(675): n is a, c, g, or t
  misc_feature (679)..(679): n is a, c, g, or t
  misc_feature (681)..(681): n is a, c, g, or t
  misc_feature (703)..(703): n is a, c, g, or t
  misc_feature (709)..(709): n is a, c, g, or t
  misc_feature (715)..(715): n is a, c, g, or t
  misc_feature (718)..(719): n is a, c, g, or t
  misc_feature (721)..(721): n is a, c, g, or t
  misc_feature (724)..(724): n is a, c, g, or t
  misc_feature (730)..(731): n is a, c, g, or t
  misc_feature (748)..(748): n is a, c, g, or t
  misc_feature (750)..(750): n is a, c, g, or t
  misc_feature (754)..(754): n is a, c, g, or t
  misc_feature (766)..(766): n is a, c, g, or t
  misc_feature (769)..(769): n is a, c, g, or t
  misc_feature (772)..(772): n is a, c, g, or t
  misc_feature (776)..(776): n is a, c, g, or t
  misc_feature (778)..(778): n is a, c, g, or t
  misc_feature (793)..(793): n is a, c, g, or t
  misc_feature (796)..(796): n is a, c, g, or t
  misc_feature (806)..(806): n is a, c, g, or t
  misc_feature (809)..(811): n is a, c, g, or t
  misc_feature (821)..(821): n is a, c, g, or t
  misc_feature (823)..(826): n is a, c, g, or t
  misc_feature (832)..(832): n is a, c, g, or t
  misc_feature (835)..(835): n is a, c, g, or t
  misc_feature (837)..(837): n is a, c, g, or t
  misc_feature (849)..(850): n is a, c, g, or t
  misc_feature (853)..(853): n is a, c, g, or t
  misc_feature (856)..(856): n is a, c, g, or t
  misc_feature (865)..(865): n is a, c, g, or t
  misc_feature (870)..(871): n is a, c, g, or t
  misc_feature (874)..(874): n is a, c, g, or t
  misc_feature (877)..(878): n is a, c, g, or t
  misc_feature (883)..(883): n is a, c, g, or t
  misc_feature (886)..(886): n is a, c, g, or t
  misc_feature (889)..(889): n is a, c, g, or t
  misc_feature (891)..(892): n is a, c, g, or t
  misc_feature (897)..(897): n is a, c, g, or t
  misc_feature (901)..(901): n is a, c, g, or t
  misc_feature (907)..(907): n is a, c, g, or t
  misc_feature (916)..(922): n is a, c, g, or t
  misc_feature (925)..(925): n is a, c, g, or t
  misc_feature (931)..(931): n is a, c, g, or t
  misc_feature (934)..(934): n is a, c, g, or t
  misc_feature (940)..(940): n is a, c, g, or t
  misc_feature (942)..(943): n is a, c, g, or t
  misc_feature (949)..(949): n is a, c, g, or t
  misc_feature (955)..(955): n is a, c, g, or t
  misc_feature (961)..(961): n is a, c, g, or t
  misc_feature (964)..(964): n is a, c, g, or t
  misc_feature (968)..(970): n is a, c, g, or t
  misc_feature (975)..(975): n is a, c, g, or t
  misc_feature (982)..(982): n is a, c, g, or t
  misc_feature (985)..(985): n is a, c, g, or t
  misc_feature (991)..(991): n is a, c, g, or t
  misc_feature (1000)..(1000): n is a, c, g, or t
  misc_feature (1002)..(1002): n is a, c, g, or t
  misc_feature (1009)..(1009): n is a, c, g, or t
  misc_feature (1012)..(1012): n is a, c, g, or t
  misc_feature (1017)..(1017): n is a, c, g, or t
  misc_feature (1021)..(1021): n is a, c, g, or t
  misc_feature (1024)..(1024): n is a, c, g, or t
  misc_feature (1026)..(1026): n is a, c, g, or t
  misc_feature (1033)..(1033): n is a, c, g, or t
  misc_feature (1035)..(1036): n is a, c, g, or t
  misc_feature (1057)..(1057): n is a, c, g, or t
  misc_feature (2077)..(2077): n is a, c, g, or t
  misc_feature (2445)..(2446): n is a, c, g, or t
  misc_feature (2448)..(2450): n is a, c, g, or t
  misc_feature (2452)..(2452): n is a, c, g, or t
  misc_feature (2456)..(2457): n is a, c, g, or t
  misc_feature (2460)..(2461): n is a, c, g, or t
  misc_feature (2463)..(2463): n is a, c, g, or t
  misc_feature (2465)..(2465): n is a, c, g, or t
  misc_feature (2470)..(2470): n is a, c, g, or t
  misc_feature (2475)..(2475): n is a, c, g, or t
  misc_feature (2477)..(2479): n is a, c, g, or t
  misc_feature (2481)..(2481): n is a, c, g, or t
  misc_feature (2484)..(2485): n is a, c, g, or t
  misc_feature (2491)..(2496): n is a, c, g, or t
  misc_feature (2500)..(2501): n is a, c, g, or t
  misc_feature (2503)..(2503): n is a, c, g, or t
  misc_feature (2505)..(2505): n is a, c, g, or t
  misc_feature (2508)..(2510): n is a, c, g, or t
  misc_feature (2512)..(2512): n is a, c, g, or t
  misc_feature (2515)..(2515): n is a, c, g, or t
  misc_feature (2519)..(2521): n is a, c, g, or t
  misc_feature (2523)..(2538): n is a, c, g, or t
  misc_feature (2541)..(2543): n is a, c, g, or t
  misc_feature (2545)..(2545): n is a, c, g, or t
  misc_feature (2548)..(2548): n is a, c, g, or t
  misc_feature (2554)..(2555): n is a, c, g, or t
  misc_feature (2557)..(2557): n is a, c, g, or t
  misc_feature (2559)..(2560): n is a, c, g, or t
  misc_feature (2562)..(2562): n is a, c, g, or t
  misc_feature (2565)..(2567): n is a, c, g, or t
  misc_feature (2570)..(2570): n is a, c, g, or t
  misc_feature (2574)..(2575): n is a, c, g, or t
  misc_feature (2577)..(2577): n is a, c, g, or t
  misc_feature (2579)..(2579): n is a, c, g, or t
  misc_feature (2584)..(2584): n is a, c, g, or t
  misc_feature (2588)..(2590): n is a, c, g, or t
  misc_feature (2592)..(2592): n is a, c, g, or t
  misc_feature (2595)..(2595): n is a, c, g, or t
  misc_feature (2597)..(2598): n is a, c, g, or t
  misc_feature (2601)..(2602): n is a, c, g, or t
  misc_feature (2608)..(2608): n is a, c, g, or t
  misc_feature (2610)..(2611): n is a, c, g, or t
  misc_feature (2614)..(2616): n is a, c, g, or t
  misc_feature (2618)..(2623): n is a, c, g, or t
  misc_feature (2625)..(2627): n is a, c, g, or t
  misc_feature (2633)..(2633): n is a, c, g, or t
  misc_feature (2638)..(2638): n is a, c, g, or t
  misc_feature (2641)..(2641): n is a, c, g, or t
  misc_feature (2643)..(2643): n is a, c, g, or t
  misc_feature (2645)..(2647): n is a, c, g, or t
  misc_feature (2649)..(2651): n is a, c, g, or t
  misc_feature (2653)..(2653): n is a, c, g, or t
  misc_feature (2655)..(2655): n is a, c, g, or t
  misc_feature (2741)..(2741): n is a, c, g, or t
  misc_feature (2757)..(2758): n is a, c, g, or t
  misc_feature (2799)..(2799): n is a, c, g, or t
  misc_feature (2913)..(2913): n is a, c, g, or t
  misc_feature (2936)..(2936): n is a, c, g, or t
  misc_feature (2942)..(2942): n is a, c, g, or t
  misc_feature (2949)..(2949): n is a, c, g, or t
  misc_feature (2952)..(2952): n is a, c, g, or t
  misc_feature (2958)..(2958): n is a, c, g, or t
  misc_feature (2960)..(2960): n is a, c, g, or t
  misc_feature (2963)..(2963): n is a, c, g, or t
  misc_feature (2968)..(2968): n is a, c, g, or t
  misc_feature (2970)..(2971): n is a, c, g, or t
  misc_feature (2974)..(2976): n is a, c, g, or t
  misc_feature (2978)..(2978): n is a, c, g, or t
  misc_feature (2980)..(2980): n is a, c, g, or t
  misc_feature (2982)..(2984): n is a, c, g, or t
  misc_feature (2986)..(2989): n is a, c, g, or t
  misc_feature (2991)..(2991): n is a, c, g, or t
  misc_feature (2993)..(2993): n is a, c, g, or t
  misc_feature (2995)..(2996): n is a, c, g, or t
  misc_feature (2999)..(3002): n is a, c, g, or t
  misc_feature (3007)..(3007): n is a, c, g, or t
  misc_feature (3009)..(3013): n is a, c, g, or t
  misc_feature (3015)..(3015): n is a, c, g, or t
  misc_feature (3017)..(3017): n is a, c, g, or t
  misc_feature (3019)..(3019): n is a, c, g, or t
  misc_feature (3021)..(3021): n is a, c, g, or t
  misc_feature (3025)..(3032): n is a, c, g, or t
  misc_feature (3034)..(3035): n is a, c, g, or t
  misc_feature (3038)..(3038): n is a, c, g, or t
  misc_feature (3040)..(3041): n is a, c, g, or t
  misc_feature (3043)..(3043): n is a, c, g, or t
  misc_feature (3045)..(3045): n is a, c, g, or t
  misc_feature (3047)..(3048): n is a, c, g, or t
  misc_feature (3050)..(3053): n is a, c, g, or t
  misc_feature (3055)..(3056): n is a, c, g, or t
  misc_feature (3058)..(3061): n is a, c, g, or t
  misc_feature (3063)..(3064): n is a, c, g, or t
  misc_feature (3066)..(3068): n is a, c, g, or t
  misc_feature (3070)..(3070): n is a, c, g, or t
  misc_feature (3072)..(3076): n is a, c, g, or t
  misc_feature (3078)..(3080): n is a, c, g, or t
  misc_feature (3082)..(3084): n is a, c, g, or t
  misc_feature (3087)..(3089): n is a, c, g, or t
  misc_feature (3093)..(3093): n is a, c, g, or t
  misc_feature (3096)..(3096): n is a, c, g, or t
  misc_feature (3099)..(3100): n is a, c, g, or t
  misc_feature (3104)..(3104): n is a, c, g, or t
  misc_feature (3108)..(3108): n is a, c, g, or t
  misc_feature (3110)..(3110): n is a, c, g, or t
  misc_feature (3126)..(3126): n is a, c, g, or t
  misc_feature (3128)..(3128): n is a, c, g, or t
  misc_feature (3131)..(3132): n is a, c, g, or t
  misc_feature (3136)..(3136): n is a, c, g, or t
  misc_feature (3139)..(3139): n is a, c, g, or t
  misc_feature (3143)..(3144): n is a, c, g, or t
  misc_feature (3146)..(3146): n is a, c, g, or t
  misc_feature (3150)..(3150): n is a, c, g, or t
  misc_feature (3155)..(3155): n is a, c, g, or t
  misc_feature (3159)..(3159): n is a, c, g, or t
  misc_feature (3163)..(3163): n is a, c, g, or t
  misc_feature (3166)..(3166): n is a, c, g, or t
  misc_feature (3169)..(3170): n is a, c, g, or t
  misc_feature (3176)..(3177): n is a, c, g, or t
  misc_feature (3182)..(3183): n is a, c, g, or t
  misc_feature (3197)..(3197): n is a, c, g, or t
  misc_feature (3202)..(3202): n is a, c, g, or t
  misc_feature (3207)..(3207): n is a, c, g, or t
  misc_feature (3209)..(3210): n is a, c, g, or t
  misc_feature (3216)..(3216): n is a, c, g, or t
  misc_feature (3219)..(3222): n is a, c, g, or t
  misc_feature (3232)..(3232): n is a, c, g, or t
  misc_feature (3236)..(3236): n is a, c, g, or t
  misc_feature (3247)..(3247): n is a, c, g, or t
  misc_feature (3250)..(3250): n is a, c, g, or t
  misc_feature (3254)..(3256): n is a, c, g, or t
  misc_feature (3258)..(3258): n is a, c, g, or t
  misc_feature (3267)..(3268): n is a, c, g, or t
  misc_feature (3274)..(3275): n is a, c, g, or t
  misc_feature (3283)..(3283): n is a, c, g, or t
  misc_feature (3285)..(3285): n is a, c, g, or t
  misc_feature (3292)..(3292): n is a, c, g, or t
  misc_feature (3296)..(3296): n is a, c, g, or t
  misc_feature (3298)..(3298): n is a, c, g, or t
  misc_feature (3306)..(3306): n is a, c, g, or t
  misc_feature (3308)..(3308): n is a, c, g, or t
  misc_feature (3310)..(3311): n is a, c, g, or t
  misc_feature (3315)..(3316): n is a, c, g, or t
  misc_feature (3322)..(3322): n is a, c, g, or t
  misc_feature (3324)..(3325): n is a, c, g, or t
  misc_feature (3328)..(3328): n is a, c, g, or t
  misc_feature (3330)..(3331): n is a, c, g, or t
  misc_feature (3334)..(3334): n is a, c, g, or t
  misc_feature (3342)..(3342): n is a, c, g, or t
  misc_feature (3348)..(3348): n is a, c, g, or t
  misc_feature (3355)..(3356): n is a, c, g, or t
  misc_feature (3358)..(3358): n is a, c, g, or t
  misc_feature (3366)..(3367): n is a, c, g, or t
  misc_feature (3376)..(3376): n is a, c, g, or t
  misc_feature (3380)..(3382): n is a, c, g, or t
  misc_feature (3391)..(3391): n is a, c, g, or t
  misc_feature (3394)..(3394): n is a, c, g, or t
  misc_feature (3401)..(3407): n is a, c, g, or t
  misc_feature (3409)..(3409): n is a, c, g, or t
  misc_feature (3415)..(3415): n is a, c, g, or t
  misc_feature (3420)..(3421): n is a, c, g, or t
  misc_feature (3424)..(3425): n is a, c, g, or t
  misc_feature (3430)..(3430): n is a, c, g, or t
  misc_feature (3435)..(3436): n is a, c, g, or t
  misc_feature (3449)..(3449): n is a, c, g, or t
  misc_feature (3457)..(3457): n is a, c, g, or t
  misc_feature (3463)..(3463): n is a, c, g, or t
  misc_feature (3466)..(3466): n is a, c, g, or t
  misc_feature (3483)..(3483): n is a, c, g, or t
  misc_feature (3490)..(3490): n is a, c, g, or t
  misc_feature (3505)..(3505): n is a, c, g, or t
  misc_feature (3507)..(3508): n is a, c, g, or t
  misc_feature (3517)..(3517): n is a, c, g, or t
  misc_feature (3521)..(3523): n is a, c, g, or t
  misc_feature (3525)..(3525): n is a, c, g, or t
  misc_feature (3527)..(3527): n is a, c, g, or t
  misc_feature (3532)..(3532): n is a, c, g, or t
  misc_feature (3541)..(3541): n is a, c, g, or t
  misc_feature (3543)..(3546): n is a, c, g, or t
  misc_feature (3552)..(3552): n is a, c, g, or t
  misc_feature (3556)..(3558): n is a, c, g, or t
  misc_feature (3560)..(3560): n is a, c, g, or t
  misc_feature (3562)..(3563): n is a, c, g, or t
  misc_feature (3565)..(3565): n is a, c, g, or t
  misc_feature (3571)..(3571): n is a, c, g, or t
  misc_feature (3578)..(3579): n is a, c, g, or t
  misc_feature (3581)..(3582): n is a, c, g, or t
  misc_feature (3586)..(3586): n is a, c, g, or t
  misc_feature (3594)..(3594): n is a, c, g, or t
  misc_feature (3596)..(3598): n is a, c, g, or t
  misc_feature (3600)..(3600): n is a, c, g, or t
  misc_feature (3604)..(3605): n is a, c, g, or t
  misc_feature (3610)..(3610): n is a, c, g, or t
  misc_feature (3616)..(3618): n is a, c, g, or t
  misc_feature (3620)..(3624): n is a, c, g, or t
  misc_feature (3626)..(3626): n is a, c, g, or t
  misc_feature (3628)..(3631): n is a, c, g, or t
  misc_feature (3633)..(3634): n is a, c, g, or t
  misc_feature (3639)..(3641): n is a, c, g, or t
  misc_feature (3649)..(3649): n is a, c, g, or t
  misc_feature (3655)..(3655): n is a, c, g, or t
  misc_feature (3660)..(3660): n is a, c, g, or t
  misc_feature (3662)..(3663): n is a, c, g, or t
  misc_feature (3665)..(3665): n is a, c, g, or t
  misc_feature (3667)..(3667): n is a, c, g, or t
  misc_feature (3669)..(3669): n is a, c, g, or t
  misc_feature (3672)..(3672): n is a, c, g, or t
  misc_feature (3674)..(3677): n is a, c, g, or t
  misc_feature (3679)..(3684): n is a, c, g, or t
  misc_feature (3687)..(3687): n is a, c, g, or t
  misc_feature (3689)..(3690): n is a, c, g, or t
  misc_feature (3692)..(3692): n is a, c, g, or t
  misc_feature (3696)..(3701): n is a, c, g, or t
  misc_feature (3705)..(3706): n is a, c, g, or t
  misc_feature (3709)..(3709): n is a, c, g, or t
  misc_feature (3711)..(3713): n is a, c, g, or t
  misc_feature (3718)..(3727): n is a, c, g, or t
  misc_feature (3729)..(3729): n is a, c, g, or t
  misc_feature (3731)..(3733): n is a, c, g, or t
  misc_feature (3736)..(3744): n is a, c, g, or t
  misc_feature (3746)..(3746): n is a, c, g, or t
  misc_feature (3749)..(3750): n is a, c, g, or t
  misc_feature (3753)..(3754): n is a, c, g, or t
  misc_feature (3756)..(3756): n is a, c, g, or t
  misc_feature (3761)..(3761): n is a, c, g, or t
  misc_feature (3764)..(3764): n is a, c, g, or t
  misc_feature (3766)..(3767): n is a, c, g, or t
  misc_feature (3770)..(3771): n is a, c, g, or t
  misc_feature (3773)..(3774): n is a, c, g, or t
  misc_feature (3777)..(3779): n is a, c, g, or t
  misc_feature (3781)..(3784): n is a, c, g, or t
  misc_feature (3786)..(3786): n is a, c, g, or t
  misc_feature (3788)..(3788): n is a, c, g, or t
  misc_feature (3791)..(3793): n is a, c, g, or t
  misc_feature (3795)..(3796): n is a, c, g, or t
  misc_feature (3798)..(3800): n is a, c, g, or t
  misc_feature (3802)..(3805): n is a, c, g, or t
  misc_feature (3809)..(3809): n is a, c, g, or t
  misc_feature (3811)..(3812): n is a, c, g, or t
  misc_feature (3814)..(3814): n is a, c, g, or t
  misc_feature (3816)..(3817): n is a, c, g, or t
  misc_feature (3819)..(3819): n is a, c, g, or t
  misc_feature (3821)..(3822): n is a, c, g, or t
  misc_feature (3825)..(3829): n is a, c, g, or t
  misc_feature (3834)..(3835): n is a, c, g, or t
  misc_feature (3837)..(3839): n is a, c, g, or t
  misc_feature (3841)..(3842): n is a, c, g, or t
  misc_feature (3845)..(3847): n is a, c, g, or t
  misc_feature (3850)..(3851): n is a, c, g, or t
  misc_feature (3855)..(3855): n is a, c, g, or t
  misc_feature (3857)..(3863): n is a, c, g, or t
  misc_feature (3866)..(3870): n is a, c, g, or t
  misc_feature (3873)..(3874): n is a, c, g, or t
  misc_feature (3876)..(3877): n is a, c, g, or t
  misc_feature (3879)..(3881): n is a, c, g, or t
  misc_feature (3885)..(3887): n is a, c, g, or t
  misc_feature (3889)..(3889): n is a, c, g, or t
  misc_feature (3892)..(3892): n is a, c, g, or t
  misc_feature (3894)..(3894): n is a, c, g, or t
  misc_feature (3896)..(3901): n is a, c, g, or t
  misc_feature (3904)..(3904): n is a, c, g, or t
  misc_feature (3906)..(3906): n is a, c, g, or t
  misc_feature (3909)..(3913): n is a, c, g, or t
  misc_feature (3915)..(3918): n is a, c, g, or t
  misc_feature (3923)..(3923): n is a, c, g, or t
  misc_feature (3926)..(3926): n is a, c, g, or t
  misc_feature (3928)..(3929): n is a, c, g, or t
  misc_feature (3932)..(3935): n is a, c, g, or t
  misc_feature (3937)..(3940): n is a, c, g, or t
  misc_feature (3942)..(3942): n is a, c, g, or t
  misc_feature (3944)..(3945): n is a, c, g, or t
  misc_feature (3947)..(3952): n is a, c, g, or t
  misc_feature (3957)..(3961): n is a, c, g, or t
  misc_feature (3965)..(3965): n is a, c, g, or t
  misc_feature (3968)..(3968): n is a, c, g, or t
  misc_feature (3971)..(3971): n is a, c, g, or t
  misc_feature (3974)..(3974): n is a, c, g, or t
  misc_feature (3979)..(3979): n is a, c, g, or t
  misc_feature (3988)..(3988): n is a, c, g, or t
  misc_feature (3990)..(3990): n is a, c, g, or t
  misc_feature (3996)..(3999): n is a, c, g, or t
atcngagtgccctaacagttcctgcacatcntttggngcngctccntttgnnagnaggttgcttgtgtaggtgtgtcgcaactggtgnaaatgnaannnntcaaatccntccagnntntnngcaannnnncngcanncaatncnnanngtgcttggcagttccanacntccntccggtctnangcagacaaagganatttccttntaatctncnggnanntnntcngttccgtccagatgatannantcatantanactctgtttttgtcntntncttcnntgtagnanttnnngtggtaaagttcnccntactgcatncggnttttaagntgttnntttcnggcnntnnnnagnatntcngncagngtatcnccaaaatcaacaatccttacnttntttcgnttggtnggtccgatgatnttnttntgnnttgnnccatcatancggatactncntntnatngtnaggcantgttcttcaagattnanntcctgccatgncannccncanncttcaccgatacgaagtccngcatantangcnatctggattggnagnattgcnggtggattntnnncntnnagnnattcnatcagtctntcataatcntcnngngnaatnggctgtatnncnncntcnanntcatcatcnganaananntcnacntcntcngnctgntntttcagcttaatatactgcatnggattnaaagtnatnnantgntttggnnatactgcaaaccggaangnctgntgtaatactgcnganaangaangnatgtaatctttgctntanccttttcttnctnnnccatctgganannnnccaccnaangnaagcagatcgannaangcntgtaaatgntcagnngtnacnnttttnaanttncnntctgnaatnggatgnttcttgatnnnnnnnatngcaccnagntaattntnnactgtnccattnctgagngtnccgnnntttanttcttcntcngcccanatatcaagnanttctccnacngtaanattntcngnctttgcnannaatttcttgctttcgtaatcntccattgcctgacggagcagtttttccgtttcacttttactttctgttccagcgtattctttctgaaccagattgccgcttgcatcttctacatagaagcggtagtaccatttctttcctttttttcttacagatccttttgccataatcgtgtgtctcctttcgatatcagacaatcggaactgatgaaatgcttcttgcgtgtaagtatatcataactccggttgtcgttctataccgaatcggaatcctcatacaaaacttctgataaaagattttcaagcctttgttctgccatttccggtttcttggaataaagccttacgatatctgccatgtcgttaaaggcattaacagtgtgggtgatctcccggagaaacataatctcgttatattcatcattcgattcaaaccccattacttttgcaatatcagcttcattcgtgttgcccttgtaattcttgcaggcaaactggaatgattccagaaacaggttatattgctttaacatcaacagcagtaaatctttggaaaaagcatcttcctttttactaaggtcgagaggtaactgtttgagaatatcgcccattgcatcacgaatctgtaattctttcttatccgtaatatcggtttcgtattcatcggtttcccctctgagccattcaatagatacatgaagtgcttccgaaagaccttccagcaccatctttttggtattgtcaatcgaaccattctcataacgcaggattgtggaagcggtaactcccatcttctctgcaacataaggctgtgtcagatttaattccagacgacgctgttttgccctgctgcctatcagcttgcgtagttctttatctttcatgctgattgcctcctttttcggtatgtatgaattatagcatgtacctcacataattgcaatatgcaatataataattatttttaaaatttcataacgcttgacaacacaatataaaaccgctatactaacagcacaacaaaaattgcataatgcaattnataaggaggtgacaagatgacggaaagaaagattgcattatccatcgaggaagcagccgactatacaggaattggcagaaacactttgagaaagctggttgaatggaagaagcttccggtattaaaagtcggaagaaaagtccttattaaaactgacattctggaaaagttcatggaagccaacgaggggcgagatctgagggataaaggaaatgtaaaagctgtcacaagaaatgtggcaacttaaaaaggcggcttcctacgaaaccgccaaaggttctatcagaccgaagccatgatatacctacacgcaagaggattataccatgtgcttctcctgatatgcaaccgggaactgttgtttatcnnannnanaaannatnnanangatanggcgnannnancanngacttnnnnnnaaannanangtnnntnagngaannngnnnnnnnnnnnnnnnnaannnanaanaaagcnnantnnanagnnnaangaanngnanaaganaaannnancanannaanntaaaanannaannnannnnnncnnncagatnggagnagngntnnnannngntnttggctgtccgattgaggaggaagatttaccaaagttgataggcttcttaaaaaggcaggaaacaaacggaaagtttttctcaaangcgatgcagaaagagnnacttacagatatggaggaagtgtaatggcggagggagtggnttttccattcccttcattgcctttgaatgaagggcgcacttatggacaaccagaggtcgtccttataagtttgccacaagtggcaaccggtctgcgcttacgcttgccgggctngttccgtcggcggggctttcagncagacntgctcangcngcaggngncantcttncnnagnnngngntnnnannnntncncnnctnnnnaaccngnnnnngntncngncggnnnnnnnngnnggntnngncngnnannnngnntnnnntnntnnngntnnnnnannntnnngtnnngatngtnggnngcantaangnaaaatctgtcatatcngnatnngcanatnttanngnagangtgangaanaatnagnaannaggcannatcanntactatacttccanaaagnaagtngnntacacnagnnnnatgatgtgcnaaantgcacctcctnaanggcnnnangtaccggannaaaatnnaaaaaggntncaacagnctancngttataananannggannataaanannccncnntgnaaaagttnaaaatnacatttnngnaacagcgnntatggaatnaggnnntgaagatanaanaaaatgnnnnnnnanagcttngacgnncanntgaantttcnntgccgaaagaatngagcaganaggaanagnttgattatacaaccgantatattnaaaagactttcgtgnannagggaatgngtgnnnantngagcntacacgatnannnngatggnaacnnncntnngnatttanttgtaannanncgancattcaancnnnancatnnatggngcagcnnngnnnnnangnnnngnnatttnnncagagatnctgacngaaananngngntngangnnnncnnnnnngantnntngcannnnnngaannatncnnnccggnnnnnnnnnngnannncgnnnnnnnnngnaannggnntncaganagncnnggnnannaannnannnnantngannngnntnnngnnnnatgntnncngnngnannaannnnnagaanngnnngnnatnnnganncgantnnnnnnngannnnnaanngnnannnatcnnnanacnancnnnnnnacnancgnnnnnannnnagacnggncnnatnnnnannnncnannannnnnnagggnnnnnatgnaanaangantgagnaaaaatatntnaccggnnnna

SEQ ID NO: 963 - DNA, 4000 bp, Escherichia coli
  misc_feature (1231)..(1231): n is a, c, g, or t
  misc_feature (2350)..(2350): n is a, c, g, or t
  misc_feature (2365)..(2365): n is a, c, g, or t
  misc_feature (2371)..(2371): n is a, c, g, or t
  misc_feature (2381)..(2381): n is a, c, g, or t
  misc_feature (2437)..(2437): n is a, c, g, or t
  misc_feature (2443)..(2443): n is a, c, g, or t
  misc_feature (2472)..(2472): n is a, c, g, or t
  misc_feature (2609)..(2609): n is a, c, g, or t
  misc_feature (2639)..(2639): n is a, c, g, or t
  misc_feature (2656)..(2656): n is a, c, g, or t
  misc_feature (2738)..(2738): n is a, c, g, or t
  misc_feature (2771)..(2771): n is a, c, g, or t
  misc_feature (3302)..(3302): n is a, c, g, or t
  misc_feature (3340)..(3340): n is a, c, g, or t
  misc_feature (3396)..(3396): n is a, c, g, or t
  misc_feature (3401)..(3401): n is a, c, g, or t
  misc_feature (3500)..(3500): n is a, c, g, or t
  misc_feature (3517)..(3517): n is a, c, g, or t
  misc_feature (3530)..(3530): n is a, c, g, or t
  misc_feature (3666)..(3666): n is a, c, g, or t
  misc_feature (3672)..(3672): n is a, c, g, or t
  misc_feature (3762)..(3762): n is a, c, g, or t
  misc_feature (3780)..(3780): n is a, c, g, or t
  misc_feature (3792)..(3792): n is a, c, g, or t
  misc_feature (3796)..(3796): n is a, c, g, or t
atcgtggagatgagccccatggtccagtacgtcgatgccgggaagcccggaaaccgcgccgggtagtatgcgtccgcgagagaccacgccagcacccagagggcgatgaaccaggtgtagttcgcgccgatgggaatgcccaggatgcgtccaagccggatcgccccgcgcatgagtcggtactcgagttcctcgcaggcaggcccccaccctgcgcggtaccacaggaggtcaccgctaggcagcgaaggagaggacgtcatctggagggctgctgatgttccgtctcctcccgaaagaagagacgttttttgagttactgaatcaggcggcccagaacgtcttgcaggccgcgcggttgctgaagcagtttctcgacgattaccgggatgtcgagcggaaagctgaggagatcaaggcggtggaggagaagggtgacgagctcacccatgcgatcatcgaccgcctgaaccggacgttcatcaccccgttcgatcgcgaagatatcttcacgctcgccaagtcactcgatgatgtcctggactggatcgaggcgtcgtccgcccggatggccgtgtataagatcccgcacgctaccagcgaggccgccgaattgggccatattgttgtcagcgagtgcgaggcggtcgtggaggccatcgccagcctccgcaacctggatcgcctggccggccccctgcgcgagatcaaccgcctggagaatctggccgaccacgtgcagcgcgacgccatcgccaagctgttcagcagcaacggtaacccgatcgaggtgatgaagtggaaggagatctacgaaacgctcgaggaggccacggatcaaggtgagcatgtggcccacgtcctggagggtatttacgccaagcataagtagccgggcctgctagtctcggcgatgcccccgctggctgtgcacttcgtctcgctgatcatcctggttgcgctggcattcgatttcatcaacgggtttcacgacgccgcgaactcgattgccaccgtcgtctccacccgcgtgctgtcgcctcgggtagcggtggtatgggccgccttcttcaacttcgtggccgccttcgggcttggcgtgcacgtggccaccaccatcggcaagggggtcgtcgatcccgcggccatgaccaacctggtggtggtcgccgcgctggccggggcgatcgtctgggatctgattacctggtactacgggctgccggtgtcntcgtcccacgccctaatcggggggctggtcggtgcggcgctcgccgccgccggcgcccgcgtgctggtgtggtcgggtatccagaagatcgtgatcttcattgtgctctcgcccgtggtcgggatgctcttgggtttcctgttcatggtcgcggtgatgtggatcgcgcggaacgccacccccatgcgcgtggaccgggtcttccggcggctgcagctcctctcggcggcactgtacagcctggggcacggcaccaacgacgctcagaaaacgatgggcgtgatcgccgtgctgctgtttaccaacgggcttctggggcccacgttctatgtgccgcgctgggtcatcctggccgcgcacgcggccatcgccgccggcaccctcgccggtgggtggcggattgtgaagaccatggggatgcggatcaccaaactgcagccggtgggcggcttctgcgcggaagcggccgcggcgatctccatcctgggagcgtcattcggaggcgtccccgtgtcgaccacccacacgatctccggggcaatcatgggcgtgggcgcgacgcggcggctctccgcggtccggtggggggtggcgacgcggatcgtgtgggcctggatcctgaccatcccggcttccgcgctcgtggccaccctgacctattgggggctggcttctttcttccggtaaccgagagctgcgcggcgcggtataatccctgtggcggaataccggctcccgggggagcgttctacttggcggaaggttgatacgtcgcgaggaggttggggtatgggcaaggcgctccacgtgaacgagaaggaattcgacacccaggtgctccaggcggagcagccggtgctggtcgatttctgggcggagtggtgcggcccgtgccggatgatcgcgccgattatcgaggacctggcggtcgagtacgatggcaaggccaaggtcgtcaaggtcgacgtggatgagaatcccggcgtggccaaccgctacgggatcatgagcattccgacgctcggaatcttcaagggcggcgagatggtcgaccgtctggtcgggtacctgcccaagccggagctgaagaagcggctggagaagattctggcgacggcnaaagtcagctaaggngaatcnccggaaaccnggaagcggggaaacgcggaaacgcgaatccccgcttcgatttttcgcctgatgcanttgttnccgcgcttccgcgttgccgcgcttccgtnagttcccttgttgctgcagccaccgttccgcgtcgatcgccgcctcgcacccgtagccggccgccgtgacggcctgccggtaggtatggtcgtggacgtcgccggcggcaaagacgccctccacgctggtcgccgancggcgcgtgcggatgatgtatccgttgtcntcgatcgccagctggcngcggaacaggtcggtgttcggcttgtggccgatggcgacaaacacgccgtcggtgggccgttccacgacgcggtcggtgcgnagctcccgtagcttcacgccgctgaccttcccntcgccgacgatgtccgcgacggtgtggctccagacgaaactgatcttgggattgtccatcgcacgctgctgcaggatcttgctggcccgcagctggtcgcggcggtgcaccaccgtcaccgatttggcgagcttggatagatacagcgcctcttccatggccgtgtcgccgccgccgaccacgatcacattgcggtcgcggaagaaaaagccgtcgcacgtggcgcacgtgctgaccccgcggcccatcagccgttgctcgccgggcaggccaagcagtttggctttggcgccggtggcgatgatcaaggcgttcgcctcgtacgtatctccgctctgactggtgatgcggaacgggcgacgcgacagatcgacctggatcgcatcctcgctgatgaactcggcgcctacgcgctgcgcctgcgcccgcatgttggcgatgagatccggacccaggatcggatcggcgaaccccggatagttctcaacctcggtggtgagcatcagctggccgccggcctccgcgccttcnaagacgaggggactcagacccgcccgggtggtgtaganggcggcggtgagcccggccggaccagaccccaagacgatgacgctacgcatagcantcatncatgtccaaacgtgttgcgatggcatgctattccgcgccgccgggctcccaccctctcggtatgacaatgatggtgtcaagatacttgacaacatccgntccgatgagtacgctanggaatgctcaggnagggtggtgaaaccgggtgcgaagtcgccgagacgatctgccagtctatgtgatcagcgtggccgcggacctgctcggcctgcacccccggacgctgcggatctacgaagagaaggggctggtgcagcccgcgcgncgcaancatcagcggctgtactcggagcgcgacctcgagcgggtgcggatgatccgccgcatgacccaggagatggggctgaatctggccggggtncgcgtgctgatggaaatncatgaacggatngagntacggggatcgaaagatgcggtgtcgtgggtatttgaacgcacggtgcgaaggaggcgagtaccatgagcatcatccggtgggatccgtttgacgacctcgcgtctctgcgcgagtcgatggacaagctgtttgaggacttcttcacccgccgcccgcggggggaggcggtgacggcgtggcagccggcggtcgagatgttcga

SEQ ID NO: 964 - DNA, 4000 bp, Escherichia coli
  misc_feature (477)..(477): n is a, c, g, or t
  misc_feature (597)..(597): n is a, c, g, or t
  misc_feature (756)..(756): n is a, c, g, or t
  misc_feature (882)..(882): n is a, c, g, or t
  misc_feature (1242)..(1242): n is a, c, g, or t
  misc_feature (1254)..(1254): n is a, c, g, or t
  misc_feature (1368)..(1368): n is a, c, g, or t
  misc_feature (1392)..(1392): n is a, c, g, or t
  misc_feature (1434)..(1434): n is a, c, g, or t
  misc_feature (1632)..(1632): n is a, c, g, or t
  misc_feature (1665)..(1665): n is a, c, g, or t
  misc_feature (1857)..(1857): n is a, c, g, or t
  misc_feature (1888)..(1888): n is a, c, g, or t
  misc_feature (1938)..(1938): n is a, c, g, or t
  misc_feature (1987)..(1987): n is a, c, g, or t
  misc_feature (1992)..(1992): n is a, c, g, or t
  misc_feature (2192)..(2192): n is a, c, g, or t
  misc_feature (3245)..(3245): n is a, c, g, or t
  misc_feature (3311)..(3311): n is a, c, g, or t
  misc_feature (3473)..(3473): n is a, c, g, or t
  misc_feature (3725)..(3725): n is a, c, g, or t
  misc_feature (3892)..(3892): n is a, c, g, or t
  misc_feature (3959)..(3959): n is a, c, g, or t
gccctgatggtcatcaacgcccagtatggcgtcgaggtgggcaccatcaaccagttccgctacaccgaacagtttcacaagcccgtcatcttcgtcgtcaaccagctggacaacgacaaggccgacttcgacaacaccgtccatcagctccgcgaaaactacggcgccaaagccgtgcagatccagtatccggtgcagaccggggccgcgtttaacgccgtggtggacgtgctgaagatgaaaatgtatcgctggaagccggagggcggcaagccagacgtgctcgacatccccgccgaggagttggacaaggccaccgagctccacaaggcgctcgtcgaagccgccgccgagcatgacgacacgctgatggagaagttcttcgaagagggcaccctctccgaggacgacatgcgcgcaggcatccgcgcaggcctcgtcagccgcggtatgttccccattttctgcgtttgcgcngggaaggacatgtgcgtgcgccgcacactggagttcctcggcaacgtcgtcccctgtaccgacaaaatgccgcgccccgtcaccacggaaggtatcgaagtcacggccgatcccgcgggnccgaccagcctcttcttcttcaagaccaccatcgagccgcacatcgggcaggtgtcttacttcaaggtcgtttcgggcaaagtcaaggtgggcgatgatctcaccaacgccgaccgtgggtcgaaggagcgcatcgcacaactcttcgccgtcgacggncagatccgcagcgaagtcagcgagatggaagcgggcgacatcggcgccacggtcaagctcaaagacgtccgccgcggcaacaccctcaatggcaaaggctgcgagtatcgcttcgacttcatcaantacccggagcccaaattccgccgcgccatcaagccggtcaacgaggccgacgccgagaagctgagcgagatcctctcccgcatgcacgaggaggacccgacgtggatcgtcgaacagtccaaagaactgaagcagaccatcgtctcaggtcaaggcgagttccacctccgcaccctcaagtggcgcatcgagaacaacgacaagctggccatcgagttcctcgagcctaaaatcccctaccgcgagacgatcaccaagtccgcccgggctgactatcgccacaagaaacagtctggcggcgccggacagtttggcgaggtgcacctcatcatcgagccctactacgagggcatgccagcncccggcacctancgcttcggcggccaagagtatcgcatgaacgtccgcgacacgcaggtttacgacctcgagtggggcggcaaactcgtcttcgtcaactgcatcgtaggcggcgccatcgatgcncgcttcctcccggccatcctcaangggatcatgggccgcatggagcagggtccgctgaccggctcntacgcccgcgatgtccgcgtctgcgtctatgacggtaagatgcaccccgtggacagcaacgaaatctccttcatgctggccggacgcaacgccttcagcaccgccttccgcgatgctgcgccgaagatcctcgagccgatctacgacatcgaagtgctcgtccccggcgactacttgggcgacgtgatgagcgacctncagggccgtcgtgccctgatcatgggcatgaanagcgagcgcggctgtgagaaattgatggccaaggtgccgctcaaagagatgtccagctactctacctcgctgagctccatcaccggaggccgcgcctcgttcacaatgaagttctccggctacgagctcgtccccaccgacgtgcaggagaagctgctcaaagagtacgccgctacgcagaccgaggagtanccctcccccatccgcgtcgtccgatcgcacngatcaacgtgaagaaggcaccccgcaacgggtgccttttttcgttccccnctcccccaacggtagccactttggaataagatttgccgaaagctccagngcccnatgcagcgaacccgctgccgtttccctctcattattgcaccataaacattcagataatgacgccctgcattcaaatcaaacgcgtttacgaggctgccgatcccgctgacggctttcgcattttagtcgaccggctgtggccgcgcggtattcgtaaagacgccctgccctacgacctctggcccaaagatctcaccccnagccctgcactccgccgttggtttcacgaagatcccgacggacgttgggctgaatttagccagcgctaccggtcagagctcgccaccgcccccagcgtggacgaagtgatcagccgcatacggccatacgacaccgtcacgctgctctccgccgctaaggcgacagaccacaaccacgcgctcattctgcgcgactttttgacccagaggatgggctaaaacgtggccagccgaaagcgttcgggttgttaaagtatatcggcctgcaaaaccgccctccgaaagatgcgtacgtttgtctctcgtaaggaatcaacggtttagcagccacttaaacttcagcaatgtaccccgtcaaacggggacaaaaaccacacattaatcaacgaggagattacgatgatgaaaacgatgaaatcagtctacctgaccagcctcttgctgctcgcggccatcagcgccacggcccaagaggactactacgacgacgtgtatttctccacaaagagcaaaaagagagaacgcacggacgaacgacgcatgtcggcctctgaccggcccgcgtcgcgccagcgctacgatcgggatcgcgacaacttcgacagcgatcgcgatgtggatgcctacaaccgccgctacaccgacagctcgacggcggattataacgactacgaccgtgacgctcgcgacgacaaccgcaaggccaaggcgagcgaacgccgcggcgacaatgagtactccgaacgcatcattcgctaccattccccaagcaaaatcaccatcaccggcgccgacaacgtcgatctcaatcttagcgacggatactactcctacagctacgataccgactactccggcggccgcaccaacgtgaatatcaacgtaaacgtcggcaacggctgggacgcttggtattcgtggtacgacccgtggttttacggcggattctactcgccctggcgatcagcctggcgctggcgcaacgcctactgggggtggagcttcggctgggggggattctacgccagctggtatgacccctggtacgacccntggtacagcggctggagcggatattatggcggctactgggggtatcgctgcgccgactattactanccctactcgtccacaaccaacaactactattacggttgggacaacggaaaccgtgacacccgccgcgactactcatcgcgatcgaccacctaccgcagctcttctgacggcggcaactacagcgacgtctattccacgcgctcgacctccacacgttcgtcntccgacggatacacccggagcggccgcgacgcctcgagccgaagctccagctacagccgcacggcggacgacatctacagcagccgcagctcatcctcccgcagctcatccagctacgacggcagcagcacgcgctcttcctcgcgcagctccgacagctattacgacggcggcagctcacgatcctcgtcccgcagctcgtccggcggatactacgacggcggcagcaacggctcctcctcacgcagctcntcagtgtacgaaggcagcagtcgcagcgcctcgtcacggagctcatccggaggctattacgacggcggcagcagtcgttcgtccagcatctacagcggcagcagcacccgttcgtcgggctcgtacaacggcagcagcacccgctcctccggctcctatagcggcancagctcacgctccagcagctacgacaacagctacggcagttcgcgctcgagtagctccagcagcttnggtggaagcagcacacgctccagcagttcgggcagcttcgg

SEQ ID NO: 965 - DNA, 4000 bp, Escherichia coli
  misc_feature (527)..(527): n is a, c, g, or t
  misc_feature (574)..(574): n is a, c, g, or t
  misc_feature (581)..(581): n is a, c, g, or t
  misc_feature (583)..(583): n is a, c, g, or t
  misc_feature (1984)..(1984): n is a, c, g, or t
  misc_feature (1988)..(1988): n is a, c, g, or t
  misc_feature (2668)..(2668): n is a, c, g, or t
  misc_feature (2707)..(2707): n is a, c, g, or t
  misc_feature (2738)..(2738): n is a, c, g, or t
ggccgccgggcacttgaaggtcgtaggtgttgcgacccgagacggtagagccatgaaccaacaacaagacgggtttgggtgcctcgcctgtttggggctcggaggcgcgcttgcgatacacatacaggcgaacatcttcgcgcgttacttcatagtcttgagtccaaatcacggggtactgccttgggaaaaagttaaaaaaaagacaagccaaagactagcattgacttgtctggtgatgaacgcgaataaaccctagacggtcagagcattggtgccaactttagtgagtaattctcatgagctttggcaaaaccgatgttcatttgctgatggtaaaagcgtccacttctttgccatcggccgtgacttgcttcactttgagagtttgttgatcaacgtccacaatggtcagggagtgcacgttggacacaaaccttttggtaaatggttgccatgagtctggggcatcgtgttgatcaacgtcgtacagctcttttccgcccgcgcccgtgaccacatagatnacgccttcggggcgtgtgtttgtgatgccatcaaattttttgtccanggtccancngccattcaccacacggccgcgaatgacggtgttgtctttgccgccaaccaacaaagtgccattgcggcccttgctggatttaaaagtcatcggatagctgcgttggtagttgtgcaggtgaccattcaataccatgtctactttgccagcttcaaaaacaggtgctaataagcgcatgtgttgctgttcaaggtgctcgttggaagagttgaagccagggtggtgaaaggtcacgatgtgccatgtggcatttttggactgcgccaagtctttggccacccagtcttgcaattctttgtttgtccagtcgacataggggttggagtcgaggacggtccaatgcgtgttgccgtagtcgaatgaataattggccatgcgcgggtaggcgtcgcctgcggcttcgacaaactggcgacgattggtttcgttggccaagaggcgcggcacgatcgggccaccttcagggccattggggccattcaggggctggttccaaaaatagaaataagccaagccatctggaaagcgattgatgtcgcggttgtcgatgtcgtggttaccgggtaccgtgaacatgggcacacttcgcatcaagggcacaccttcagcggtggctgtttctgcgttgtagatgggccaaaagtttttgtcgtattctttgatcaagccatattcataaacgatatcgccgggcaccaccaccaaatcaggcttggcgatccatgcacgttcggccatttgtttttgtcccagtgtgcctgcgcccacatcggcaaaggccacaaagcgataggcctgagcaggcgttttgggtgcgatggcttctgattgaaataccaagttgccatctttcaacaagcggtattcaaactttttgcctggctcaagttgcgccagtgtgctgttcaaaataagtcggggggccacgccggccacactgatgcgtgtgctctttgcgggttctgccgtcagccagggtgaggtcggggagaggcgcagctgtacaagccatgaagcggcttcgtcggcggtgtgccacatgaggctcaaagaagtggggctcgggttgcggccgatttgtaaatagggtttgacaacaaacgcagtggcttgattcgtttgtgcctgtgtgaaggagggccacacacccaaggatgcagcgagtgccaaggacaatgacaacgacaaagtgaaagatgcaaatttgaatttcatggggcaagtgttgttgtgggggagtgcgaaatgaagggtgacgatgtctctagatgagccaaggaggcctgatggtttcaacaacttatttaagtttgatgacagcgccgcaaaattcgatgagcgcgtgaaaattagtgttaaccctattttttgtcatattttcgtcaccatatttccctaaantaantgaggtttttaaattcattgtgctttcaaatcaagtcaaccatgtttcacaacaacaactcaatcattcaaaaaatgaacaccttgtccacccccaagcttcaaaaaatcgccttcttggtttcagttgcagttctctcctttgccaacacacccttggccatggcgcaagccaaagactcggtagatttgggcaccattggcgccaccactgcagcaggtgcatttcgaccagaagatgccatcaagggcacagccactgccgtagcgcctacccaagccagcttgcaagccactcagcctcagtccatcattacccgtgagttcatggacttgtctgtagcgcccaccgccgaatacacccgcatcgtgaacatctctcccagcttgtctggcgactctgccaacggccctggtttgagcgaaacaaaaattaccatgcgcggcttgcccgatggttactacaacgtcacatttgatggcattccttggggcgacaccaacaaccccacacaccactccacctctttcttcccagccgccatcattggtggtgccgtggtggaacgtggacccggcaaggccagcgatttgggctacgccaccttcggcggctctatcaacttgtactccaaaaagccttcagccgaacaaatttcaagcgtggccgctacggtcggnacatggaacaccagcctgctcacctatgcatttgaaagnggccgcttggccagcatgggcgatgccacantgcaactcaatgtgcagcacatgtcttccgacggctatctctccaacagccccgtcaagggcgacaacctgacggttaagtttgagcgccccgtgggtgattcatccttgctcaccgcttttgcctcgatcaacaaaaacaattatttccaatcggacaccagcaaaggtgtcaccctttctcaagctgcagcgtttggtaaaaatttccaactggacaacgaccccaccagcatgaactacaaaggctacgcctcagcctttaaaaacacagattttgattacttgcgtttgcgcaccgactggggcaatggttggaacaccgacaacagtttgtacacatttgcttacgagaacaacaccctgtccaccatggtgggttcttggactggtaccttaccggtgactgccgacccacgtcgcacctccaccactgcttgggtaaagggttacatggccgccacttacaacggccacattcctggctacgacaagctgaaccaataccgggtcacgggtgacagcttcaaggccaccaagaaaactgaagaaggcttgttgcgtttgggtgtttgggtcgaaaaggcggataccaatcgccataactacgacctggacttgaccaccatgcaacccaaccgcgtggaaggctctgcggccaacgctgctttgttgcccggctcgacacgtcctttggacagcgtgagctatgaccaaaagtcaaacatcgattcagtgcagtccttcattgaatacgaatgggctgccagcaaaggcctgaccatcacaccgggtgtgaagtatgtgcacattacgcgttctgtgaacgccaacgtgcaagccaccacacgcgttgaagatcactcctctttaacctaccccgacatgttgcctttcctgaccgtgaatcagaaaatcaatgacaacatggccgcttatgcgcaatacgccaagggcttcctgatccccgacttgaatacgttctacatcaagaacgctgcagctaacagcaccgacccccagaaaaccaccaactaccaagctggtttggtgagccagtctgacaccttcacttgggacgtcgatctgtatcgcatcgacttcaccaacaagtctgtgtccgtcagtgtcaatggtgtggccgatcactttgtcaatgtgggcggcgtgcagtacaaaggtgttgaaggtcaaatgacttatgtgttgggcaatggctttgcagcttatgccaatggttcttacaacaaggccatcgtcaac

SEQ ID NO: 966 - DNA, 4000 bp, Escherichia coli
  misc_feature (1)..(2): n is a, c, g, or t
  misc_feature (11)..(12): n is a, c, g, or t
  misc_feature (18)..(21): n is a, c, g, or t
  misc_feature (24)..(24): n is a, c, g, or t
  misc_feature (29)..(29): n is a, c, g, or t
  misc_feature (31)..(32): n is a, c, g, or t
  misc_feature (37)..(37): n is a, c, g, or t
  misc_feature (50)..(50): n is a, c, g, or t
  misc_feature (53)..(59): n is a, c, g, or t
  misc_feature (61)..(61): n is a, c, g, or t
  misc_feature (65)..(65): n is a, c, g, or t
  misc_feature (71)..(71): n is a, c, g, or t
  misc_feature (78)..(83): n is a, c, g, or t
  misc_feature (86)..(88): n is a, c, g, or t
  misc_feature (91)..(91): n is a, c, g, or t
  misc_feature (94)..(94): n is a, c, g, or t
  misc_feature (97)..(98): n is a, c, g, or t
  misc_feature (101)..(101): n is a, c, g, or t
  misc_feature (105)..(105): n is a, c, g, or t
  misc_feature (111)..(112): n is a, c, g, or t
  misc_feature (116)..(116): n is a, c, g, or t
  misc_feature (119)..(122): n is a, c, g, or t
  misc_feature (128)..(130): n is a, c, g, or t
  misc_feature (133)..(136): n is a, c, g, or t
  misc_feature (139)..(145): n is a, c, g, or t
  misc_feature (148)..(151): n is a, c, g, or t
  misc_feature (161)..(161): n is a, c, g, or t
  misc_feature (164)..(166): n is a, c, g, or t
  misc_feature (170)..(170): n is a, c, g, or t
  misc_feature (173)..(176): n is a, c, g, or t
  misc_feature (179)..(179): n is a, c, g, or t
  misc_feature (184)..(184): n is a, c, g, or t
  misc_feature (187)..(187): n is a, c, g, or t
  misc_feature (190)..(192): n is a, c, g, or t
  misc_feature (199)..(201): n is a, c, g, or t
  misc_feature (204)..(205): n is a, c, g, or t
  misc_feature (212)..(214): n is a, c, g, or t
  misc_feature (218)..(218): n is a, c, g, or t
  misc_feature (223)..(227): n is a, c, g, or t
  misc_feature (231)..(233): n is a, c, g, or t
  misc_feature (236)..(241): n is a, c, g, or t
  misc_feature (247)..(248): n is a, c, g, or t
  misc_feature (251)..(251): n is a, c, g, or t
  misc_feature (254)..(255): n is a, c, g, or t
  misc_feature (261)..(264): n is a, c, g, or t
  misc_feature (268)..(273): n is a, c, g, or t
  misc_feature (276)..(277): n is a, c, g, or t
  misc_feature (284)..(284): n is a, c, g, or t
  misc_feature (289)..(289): n is a, c, g, or t
  misc_feature (292)..(295): n is a, c, g, or t
  misc_feature (299)..(300): n is a, c, g, or t
  misc_feature (308)..(312): n is a, c, g, or t
  misc_feature (316)..(320): n is a, c, g, or t
  misc_feature (325)..(328): n is a, c, g, or t
  misc_feature (332)..(332): n is a, c, g, or t
  misc_feature (337)..(339): n is a, c, g, or t
  misc_feature (346)..(347): n is a, c, g, or t
  misc_feature (350)..(359): n is a, c, g, or t
  misc_feature (362)..(366): n is a, c, g, or t
  misc_feature (369)..(370): n is a, c, g, or t
  misc_feature (375)..(378): n is a, c, g, or t
  misc_feature (382)..(390): n is a, c, g, or t
  misc_feature (393)..(393): n is a, c, g, or t
  misc_feature (402)..(402): n is a, c, g, or t
  misc_feature (407)..(407): n is a, c, g, or t
  misc_feature (412)..(412): n is a, c, g, or t
  misc_feature (416)..(420): n is a, c, g, or t
  misc_feature (424)..(425): n is a, c, g, or t
  misc_feature (428)..(432): n is a, c, g, or t
  misc_feature (437)..(439): n is a, c, g, or t
  misc_feature (442)..(442): n is a, c, g, or t
  misc_feature (453)..(453): n is a, c, g, or t
  misc_feature (456)..(460): n is a, c, g, or t
  misc_feature (466)..(471): n is a, c, g, or t
  misc_feature (474)..(476): n is a, c, g, or t
  misc_feature (479)..(485): n is a, c, g, or t
  misc_feature (488)..(490): n is a, c, g, or t
  misc_feature (493)..(495): n is a, c, g, or t
  misc_feature (499)..(499): n is a, c, g, or t
  misc_feature (502)..(502): n is a, c, g, or t
  misc_feature (505)..(507): n is a, c, g, or t
  misc_feature (510)..(517): n is a, c, g, or t
  misc_feature (522)..(523): n is a, c, g, or t
  misc_feature (526)..(528): n is a, c, g, or t
  misc_feature (531)..(545): n is a, c, g, or t
  misc_feature (549)..(551): n is a, c, g, or t
  misc_feature (563)..(565): n is a, c, g, or t
  misc_feature (570)..(570): n is a, c, g, or t
  misc_feature (573)..(573): n is a, c, g, or t
  misc_feature (579)..(584): n is a, c, g, or t
  misc_feature (589)..(593): n is a, c, g, or t
  misc_feature (596)..(596): n is a, c, g, or t
  misc_feature (599)..(601): n is a, c, g, or t
  misc_feature (604)..(604): n is a, c, g, or t
  misc_feature (607)..(607): n is a, c, g, or t
  misc_feature (612)..(612): n is a, c, g, or t
  misc_feature (616)..(618): n is a, c, g, or t
  misc_feature (623)..(623): n is a, c, g, or t
  misc_feature (626)..(632): n is a, c, g, or t
  misc_feature (637)..(637): n is a, c, g, or t
  misc_feature (643)..(643): n is a, c, g, or t
  misc_feature (648)..(648): n is a, c, g, or t
  misc_feature (651)..(657): n is a, c, g, or t
  misc_feature (659)..(661): n is a, c, g, or t
  misc_feature (666)..(675): n is a, c, g, or t
  misc_feature (682)..(686): n is a, c, g, or t
  misc_feature (689)..(700): n is a, c, g, or t
  misc_feature (705)..(705): n is a, c, g, or t
  misc_feature (2008)..(2008): n is a, c, g, or t
  misc_feature (2574)..(2574): n is a, c, g, or t
  misc_feature (2595)..(2595): n is a, c, g, or t
  misc_feature (2608)..(2608): n is a, c, g, or t
  misc_feature (2612)..(2613): n is a, c, g, or t
  misc_feature (2615)..(2615): n is a, c, g, or t
  misc_feature (3000)..(3000): n is a, c, g, or t
nnccaaaaccnnttcccnnnnccnttaangnnaaggnaattggaaaaccnaannnnnnngnaaanaaaaanaaccccnnnnnnaannnggnaanttnnggntttnttaaannaaanaannnntttttnnnccnnnnccnnnnnnnttnnnnttaaaatttnttnnntttnttnnnnaanaaccnttnttnnnggccaannnccnnttttaannnaaanaattnnnnnaaannnttnnnnnnttcccnnaanaannaaaaannnncccnnnnnnggnnttaaggnttttnccnnnnaaannttaatttnnnnngggnnnnnccaannnntttnttttnnnttccaannaannnnnnnnnnttnnnnnccnnaaaannnnaaannnnnnnnnccnggaaaaaanaaaanaaaanaaannnnnaaannaannnnnccttnnnttnttggtttaaanaannnnnaaattnnnnnnccnnnaannnnnnnttnnnttnnnaaanaanaannnccnnnnnnnnttaannttnnnccnnnnnnnnnnnnnnnaaannnaaaattccaaannnttggnttnttaaannnnnnggccnnnnnaanttnnnaanaanttccncccnnnaaaanaannnnnnnccaanaaaaanccttnccnnnnnnngnnnttaannnnnnnnnnaattttnnnnnggnnnnnnnnnnnntttgnataggatactctaattttgttaaaaactgtactataaaaaaagggggccgaaacccccttcttaaattattaaaaagttaattagattttaacttttccaattggtccaaactcattttcataagctagtttgtaattaggctgattcatcagcaagtacttcattactttcttagcgtatgctttttgagagtctaccacttttttgaagaatgcatcttttccagagaattctccaacaactttatcccaaccttttaactgttcagctaaaatagcatcagatgtttggtaaacgttaaccttatgtgtgttcatcaaatcagctaaactgtcagaatatctaacaagtgctttgaagtagttatctgagttagcagcataagcagcgttcttcaagatagcttgatgagcaggtgaaaggctgttcagtctcttcgtgttcataggaatttcaaacatctcttgagattggtggaaacttcctaagtgatagtgtttagagacatcttgcattccaaactgtgagtctgatgttgggttgttaaactcagcagcatcgatcaaaccagttttcattgctggttggatttcaccacctggtaattgtcttacgaccatccccatagcagttaaaacgttagtcgctagaccaactgttctatacttcatacctttaacatcagatactttagttacattctttttgaaccaaccaaaaggttgtgctggcataggcatatgaaagaatccagtgtagttatatccaacactagctactgcttcttcatataattttcttcctccaccatactccatccatcccataacttcttgagatgacattccgtatgaaggaccagttccaaaaagtgaagctgcagcgtttttaccgtaccaatacgcagtcacccagtgacccatatcaacgattccatcgcttaccgccgctccgatttctgaagttttaacaattgcgtttacaggctgaagatcaattttaagtgatccacctgacatatcgctaaccatgttacagtagtcttgcgccatttcaaaaaagatgtttgcgcctgaaggccaagcagcttgcatctttaatacagtagcgtgagatcctgcagttgcaatatttggcattgcaacagttgctgcagctacagcaccagctttagcagcagtcttaaagaacttacgtcttgaagaagttgaattcttcaatgattttttttctttaatcattatttctctctccttgttatttatattagttaattaactattatgattttaagcacaaaanataattagagtctaatgaatactccttagttttgttgtaaagacacttgttatataaggctaattcaatggtacgactattatgactacaactttaaattgcattattttttaaatgttaagcttgcccacaagctaaaccagtctgatttatattttagtttttctatataatttgctttgtccaacttaactgcactcaataaataggttctattttcaaaaatccttatttttcctactccatttgggtttgtttttacaatttccttgtagctattttcttcatctctactgaagatagtaatttgccagttttctagagggttgcccttttcaaatagttgaaactcaaatatctcctcctttaagttatatggtgaagttaaagcaataatctcaaagtctaattttggcttttgaataaaaaaacttttattaccatttgtcattaatgcttttgcaaatcttcgataactctctgtgggcagcttatttttatcaaatttttctaaagtgctttcaaaattttgctcttttaagaaatcttcaaacttttcaatagantcatattttaagaattcatantttgtttcataanttannanatgaaaacctttatctaaaattagtgtttggatggctggaaaatttccatctctttgaggtaaatttattactttatttttgttttctaaatataaattttttttatttggatcatagtaaccaaatggagagccattaaaattttggcctaccttaatatgtatcttggacacttcattattattaaatttaaaattaattggctcaagccataattcgtgggcatgcacattgaactttaaaaaagtagtcaataataatattacaaaaaaatagaaaatctgatttaataagttaatgttttttaaaatatttatatttttattatttttcattaagtcatcttatgctcatgaactacgtccagcaattgcaaatcttaanatttatgaaaaagataatattataaatgctacgctatcaattcgattaaatcttgaggcaataattgctgaagtgaatatggatcactctaacacagaagaatctgaaaagtcaggtcaatatgaaagcttaagaactatgaatgctgatgaattgcttaaaaaatttaattccaaaataagagaccttcaaaacaaaatttacttaacttctgctaattctaattatggcttaactctagtggatgtggacatacccgaggttggcaatactgatataattagagataccgttattaactttgatattaaaaatatcaaagatgaagacttaaaattttcttgggataaaaatttaggatccatcattttaagagttaattctaaaaataatgagggtttatactcaaaactaattgaaagtaatgataaatcagaatggtttagtataacaaacaaaagagaagaaaggcttatagacaatgttaaatcttatactcaattaggttttaagcacataatacctaaaggtttagaccatatattatttgttatcgctttatttcttctctcttcgaagttaaagcctttggtattgcaggtttcaattttcactatagcgcacacaataacattatttcttggtgctttagatgtaataaaaataccctcaataattgttgaacctatcattgctctatcaatttgttttattgctattgagaatctatttactgaaaatataaaaaaaatgagaccctatataatttttatttttggattactccatggcttagggtttgctggggttttaaatgaaattggaatttcagacgggttatttatttcaagtcttatttcttttaatattggagtagaggtaggtcaaattagtgtaatacttttatcttatatttttatctcattattatttcagaataaaccttggtaccgtaatagaattactaggcctctttcattagtaattgcgttgattggct

SEQ ID NO: 967 - DNA, 4000 bp, Escherichia coli
  misc_feature (3044)..(3045): n is a, c, g, or t
  misc_feature (3049)..(3049): n is a, c, g, or t
  misc_feature (3055)..(3056): n is a, c, g, or t
  misc_feature (3061)..(3063): n is a, c, g, or t
  misc_feature (3067)..(3069): n is a, c, g, or t
  misc_feature (3071)..(3071): n is a, c, g, or t
  misc_feature (3073)..(3074): n is a, c, g, or t
  misc_feature (3079)..(3080): n is a, c, g, or t
  misc_feature (3083)..(3083): n is a, c, g, or t
  misc_feature (3085)..(3087): n is a, c, g, or t
  misc_feature (3089)..(3089): n is a, c, g, or t
  misc_feature (3091)..(3093): n is a, c, g, or t
  misc_feature (3095)..(3095): n is a, c, g, or t
  misc_feature (3097)..(3099): n is a, c, g, or t
  misc_feature (3101)..(3104): n is a, c, g, or t
  misc_feature (3107)..(3118): n is a, c, g, or t
  misc_feature (3120)..(3212): n is a, c, g, or t
  misc_feature (3214)..(3268): n is a, c, g, or t
  misc_feature (3270)..(3353): n is a, c, g, or t
  misc_feature (3355)..(3364): n is a, c, g, or t
  misc_feature (3366)..(3370): n is a, c, g, or t
  misc_feature (3372)..(3393): n is a, c, g, or t
  misc_feature (3395)..(3450): n is a, c, g, or t
  misc_feature (3452)..(3459): n is a, c, g, or t
  misc_feature (3461)..(3473): n is a, c, g, or t
  misc_feature (3475)..(3526): n is a, c, g, or t
  misc_feature (3528)..(3598): n is a, c, g, or t
  misc_feature (3600)..(3619): n is a, c, g, or t
  misc_feature (3621)..(3627): n is a, c, g, or t
  misc_feature (3629)..(3633): n is a, c, g, or t
  misc_feature (3635)..(3669): n is a, c, g, or t
  misc_feature (3671)..(3757): n is a, c, g, or t
  misc_feature (3759)..(3768): n is a, c, g, or t
  misc_feature (3770)..(3785): n is a, c, g, or t
  misc_feature (3787)..(3789): n is a, c, g, or t
  misc_feature (3791)..(3806): n is a, c, g, or t
  misc_feature (3808)..(3820): n is a, c, g, or t
  misc_feature (3822)..(3841): n is a, c, g, or t
  misc_feature (3843)..(3922): n is a, c, g, or t
  misc_feature (3924)..(3960): n is a, c, g, or t
  misc_feature (3962)..(3966): n is a, c, g, or t
  misc_feature (3968)..(4000): n is a, c, g, or t
gcccgcgcgcgcgcgcgcgacggttctcgtggcgagtggtgcgagcggaacgagcggaactttttcggattctgacactggcgaagaactaacgccagcgtcgacggagaagatggcgacgatcgcggaagaaacgagcgcggatacattgggagatgtactttctccgagtcagttccgtgcggcgatggatgtcgatgaagatggggtgtcgccgtacgctgcgatgcgcgcgacgttggatgcgcttcgagtgcgcggcgagagagcggaaccgcctgatgcgatggatggtgagtgggttcgcgctcgaacgtcggtgacgaatggaggaacgggtgaagatggtgatgacgtagtttcgtcgtataaagaggtggagaagattgtcggacggggcgcaccgagcgcaatgcgatactcgaaagtaggcgcgcggaacttagccgtcggggatatttctggagggatcatggtgactcgaagcgcgtctagtgacatggaagcggcaagtgcatatgtagataaagcgcacttcgggcgagtcacgagagtggattggaatttgaacgggagtcgactcatcagtggaagcgtaacgggtcaagtgaaaatctggaacgtaagtcacacatccaagtcaacaatgtcaattgagatggacagcgaagtggatgtcgtaaatgaagtgacgacggtaatgttccatcctgtgcacgtagacttggcttttgtgggcttgaaatcgcgtcaagtggtcatcattgatgcctctcttgggatggtcatagaacggctcgcgacgaaaaatatcccgagttgctttgactttaccacaagcgggatgattttatttgtaggggatgatgaaggtcggataaatatagcgagttttgagcctcgaatgaagaagatattatcactgaacccagagagagaagctgcggttgaaaatccactgcatcgcgtcattgccgagcgctcagtgagccaatcggaaagaatagacgcaatcggtactcaacgcggtatgggtacgagtatgactggtgaagaggagacatcttcaacctctaaattgcgttcgaagttcaaaagtatgtttgcgacagcaaaacatatcgttcctcgtccacacattggtgaaatcagaatgggttacaaattaagagcgttaggcgcaatgaacggtccgaaagaaccgtgtgaacttatgcgtatgcgatactgcacgtatcctgaatccatgggtggcccaacgttattcgcattctatgcgaatggtgaaattcgcatatttcgcgctgaaggaacgccattcaaagaactacacctctttacaacttgccgaattgcatcgagacctcaagatgggggtggggtgatttctttcgcgccaggtcaaatgttggagctgccgctcgtatcggcatctcgaggtaatcgtacagcaatttatcttttgccaagtaccccaggtgcgccggttcaggcgacgcaattcacagatgacttcgaaaccaatagtgaagaatctattgatgtcgcgactgtctctgtatggtcacatgagggctcgcacttagccattggatattcgtccggtaaaattagcatttggcagcgccaatagtaacatgcagtagctgcgcatataaattgatcgtataaatacacatcacgcgatgctcaatacttcacaaatttgcacgcaaatttgcacgcactcatgcgctcaggaaaacggatgcacagcaagttatgcgataaaatgcgtgtcatagcactcggagtgtttgttgctcattcgctttccatcgttgatgcgaaaagagagagagcaaattccaataccaccgtggccaataccacctcgacctcgtcaacgaccttctcaacgaaatgcaaatgctcttactctggcttttcatctggaattgacgtcagtaatgagggccgaggttgcttttactcgccgatgcttgacagtgagccgtaccactgctatgtgtcagatgccgaagccaatggttgccaaggtgtatcgccatctacgcggtatcctggtgcattcttgcgagcgtgcaatccactccttgaaactttgacgccatacaacgatatacttccgtttgattcagttacagaggcgttttcatcacgaaaagacctatcactgttttctctcatcgtttcaaccaacaccgattttggagacgtcgtttccaacctcaattggaaccaagactcagatgcggttggaacactttttgttccaacaaatgctgcaatcgagaattttgctcgttttcgtctgatggagtccaatctcacgagcgcaatcaactcggggaacatgtcagacgccctgaaaacgctcatcgttgatggttcatttggacgatacgaatacgaaagcaaaacatttacaacatttgcgtcaacgatgcagacgcgaacacatgtgagaaatttggatgcactaacactctcttatgctgatgcaaagtttcttcaaccgtacattgattcgcggaattggttgacgcgtacgtttgacaagattttccgtcgccgacataattcaaaaattatgtcaaaagtgcacagtgtgccaagcaagcttccgacgaatctcgtcgtggagcgatcgcgtgttatgacaagtggtactgtcgcaaaacctttgaattctatcaaggttgcagtgcaagatttactttttgcacgcaacggcgtggtttttgtcattgatgatgtcgtcgaaccagcatcggacaaggactacgaaattctttcgattgatgagcaaaattaaggcgcgaggtaaagcgtagcgtttgttgtgtttttccttcacacattaaaaatcaacttccaatcccgtctatcgctttgtgcgccccttcgcacaaaaaacgttccaaccccctatgttcctacctactttccctcttccctcttccctcttccctcttccctcttccctcttcctcttcctcttcctcttcctcttcctcttcctcttcctcttcctcttcctnntccncttccnnttccnnntccnnntncnnttccnnttncnnntncnnntncnnntnnnnttnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnncnnnnncnnnnnnnnnnnnnnnnnnnnnncnnnnnnnnnnnnnnnnnnnnnnnnnnnnnnnnnnnnnnnnnnnnnnnnnnnnnnnnannnnnnnnannnnnnnnnnnnncnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnngnnnnnnngnnnnnannnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnngnnnnnnnnnnnnnnnngnnnannnnnnnnnnnnnnnncnnnnnnnnnnnnncnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnannnnngnnnnnnnnnnnnnnnnnnnnnnnnnnnnnnnnn

SEQ ID NO: 968 - DNA, 4000 bp, Escherichia coli
  misc_feature (1403)..(1403): n is a, c, g, or t
  misc_feature (1986)..(1986): n is a, c, g, or t
  misc_feature (2364)..(2364): n is a, c, g, or t
ttcaggatcaggaaagtcgactctattgcactctttagggctacttgaaaagccaacttcgggcgaaataatcattgatggtattaattgtaagcaacttggtagtaagaaacgaacattagtccgcaggaatagtattggtgtagtctatcaatttcatcacttacttaaggaattttcggcgcttgataatgtaataataccacaaatgatttctggaaaaagtattgaggaatcgagtgtagaagctatgagattgctagaaattttaggtttaaaaaatcgattttatcatatgccaggagagctttcaggtggagagcaacaacgagttgccattgctcgtgctatgtcaaataagcccaaaattttacttactgatgagcctacgggtaatctggatccagaaacttctcttattgtatttgataggttattggctttgagtcgtaatgaaaaaatagctgtattagttgcaactcataatatgaatttaataaatcaaatgaacagggttttaactgttcatcagggaaaggttattccatttgtgagtatttaaatttattaaataactataacttagctgatgttattttgagttttcaaaatgtctataaaatattactcctacaataataattgttatgctacctaatgcatttaaaggcgcgttagcggctgccattgcaatcataataaatgttataattaaataaaaagcaggaacaaatggatagccaaaggttttgtatggacgaattaagtccggttctttcctgcgtaaaacaaatacaccaagaattgctaaaaaactatttaatgcaagtatcattcccgcaaaaataatgattttttcaaagcttgatgtaaaaatatatattaatgaaattatggattggaagtaaattgcattttctggaatatctgatttatttactttggacaaaaaactaagagaattgaagtcttcccctattgcttgaagagctcttggtccagctattatcatagcgcttacagttgaaatcaatagcaaggatagcatcaatcctacaattgcagctccatttgaaccaaatatatttacggcagcaatgtaaccaatttctgttttgccttcaaggtctgctattggtgatgagtataagaaggcaatattaagtaataaataaagaaccataacagtggcagttccgatcaaaagaattttaggtagttctttttgaggtctttcaagctcacttgttatgtaaacagcggcattccatcctgtgtaagcataagaaacataaattaaagaaattccaaaagcggtacttgtaagtattttgaaatcatctttttgaggtaaaaatgaaataggttgaggttctggtgtaatagtaaaagcacaaaggcanaagccaattattagaaaaacttttatagatgtaaatccaatttgaaatttaccactaatatttttatttttaacgtgaatgagcgttatgataagaactaaaagacatgcaattattttttttatccaaatgggctgtgagccaaatataattgcagtactataatcactaaatgcaagtgctacggcagcaataggtgctgcgaaaccgataacagttgatatccagcctgatataaaaccagcgagagggtggtatattctaccaaggaagttatattctcctcctgagcgaggtaacgctgaaccaagctcagcatatgttgcagcgccgcataaagctgcaattccaccaactgtccatagcaaaactaaaagaaatgtggattggatgtccattagttggaagccgatagaggtgaaaacacctgttcctatcatatttgcaattattacagaggtagcagcctttttactgtagtatgttctcatgagggcacaatgctttgcagattagccgctgtctataattatttataattgacatatcaaacaaatttatgtagaacaaaaggtgaacatanaagctttttaggattttactaacacataaatggagattttatatgaaacaattactattagatgttactaacggaatagttatggctggttttgtagttataactacattatggtttattgttattggaggatagcctctaataaagagggagtactgagtggcaagatcgccggtttttgttcatcttagatcacgctctccttattcgctattagaaggtgcgctaaagattgaagagacagcacaactgtctcgaagaatgggcatgcctgctctagcgcttactgatactaataatatgtgcggtgctcttgagttttcagaaattcttacaaaagagggaatacaacctattataggtttaactcttagtatngagactgaaaaaacaaaaaatactgttcataataataaagtattggatggaactttagttctcttagccaagaatgaaattggctactgtaatcttatgaaattgagtagttcagcttttcttgatgttgagccctatgatttacctcattttagatcatctcaactatccgctttctctgatggacttattgctcttactggaggcccagaaggcgttttaaataagcttatttgtcaaggacagttagataaagctgaagaatggttagactatttattggatatatattctgataacttatacattgagttgcaaaggcacgggttgcatgatgaagtaattgcagaaaagcatttgattaattgggcttacgctaaaggaataagattagtagctacaaatgagccttactttatgaatcctgatatttttgagtcccatgatgctctcttagcaatgcaggagggttcatatatccttgagaaggacagaagaagactgactcgccagcattactttaaatctacagaagaaatggtagatttatttaaagatctaccagaagcaattgaaaatactattaatatttctaaaatgtgtttggttaaatcagttaagcgcgatcccattcttccaagctttagtgatggctctttaagtgaaggtgatatccttgatcaacaagcacatgaaggtttaaagagacgtttatctaagattaaattatcagcccctaaaagggattacgttaaaagattagaatttgaaattaaaataattcgccaaatggggtttcctggttattttttaatagtttctgattttataaaatgggcaaaatctcaaggtataccagttggaccaggccgtgggtctggagctgggtcggttgttgcatgggctttaactataaccgatttagatcctcttaagtacggtttgctttttgaaaggtttctaaatcctgaaagagtttctatgcccgactttgatatagatttctgtcaagaacggcgtggggaagttatcaaatacgttcaagaaaagtatggtgaagatcaggtggctcatattattacatttggaacgcttcaggcaagggcagttgtaagagatgttggtagagttatgcaaatgcctctacctcaagttgatcgtttagctaaacttgtgccttcgaacccagcaaatcctgtttcattgagcgaagcggttaagatggaaaaaggtttacgtgatgctaaagctgaagaccctgcagtaagaaagttactcgatacagctctgaaacttgagggcttatatcgaaacgcatcaacacatgctgccggtgttgttataggtgacagacccctaactgaattgattccactttaccgtgacccgagatctgatgttcctgctacccaatttacaatgaagtgggcagaaaaagctggattggtgaaatttgattttctggggttaaaaactcttactgttattgataggtgcataaagtacttatctaaacagggcattcaagttgatttagaaaatatagatacatcaaatcccttagcttatattcctttatcagagggcctttcagcgggtgtatttcagcttgaaagctctggaatgcgcgatgttt

SEQ ID NO: 969 - DNA, 4000 bp, Escherichia coli
  misc_feature (2)..(5): n is a, c, g, or t
  misc_feature (7)..(7): n is a, c, g, or t
  misc_feature (9)..(9): n is a, c, g, or t
  misc_feature (12)..(13): n is a, c, g, or t
  misc_feature (15)..(15): n is a, c, g, or t
  misc_feature (17)..(19): n is a, c, g, or t
  misc_feature (21)..(24): n is a, c, g, or t
  misc_feature (26)..(26): n is a, c, g, or t
  misc_feature (28)..(30): n is a, c, g, or t
  misc_feature (34)..(34): n is a, c, g, or t
  misc_feature (36)..(36): n is a, c, g, or t
  misc_feature (38)..(43): n is a, c, g, or t
  misc_feature (45)..(47): n is a, c, g, or t
  misc_feature (49)..(49): n is a, c, g, or t
  misc_feature (51)..(53): n is a, c, g, or t
  misc_feature (55)..(56): n is a, c, g, or t
  misc_feature (58)..(67): n is a, c, g, or t
  misc_feature (69)..(71): n is a, c, g, or t
  misc_feature (73)..(74): n is a, c, g, or t
  misc_feature (77)..(79): n is a, c, g, or t
  misc_feature (82)..(82): n is a, c, g, or t
  misc_feature (84)..(85): n is a, c, g, or t
  misc_feature (87)..(103): n is a, c, g, or t
  misc_feature (106)..(106): n is a, c, g, or t
  misc_feature (109)..(113): n is a, c, g, or t
  misc_feature (115)..(115): n is a, c, g, or t
  misc_feature (117)..(122): n is a, c, g, or t
  misc_feature (125)..(130): n is a, c, g, or t
  misc_feature (133)..(134): n is a, c, g, or t
  misc_feature (136)..(148): n is a, c, g, or t
  misc_feature (151)..(152): n is a, c, g, or t
  misc_feature (154)..(154): n is a, c, g, or t
  misc_feature (156)..(156): n is a, c, g, or t
  misc_feature (158)..(158): n is a, c, g, or t
  misc_feature (160)..(160): n is a, c, g, or t
  misc_feature (162)..(162): n is a, c, g, or t
  misc_feature (164)..(169): n is a, c, g, or t
  misc_feature (172)..(178): n is a, c, g, or t
  misc_feature (180)..(180): n is a, c, g, or t
  misc_feature (182)..(184): n is a, c, g, or t
  misc_feature (186)..(189): n is a, c, g, or t
  misc_feature (191)..(191): n is a, c, g, or t
  misc_feature (193)..(193): n is a, c, g, or t
  misc_feature (195)..(198): n is a, c, g, or t
  misc_feature (201)..(205): n is a, c, g, or t
  misc_feature (208)..(211): n is a, c, g, or t
  misc_feature (214)..(214): n is a, c, g, or t
  misc_feature (216)..(217): n is a, c, g, or t
  misc_feature (219)..(222): n is a, c, g, or t
  misc_feature (224)..(228): n is a, c, g, or t
  misc_feature (231)..(231): n is a, c, g, or t
  misc_feature (233)..(238): n is a, c, g, or t
  misc_feature (240)..(245): n is a, c, g, or t
  misc_feature (247)..(247): n is a, c, g, or t
  misc_feature (249)..(252): n is a, c, g, or t
  misc_feature (254)..(257): n is a, c, g, or t
  misc_feature (261)..(263): n is a, c, g, or t
  misc_feature (267)..(267): n is a, c, g, or t
  misc_feature (269)..(272): n is a, c, g, or t
  misc_feature (276)..(278): n is a, c, g, or t
  misc_feature (280)..(282): n is a, c, g, or t
  misc_feature (285)..(288): n is a, c, g, or t
  misc_feature (291)..(291): n is a, c, g, or t
  misc_feature (294)..(297): n is a, c, g, or t
  misc_feature (299)..(300): n is a, c, g, or t
  misc_feature (303)..(309): n is a, c, g, or t
  misc_feature (311)..(315): n is a, c, g, or t
  misc_feature (317)..(318): n is a, c, g, or t
  misc_feature (320)..(320): n is a, c, g, or t
  misc_feature (323)..(326): n is a, c, g, or t
  misc_feature (328)..(330): n is a, c, g, or t
  misc_feature (332)..(336): n is a, c, g, or t
  misc_feature (338)..(338): n is a, c, g, or t
  misc_feature (340)..(342): n is a, c, g, or t
  misc_feature (346)..(350): n is a, c, g, or t
  misc_feature (352)..(352): n is a, c, g, or t
  misc_feature (354)..(354): n is a, c, g, or t
  misc_feature (357)..(360): n is a, c, g, or t
  misc_feature (364)..(370): n is a, c, g, or t
  misc_feature (372)..(372): n is a, c, g, or t
  misc_feature (376)..(378): n is a, c, g, or t
  misc_feature (381)..(381): n is a, c, g, or t
  misc_feature (383)..(383): n is a, c, g, or t
  misc_feature (385)..(385): n is a, c, g, or t
  misc_feature (387)..(390): n is a, c, g, or t
  misc_feature (392)..(392): n is a, c, g, or t
  misc_feature (395)..(400): n is a, c, g, or t
  misc_feature (403)..(405): n is a, c, g, or t
  misc_feature (407)..(429): n is a, c, g, or t
  misc_feature (431)..(442): n is a, c, g, or t
  misc_feature (445)..(450): n is a, c, g, or t
  misc_feature (452)..(455): n is a, c, g, or t
  misc_feature (457)..(457): n is a, c, g, or t
  misc_feature (460)..(463): n is a, c, g, or t
  misc_feature (465)..(469): n is a, c, g, or t
  misc_feature (471)..(475): n is a, c, g, or t
  misc_feature (477)..(477): n is a, c, g, or t
  misc_feature (479)..(479): n is a, c, g, or t
  misc_feature (482)..(485): n is a, c, g, or t
  misc_feature (487)..(488): n is a, c, g, or t
  misc_feature (490)..(491): n is a, c, g, or t
  misc_feature (495)..(495): n is a, c, g, or t
  misc_feature (497)..(497): n is a, c, g, or t
  misc_feature (500)..(502): n is a, c, g, or t
  misc_feature (504)..(507): n is a, c, g, or t
  misc_feature (510)..(516): n is a, c, g, or t
  misc_feature (519)..(520): n is a, c, g, or t
  misc_feature (523)..(523): n is a, c, g, or t
  misc_feature (525)..(525): n is a, c, g, or t
  misc_feature (527)..(528): n is a, c, g, or t
  misc_feature (530)..(537): n is a, c, g, or t
  misc_feature (539)..(539): n is a, c, g, or t
  misc_feature (542)..(546): n is a, c, g, or t
  misc_feature (548)..(552): n is a, c, g, or t
  misc_feature (554)..(554): n is a, c, g, or t
  misc_feature (556)..(558): n is a, c, g, or t
  misc_feature (561)..(562): n is a, c, g, or t
  misc_feature (564)..(569): n is a, c, g, or t
  misc_feature (571)..(572): n is a, c, g, or t
  misc_feature (575)..(575): n is a, c, g, or t
  misc_feature (577)..(578): n is a, c, g, or t
  misc_feature (580)..(583): n is a, c, g, or t
  misc_feature (585)..(585): n is a, c, g, or t
  misc_feature (587)..(587): n is a, c, g, or t
  misc_feature (589)..(589): n is a, c, g, or t
  misc_feature (591)..(596): n is a, c, g, or t
  misc_feature (599)..(605): n is a, c, g, or t
  misc_feature (607)..(610): n is a, c, g, or t
  misc_feature (612)..(612): n is a, c, g, or t
  misc_feature (614)..(630): n is a, c, g, or t
  misc_feature (633)..(635): n is a, c, g, or t
  misc_feature (637)..(642): n is a, c, g, or t
  misc_feature (644)..(646): n is a, c, g, or t
  misc_feature (648)..(655): n is a, c, g, or t
  misc_feature (657)..(657): n is a, c, g, or t
  misc_feature (659)..(664): n is a, c, g, or t
  misc_feature (666)..(674): n is a, c, g, or t
  misc_feature (677)..(679): n is a, c, g, or t
  misc_feature (681)..(687): n is a, c, g, or t
  misc_feature (689)..(690): n is a, c, g, or t
  misc_feature (692)..(692): n is a, c, g, or t
  misc_feature (695)..(696): n is a, c, g, or t
  misc_feature (698)..(704): n is a, c, g, or t
  misc_feature (708)..(709): n is a, c, g, or t
  misc_feature (711)..(711): n is a, c, g, or t
  misc_feature (713)..(713): n is a, c, g, or t
  misc_feature (715)..(717): n is a, c, g, or t
  misc_feature (719)..(720): n is a, c, g, or t
  misc_feature (722)..(730): n is a, c, g, or t
  misc_feature (732)..(738): n is a, c, g, or t
  misc_feature (740)..(740): n is a, c, g, or t
  misc_feature (742)..(744): n is a, c, g, or t
  misc_feature (747)..(750): n is a, c, g, or t
  misc_feature (753)..(759): n is a, c, g, or t
  misc_feature (761)..(763): n is a, c, g, or t
  misc_feature (765)..(765): n is a, c, g, or t
  misc_feature (768)..(768): n is a, c, g, or t
  misc_feature (770)..(772): n is a, c, g, or t
  misc_feature (775)..(780): n is a, c, g, or t
  misc_feature (782)..(789): n is a, c, g, or t
  misc_feature (792)..(792): n is a, c, g, or t
  misc_feature (794)..(795): n is a, c, g, or t
  misc_feature (798)..(802): n is a, c, g, or t
  misc_feature (804)..(807): n is a, c, g, or t
  misc_feature (809)..(810): n is a, c, g, or t
  misc_feature (812)..(816): n is a, c, g, or t
  misc_feature (818)..(818): n is a, c, g, or t
  misc_feature (820)..(828): n is a, c, g, or t
  misc_feature (830)..(833): n is a, c, g, or t
  misc_feature (835)..(845): n is a, c, g, or t
  misc_feature (847)..(851): n is a, c, g, or t
  misc_feature (853)..(854): n is a, c, g, or t
  misc_feature (857)..(857): n is a, c, g, or t
  misc_feature (859)..(860): n is a, c, g, or t
  misc_feature (862)..(863): n is a, c, g, or t
  misc_feature (865)..(866): n is a, c, g, or t
  misc_feature (869)..(874): n is a, c, g, or t
  misc_feature (876)..(877): n is a, c, g, or t
  misc_feature (879)..(879): n is a, c, g, or t
  misc_feature (882)..(884): n is a, c, g, or t
  misc_feature (886)..(887): n is a, c, g, or t
  misc_feature (890)..(894): n is a, c, g, or t
  misc_feature (896)..(899): n is a, c, g, or t
  misc_feature (902)..(905): n is a, c, g, or t
  misc_feature (907)..(918): n is a, c, g, or t
  misc_feature (920)..(921): n is a, c, g, or t
  misc_feature (923)..(924): n is a, c, g, or t
  misc_feature (926)..(928): n is a, c, g, or t
  misc_feature (930)..(931): n is a, c, g, or t
  misc_feature (933)..(944): n is a, c, g, or t
  misc_feature (947)..(958): n is a, c, g, or t
  misc_feature (960)..(963): n is a, c, g, or t
  misc_feature (965)..(968): n is a, c, g, or t
  misc_feature (973)..(973): n is a, c, g, or t
  misc_feature (975)..(975): n is a, c, g, or t
  misc_feature (977)..(979): n is a, c, g, or t
  misc_feature (981)..(984): n is a, c, g, or t
  misc_feature (986)..(987): n is a, c, g, or t
  misc_feature (989)..(990): n is a, c, g, or t
  misc_feature (992)..(995): n is a, c, g, or t
  misc_feature (997)..(997): n is a, c, g, or t
  misc_feature (999)..(1000): n is a, c, g, or t
  misc_feature (1002)..(1005): n is a, c, g, or t
  misc_feature (1007)..(1019): n is a, c, g, or t
  misc_feature (1024)..(1033): n is a, c, g, or t
  misc_feature (1035)..(1040): n is a, c, g, or t
  misc_feature (1043)..(1044): n is a, c, g, or t
  misc_feature (1046)..(1047): n is a, c, g, or t
  misc_feature (1049)..(1055): n is a, c, g, or t
  misc_feature (1058)..(1059): n is a, c, g, or t
  misc_feature (1061)..(1063): n is a, c, g, or t
  misc_feature (1071)..(1072): n is a, c, g, or t
  misc_feature (1074)..(1074): n is a, c, g, or t
  misc_feature (1077)..(1079): n is a, c, g, or t
  misc_feature (1081)..(1081): n is a, c, g, or t
  misc_feature (1084)..(1088): n is a, c, g, or t
  misc_feature (1090)..(1090): n is a, c, g, or t
  misc_feature (1092)..(1092): n is a, c, g, or t
  misc_feature (1095)..(1095): n is a, c, g, or t
  misc_feature (1101)..(1101): n is a, c, g, or t
  misc_feature (1104)..(1104): n is a, c, g, or t
  misc_feature (1108)..(1108): n is a, c, g, or t
  misc_feature (1110)..(1111): n is a, c, g, or t
  misc_feature (1115)..(1115): n is a, c, g, or t
  misc_feature (1118)..(1119): n is a, c, g, or t
  misc_feature (1124)..(1124): n is a, c, g, or t
  misc_feature (1127)..(1127): n is a, c, g, or t
  misc_feature (1130)..(1131): n is a, c, g, or t
  misc_feature (1136)..(1139): n is a, c, g, or t
  misc_feature (1141)..(1143): n is a, c, g, or t
  misc_feature (1145)..(1145): n is a, c, g, or t
  misc_feature (1147)..(1147): n is a, c, g, or t
  misc_feature (1149)..(1149): n is a, c, g, or t
  misc_feature (1152)..(1153): n is a, c, g, or t
  misc_feature (1156)..(1156): n is a, c, g, or t
  misc_feature (1158)..(1159): n is a, c, g, or t
  misc_feature (1161)..(1162): n is a, c, g, or t
  misc_feature (1164)..(1164): n is a, c, g, or t
  misc_feature (1167)..(1167): n is a, c, g, or t
  misc_feature (1169)..(1169): n is a, c, g, or t
  misc_feature (1171)..(1171): n is a, c, g, or t
  misc_feature (1175)..(1175): n is a, c, g, or t
  misc_feature (1178)..(1179): n is a, c, g, or t
  misc_feature (1182)..(1183): n is a, c, g, or t
  misc_feature (1189)..(1189): n is a, c, g, or t
  misc_feature (1193)..(1193): n is a, c, g, or t
  misc_feature (1195)..(1195): n is a, c, g, or t
  misc_feature (1198)..(1199): n is a, c, g, or t
  misc_feature (1204)..(1207): n is a, c, g, or t
  misc_feature (1210)..(1210): n is a, c, g, or t
  misc_feature (1212)..(1213): n is a, c, g, or t
  misc_feature (1216)..(1216): n is a, c, g, or t
  misc_feature (1220)..(1221): n is a, c, g, or t
  misc_feature (1223)..(1226): n is a, c, g, or t
  misc_feature (1228)..(1228): n is a, c, g, or t
  misc_feature (1232)..(1233): n is a, c, g, or t
  misc_feature (1235)..(1235): n is a, c, g, or t
  misc_feature (1240)..(1240): n is a, c, g, or t
  misc_feature (1242)..(1243): n is a, c, g, or t
  misc_feature (1245)..(1246): n is a, c, g, or t
  misc_feature (1248)..(1249): n is a, c, g, or t
  misc_feature (1251)..(1251): n is a, c, g, or t
  misc_feature (1253)..(1253): n is a, c, g, or t
  misc_feature (1255)..(1256): n is a, c, g, or t
  misc_feature (1260)..(1262): n is a, c, g, or t
  misc_feature (1265)..(1266): n is a, c, g, or t
  misc_feature (1268)..(1272): n is a, c, g, or t
  misc_feature (1274)..(1276): n is a, c, g, or t
  misc_feature (1279)..(1280): n is a, c, g, or t
  misc_feature (1282)..(1283): n is a, c, g, or t
  misc_feature (1286)..(1287): n is a, c, g, or t
  misc_feature (1289)..(1292): n is a, c, g, or t
  misc_feature (1294)..(1298): n is a, c, g, or t
  misc_feature (1300)..(1302): n is a, c, g, or t
  misc_feature (1307)..(1310): n is a, c, g, or t
  misc_feature (1312)..(1312): n is a, c, g, or t
  misc_feature (1314)..(1315): n is a, c, g, or t
  misc_feature (1317)..(1317): n is a, c, g, or t
  misc_feature (1320)..(1320): n is a, c, g, or t
  misc_feature (1323)..(1328): n is a, c, g, or t
  misc_feature (1331)..(1332): n is a, c, g, or t
  misc_feature (1334)..(1334): n is a, c, g, or t
  misc_feature (1337)..(1337): n is a, c, g, or t
  misc_feature (1339)..(1339): n is a, c, g, or t
  misc_feature (1342)..(1342): n is a, c, g, or t
  misc_feature (1345)..(1345): n is a, c, g, or t
  misc_feature (1347)..(1347): n is a, c, g, or t
  misc_feature (1350)..(1350): n is a, c, g, or t
  misc_feature (1353)..(1353): n is a, c, g, or t
  misc_feature (1355)..(1355): n is a, c, g, or t
  misc_feature (1357)..(1357): n is a, c, g, or t
  misc_feature (1359)..(1360): n is a, c, g, or t
  misc_feature (1362)..(1362): n is a, c, g, or t
  misc_feature (1364)..(1364): n is a, c, g, or t
  misc_feature (1366)..(1366): n is a, c, g, or t
  misc_feature (1371)..(1373): n is a, c, g, or t
  misc_feature (1375)..(1378): n is a, c, g, or t
  misc_feature (1381)..(1381): n is a, c, g, or t
  misc_feature (1384)..(1384): n is a, c, g, or t
  misc_feature (1386)..(1388): n is a, c, g, or t
  misc_feature (1391)..(1391): n is a, c, g, or t
  misc_feature (1393)..(1394): n is a, c, g, or t
  misc_feature (1398)..(1399): n is a, c, g, or t
  misc_feature (1401)..(1402): n is a, c, g, or t
  misc_feature (1405)..(1409): n is a, c, g, or t
  misc_feature (1411)..(1411): n is a, c, g, or t
  misc_feature (1413)..(1414): n is a, c, g, or t
  misc_feature (1416)..(1416): n is a, c, g, or t
  misc_feature (1422)..(1423): n is a, c, g, or t
  misc_feature (1425)..(1426): n is a, c, g, or t
  misc_feature (1429)..(1430): n is a, c, g, or t
  misc_feature (1434)..(1437): n is a, c, g, or t
  misc_feature (1439)..(1441): n is a, c, g, or t
  misc_feature (1444)..(1444): n is a, c, g, or t
  misc_feature (1446)..(1447): n is a, c, g, or t
  misc_feature (1449)..(1449): n is a, c, g, or t
  misc_feature (1451)..(1451): n is a, c, g, or t
  misc_feature (1454)..(1454): n is a, c, g, or t
  misc_feature (1456)..(1460): n is a, c, g, or t
  misc_feature (1463)..(1464): n is a, c, g, or t
  misc_feature (1467)..(1468): n is a, c, g, or t
  misc_feature (1472)..(1474): n is a, c, g, or t
  misc_feature (1476)..(1476): n is a, c, g, or t
  misc_feature (1479)..(1481): n is a, c, g, or t
  misc_feature (1483)..(1483): n is a, c, g, or t
  misc_feature (1487)..(1487): n is a, c, g, or t
  misc_feature (1491)..(1492): n is a, c, g, or t
  misc_feature (1495)..(1499): n is a, c, g, or t
  misc_feature (1503)..(1503): n is a, c, g, or t
  misc_feature (1507)..(1510): n is a, c, g, or t
  misc_feature (1513)..(1513): n is a, c, g, or t
  misc_feature (1516)..(1516): n is a, c, g, or t
  misc_feature (1521)..(1521): n is a, c, g, or t
  misc_feature (1524)..(1525): n is a, c, g, or t
  misc_feature (1527)..(1528): n is a, c, g, or t
  misc_feature (1532)..(1535): n is a, c, g, or t
  misc_feature (1537)..(1538): n is a, c, g, or t
  misc_feature (1540)..(1544): n is a, c, g, or t
  misc_feature (1546)..(1547): n is a, c, g, or t
  misc_feature (1549)..(1549): n is a, c, g, or t
  misc_feature (1552)..(1557): n is a, c, g, or t
  misc_feature (1559)..(1559): n is a, c, g, or t
  misc_feature (1561)..(1561): n is a, c, g, or t
  misc_feature (1563)..(1563): n is a, c, g, or t
  misc_feature (1565)..(1567): n is a, c, g, or t
  misc_feature (1569)..(1570): n is a, c, g, or t
  misc_feature (1573)..(1573): n is a, c, g, or t
  misc_feature (1576)..(1578): n is a, c, g, or t
  misc_feature (1580)..(1580): n is a, c, g, or t
  misc_feature (1582)..(1589): n is a, c, g, or t
  misc_feature (1592)..(1592): n is a, c, g, or t
  misc_feature (1595)..(1601): n is a, c, g, or t
  misc_feature (1603)..(1606): n is a, c, g, or t
  misc_feature (1609)..(1609): n is a, c, g, or t
  misc_feature (1613)..(1613): n is a, c, g, or t
  misc_feature (1615)..(1615): n is a, c, g, or t
  misc_feature (1618)..(1618): n is a, c, g, or t
  misc_feature (1621)..(1621): n is a, c, g, or t
  misc_feature (1623)..(1623): n is a, c, g, or t
  misc_feature (1626)..(1626): n is a, c, g, or t
  misc_feature (1628)..(1628): n is a, c, g, or t
  misc_feature (1630)..(1630): n is a, c, g, or t
  misc_feature (1633)..(1634): n is a, c, g, or t
  misc_feature (1636)..(1636): n is a, c, g, or t
  misc_feature (1639)..(1639): n is a, c, g, or t
  misc_feature (1642)..(1642): n is a, c, g, or t
  misc_feature (1644)..(1645): n is a, c, g, or t
  misc_feature (1647)..(1647): n is a, c, g, or t
  misc_feature (1651)..(1651): n is a, c, g, or t
  misc_feature (1653)..(1653): n is a, c, g, or t
  misc_feature (1655)..(1655): n is a, c, g, or t
  misc_feature (1657)..(1658): n is a, c, g, or t
  misc_feature (1660)..(1664): n is a, c, g, or t
  misc_feature (1666)..(1668): n is a, c, g, or t
  misc_feature (1671)..(1673): n is a, c, g, or t
  misc_feature (1675)..(1675): n is a, c, g, or t
  misc_feature (1681)..(1682): n is a, c, g, or t
  misc_feature (1684)..(1685): n is a, c, g, or t
  misc_feature (1688)..(1688): n is a, c, g, or t
  misc_feature (1691)..(1692): n is a, c, g, or t
  misc_feature (1695)..(1698): n is a, c, g, or t
  misc_feature (1701)..(1702): n is a, c, g, or t
  misc_feature (1704)..(1705): n is a, c, g, or t
  misc_feature (1708)..(1708): n is a, c, g, or t
  misc_feature (1711)..(1714): n is a, c, g, or t
  misc_feature (1717)..(1717): n is a, c, g, or t
  misc_feature (1719)..(1719): n is a, c, g, or t
  misc_feature (1721)..(1724): n is a, c, g, or t
  misc_feature (1726)..(1726): n is a, c, g, or t
  misc_feature (1728)..(1731): n is a, c, g, or t
  misc_feature (1733)..(1733): n is a, c, g, or t
  misc_feature (1735)..(1736): n is a, c, g, or t
  misc_feature (1741)..(1741): n is a, c, g, or t
  misc_feature (1744)..(1744): n is a, c, g, or t
  misc_feature (1748)..(1754): n is a, c, g, or t
  misc_feature (1761)..(1761): n is a, c, g, or t
  misc_feature (1764)..(1764): n is a, c, g, or t
  misc_feature (1767)..(1770): n is a, c, g, or t
  misc_feature (1773)..(1777): n is a, c, g, or t
  misc_feature (1780)..(1780): n is a, c, g, or t
  misc_feature (1782)..(1782): n is a, c, g, or t
  misc_feature (1784)..(1784): n is a, c, g, or t
  misc_feature (1786)..(1787): n is a, c, g, or t
  misc_feature (1789)..(1792): n is a, c, g, or t
  misc_feature (1819)..(1819): n is a, c, g, or t
  misc_feature (1828)..(1828): n is a, c, g, or t
  misc_feature (1852)..(1852): n is a, c, g, or t
  misc_feature (1858)..(1858): n is a, c, g, or t
  misc_feature (1880)..(1880): n is a, c, g, or t
  misc_feature (1925)..(1925): n is a, c, g, or t
  misc_feature (1935)..(1936): n is a, c, g, or t
  misc_feature (1938)..(1939): n is a, c, g, or t
  misc_feature (1957)..(1957): n is a, c, g, or t
  misc_feature (1979)..(1979): n is a, c, g, or t
  misc_feature (1989)..(1989): n is a, c, g, or t
  misc_feature (1992)..(1992): n is a, c, g, or t
  misc_feature (1994)..(1994): n is a, c, g, or t
  misc_feature (2119)..(2119): n is a, c, g, or t
  misc_feature (2865)..(2865): n is a, c, g, or t
  misc_feature (3114)..(3114): n is a, c, g, or t
  misc_feature (3170)..(3171): n is a, c, g, or t
  misc_feature (3173)..(3173): n is a, c, g, or t
  misc_feature (3176)..(3177): n is a, c, g, or t
  misc_feature (3192)..(3192): n is a, c, g, or t
  misc_feature (3197)..(3198): n is a, c, g, or t
  misc_feature (3230)..(3230): n is a, c, g, or t
  misc_feature (3270)..(3270): n is a, c, g, or t
  misc_feature (3279)..(3279): n is a, c, g, or t
  misc_feature (3295)..(3295): n is a, c, g, or t
  misc_feature (3305)..(3305): n is a, c, g, or t
  misc_feature (3316)..(3316): n is a, c, g, or t
  misc_feature (3321)..(3321): n is a, c, g, or t
  misc_feature (3366)..(3370): n is a, c, g, or t
  misc_feature (3372)..(3373): n is a, c, g, or t
  misc_feature (3375)..(3378): n is a, c, g, or t
  misc_feature (3380)..(3380): n is a, c, g, or t
  misc_feature (3383)..(3389): n is a, c, g, or t
  misc_feature (3391)..(3393): n is a, c, g, or t
  misc_feature (3395)..(3395): n is a, c, g, or t
  misc_feature (3397)..(3403): n is a, c, g, or t
  misc_feature (3406)..(3406): n is a, c, g, or t
  misc_feature (3409)..(3411): n is a, c, g, or t
  misc_feature (3416)..(3417): n is a, c, g, or t
  misc_feature (3419)..(3422): n is a, c, g, or t
  misc_feature (3424)..(3425): n is a, c, g, or t
  misc_feature (3428)..(3435): n is a, c, g, or t
  misc_feature (3437)..(3440): n is a, c, g, or t
  misc_feature (3442)..(3445): n is a, c, g, or t
  misc_feature (3448)..(3448): n is a, c, g, or t
  misc_feature (3451)..(3454): n is a, c, g, or t
  misc_feature (3456)..(3458): n is a, c, g, or t
  misc_feature (3460)..(3460): n is a, c, g, or t
  misc_feature (3462)..(3468): n is a, c, g, or t
  misc_feature (3470)..(3470): n is a, c, g, or t
  misc_feature (3472)..(3477): n is a, c, g, or t
  misc_feature (3480)..(3480): n is a, c, g, or t
  misc_feature (3482)..(3483): n is a, c, g, or t
  misc_feature (3485)..(3486): n is a, c, g, or t
  misc_feature (3488)..(3489): n is a, c, g, or t
  misc_feature (3491)..(3491): n is a, c, g, or t
  misc_feature (3495)..(3495): n is a, c, g, or t
  misc_feature (3498)..(3498): n is a, c, g, or t
  misc_feature (3500)..(3502): n is a, c, g, or t
  misc_feature (3504)..(3514): n is a, c, g, or t
  misc_feature (3520)..(3520): n is a, c, g, or t
  misc_feature (3522)..(3523): n is a, c, g, or t
  misc_feature (3525)..(3525): n is a, c, g, or t
  misc_feature (3527)..(3531): n is a, c, g, or t
  misc_feature (3533)..(3534): n is a, c, g, or t
  misc_feature (3536)..(3536): n is a, c, g, or t
  misc_feature (3538)..(3539): n is a, c, g, or t
  misc_feature (3541)..(3543): n is a, c, g, or t
  misc_feature (3549)..(3553): n is a, c, g, or t
  misc_feature (3555)..(3561): n is a, c, g, or t
  misc_feature (3563)..(3563): n is a, c, g, or t
  misc_feature (3565)..(3565): n is a, c, g, or t
  misc_feature (3567)..(3569): n is a, c, g, or t
  misc_feature (3571)..(3577): n is a, c, g, or t
  misc_feature (3579)..(3579): n is a, c, g, or t
  misc_feature (3581)..(3581): n is a, c, g, or t
  misc_feature (3587)..(3587): n is a, c, g, or t
  misc_feature (3589)..(3596): n is a, c, g, or t
  misc_feature (3599)..(3602): n is a, c, g, or t
  misc_feature (3604)..(3605): n is a, c, g, or t
  misc_feature (3609)..(3611): n is a, c, g, or t
  misc_feature (3613)..(3613): n is a, c, g, or t
  misc_feature (3618)..(3619): n is a, c, g, or t
  misc_feature (3622)..(3622): n is a, c, g, or t
  misc_feature (3627)..(3629): n is a, c, g, or t
  misc_feature (3631)..(3632): n is a, c, g, or t
  misc_feature (3634)..(3636): n is a, c, g, or t
  misc_feature (3638)..(3641): n is a, c, g, or t
  misc_feature (3643)..(3645): n is a, c, g, or t
  misc_feature (3649)..(3649): n is a, c, g, or t
  misc_feature (3653)..(3656): n is a, c, g, or t
  misc_feature (3659)..(3660): n is a, c, g, or t
  misc_feature (3662)..(3665): n is a, c, g, or t
  misc_feature (3667)..(3667): n is a, c, g, or t
  misc_feature (3669)..(3671): n is a, c, g, or t
  misc_feature (3675)..(3676): n is a, c, g, or t
  misc_feature (3680)..(3681): n is a, c, g, or t
  misc_feature (3683)..(3686): n is a, c, g, or t
  misc_feature (3690)..(3699): n is a, c, g, or t
  misc_feature (3703)..(3703): n is a, c, g, or t
  misc_feature (3705)..(3709): n is a, c, g, or t
  misc_feature (3712)..(3721): n is a, c, g, or t
  misc_feature (3725)..(3725): n is a, c, g, or t
  misc_feature (3727)..(3730): n is a, c, g, or t
  misc_feature (3734)..(3737): n is a, c, g, or t
  misc_feature (3739)..(3739): n is a, c, g, or t
  misc_feature (3741)..(3742): n is a, c, g, or t
  misc_feature (3746)..(3747): n is a, c, g, or t
  misc_feature (3749)..(3752): n is a, c, g, or t
  misc_feature (3756)..(3764): n is a, c, g, or t
  misc_feature (3766)..(3766): n is a, c, g, or t
  misc_feature (3769)..(3775): n is a, c, g, or t
  misc_feature (3778)..(3781): n is a, c, g, or t
  misc_feature (3783)..(3783): n is a, c, g, or t
  misc_feature (3785)..(3786): n is a, c, g, or t
  misc_feature (3790)..(3792): n is a, c, g, or t
  misc_feature (3794)..(3803): n is a, c, g, or t
  misc_feature (3805)..(3811): n is a, c, g, or t
  misc_feature (3813)..(3817): n is a, c, g, or t
  misc_feature (3820)..(3823): n is a, c, g, or t
  misc_feature (3825)..(3829): n is a, c, g, or t
  misc_feature (3832)..(3833): n is a, c, g, or t
  misc_feature (3835)..(3838): n is a, c, g, or t
  misc_feature (3841)..(3844): n is a, c, g, or t
  misc_feature (3846)..(3846): n is a, c, g, or t
  misc_feature (3848)..(3848): n is a, c, g, or t
  misc_feature (3851)..(3852): n is a, c, g, or t
  misc_feature (3855)..(3856): n is a, c, g, or t
  misc_feature (3858)..(3859): n is a, c, g, or t
  misc_feature (3861)..(3861): n is a, c, g, or t
  misc_feature (3866)..(3869): n is a, c, g, or t
  misc_feature (3871)..(3871): n is a, c, g, or t
  misc_feature (3878)..(3878): n is a, c, g, or t
  misc_feature (3881)..(3882): n is a, c, g, or t
  misc_feature (3886)..(3888): n is a, c, g, or t
  misc_feature (3890)..(3892): n is a, c, g, or t
  misc_feature (3894)..(3894): n is a, c, g, or t
  misc_feature (3899)..(3901): n is a, c, g, or t
  misc_feature (3909)..(3909): n is a, c, g, or t
  misc_feature (3914)..(3914): n is a, c, g, or t
  misc_feature (3916)..(3916): n is a, c, g, or t
  misc_feature (3920)..(3923): n is a, c, g, or t
  misc_feature (3925)..(3926): n is a, c, g, or t
  misc_feature (3929)..(3930): n is a, c, g, or t
  misc_feature (3932)..(3934): n is a, c, g, or t
  misc_feature (3936)..(3939): n is a, c, g, or t
  misc_feature (3943)..(3951): n is a, c, g, or t
  misc_feature (3953)..(3954): n is a, c, g, or t
  misc_feature (3956)..(3956): n is a, c, g, or t
  misc_feature (3958)..(3958): n is a, c, g, or t
  misc_feature (3961)..(3965): n is a, c, g, or t
  misc_feature (3968)..(3968): n is a, c, g, or t
  misc_feature (3970)..(3971): n is a, c, g, or t
  misc_feature (3975)..(3976): n is a, c, g, or t
  misc_feature (3978)..(3981): n is a, c, g, or t
  misc_feature (3985)..(3989): n is a, c, g, or t
  misc_feature (3991)..(3991): n is a, c, g, or t
  misc_feature (3994)..(3994): n is a, c, g, or t
  misc_feature (3996)..(3996): n is a, c, g, or t
  misc_feature (3998)..(3998): n is a, c, g, or t
tnnnnangnccnncnannnannnncnannntttngncnnnnnncnnnancnnntnnannnnnnnnnngnnntnnttnnnggntnncnnnnnnnnnnnnnnnnnggnaannnnngncnnnnnnttnnnnnnttnntnnnnnnnnnnnnnttnncngncntncntnnnnnnttnnnnnnngntnnngnnnnangncnnnnccnnnnnttnnnnttncnngnnnncnnnnnttncnnnnnngnnnnnnantnnnntnnnnaaannngggnannnncccnnntnnnccnnnnaanccnnnntnnccnnnnnnnannnnncnntnaannnnannncnnnnncnannncccnnnnnangnttnnnnaaannnnnnncntttnnnccntnancnnnncnttnnnnnnttnnncnnnnnnnnnnnnnnnnnnnnnnntnnnnnnnnnnnnccnnnnnncnnnncnttnnnncnnnnngnnnnncnanggnnnntnntnnaaantnaannngnnnnaannnnnnnccnnttncngnntnnnnnnnncnggnnnnntnnnnncnannnttnngnnnnnntnnttngnnannnncnantngnnnnnnaannnnnnnannnnancnnnnnnnnnnnnnnnnnccnnntnnnnnntnnngnnnnnnnnangnnnnnncnnnnnnnnnttnnncnnnnnnncnntnaanntnnnnnnncccnngntnannncnntnnnnnnnnngnnnnnnncnannnaannnnccnnnnnnngnnncnaancnnnaannnnnngnnnnnnnnccntnnccnnnnncnnnntnncnnnnntnannnnnnnnncnnnntnnnnnnnnnnngnnnnnannttngnnanngnnggnnnnnntnngnttnnntnnttnnnnnannnnggnnnngnnnnnnnnnnnntnntnnannnannannnnnnnnnnnnttnnnnnnnnnnnncnnnntnnnnccccntnannngnnnntnnannannnngntnncnnnntnnnnnnnnnnnnnttttnnnnnnnnnngnnnnnnttnncnncnnnnnnnaanntnnnaaaaaatnncntannntnccnnnnnantnaanaaaaanaancgcncnntttnacnntttanaanaannttttnnnnannncncncnaannggngnncnnangcncncnggtnttnnccnntttttntttntnttnncacannnnaanannttnaacnntnnnntnaaanntnttttngnnanngnntncncnnttcnnntcnngnnnnngnnnttnncnnaanncnnnncnnnnntnnngggtnnnncntnngnaanaannnnnnaanngnccntnaanggnanaanggnanantnngnancncccannncnnnnaanaanannnaantnnaatnncnnaannnnntntnnangggtgnnannttnnaaannnnannnttnanntncnaancnnnnnaannggnnaacnnntnttnnngngagncccnnttnnnnncgcncccnnnnaanaanaaaancgnntnnaaannnntnnannnnntnncnaannnnnngnanangnnntnnccnggnnnancnnnnnnnnggnaannnnnnnannnnccntttnanaanggngnttntncnccnntnganaananntntctntncncnntnnnnntnnnccnnncnggaaanncnnacnccnnggnnnngcnntnnggnccnnnnccntntnnnngnannnnanannccccnccncacnnnnnnnaaaaaanatnttnnnnaannnnnttncnananngnnnnggctggcttatgaagacagcatggagnttcctagcngccaaataaacccttttccacaancttgcngagggcaacatcatgggcgttncaaccgaaaataagcgtttacgcaaaaccaattgggcaacgccangcgcgttggnncnnggctttcaccctcaaccncttgcctacaaacgcaagccancatcaaggcnggncnttttaagaaaggccccattgcaccaagcataagccaacaaagcacctgcgggctaagcccgaggtgcgattaaggtctacaaaagggaaagcttaaagggttgcgacacattaaggcaccagcgngagcgtcttgaatgtaaaaagaaacgaggttgccacgccgggcttctgtgtcgctccctttcttcaaacaacagtatgtatcttcaaatcagttgcggcagtcaatcataatcgtgccggcatggcaacgatacacctgcctcactcgtccgtcggcggagtaatgggaggccaaagcctgtcgcagctgttcgtaatcatcgtcggaggccatgctatcaatcttcacattgatgagtcttcccatgggaaacacctggtaaaggccgtcgcgcgtgtacttaatcttatccacgccgccgagaagtccgtagctctggtagtccgtctcgaggctcgacacgaactcgtctgccaagcttagtacctcacgatacttcacctgcccgcaggcccacagctgcaataacataaaaacaaacaatactaccttcttcatacaaacatcagtttagattattttatatacatatcaggtttcccgctttcaaagcggaacatcgagaggtattagcgaccatagaaatacgctcgttcacaacatggcatgtatggaaaaggaaaggcggttgccttacgaaacagggctccgatggctttgttaccacgcgaagtggcttgtctcttggctttcttctctaatccttcgactgaatagttgttgaacttgctatattcttctactggtatttgcgcaaccgccattcgctggatggcgggtgttggggcattggcgtgattccccntcttgtggatttgcgcttgtaaaatacgcgcaccacctgtgaatctctgtttttgttttcaaagactactaagtacttggcaaagataggcatttgtaaaataactgccaaacattttcttcattatttttaatataatgcgaaaaaacttctttactaagtacgaaataagtataaatatcgaataaatacgtcaaaatttcccataacgtgcttaaccaccagcaagtaggtgttactttaaagccnacttgtctccttaaaattcaagcggttcatcagaccgcccatcagatgttttaggnncnccnnttcgtttcgtgttcnttctnngcttgcttgttgggcctattgcccaccattcngctgaagtaacttgccgcaccttcaagaataagacggacnataggcccnacaatcaaacaaaatntgcacagacnctaatgaaccnattgnggtggaatgtttgcggcaagacctgctgttggcggacgaaagggnnnnnannannnntnaannnnnnntnnntnannnnnnnccnaannnttttnncnnnnannttnnnnnnnnannnntnnnnaanttnnnntnnntnannnnnnnancnnnnnnaantnntnngnnangaanttnannntnnnnnnnnnnntttttncnncnannnnncnncntnncnnnaaaaannnnntnnnnnnnangntnnntnnnnnnncnanaagggntnnnnnnnngannnngnnaaannnanttttnnttnaaaannncnncnnncnnnncnnntttngggnnnnttnntnnnnantnnngggnnaaanngnnnnaaannnnnnnnnntttngnnnnnaannnnnnnnnntttngnnnnaaannnnangnnaaanngnnnnaaannnnnnnnnanttnnnnnnnaannnnangnnaaannncnnnnnnnnnnannnnnnnannnnnaannnncnnnnnaanngnnnnaannnnancnttnnaanncnntnaaaannnngnccaaaanggnnaaannngnnntnaaaannngttttttnggggntnaaannnngnnaanngnnntnnnnaaannnnnnnnngnnancnaannnnnaangnnaaanngnnnnaaannnnngnttnangncc

SEQ ID NO: 970 - DNA, 4000 bp, Escherichia coli
  misc_feature (2415)..(2415): n is a, c, g, or t
  misc_feature (2634)..(2634): n is a, c, g, or t
  misc_feature (2640)..(2640): n is a, c, g, or t
  misc_feature (3082)..(3082): n is a, c, g, or t
ttcagggcagggaggtgctacaagaaagcatccccatgaagaccctccgtctcctcgccgcctgcctcggtgtcgtctcgttcgtcgcagcggccactccgccagtccgtccgaacgtgttgctcatcgtcgcagatgacatgggctgggccgacgtcagttggcatggcgggaagtttgccacgccgcggatggcagagattcttaagacttcggtggagctggatcgtcattatgtgcaacccgtgtgcaccccgacccgcacggctttgctctcaggtcgctggacgagccgcttcggtccccatgtgctcggtccgacgaacatgcgcgctttccccgaggggacctacacgctggcctcggcgttaaagtccgtaggctatcgcacatccatctcgggcaagtggcatctgggtggcaagtttgcttggggaccccgccagtatgggttcgaccagtcgtatggcttcctctcgggcgccgtcgacccgtggacacacaagtatcggtcgggtatcttggaggatacgtggaatcgtaacgacgtgctgctgaaggaggaaggcaacgccacggaactgatcgctgccgacgccaagcgcgtcatccttgagaagaaagggccgtggtttgcttacgtcccgttcggcgcggtgcataccccgatcgacgccccgaaagagtatttcaaggcctacgaaggcgtgcagttccatgccgaccccgccaaggatgactccattcgtcgctacgccgcctttgtgacgcaactggatgctaaggtgggcgagttctacgacgccctcaaggcctcggggcagctcgagaacacggtgatcatcttcacctcggacaacggtggaatcgaaagcagcggcaatccctatgtcggcaagaccaaggggagtccggccgtgaccacgaatgcccccctccgcggctggaagaatacgccgtatgagggagggatgcgcgtcaacgcgtttgtcagctggccgggtcacctgcccgccggcaagaatagccacccgatgcatgtggcggactggctgccgacgttggctcgcctgacgggagcttccgtccctgcggatgcaaagttagatggcctcgaccgttgggccgtcttgaccggtgccgatgcgacgcccgcgccgcggaccatctatattccccactaccagcgttcggctgtcttttatggcgactggaaactcatcgccccgcataccaacccccaagggaaggcagaactcttcaaccttaccaaagaccccttcgagcaggacgagtgttccgcccgcttccctgaaaagcttaaggagatgcgcgagcgcttcctcgaactccggaagggcgacttactcgaagccccggccgacgccaagtttagcgaaaaatccgcaaaatgaaactacgcctattcctctgcctgctggcgattaccagccaagccgccgaccccatcggcgacgtcacggccccgcccgctgaactaaagctgccgccgttttacaaaaaatacatcagtgcccaaggtttgccgattgtggcctccggtgccgtcaacgactacgccctcaaggagaccgcttacctagctaacctcatgttggccaagcgcccagatgtccgcacagcgatgatcgcgaacggctcgcgggtcatcatcatggggcgggcggagtttaccaccgatgttcctgaatacgctggcttcaagccgaaggattactgggacgcccgcgcccgtggactcggcggctcgcagactgaccccgtctgttcttgtgcggaagagaatatgttggcgttccctggcgacccttacgcttccgagaacatcttcatccatgagttcgcgcacaatatccacctgcgcggcatgctgaaggttgacccgacctttgaccgtcgcctcaaggcaacttaccaagccgccatggccaagggcctgtggaaggggaagtatgctgcgaccaatcacagtgaatactttgccgaaggcgtccagtcgtggttcgataacaaccgcgtcaacgaccacgaccacaaccacgtgcacctgcgcacacagttgctggaatacgaccccggcttggccgcgatgtgccgcgaggtctttggtgacaccgaactaaagtataccaagccgaccacccggctgacgggccacatggcgggctacgacccgtcgacggccccgaaatttgtctggccggaacgcctgacgacggcgaaggccgacatccgcaagaaggtcgacgaacgcgtgcaggcggcagagaagggcccgatcacacagccctatacgaagtaagccagatggaccgccgacatttctttggggcttctgccacgctggctctcgcggtagccctgcgcgccgccgcccccggccgcgccccgcgnatcctgctgcgctcctcctggcagactgtgaatatcggtgatatcgcgcatacgccgggtatgttggccttgctggagaagcacctacccgaagcggaaattaccttatggcctgggagtgtggataatggggtgggggagatgctgcagcgccgcttcccaaaactccgtatcctcgtccctggaaagatcgacgtcgcccaggcctatgcggatcangatttnctcctgcatggttcagggccttccctcgtcgccgaaaaagacgttgtccgctggcgtcagctcgggtccaagccctatggcgtgctcggtattacccaaggtaaaccgacccctgcgaccatcgaagtcctgaatggtgctcagttcgtcttcttccgcgatggcgtctcgcacgccgtcgccatctcctctggcgtgaagtgtcccttgatgggcttagcgcccgatggcgctttcgccacggaccttcgcgatgacgccaaggcaacggctttcctgcaggctaaccagttagaggtcggcggttttctttgctgtatccctcggtaccgctccacgccctattggttgattaagacgggtatacccttcgacccggtgaagcagaagcgtaacgatgagctcaaggaacatgaccacgcccaactgcgtgctgccatcntcgaggtcgttcgccagacgaagctcaaggtgctcatctgccccgaagaccgcacgcagatgaccttagggaaggaagtgctgttcgatcgcttgcccgacgacgtgaagccgcgcgtggtttggcgccccgactattggctcaccgacgaagcgctctcggtctacgtccgcagcgccgggctctttggtaacgagatgcattcgccgatcatgtgcatcggtaatggcgtccccgccatcgtctgccgctgggccgaacagacgtctaaaggcacgatgtggaaagacatcggccttggggagtggctctttgacctcgacgatgagacgcagctgccaggcatcgttcccgccgtcttaacgatggccaaagaccgcgcggcgtccctcgccaaagtgggcaaagctcaagccatcgtccaggcccgtcaggctgcggccatcgccgccctgcggaaggcgctctgagttcccttaggacgccttcgtgaagggattggcctccgtcgtcgctggtgccgctggacgggccatgcggacaatcacgaccataaagacaatggtcgcgaggcccgagagcagcagcagggccagtccgtagccttcggggttcgggctgaggtcaaaggtcagcggaccgtagagcttattccagagtgacacccgctgaggttggccgctcgccatccagcctaacaccaggtagaggtccgtgatcccgtaggccacgcagagcgcggcaatcttcaactgcttcatggcttacttcgcagctttcttaaagacgggcttttctttgtcgccaccgctcaggacgtaggccacgaggtcaaggatttcgtcctgcgtgagcatgctgaggagcatcggcggcatcggggagattgcgctgcgctcgatgctcttcacttccttg

SEQ ID NO: 971 - DNA, 4000 bp, Escherichia coli
  misc_feature (1)..(4): n is a, c, g, or t
  misc_feature (6)..(11): n is a, c, g, or t
  misc_feature (13)..(16): n is a, c, g, or t
  misc_feature (18)..(20): n is a, c, g, or t
  misc_feature (23)..(42): n is a, c, g, or t
  misc_feature (47)..(48): n is a, c, g, or t
  misc_feature (50)..(51): n is a, c, g, or t
  misc_feature (55)..(56): n is a, c, g, or t
  misc_feature (59)..(60): n is a, c, g, or t
  misc_feature (62)..(65): n is a, c, g, or t
  misc_feature (67)..(67): n is a, c, g, or t
  misc_feature (70)..(75): n is a, c, g, or t
  misc_feature (77)..(78): n is a, c, g, or t
  misc_feature (80)..(80): n is a, c, g, or t
  misc_feature (82)..(84): n is a, c, g, or t
  misc_feature (86)..(87): n is a, c, g, or t
  misc_feature (89)..(89): n is a, c, g, or t
  misc_feature (91)..(98): n is a, c, g, or t
  misc_feature (100)..(101): n is a, c, g, or t
  misc_feature (103)..(103): n is a, c, g, or t
  misc_feature (106)..(107): n is a, c, g, or t
  misc_feature (110)..(111): n is a, c, g, or t
  misc_feature (115)..(116): n is a, c, g, or t
  misc_feature (118)..(118): n is a, c, g, or t
  misc_feature (120)..(123): n is a, c, g, or t
  misc_feature (125)..(127): n is a, c, g, or t
  misc_feature (129)..(129): n is a, c, g, or t
  misc_feature (132)..(132): n is a, c, g, or t
  misc_feature (134)..(137): n is a, c, g, or t
  misc_feature (139)..(140): n is a, c, g, or t
  misc_feature (142)..(148): n is a, c, g, or t
  misc_feature (150)..(150): n is a, c, g, or t
  misc_feature (155)..(157): n is a, c, g, or t
  misc_feature (159)..(161): n is a, c, g, or t
  misc_feature (163)..(163): n is a, c, g, or t
  misc_feature (169)..(175): n is a, c, g, or t
  misc_feature (180)..(184): n is a, c, g, or t
  misc_feature (187)..(188): n is a, c, g, or t
  misc_feature (190)..(194): n is a, c, g, or t
  misc_feature (198)..(198): n is a, c, g, or t
  misc_feature (200)..(204): n is a, c, g, or t
  misc_feature (206)..(206): n is a, c, g, or t
  misc_feature (208)..(210): n is a, c, g, or t
  misc_feature (214)..(214): n is a, c, g, or t
  misc_feature (216)..(222): n is a, c, g, or t
  misc_feature (224)..(225): n is a, c, g, or t
  misc_feature (227)..(228): n is a, c, g, or t
  misc_feature (230)..(230): n is a, c, g, or t
  misc_feature (233)..(239): n is a, c, g, or t
  misc_feature (244)..(248): n is a, c, g, or t
  misc_feature (250)..(251): n is a, c, g, or t
  misc_feature (253)..(258): n is a, c, g, or t
  misc_feature (260)..(260): n is a, c, g, or t
  misc_feature (263)..(266): n is a, c, g, or t
  misc_feature (268)..(272): n is a, c, g, or t
  misc_feature (275)..(277): n is a, c, g, or t
  misc_feature (279)..(279): n is a, c, g, or t
  misc_feature (282)..(282): n is a, c, g, or t
  misc_feature (284)..(284): n is a, c, g, or t
  misc_feature (287)..(287): n is a, c, g, or t
  misc_feature (289)..(289): n is a, c, g, or t
  misc_feature (292)..(304): n is a, c, g, or t
  misc_feature (306)..(309): n is a, c, g, or t
  misc_feature (311)..(311): n is a, c, g, or t
  misc_feature (314)..(316): n is a, c, g, or t
  misc_feature (320)..(320): n is a, c, g, or t
  misc_feature (322)..(324): n is a, c, g, or t
  misc_feature (326)..(327): n is a, c, g, or t
  misc_feature (332)..(332): n is a, c, g, or t
  misc_feature (334)..(335): n is a, c, g, or t
  misc_feature (337)..(337): n is a, c, g, or t
  misc_feature (339)..(341): n is a, c, g, or t
  misc_feature (343)..(348): n is a, c, g, or t
  misc_feature (350)..(360): n is a, c, g, or t
  misc_feature (363)..(365): n is a, c, g, or t
  misc_feature (367)..(371): n is a, c, g, or t
  misc_feature (374)..(375): n is a, c, g, or t
  misc_feature (378)..(381): n is a, c, g, or t
  misc_feature (383)..(388): n is a, c, g, or t
  misc_feature (391)..(396): n is a, c, g, or t
  misc_feature (398)..(398): n is a, c, g, or t
  misc_feature (400)..(401): n is a, c, g, or t
  misc_feature (403)..(404): n is a, c, g, or t
  misc_feature (406)..(410): n is a, c, g, or t
  misc_feature (412)..(413): n is a, c, g, or t
  misc_feature (415)..(416): n is a, c, g, or t
  misc_feature (418)..(422): n is a, c, g, or t
  misc_feature (424)..(435): n is a, c, g, or t
  misc_feature (437)..(438): n is a, c, g, or t
  misc_feature (441)..(442): n is a, c, g, or t
  misc_feature (444)..(444): n is a, c, g, or t
  misc_feature (447)..(454): n is a, c, g, or t
  misc_feature (458)..(460): n is a, c, g, or t
  misc_feature (463)..(471): n is a, c, g, or t
  misc_feature (474)..(476): n is a, c, g, or t
  misc_feature (478)..(482): n is a, c, g, or t
  misc_feature (484)..(484): n is a, c, g, or t
  misc_feature (486)..(488): n is a, c, g, or t
  misc_feature (491)..(495): n is a, c, g, or t
  misc_feature (497)..(497): n is a, c, g, or t
  misc_feature (499)..(503): n is a, c, g, or t
  misc_feature (505)..(508): n is a, c, g, or t
  misc_feature (511)..(514): n is a, c, g, or t
  misc_feature (517)..(521): n is a, c, g, or t
  misc_feature (525)..(526): n is a, c, g, or t
  misc_feature (528)..(533): n is a, c, g, or t
  misc_feature (538)..(538): n is a, c, g, or t
  misc_feature (540)..(540): n is a, c, g, or t
  misc_feature (542)..(546): n is a, c, g, or t
  misc_feature (548)..(556): n is a, c, g, or t
  misc_feature (558)..(561): n is a, c, g, or t
  misc_feature (563)..(572): n is a, c, g, or t
  misc_feature (574)..(576): n is a, c, g, or t
  misc_feature (578)..(583): n is a, c, g, or t
  misc_feature (587)..(590): n is a, c, g, or t
  misc_feature (592)..(600): n is a, c, g, or t
  misc_feature (602)..(604): n is a, c, g, or t
  misc_feature (606)..(606): n is a, c, g, or t
  misc_feature (608)..(608): n is a, c, g, or t
  misc_feature (612)..(614): n is a, c, g, or t
  misc_feature (616)..(620): n is a, c, g, or t
  misc_feature (622)..(622): n is a, c, g, or t
  misc_feature (625)..(627): n is a, c, g, or t
  misc_feature (631)..(632): n is a, c, g, or t
  misc_feature (634)..(634): n is a, c, g, or t
  misc_feature (637)..(639): n is a, c, g, or t
  misc_feature (642)..(643): n is a, c, g, or t
  misc_feature (645)..(645): n is a, c, g, or t
  misc_feature (648)..(655): n is a, c, g, or t
  misc_feature (657)..(660): n is a, c, g, or t
  misc_feature (666)..(668): n is a, c, g, or t
  misc_feature (671)..(675): n is a, c, g, or t
  misc_feature (677)..(679): n is a, c, g, or t
  misc_feature (681)..(682): n is a, c, g, or t
  misc_feature (685)..(692): n is a, c, g, or t
  misc_feature (696)..(696): n is a, c, g, or t
  misc_feature (700)..(700): n is a, c, g, or t
  misc_feature (702)..(708): n is a, c, g, or t
  misc_feature (710)..(716): n is a, c, g, or t
  misc_feature (718)..(718): n is a, c, g, or t
  misc_feature (720)..(720): n is a, c, g, or t
  misc_feature (723)..(723): n is a, c, g, or t
  misc_feature (725)..(726): n is a, c, g, or t
  misc_feature (728)..(728): n is a, c, g, or t
  misc_feature (730)..(743): n is a, c, g, or t
  misc_feature (745)..(747): n is a, c, g, or t
  misc_feature (749)..(755): n is a, c, g, or t
  misc_feature (757)..(760): n is a, c, g, or t
  misc_feature (762)..(764): n is a, c, g, or t
  misc_feature (768)..(770): n is a, c, g, or t
  misc_feature (772)..(781): n is a, c, g, or t
  misc_feature (783)..(791): n is a, c, g, or t
  misc_feature (793)..(802): n is a, c, g, or t
  misc_feature (804)..(805): n is a, c, g, or t
  misc_feature (807)..(808): n is a, c, g, or t
  misc_feature (810)..(812): n is a, c, g, or t
  misc_feature (814)..(821): n is a, c, g, or t
  misc_feature (823)..(828): n is a, c, g, or t
  misc_feature (834)..(850): n is a, c, g, or t
  misc_feature (852)..(852): n is a, c, g, or t
  misc_feature (854)..(856): n is a, c, g, or t
  misc_feature (858)..(858): n is a, c, g, or t
  misc_feature (860)..(862): n is a, c, g, or t
  misc_feature (864)..(866): n is a, c, g, or t
  misc_feature (869)..(879): n is a, c, g, or t
  misc_feature (881)..(887): n is a, c, g, or t
  misc_feature (890)..(896): n is a, c, g, or t
  misc_feature (898)..(898): n is a, c, g, or t
  misc_feature (901)..(907): n is a, c, g, or t
  misc_feature (909)..(910): n is a, c, g, or t
  misc_feature (912)..(912): n is a, c, g, or t
  misc_feature (914)..(921): n is a, c, g, or t
  misc_feature (923)..(929): n is a, c, g, or t
  misc_feature (932)..(932): n is a, c, g, or t
  misc_feature (934)..(935): n is a, c, g, or t
  misc_feature (937)..(940): n is a, c, g, or t
  misc_feature (942)..(942): n is a, c, g, or t
  misc_feature (944)..(944): n is a, c, g, or t
  misc_feature (948)..(955): n is a, c, g, or t
  misc_feature (957)..(957): n is a, c, g, or t
  misc_feature (959)..(973): n is a, c, g, or t
  misc_feature (975)..(976): n is a, c, g, or t
  misc_feature (978)..(978): n is a, c, g, or t
  misc_feature (980)..(984): n is a, c, g, or t
  misc_feature (987)..(988): n is a, c, g, or t
  misc_feature (991)..(992): n is a, c, g, or t
  misc_feature (994)..(1003): n is a, c, g, or t
  misc_feature (1005)..(1010): n is a, c, g, or t
  misc_feature (1012)..(1013): n is a, c, g, or t
  misc_feature (1015)..(1015): n is a, c, g, or t
  misc_feature (1018)..(1020): n is a, c, g, or t
  misc_feature (1022)..(1024): n is a, c, g, or t
  misc_feature (1026)..(1028): n is a, c, g, or t
  misc_feature (1030)..(1030): n is a, c, g, or t
  misc_feature (1032)..(1033): n is a, c, g, or t
  misc_feature (1037)..(1041): n is a, c, g, or t
  misc_feature (1044)..(1045): n is a, c, g, or t
  misc_feature (1049)..(1053): n is a, c, g, or t
  misc_feature (1055)..(1055): n is a, c, g, or t
  misc_feature (1059)..(1062): n is a, c, g, or t
  misc_feature (1064)..(1069): n is a, c, g, or t
  misc_feature (1071)..(1073): n is a, c, g, or t
  misc_feature (1078)..(1081): n is a, c, g, or t
  misc_feature (1083)..(1083): n is a, c, g, or t
  misc_feature (1088)..(1094): n is a, c, g, or t
  misc_feature (1096)..(1099): n is a, c, g, or t
  misc_feature (1101)..(1101): n is a, c, g, or t
  misc_feature (1105)..(1105): n is a, c, g, or t
  misc_feature (1107)..(1107): n is a, c, g, or t
  misc_feature (1111)..(1112): n is a, c, g, or t
  misc_feature (1114)..(1116): n is a, c, g, or t
  misc_feature (1118)..(1118): n is a, c, g, or t
  misc_feature (1123)..(1123): n is a, c, g, or t
  misc_feature (1131)..(1131): n is a, c, g, or t
  misc_feature (1141)..(1144): n is a, c, g, or t
  misc_feature (1146)..(1149): n is a, c, g, or t
  misc_feature (1152)..(1152): n is a, c, g, or t
  misc_feature (1154)..(1154): n is a, c, g, or t
  misc_feature (1156)..(1159): n is a, c, g, or t
  misc_feature (1161)..(1165): n is a, c, g, or t
  misc_feature (1167)..(1167): n is a, c, g, or t
  misc_feature (1171)..(1174): n is a, c, g, or t
  misc_feature (1176)..(1181): n is a, c, g, or t
  misc_feature (1183)..(1194): n is a, c, g, or t
  misc_feature (1196)..(1199): n is a, c, g, or t
  misc_feature (1357)..(1357): n is a, c, g, or t
  misc_feature (1624)..(1624): n is a, c, g, or t
  misc_feature (1651)..(1651): n is a, c, g, or t
  misc_feature (1663)..(1663): n is a, c, g, or t
  misc_feature (1669)..(1669): n is a, c, g, or t
  misc_feature (1672)..(1674): n is a, c, g, or t
  misc_feature (1681)..(1681): n is a, c, g, or t
  misc_feature (1691)..(1691): n is a, c, g, or t
  misc_feature (1989)..(1990): n is a, c, g, or t
  misc_feature (2518)..(2518): n is a, c, g, or t
  misc_feature (3269)..(3269): n is a, c, g, or t
  misc_feature (3286)..(3286): n is a, c, g, or t
  misc_feature (3382)..(3382): n is a, c, g, or t
  misc_feature (3538)..(3538): n is a, c, g, or t
  misc_feature (3640)..(3640): n is a, c, g, or t
  misc_feature (3790)..(3790): n is a, c, g, or t
nnnntnnnnnnannnngnnnagnnnnnnnnnnnnnnnnnnnnttttnnannaaannaanntnnnnanggnnnnnntnnantnnnanntngnnnnnnnnanncngannaanntaanntntnnnntnnnanaanannnngnnannnnnnnancggannncnnnanaaaaannnnnnngaaannnnnaanngnnnnnaaangnnnnntntnnngaantnnnnnnncnntnngnaannnnnnnaaaannnnntnnannnnnnangannnnannnnnaannntnttnanttnanggnnnnnnnnnnnnngnnnnanaannntttnannntnnttttnannantnnnannnnnntnnnnnnnnnnngtnnntnnnnnaanngtnnnntnnnnnnaannnnnngnanngnnannnnnannannannnnnannnnnnnnnnnnannaanngnaannnnnnnnaaannnagnnnnnnnnnaannnannnnngntnnnttnnnnngntnnnnntnnnnaannnnggnnnnnaatnntnnnnnnaaaantnannnnntnnnnnnnnnannnntnnnnnnnnnngnnngnnnnnnaaannnngnnnnnnnnnannnananttannntnnnnngnttnnngaannanttnnngannanaannnnnnnnannnnaacaannntgnnnnngnnntnnatnnnnnnnntttnaaanannnnnnnannnnnnngnanttnanngntnnnnnnnnnnnnnnannngnnnnnnntnnnnannnaaannnannnnnnnnnntnnnnnnnnntnnnnnnnnnnannannannnannnnnnnntnnnnnnttaaannnnnnnnnnnnnnnnnangnnnantnnntnnnttnnnnnnnnnnncnnnnnnnaannnnnnnanccnnnnnnntnnantnnnnnnnngnnnnnnnttngnngnnnntngnaaannnnnnnnangnnnnnnnnnnnnnnngnntngnnnnnggnnttnnannnnnnnnnnannnnnnanngnttnnnannngnnnananntttnnnnnaannaaannnnntntgannnnannnnnntnnnaaaannnnanaaagnnnnnnngnnnngnaaantnaatnnannngnaaaanaaaaaatngaaacaccannnntnnnnaantncnnnnannnnntnaaannnnannnnnntnnnnnnnnnnnntnnnnttttgaaaagaagtttagaggatacgaaaagaatgtcgacgaaagcagaagatacacagaaaaacatattagatacagccagaaaacattttctgaaagatggtttgacaggagcatctttaagaaatattgtaaaagatgcagggcttactactggngcattttacaaatattatccgacgaaagaggcactttttgatgcactgacggatccttatatggaacatatttatcagatttatgaccagatcgttgaggagtttgaaaagctttctgccagtgatcagacaaggaatatgtcggatacatccagtgatgggatggagcagatggttgattatatctatgatcattatgataatttcagattattgttgaaatgcggagacagtggaaaatttgaattattcatacacaatatggtngagcgggaaatgaagtccagcctgaantatatggaaaanatgaangannncggtgtnaaaataccgnttgtagaggaaagccttatgcatatgatctatacgggatttttttcatcagtatttcagatcattgagcatgatatagacagggagactgcaaagaaaaatgtacatcaactgaaagaatttaatacaggtggctgggaacgattgtggaatattgaatttccagtataactgatgcaggaattctgaataggttatgtgtgttgcaggttctggatttctgaataaagttcagacaggataataatatcaggtggttgatgccagtaaaccacctattttattatatgttggttagnncgaactaacagaaggtaaaacaataaaacgaaacaataaaacgaacgtaaggagtgaacagatgtgaaagaaaaaaagaagtcggcagtcagctggatcctgacgtgggccggacaaaaaagaattgcctatgtgtggagtgtgttacttgcaataggaaatgtgatttttaagattttgccgtattttattattgcagatgtagtaaagctgtttttaaatggtgaaaaggagtttgaaatatatcttgcaaaagcggttctgattgcattatcgtttatcattgcagaactgcttcattcactttcgacagcattgtcacataaagcaacgtttgcagtacttgcaaatataagaaaatcctgctgtgacaagctggcgcgggtacctcttggctatgtgaaagacacaccttccggtacatttaaaaatattatggtggaaagaatcgacagtatcgagacaacactggcgcatattgtcccggaattcacgtccaatctgctggcaccgattgtgattttgatntatttcttcctgacagactggagactggcactctggtcattggtgccggttatagtgggatttctttcctattttggaatgatgctggattataaaccaagcttcgagagaacggttcagacaacaaaagatctgaatgatgcggcagtggaatatattgacggaatcgaagtgatcaaggcatttggaaagacagaaagttcttatgcaaaatttacaaaggcggctatggcttatgcagattcctttatttcctggatgaaacggtgctcgatctttcatggactgatgatggtggtcacaccttatacgcttcttacggtattgccgtttggggcacattatgtagccaatggaacacttgcgatttcagattttgtcatctgcattattttatcacttggaatcgttggaccgttgatcacagtgggttcctatacagatgatcttggcaagatcggagtgattgttggtgaagtggcaggaattctggaacagccggagcttgaacgtccagagaaaagtaaaagtgttccaaaagataactccgttactcttgaagatgtcagatttggttatcacgacaaagaaatcctgcacggagtaactatggagctgaaagcaggaacggtaaatgcaatcgtaggaccttccggaagcggcaagtcgaccatcgcaaagctgattgcgtccctgtgggatgtggattccggaagcatcaaaatcggtggagttgatgtcaaagaactgncatttgcagattttaancggaaaattgcatatgttgcacaggacaattatctgtttaatgaaacagtccgtgaaaatatcagacagggaaatccggatgctacagatgaacanatcatcgaggtgacaaagaaaagtggatgctatgaatttatcatgcagttggagaatggatttgatacggttgtaggaggtgcaggaggacatctgtcaggtggcgagaggcagcgtatctccattgcaagagcaatgttaaaggatgctccgatngtgatccttgatgaggcaactgcctacacagatccggaaaatgaggcaattctgcagaattctatcgcaaaactggtagcagggaagaccctgatcgtaatngcacacagactttctactgttaaggacagtgaccagatctttgttgtaaatgatggaaatgtaacagcacatggcacacatgaggaacttctggtgtcatgcccgctttataaggaaatgtggaatgcccatatttctgtaaaagatacngtgaaggagggagaatgatatgtttgggattctggcaaaattctttcgtttttcaggcagggaaaatggcaataaatttaaactgtcgatagtgatcggactcatagaggctcttgcctcagcaatgaagattccggctattatgtacatactgattggtctgctgagtgggaaaccgacaggaaaatatattggaggctccgttgcgat

SEQ ID NO: 972 - DNA, 4000 bp, Escherichia coli
  misc_feature (242)..(242): n is a, c, g, or t
  misc_feature (287)..(287): n is a, c, g, or t
  misc_feature (290)..(290): n is a, c, g, or t
  misc_feature (598)..(598): n is a, c, g, or t
  misc_feature (1300)..(1300): n is a, c, g, or t
  misc_feature (1321)..(1321): n is a, c, g, or t
  misc_feature (1330)..(1330): n is a, c, g, or t
  misc_feature (1762)..(1762): n is a, c, g, or t
  misc_feature (1768)..(1768): n is a, c, g, or t
  misc_feature (2191)..(2193): n is a, c, g, or t
  misc_feature (2197)..(2197): n is a, c, g, or t
  misc_feature (2199)..(2199): n is a, c, g, or t
  misc_feature (2205)..(2205): n is a, c, g, or t
  misc_feature (2217)..(2217): n is a, c, g, or t
  misc_feature (2220)..(2220): n is a, c, g, or t
  misc_feature (2224)..(2224): n is a, c, g, or t
  misc_feature (2228)..(2228): n is a, c, g, or t
  misc_feature (2232)..(2232): n is a, c, g, or t
  misc_feature (2240)..(2240): n is a, c, g, or t
  misc_feature (2249)..(2249): n is a, c, g, or t
  misc_feature (2251)..(2251): n is a, c, g, or t
  misc_feature (2255)..(2255): n is a, c, g, or t
  misc_feature (2262)..(2262): n is a, c, g, or t
  misc_feature (2272)..(2272): n is a, c, g, or t
  misc_feature (2274)..(2274): n is a, c, g, or t
  misc_feature (2279)..(2279): n is a, c, g, or t
  misc_feature (2281)..(2281): n is a, c, g, or t
  misc_feature (2288)..(2288): n is a, c, g, or t
  misc_feature (2298)..(2298): n is a, c, g, or t
  misc_feature (2301)..(2301): n is a, c, g, or t
  misc_feature (2311)..(2311): n is a, c, g, or t
  misc_feature (2319)..(2319): n is a, c, g, or t
  misc_feature (2323)..(2323): n is a, c, g, or t
  misc_feature (2325)..(2325): n is a, c, g, or t
  misc_feature (2328)..(2331): n is a, c, g, or t
  misc_feature (2338)..(2338): n is a, c, g, or t
  misc_feature (2341)..(2342): n is a, c, g, or t
  misc_feature (2345)..(2345): n is a, c, g, or t
  misc_feature (2350)..(2350): n is a, c, g, or t
  misc_feature (2352)..(2352): n is a, c, g, or t
  misc_feature (2363)..(2363): n is a, c, g, or t
  misc_feature (2365)..(2366): n is a, c, g, or t
  misc_feature (2370)..(2370): n is a, c, g, or t
  misc_feature (2374)..(2374): n is a, c, g, or t
  misc_feature (2376)..(2376): n is a, c, g, or t
  misc_feature (2383)..(2385): n is a, c, g, or t
  misc_feature (2388)..(2388): n is a, c, g, or t
  misc_feature (2390)..(2390): n is a, c, g, or t
  misc_feature (2407)..(2408): n is a, c, g, or t
  misc_feature (2423)..(2423): n is a, c, g, or t
  misc_feature (2432)..(2433): n is a, c, g, or t
  misc_feature (2438)..(2438): n is a, c, g, or t
  misc_feature (2440)..(2440): n is a, c, g, or t
  misc_feature (2443)..(2444): n is a, c, g, or t
  misc_feature (2448)..(2448): n is a, c, g, or t
  misc_feature (2450)..(2450): n is a, c, g, or t
  misc_feature (2458)..(2458): n is a, c, g, or t
  misc_feature (2460)..(2460): n is a, c, g, or t
  misc_feature (2464)..(2464): n is a, c, g, or t
  misc_feature (2467)..(2467): n is a, c, g, or t
  misc_feature (2477)..(2477): n is a, c, g, or t
  misc_feature (2479)..(2479): n is a, c, g, or t
  misc_feature (2490)..(2490): n is a, c, g, or t
  misc_feature (2492)..(2492): n is a, c, g, or t
  misc_feature (2496)..(2496): n is a, c, g, or t
  misc_feature (2501)..(2501): n is a, c, g, or t
  misc_feature (2505)..(2505): n is a, c, g, or t
  misc_feature (2509)..(2510): n is a, c, g, or t
  misc_feature (2512)..(2513): n is a, c, g, or t
  misc_feature (2517)..(2517): n is a, c, g, or t
  misc_feature (2521)..(2521): n is a, c, g, or t
  misc_feature (2532)..(2532): n is a, c, g, or t
  misc_feature (2534)..(2534): n is a, c, g, or t
  misc_feature (2539)..(2539): n is a, c, g, or t
  misc_feature (2541)..(2541): n is a, c, g, or t
  misc_feature (2543)..(2543): n is a, c, g, or t
  misc_feature (2552)..(2553): n is a, c, g, or t
  misc_feature (2556)..(2556): n is a, c, g, or t
  misc_feature (2560)..(2561): n is a, c, g, or t
  misc_feature (2565)..(2565): n is a, c, g, or t
  misc_feature (2568)..(2569): n is a, c, g, or t
  misc_feature (2578)..(2578): n is a, c, g, or t
  misc_feature (2581)..(2581): n is a, c, g, or t
  misc_feature (2585)..(2587): n is a, c, g, or t
  misc_feature (2591)..(2591): n is a, c, g, or t
  misc_feature (2595)..(2595): n is a, c, g, or t
  misc_feature (2597)..(2597): n is a, c, g, or t
  misc_feature (2599)..(2599): n is a, c, g, or t
  misc_feature (2610)..(2611): n is a, c, g, or t
  misc_feature (2615)..(2615): n is a, c, g, or t
  misc_feature (2620)..(2620): n is a, c, g, or t
  misc_feature (2623)..(2623): n is a, c, g, or t
  misc_feature (2627)..(2628): n is a, c, g, or t
  misc_feature (2631)..(2631): n is a, c, g, or t
  misc_feature (2634)..(2635): n is a, c, g, or t
  misc_feature (2645)..(2646): n is a, c, g, or t
  misc_feature (2648)..(2649): n is a, c, g, or t
  misc_feature (2652)..(2652): n is a, c, g, or t
  misc_feature (2656)..(2656): n is a, c, g, or t
  misc_feature (2658)..(2658): n is a, c, g, or t
  misc_feature (2662)..(2662): n is a, c, g, or t
  misc_feature (2664)..(2664): n is a, c, g, or t
  misc_feature (2669)..(2669): n is a, c, g, or t
  misc_feature (2671)..(2672): n is a, c, g, or t
  misc_feature (2679)..(2679): n is a, c, g, or t
  misc_feature (2683)..(2686): n is a, c, g, or t
  misc_feature (2693)..(2693): n is a, c, g, or t
  misc_feature (2699)..(2699): n is a, c, g, or t
  misc_feature (2704)..(2704): n is a, c, g, or t
  misc_feature (2712)..(2712): n is a, c, g, or t
  misc_feature (2714)..(2714): n is a, c, g, or t
  misc_feature (2719)..(2720): n is a, c, g, or t
  misc_feature (2723)..(2726): n is a, c, g, or t
  misc_feature (2728)..(2728): n is a, c, g, or t
  misc_feature (2731)..(2732): n is a, c, g, or t
  misc_feature (2734)..(2734): n is a, c, g, or t
  misc_feature (2736)..(2736): n is a, c, g, or t
  misc_feature (2740)..(2742): n is a, c, g, or t
  misc_feature (2744)..(2745): n is a, c, g, or t
  misc_feature (2747)..(2747): n is a, c, g, or t
  misc_feature (2753)..(2753): n is a, c, g, or t
  misc_feature (2761)..(2762): n is a, c, g, or t
  misc_feature (2767)..(2768): n is a, c, g, or t
  misc_feature (2773)..(2774): n is a, c, g, or t
  misc_feature (2777)..(2777): n is a, c, g, or t
  misc_feature (2781)..(2781): n is a, c, g, or t
  misc_feature (2783)..(2783): n is a, c, g, or t
  misc_feature (2785)..(2788): n is a, c, g, or t
  misc_feature (2800)..(2800): n is a, c, g, or t
  misc_feature (2812)..(2812): n is a, c, g, or t
  misc_feature (2815)..(2816): n is a, c, g, or t
  misc_feature (2818)..(2818): n is a, c, g, or t
  misc_feature (2821)..(2821): n is a, c, g, or t
  misc_feature (2824)..(2827): n is a, c, g, or t
  misc_feature (2829)..(2829): n is a, c, g, or t
  misc_feature (2839)..(2839): n is a, c, g, or t
  misc_feature (2844)..(2845): n is a, c, g, or t
  misc_feature (2849)..(2854): n is a, c, g, or t
  misc_feature (2856)..(2858): n is a, c, g, or t
  misc_feature (2862)..(2862): n is a, c, g, or t
  misc_feature (2867)..(2867): n is a, c, g, or t
  misc_feature (2870)..(2871): n is a, c, g, or t
  misc_feature (2873)..(2873): n is a, c, g, or t
  misc_feature (2875)..(2881): n is a, c, g, or t
  misc_feature (2885)..(2886): n is a, c, g, or t
  misc_feature (2894)..(2895): n is a, c, g, or t
  misc_feature (2897)..(2897): n is a, c, g, or t
  misc_feature (2902)..(2902): n is a, c, g, or t
  misc_feature (2909)..(2909): n is a, c, g, or t
  misc_feature (2916)..(2916): n is a, c, g, or t
  misc_feature (2918)..(2919): n is a, c, g, or t
  misc_feature (2923)..(2924): n is a, c, g, or t
  misc_feature (2927)..(2928): n is a, c, g, or t
  misc_feature (2940)..(2940): n is a, c, g, or t
  misc_feature (2945)..(2945): n is a, c, g, or t
  misc_feature (2949)..(2950): n is a, c, g, or t
  misc_feature (2955)..(2955): n is a, c, g, or t
  misc_feature (2959)..(2962): n is a, c, g, or t
  misc_feature (2966)..(2966): n is a, c, g, or t
  misc_feature (2968)..(2968): n is a, c, g, or t
  misc_feature (2971)..(2971): n is a, c, g, or t
  misc_feature (2974)..(2974): n is a, c, g, or t
  misc_feature (2984)..(2984): n is a, c, g, or t
  misc_feature (2987)..(2987): n is a, c, g, or t
  misc_feature (2990)..(2990): n is a, c, g, or t
  misc_feature (3000)..(3000): n is a, c, g, or t
  misc_feature (3005)..(3005): n is a, c, g, or t
  misc_feature (3011)..(3011): n is a, c, g, or t
  misc_feature (3015)..(3015): n is a, c, g, or t
  misc_feature (3017)..(3017): n is a, c, g, or t
  misc_feature (3024)..(3025): n is a, c, g, or t
  misc_feature (3028)..(3028): n is a, c, g, or t
  misc_feature (3033)..(3033): n is a, c, g, or t
  misc_feature (3038)..(3038): n is a, c, g, or t
  misc_feature (3040)..(3041): n is a, c, g, or t
  misc_feature (3052)..(3052): n is a, c, g, or t
  misc_feature (3057)..(3057): n is a, c, g, or t
  misc_feature (3060)..(3061): n is a, c, g, or t
  misc_feature (3071)..(3071): n is a, c, g, or t
  misc_feature (3077)..(3077): n is a, c, g, or t
  misc_feature (3082)..(3085): n is a, c, g, or t
  misc_feature (3089)..(3089): n is a, c, g, or t
  misc_feature (3096)..(3096): n is a, c, g, or t
  misc_feature (3101)..(3103): n is a, c, g, or t
  misc_feature (3105)..(3106): n is a, c, g, or t
  misc_feature (3109)..(3112): n is a, c, g, or t
  misc_feature (3119)..(3119): n is a, c, g, or t
  misc_feature (3125)..(3125): n is a, c, g, or t
  misc_feature (3131)..(3132): n is a, c, g, or t
  misc_feature (3136)..(3136): n is a, c, g, or t
  misc_feature (3140)..(3140): n is a, c, g, or t
  misc_feature (3149)..(3149): n is a, c, g, or t
  misc_feature (3152)..(3152): n is a, c, g, or t
  misc_feature (3154)..(3154): n is a, c, g, or t
  misc_feature (3157)..(3160): n is a, c, g, or t
  misc_feature (3162)..(3162): n is a, c, g, or t
  misc_feature (3183)..(3183): n is a, c, g, or t
  misc_feature (3194)..(3194): n is a, c, g, or t
  misc_feature (3203)..(3204): n is a, c, g, or t
  misc_feature (3214)..(3214): n is a, c, g, or t
  misc_feature (3216)..(3216): n is a, c, g, or t
  misc_feature (3218)..(3218): n is a, c, g, or t
  misc_feature (3221)..(3223): n is a, c, g, or t
  misc_feature (3227)..(3228): n is a, c, g, or t
  misc_feature (3233)..(3233): n is a, c, g, or t
  misc_feature (3240)..(3240): n is a, c, g, or t
  misc_feature (3242)..(3243): n is a, c, g, or t
  misc_feature (3254)..(3255): n is a, c, g, or t
  misc_feature (3258)..(3259): n is a, c, g, or t
  misc_feature (3262)..(3262): n is a, c, g, or t
  misc_feature (3265)..(3265): n is a, c, g, or t
  misc_feature (3267)..(3267): n is a, c, g, or t
  misc_feature (3270)..(3270): n is a, c, g, or t
  misc_feature (3272)..(3276): n is a, c, g, or t
  misc_feature (3282)..(3282): n is a, c, g, or t
  misc_feature (3285)..(3285): n is a, c, g, or t
  misc_feature (3290)..(3290): n is a, c, g, or t
  misc_feature (3295)..(3295): n is a, c, g, or t
  misc_feature (3297)..(3297): n is a, c, g, or t
  misc_feature (3299)..(3299): n is a, c, g, or t
  misc_feature (3302)..(3303): n is a, c, g, or t
  misc_feature (3306)..(3306): n is a, c, g, or t
  misc_feature (3311)..(3311): n is a, c, g, or t
  misc_feature (3314)..(3314): n is a, c, g, or t
  misc_feature (3324)..(3324): n is a, c, g, or t
  misc_feature (3326)..(3327): n is a, c, g, or t
  misc_feature (3332)..(3332): n is a, c, g, or t
  misc_feature (3335)..(3335): n is a, c, g, or t
  misc_feature (3337)..(3338): n is a, c, g, or t
  misc_feature (3351)..(3351): n is a, c, g, or t
  misc_feature (3356)..(3356): n is a, c, g, or t
  misc_feature (3361)..(3361): n is a, c, g, or t
  misc_feature (3368)..(3369): n is a, c, g, or t
  misc_feature (3377)..(3377): n is a, c, g, or t
  misc_feature (3381)..(3382): n is a, c, g, or t
  misc_feature (3388)..(3388): n is a, c, g, or t
  misc_feature (3393)..(3393): n is a, c, g, or t
  misc_feature (3395)..(3395): n is a, c, g, or t
  misc_feature (3397)..(3397): n is a, c, g, or t
  misc_feature (3402)..(3405): n is a, c, g, or t
  misc_feature (3409)..(3409): n is a, c, g, or t
  misc_feature (3413)..(3413): n is a, c, g, or t
  misc_feature (3415)..(3415): n is a, c, g, or t
  misc_feature (3417)..(3417): n is a, c, g, or t
  misc_feature (3422)..(3423): n is a, c, g, or t
  misc_feature (3426)..(3426): n is a, c, g, or t
  misc_feature (3438)..(3438): n is a, c, g, or t
  misc_feature (3440)..(3442): n is a, c, g, or t
  misc_feature (3444)..(3446): n is a, c, g, or t
  misc_feature (3449)..(3449): n is a, c, g, or t
  misc_feature (3451)..(3456): n is a, c, g, or t
  misc_feature (3464)..(3464): n is a, c, g, or t
  misc_feature (3466)..(3466): n is a, c, g, or t
  misc_feature (3474)..(3474): n is a, c, g, or t
  misc_feature (3481)..(3481): n is a, c, g, or t
  misc_feature (3487)..(3487): n is a, c, g, or t
  misc_feature (3490)..(3490): n is a, c, g, or t
  misc_feature (3493)..(3493): n is a, c, g, or t
  misc_feature (3495)..(3495): n is a, c, g, or t
  misc_feature (3502)..(3502): n is a, c, g, or t
  misc_feature (3505)..(3507): n is a, c, g, or t
  misc_feature (3510)..(3511): n is a, c, g, or t
  misc_feature (3516)..(3516): n is a, c, g, or t
  misc_feature (3519)..(3519): n is a, c, g, or t
  misc_feature (3528)..(3528): n is a, c, g, or t
  misc_feature (3534)..(3534): n is a, c, g, or t
  misc_feature (3538)..(3538): n is a, c, g, or t
  misc_feature (3540)..(3541): n is a, c, g, or t
  misc_feature (3544)..(3545): n is a, c, g, or t
  misc_feature (3549)..(3549): n is a, c, g, or t
  misc_feature (3551)..(3552): n is a, c, g, or t
  misc_feature (3557)..(3560): n is a, c, g, or t
  misc_feature (3563)..(3563): n is a, c, g, or t
  misc_feature (3567)..(3567): n is a, c, g, or t
  misc_feature (3570)..(3572): n is a, c, g, or t
  misc_feature (3580)..(3582): n is a, c, g, or t
  misc_feature (3586)..(3589): n is a, c, g, or t
  misc_feature (3596)..(3597): n is a, c, g, or t
  misc_feature (3601)..(3601): n is a, c, g, or t
  misc_feature (3606)..(3606): n is a, c, g, or t
  misc_feature (3608)..(3608): n is a, c, g, or t
  misc_feature (3610)..(3610): n is a, c, g, or t
  misc_feature (3613)..(3613): n is a, c, g, or t
  misc_feature (3616)..(3618): n is a, c, g, or t
  misc_feature (3620)..(3620): n is a, c, g, or t
  misc_feature (3623)..(3623): n is a, c, g, or t
  misc_feature (3629)..(3632): n is a, c, g, or t
  misc_feature (3634)..(3635): n is a, c, g, or t
  misc_feature (3640)..(3640): n is a, c, g, or t
  misc_feature (3643)..(3644): n is a, c, g, or t
  misc_feature (3672)..(3673): n is a, c, g, or t
  misc_feature (3685)..(3685): n is a, c, g, or t
  misc_feature (3689)..(3690): n is a, c, g, or t
  misc_feature (3692)..(3693): n is a, c, g, or t
  misc_feature (3699)..(3699): n is a, c, g, or t
  misc_feature (3701)..(3701): n is a, c, g, or t
  misc_feature (3706)..(3706): n is a, c, g, or t
  misc_feature (3718)..(3718): n is a, c, g, or t
  misc_feature (3721)..(3722): n is a, c, g, or t
  misc_feature (3725)..(3726): n is a, c, g, or t
  misc_feature (3732)..(3732): n is a, c, g, or t
  misc_feature (3734)..(3736): n is a, c, g, or t
  misc_feature (3739)..(3739): n is a, c, g, or t
  misc_feature (3742)..(3744): n is a, c, g, or t
  misc_feature (3747)..(3747): n is a, c, g, or t
  misc_feature (3753)..(3753): n is a, c, g, or t
  misc_feature (3757)..(3758): n is a, c, g, or t
  misc_feature (3761)..(3761): n is a, c, g, or t
  misc_feature (3763)..(3763): n is a, c, g, or t
  misc_feature (3767)..(3767): n is a, c, g, or t
  misc_feature (3769)..(3770): n is a, c, g, or t
  misc_feature (3773)..(3773): n is a, c, g, or t
  misc_feature (3775)..(3775): n is a, c, g, or t
  misc_feature (3777)..(3777): n is a, c, g, or t
  misc_feature (3783)..(3784): n is a, c, g, or t
  misc_feature (3787)..(3791): n is a, c, g, or t
  misc_feature (3796)..(3796): n is a, c, g, or t
  misc_feature (3808)..(3808): n is a, c, g, or t
  misc_feature (3811)..(3811): n is a, c, g, or t
  misc_feature (3814)..(3816): n is a, c, g, or t
  misc_feature (3818)..(3818): n is a, c, g, or t
  misc_feature (3820)..(3820): n is a, c, g, or t
  misc_feature (3827)..(3828): n is a, c, g, or t
  misc_feature (3850)..(3850): n is a, c, g, or t
  misc_feature (3853)..(3853): n is a, c, g, or t
  misc_feature (3857)..(3858): n is a, c, g, or t
  misc_feature (3861)..(3861): n is a, c, g, or t
  misc_feature (3864)..(3864): n is a, c, g, or t
  misc_feature (3868)..(3868): n is a, c, g, or t
  misc_feature (3870)..(3871): n is a, c, g, or t
  misc_feature (3875)..(3876): n is a, c, g, or t
  misc_feature (3880)..(3881): n is a, c, g, or t
  misc_feature (3884)..(3884): n is a, c, g, or t
  misc_feature (3886)..(3887): n is a, c, g, or t
  misc_feature (3889)..(3889): n is a, c, g, or t
  misc_feature (3891)..(3891): n is a, c, g, or t
  misc_feature (3893)..(3893): n is a, c, g, or t
  misc_feature (3898)..(3901): n is a, c, g, or t
  misc_feature (3903)..(3907): n is a, c, g, or t
  misc_feature (3911)..(3911): n is a, c, g, or t
  misc_feature (3920)..(3920): n is a, c, g, or t
  misc_feature (3923)..(3923): n is a, c, g, or t
  misc_feature (3925)..(3925): n is a, c, g, or t
  misc_feature (3927)..(3928): n is a, c, g, or t
  misc_feature (3930)..(3931): n is a, c, g, or t
  misc_feature (3936)..(3939): n is a, c, g, or t
  misc_feature (3942)..(3942): n is a, c, g, or t
  misc_feature (3945)..(3945): n is a, c, g, or t
  misc_feature (3950)..(3950): n is a, c, g, or t
  misc_feature (3954)..(3954): n is a, c, g, or t
  misc_feature (3957)..(3957): n is a, c, g, or t
  misc_feature (3960)..(3961): n is a, c, g, or t
  misc_feature (3963)..(3964): n is a, c, g, or t
  misc_feature (3970)..(3970): n is a, c, g, or t
  misc_feature (3973)..(3974): n is a, c, g, or t
  misc_feature (3976)..(3976): n is a, c, g, or t
  misc_feature (3982)..(3983): n is a, c, g, or t
  misc_feature (3989)..(3989): n is a, c, g, or t
  misc_feature (3995)..(3997): n is a, c, g, or t
  misc_feature (4000)..(4000): n is a, c, g, or t
ggatgttggagggcttaacgtcgcggtgtaccacgccagcctcgtgcaccacctgcagggcgcgggcggtttgggctagcaacggcaaaatcacgctggggggtagggtgcccttctcagcgatcagctctgacaggggcttaccctgcactagctccataatgatccagccagagccgtcagcctcaccatagtcaagcaccatggctaggttggggtggcgcaggccgcgagcatttttngcttcggtgcgtagacgctgcaaaaacagctcgtcaccggctaantcngggcgcattactttggcggctacaacacgtccagatcgtagatcttgagcacgccaaacttcacccatgccgcccatggcgatgcgttcgatcaggcggtagcggtcctgaagtactagtccagcttctggtttaatcattgctgcgttgccttaaagacagtggctgcgataggggcagcttcactaccgccagtacccgtgtcagcggtctgatcgccgccatcgagtacgacagcgatggcaatggtcggagcctgtccggaaggaccagcgtagccaataaaccaggtgacggggccgccgtcnctaccggtttcagccgtaccagtcttacccgctacatccatgccatcaacctgagccgaggtgccggttcccgaagcaaccacctggatcatcatggttttaagctgtcccgcaaccgtcgaagaaatgggggagcgtgccacctttgggctggtggtggaaatgaccgaaagcttgtcgtccaaagtacgcttaaccaggtagggctgcatctggttaccgtcgtttgccaccgtggcagcaacttgggccatttgcagaggagttacacgtacggactgctgcccgatacccgccattgccaactcagcttgtgacttgactggcgggaagctggagggggtaaccgtcaaggggatcgacgacgacgtgttgaagccccaggcttcagcctcgcgggtgagttcctgctcgcctacgttcatagctagctgagcgaaggtggtgttgcaggactcggcgaaggcgtaagtcagggtgactttaccgttaccgcaggactcacccgcatagttttgcaactggtgggtggtgcccggaagggtgacggtgtcaggggcgtcaacttgggaatcaggggtgaccttacccaggcgcagtgcggctgaggcggtaattaccttgaaggtagaaccgggtgggtacaggtcaccgccaatggcgcggttgatcagcggggtggcgctgtcagagttgagctgnttccaggcggtgtcggcagtngtgccgtcntggctggctagcaggttggggtcaaaagagggggtggagaccattgccaaaatggcgccggtcttagggttgagggccaccacagccccccgcttgttgcccagggcttggtaggcgaccttttgcaaagtggggttgatggttagctcaactgagccaccctggggctggtctccggtgaacaggttctggatgcggctgcgccacagcgacggcgaagagccgtttagcaccgtgttctcggcattctcaatgccggtcatgttggagaaaatagtggagtagtagccggtcactggcgcatatagcggaccgttagagtaaacgcgctggtagcccagggagtcggaggatttaactgaggcggccacagccgtgccgttaaccataatggctccgcgcgccttaccgtactcctggtagatagtgcgngcgttncgcgagtcctcagttagcgagccatactgcgagctagattcccacagggcgggacgcgcaaatccctgcagtgaagtcagggagatgagcagggccaaaaacatgcccgtgacaagtaaagaaacgtggcgaatctgagggttcattcaaaagctcctctgattacttccgtgttctggtggtcttgggccgacggcggcttgggcctgcctggctgtacgggctgcactggttgtacctgctgcaccggctgggcggcgcggcggccgtgagcgcggttaggggtgactgctggggctggctgagcagctggggcgccttgggggccacccatcggtattccctgaggagcggtcccctgcgggccaccagtcggcccttgcgggccgtacgggccagggccgccctgcgggccagggccannnggcncngggccntgggggccgccntgngggncgcnaccnccctgggngccggcggngncgtngccagcngcggcggcgncnggagngnccgcgcnagcagcggcngcnttatcagccnccgcgttntccngngcnnnntggcgcngcnncgnctcangnagctcagtagnannaatnatcngnggggcgnnnacngnggggcgacgggcggcgnnggaaagacgcagcancaaagccannatcancnagnnagcnancaaagacnanccancanaagccaagancngcatagtcaancnggtnagcgnaatnaggnngnngacnccancaaccaccacnancaccngnanggccatggnnaangacnnggcngtnnccagcagcntgncaannncatnacgnancnccaccgcagtnngcangccgngcncaannaanacnnggtacatcannannatngcgntnagancngtcancnncagctcntcannnnaagaggnggtgangaagncagagttngngaaannaannnngntgnngnancccnnncnncngccggnaccaaacnngccgnnagaanncancccnancnnnnccataaccagcngccaggagccancanngnagntgnnnncnttgtcgtccntggcnnagcnnnnnncnnnaacncggcnggnnangnnnnnnnggtnngaggacannangggcncaaacancagccanannaacnncanncccacaatggcnagggnggcnncaatnatcnnnnaggnanganggntggtggccanatncancaccaccacnaacancccgangatnantactganntgnccagntcctncnncatcaccagcnccccnatnntggctgcccncaccancatcnnnngcancaggtgncgccnnngnnggnnnngcacacncaggangcgccnnccanacancgccaggtngtngnggnnnncnaccaggtaggaggcgaagaanatcgacagcancaccttggnnagctctgccngntngannntcanncccangccgggnannacaatccaaanntgnnaancgntnatntnnnnncccaanccngggangaaangnanaannagncaganaanacccagccananncaccnggngnnccagcggcgcagntggcngtagncgcggannaagaacancgcnncgcagnacaanancncgccnnnngaantccnancnacctnnttnaaacccacaatntnnncnnnctncnnnnnnttgcggtngncaatgtcnaggcggntgatcntgnccngncccaggncgnnnagnnccacngcngtgggcagnagcacngggncnncgnngggngnncgccnnnncanccanagnnncacggcannngaannnnccagcanngagncggcnancngcnagnnngnggngggggnnnngnnggtgnggnngaggatggtcagcaagaagccgcccagnncaatgaccaggncgannannagcagnanaaccncagaccagcgtncannacnnggtttnannnaantcnnngtnttgacnccgnngtngncgtngnntcngngntggtgnnggnnnnnggggnggccggggaggnggncgnnncngnaggcggnngggtggacgacgacgtcggcgnggngtcnntcnggngggnanngacnntctnngananntngntncgcgnnnnannnnngganggcagcagnacntntnngnncaggnnnnccngcntctgntggnccnacnngnngggttnggnngnggcaannttttcnacgggnnnggn

SEQ ID NO: 973 - DNA, 4000 bp, Escherichia coli
  misc_feature (1992)..(1992): n is a, c, g, or t
  misc_feature (1995)..(1995): n is a, c, g, or t
  misc_feature (3265)..(3266): n is a, c, g, or t
  misc_feature (3268)..(3272): n is a, c, g, or t
  misc_feature (3274)..(3274): n is a, c, g, or t
  misc_feature (3277)..(3277): n is a, c, g, or t
  misc_feature (3281)..(3283): n is a, c, g, or t
  misc_feature (3285)..(3285): n is a, c, g, or t
  misc_feature (3288)..(3288): n is a, c, g, or t
  misc_feature (3290)..(3290): n is a, c, g, or t
  misc_feature (3292)..(3294): n is a, c, g, or t
  misc_feature (3296)..(3296): n is a, c, g, or t
  misc_feature (3298)..(3298): n is a, c, g, or t
  misc_feature (3300)..(3302): n is a, c, g, or t
  misc_feature (3304)..(3311): n is a, c, g, or t
  misc_feature (3313)..(3317): n is a, c, g, or t
  misc_feature (3319)..(3326): n is a, c, g, or t
  misc_feature (3328)..(3328): n is a, c, g, or t
  misc_feature (3330)..(3331): n is a, c, g, or t
  misc_feature (3338)..(3340): n is a, c, g, or t
  misc_feature (3342)..(3342): n is a, c, g, or t
  misc_feature (3344)..(3347): n is a, c, g, or t
  misc_feature (3350)..(3350): n is a, c, g, or t
  misc_feature (3352)..(3352): n is a, c, g, or t
  misc_feature (3354)..(3355): n is a, c, g, or t
  misc_feature (3357)..(3359): n is a, c, g, or t
  misc_feature (3363)..(3368): n is a, c, g, or t
  misc_feature (3371)..(3371): n is a, c, g, or t
  misc_feature (3373)..(3374): n is a, c, g, or t
  misc_feature (3376)..(3380): n is a, c, g, or t
  misc_feature (3383)..(3384): n is a, c, g, or t
  misc_feature (3386)..(3387): n is a, c, g, or t
  misc_feature (3389)..(3391): n is a, c, g, or t
  misc_feature (3393)..(3394): n is a, c, g, or t
  misc_feature (3397)..(3397): n is a, c, g, or t
  misc_feature (3400)..(3403): n is a, c, g, or t
  misc_feature (3405)..(3406): n is a, c, g, or t
  misc_feature (3408)..(3420): n is a, c, g, or t
  misc_feature (3422)..(3424): n is a, c, g, or t
  misc_feature (3427)..(3438): n is a, c, g, or t
  misc_feature (3440)..(3444): n is a, c, g, or t
  misc_feature (3446)..(3446): n is a, c, g, or t
  misc_feature (3449)..(3449): n is a, c, g, or t
  misc_feature (3454)..(3456): n is a, c, g, or t
  misc_feature (3458)..(3471): n is a, c, g, or t
  misc_feature (3473)..(3473): n is a, c, g, or t
  misc_feature (3475)..(3478): n is a, c, g, or t
  misc_feature (3480)..(3484): n is a, c, g, or t
  misc_feature (3486)..(3486): n is a, c, g, or t
  misc_feature (3488)..(3491): n is a, c, g, or t
  misc_feature (3494)..(3494): n is a, c, g, or t
  misc_feature (3496)..(3498): n is a, c, g, or t
  misc_feature (3500)..(3504): n is a, c, g, or t
  misc_feature (3507)..(3509): n is a, c, g, or t
  misc_feature (3511)..(3511): n is a, c, g, or t
  misc_feature (3513)..(3514): n is a, c, g, or t
  misc_feature (3516)..(3517): n is a, c, g, or t
  misc_feature (3519)..(3525): n is a, c, g, or t
  misc_feature (3527)..(3532): n is a, c, g, or t
  misc_feature (3535)..(3537): n is a, c, g, or t
  misc_feature (3540)..(3541): n is a, c, g, or t
  misc_feature (3543)..(3544): n is a, c, g, or t
  misc_feature (3546)..(3547): n is a, c, g, or t
  misc_feature (3550)..(3555): n is a, c, g, or t
  misc_feature (3557)..(3558): n is a, c, g, or t
  misc_feature (3560)..(3560): n is a, c, g, or t
  misc_feature (3563)..(3564): n is a, c, g, or t
  misc_feature (3567)..(3567): n is a, c, g, or t
  misc_feature (3569)..(3569): n is a, c, g, or t
  misc_feature (3571)..(3575): n is a, c, g, or t
  misc_feature (3577)..(3579): n is a, c, g, or t
  misc_feature (3581)..(3589): n is a, c, g, or t
  misc_feature (3591)..(3591): n is a, c, g, or t
  misc_feature (3593)..(3594): n is a, c, g, or t
  misc_feature (3596)..(3601): n is a, c, g, or t
  misc_feature (3604)..(3607): n is a, c, g, or t
  misc_feature (3609)..(3615): n is a, c, g, or t
  misc_feature (3619)..(3621): n is a, c, g, or t
  misc_feature (3623)..(3624): n is a, c, g, or t
  misc_feature (3626)..(3627): n is a, c, g, or t
  misc_feature (3629)..(3633): n is a, c, g, or t
  misc_feature (3635)..(3636): n is a, c, g, or t
  misc_feature (3639)..(3640): n is a, c, g, or t
  misc_feature (3643)..(3645): n is a, c, g, or t
  misc_feature (3648)..(3651): n is a, c, g, or t
  misc_feature (3653)..(3653): n is a, c, g, or t
  misc_feature (3655)..(3657): n is a, c, g, or t
  misc_feature (3659)..(3665): n is a, c, g, or t
  misc_feature (3667)..(3668): n is a, c, g, or t
  misc_feature (3671)..(3679): n is a, c, g, or t
  misc_feature (3681)..(3682): n is a, c, g, or t
  misc_feature (3684)..(3685): n is a, c, g, or t
  misc_feature (3687)..(3687): n is a, c, g, or t
  misc_feature (3689)..(3692): n is a, c, g, or t
  misc_feature (3694)..(3698): n is a, c, g, or t
  misc_feature (3700)..(3703): n is a, c, g, or t
  misc_feature (3706)..(3711): n is a, c, g, or t
  misc_feature (3714)..(3714): n is a, c, g, or t
  misc_feature (3716)..(3716): n is a, c, g, or t
  misc_feature (3719)..(3720): n is a, c, g, or t
  misc_feature (3723)..(3726): n is a, c, g, or t
  misc_feature (3729)..(3734): n is a, c, g, or t
  misc_feature (3736)..(3746): n is a, c, g, or t
  misc_feature (3752)..(3755): n is a, c, g, or t
  misc_feature (3757)..(3758): n is a, c, g, or t
  misc_feature (3760)..(3762): n is a, c, g, or t
  misc_feature (3764)..(3770): n is a, c, g, or t
  misc_feature (3772)..(3773): n is a, c, g, or t
  misc_feature (3775)..(3777): n is a, c, g, or t
  misc_feature (3779)..(3781): n is a, c, g, or t
  misc_feature (3783)..(3785): n is a, c, g, or t
  misc_feature (3788)..(3789): n is a, c, g, or t
  misc_feature (3791)..(3792): n is a, c, g, or t
  misc_feature (3794)..(3794): n is a, c, g, or t
  misc_feature (3796)..(3814): n is a, c, g, or t
  misc_feature (3816)..(3816): n is a, c, g, or t
  misc_feature (3818)..(3819): n is a, c, g, or t
  misc_feature (3822)..(3822): n is a, c, g, or t
  misc_feature (3824)..(3825): n is a, c, g, or t
  misc_feature (3827)..(3829): n is a, c, g, or t
  misc_feature (3831)..(3831): n is a, c, g, or t
  misc_feature (3833)..(3838): n is a, c, g, or t
  misc_feature (3840)..(3855): n is a, c, g, or t
  misc_feature (3858)..(3863): n is a, c, g, or t
  misc_feature (3865)..(3881): n is a, c, g, or t
  misc_feature (3883)..(3885): n is a, c, g, or t
  misc_feature (3887)..(3888): n is a, c, g, or t
  misc_feature (3890)..(3890): n is a, c, g, or t
  misc_feature (3895)..(3895): n is a, c, g, or t
  misc_feature (3897)..(3907): n is a, c, g, or t
  misc_feature (3909)..(3909): n is a, c, g, or t
  misc_feature (3912)..(3912): n is a, c, g, or t
  misc_feature (3914)..(3917): n is a, c, g, or t
  misc_feature (3921)..(3925): n is a, c, g, or t
  misc_feature (3928)..(3928): n is a, c, g, or t
  misc_feature (3931)..(3932): n is a, c, g, or t
  misc_feature (3935)..(3935): n is a, c, g, or t
  misc_feature (3937)..(3939): n is a, c, g, or t
  misc_feature (3941)..(3942): n is a, c, g, or t
  misc_feature (3946)..(3946): n is a, c, g, or t
  misc_feature (3948)..(3952): n is a, c, g, or t
  misc_feature (3954)..(3956): n is a, c, g, or t
  misc_feature (3959)..(3961): n is a, c, g, or t
  misc_feature (3963)..(3970): n is a, c, g, or t
  misc_feature (3972)..(3978): n is a, c, g, or t
  misc_feature (3981)..(3982): n is a, c, g, or t
  misc_feature (3984)..(3988): n is a, c, g, or t
  misc_feature (3990)..(3990): n is a, c, g, or t
  misc_feature (3994)..(3995): n is a, c, g, or t
  misc_feature (3997)..(3997): n is a, c, g, or t
  misc_feature (3999)..(3999): n is a, c, g, or t
cagttgatatacttaagagcattttcaacatttggagcatccttcggtattgctaattggtcaaaccacattagcgcaccttcatcaggaatcgtatagacaatttcaacaccgttctctgcttcccatgctgcatattgagccataaatatatcacctgaccagccaacaactaaacagatatcaccatttgaaagggcatcgatgtattgagatgaatggaatttttggatataagggcgaacattagagatgacagcttccgctttagcaattacatcagtatcattagttctagggtcctctcctatataggctagagccgctgggattatttcttctggcgcatcaagaagatgaacgccgcaatcggcaaacttcgaaacaacgtcaggatcaaataccatagcaagagaagttgtaggtgcattctccattctttcattgatcatgtcttcgttataaccgatgcctgtcgttccccacatatagtttactgagtagtcatttagaggtccaaattgtgcaacttgatcctcaatatcactccacatatttccaatatttgataattttgatttatccaacttcatgaaaacgcctgcctgtatctggcgcgctaagaaactacttgaagggactacaacgtcatacccagagccaccagctaagagtttggactgaagaaattcatttgaatcgaatacgtcatagactacctttatgcctgtcgcagcagtaaagtcatcattgacttgctcatcaatatagtctgaccagttataaacatttactacttcttctgcaattgcagcttgagctgaaaaagttagagctccagcaatgagaagattatttaacttatttttcattattactctccttttatttttttactttattaattggattatattaagttttattccttaatagttaccatttttttgaaattacaattccagctcatattaaagatgtctcaaatatgagttgtattcaaaatctgtaattgtactctcaaatttttttatttccgactccttaacacattgatatgatttttgaaatcgttcaccaaaaaattcttttactattaatgactcacttgttttatgaacagcctctctccatgttatagctaatgcagcttcatgctgtgcatgagcatttccaagagtttctttatcaagggggtatttttctattattcccgataagacacttgaaagaattgaagcaaatactaagtaggggttcgagtctgcactgggaagtctaaattctagtcttgttgcttctgcagaggcttctggcaatctaattagagcggttctgttttcattgccccagcttaatgttgttggcgcgtggtcagcattgtggaccaagcgtcgatatgaatttgagtgagaggcatagaaagaaagaaaatcaggagtcgtttttaatagacctgaaatggcttcagcaaagattccttggggatgtttatctttgttgactttaaaaacatttttcccatctttgtcaacaatgctaagatgtgcgtgcataccattaccagcttcttcagaaaaaggtttagccataaaggtagcattcatattgaattttcgagcgcagtttttaattagtcgcttcattaagaaagtttgatcagccatcaagagtgcatcatcatgatgaagtaaattaatttcaaactgcccaggagcacactcctttattgcagtttcagaagggattcctagagaatgagcgcttttttctaccatatcaaagaaaccttcaaagtcatccatttcatttaagttaaggagttgaacgtcttcatatcgcctatgagtgccaggaattaatggcatttgagggtgtccatttttttgtagttgtttgtcgacaagataaaattccatttcaggtgcaataactggcttaagattaagtttattaaagcgatcaagaactgaagacaagatatgccttggntcngcatagataggttcaccatcgccactctccatactaacaaggcattgagcagtattacggctactccatggtgtaacagcaagagaacttgcaacgggcctacaaattgcatcaccatccccagacatcactaacccggttcctttagggttgtctccccagacatcaagaacgtaacttgagataggcattctaaggccaccatcaaatgccttaactagagtttttggtgaggcatttttccctctaggaatcccattaaagtcaacatagataaactcaactttttcaaggtcagggtgaagctctaaaaatttttttgcaatattttccataactttaatgttcaatgaattgggtaaatattatcttaaaaaagatttggaaaataatctttgccaacatatttaatattaattgtgagataattgtaacatatttgtgatcacaaattataaatataaatataaatacgaataattaataaaatatgagtaaggatatattatcaaaagttgaaccaagggattcagagcttaatgctaatgaatgggtttataactctctatgccagttaattctttcaggagaatttactcctggtatttcgtttacttttagagggattgctaattcattcggagttagcacaatgcctgtgcgtgaggctgcaaagagacttatttctgagggcgcccttgatatgtctgaaaagcgaagaattactgtctcccagatgactcaatctaagtttgatgaattgaagattgctagattaaatttagagccacagctatctggacttgctttaaaacatattgattctaaaagacttaaactactgataaatatagataaaaatcttgattatgctatctcaactggaaacattgaagactacattaaatacaattatcagtttcattttggtatttatgaggctggatcatcaccagtacttcttcccctggtaaaaactttatggttacgtttttcacctttttatagaattgttgccggtagagcaggaactcaaactctgaaagattttcatcattcagcaattgatgcaattaaagctaaagattctgttgctttggtagaggctatccatagtgatatattagaaggaatggaaatgctcaatgaatctctcaatgagtaatcgtacttgatcttattgtttaattttatttgtatctaatgagtgaaattccttgcgtttactctcgtttatctatattataatctgtgatcacaatattttttnntnnnnnanttntttnnnanttnantnnngnantnnnannnnnnnnannnnntnnnnnnnncnannaaaaaannncnannnnttnantnnannntttnnnnnnttnanntnnnnnaannanncnnnannaanccnnnntnntnnnnnnnnnnnnngnnnttnnnnnnnnnnnnannnnngnaanaaaannntnnnnnnnnnnnnnngncnnnngnnnnntnannnnggntnnngnnnnnaannnantnntnnannnnnnnannnnnnaannnaannanntnnttnnnnnnannanttnnttngntnnnnncnnncnnnnnnnnntnanntnnnnnnaannnntnnnnnnnaaannncnncnngnnnnnannaannttnnnttnnnngntnnngnnnnnnngnnaannnnnnnnntnntnngntnnnnannnnntnnnnggnnnnnnaangnaannccnnnnaannnnnnannnnnnnnnnnaaaaannnntnncnnngnnnnnnnanngnnngnnncnnnttnngnngnannnnnnnnnnnnnnnnnnnangnnggntnncnnntncnnnnnntnnnnnnnnnnnnnnnnccnnnnnntnnnnnnnnnnnnnnnnngnnngnngnaaaantnnnnnnnnnnnanttngnnnnaaannnnnccnaannttngnnnannaaantnnnnnannnggnnnannnnnnnntnnnnnnnttnntnnnnnanccanncnang

SEQ ID NO: 974 - DNA, 4000 bp, Escherichia coli
  misc_feature (545)..(545): n is a, c, g, or t
  misc_feature (578)..(578): n is a, c, g, or t
  misc_feature (1985)..(1985): n is a, c, g, or t
  misc_feature (2210)..(2210): n is a, c, g, or t
  misc_feature (2258)..(2258): n is a, c, g, or t
  misc_feature (2263)..(2263): n is a, c, g, or t
  misc_feature (2272)..(2272): n is a, c, g, or t
  misc_feature (2276)..(2276): n is a, c, g, or t
  misc_feature (2294)..(2294): n is a, c, g, or t
  misc_feature (2297)..(2297): n is a, c, g, or t
  misc_feature (2303)..(2303): n is a, c, g, or t
  misc_feature (2305)..(2306): n is a, c, g, or t
  misc_feature (2309)..(2309): n is a, c, g, or t
  misc_feature (2312)..(2313): n is a, c, g, or t
  misc_feature (2315)..(2315): n is a, c, g, or t
  misc_feature (3671)..(3671): n is a, c, g, or t
  misc_feature (3681)..(3681): n is a, c, g, or t
  misc_feature (3686)..(3686): n is a, c, g, or t
  misc_feature (3689)..(3689): n is a, c, g, or t
  misc_feature (3698)..(3698): n is a, c, g, or t
  misc_feature (3701)..(3706): n is a, c, g, or t
  misc_feature (3708)..(3710): n is a, c, g, or t
  misc_feature (3712)..(3719): n is a, c, g, or t
  misc_feature (3723)..(3726): n is a, c, g, or t
  misc_feature (3728)..(3733): n is a, c, g, or t
  misc_feature (3735)..(3737): n is a, c, g, or t
  misc_feature (3739)..(3745): n is a, c, g, or t
  misc_feature (3747)..(3748): n is a, c, g, or t
  misc_feature (3750)..(3756): n is a, c, g, or t
  misc_feature (3758)..(3759): n is a, c, g, or t
  misc_feature (3761)..(3761): n is a, c, g, or t
  misc_feature (3765)..(3765): n is a, c, g, or t
  misc_feature (3767)..(3767): n is a, c, g, or t
  misc_feature (3769)..(3769): n is a, c, g, or t
  misc_feature (3772)..(3778): n is a, c, g, or t
  misc_feature (3780)..(3790): n is a, c, g, or t
  misc_feature (3792)..(3792): n is a, c, g, or t
  misc_feature (3795)..(3797): n is a, c, g, or t
  misc_feature (3802)..(3804): n is a, c, g, or t
  misc_feature (3807)..(3808): n is a, c, g, or t
  misc_feature (3812)..(3812): n is a, c, g, or t
  misc_feature (3817)..(3817): n is a, c, g, or t
  misc_feature (3823)..(3823): n is a, c, g, or t
  misc_feature (3825)..(3826): n is a, c, g, or t
  misc_feature (3830)..(3835): n is a, c, g, or t
  misc_feature (3838)..(3844): n is a, c, g, or t
  misc_feature (3846)..(3848): n is a, c, g, or t
  misc_feature (3850)..(3850): n is a, c, g, or t
  misc_feature (3852)..(3856): n is a, c, g, or t
  misc_feature (3858)..(3862): n is a, c, g, or t
  misc_feature (3865)..(3869): n is a, c, g, or t
  misc_feature (3871)..(3871): n is a, c, g, or t
  misc_feature (3873)..(3874): n is a, c, g, or t
  misc_feature (3877)..(3882): n is a, c, g, or t
  misc_feature (3884)..(3886): n is a, c, g, or t
  misc_feature (3888)..(3891): n is a, c, g, or t
  misc_feature (3893)..(3895): n is a, c, g, or t
  misc_feature (3897)..(3901): n is a, c, g, or t
  misc_feature (3903)..(3903): n is a, c, g, or t
  misc_feature (3905)..(3909): n is a, c, g, or t
  misc_feature (3911)..(3912): n is a, c, g, or t
  misc_feature (3915)..(3919): n is a, c, g, or t
  misc_feature (3922)..(3922): n is a, c, g, or t
  misc_feature (3924)..(3928): n is a, c, g, or t
  misc_feature (3930)..(3931): n is a, c, g, or t
  misc_feature (3933)..(3934): n is a, c, g, or t
  misc_feature (3936)..(3939): n is a, c, g, or t
  misc_feature (3942)..(3943): n is a, c, g, or t
  misc_feature (3945)..(3948): n is a, c, g, or t
  misc_feature (3952)..(3952): n is a, c, g, or t
  misc_feature (3954)..(3959): n is a, c, g, or t
  misc_feature (3962)..(3964): n is a, c, g, or t
  misc_feature (3966)..(3966): n is a, c, g, or t
  misc_feature (3969)..(3969): n is a, c, g, or t
  misc_feature (3971)..(3971): n is a, c, g, or t
  misc_feature (3974)..(3975): n is a, c, g, or t
  misc_feature (3979)..(3980): n is a, c, g, or t
  misc_feature (3982)..(3984): n is a, c, g, or t
  misc_feature (3986)..(3988): n is a, c, g, or t
  misc_feature (3990)..(3992): n is a, c, g, or t
  misc_feature (3994)..(4000): n is a, c, g, or t
gtgtgtctgaattgattgcaacatcacctgttccatgtggagtaagaatgatgttattattactggcagttgttgaaattgtttgaccattgatgtttatatcatcaatagttgctgttgtgataacagcattagaacctaatgtaactccgtcaatcgcacctgaatctatattaacattagtagttgcttgtgaattcatgtccacattaccagagaatgttgttgttcctgctactgttaatgcacctacgactgcagttgttgaactagcgactgttgcatgtggtgttaaaactaattgtgctactgatgtaccttttgatgctatatcattacctattgataatgttccacctgtggctgtaacaatatcccaagtatcacttgcatcatcaccatcatctgcttgtattgctactctacccgctgctgcttctccacctgttactactaagttagcttgttcacttgccgcagctgcgacttgtaaagtatctgtactcgtaataacattacctgtaccatttggtgcaattgtaatntcaccattagagtttgtagatgagaatgtattnccatctaatcttaaattgtcaacacttagaatagtagctactgcgttgctaccaatagtaactccgtcaacagtaccaccatcgatgcctactgagtctactactaatgtatcaatgtaagcagttccatctaagtataagtctttgaattcagctgaacctgttcctaaatctaaatcatcatctgatgaaggaacgattgcaccatcagtaaatgtaacttgattacctccacctactgaaactgtaatgacatctgaacctgagaatgtgattgctgtgttagtatctccatctcctgttattgaatctaattgaatatctccaacatttgtaatatcagcatcaccgaatgatgttgctgctaaagttgttgaaccactaactgttaatcctgttaatgttcctaaacttgttacatttccttgagctgctgtttgtaatgttcctgttagatcacctgttatgtttcctacaaatgcggtagatgtaattgaagttgctcctgtgactactcctgcgtctacactaatcgtaccatctagtaaaattactgaaccggctgctggctcaagattgattgctgctccagagtctaaagttaaggctcctgttgaatcaatatctactgtaccatctgctgtgatttgaatattggctgcagctgctgcagtatcagttgttacaatactaagtgtaccattagtgcctacagttaatactgcagtatcatcagtagaacctgtcattgtaacaactttaccgtctatagcaacattatcaactgttaatgctgttaaagtacctaaacttgtaacatttccttgtgctgctgtacttaatgttccaacaaatgctgttgatgtaattgaagttgcacctgttacttcacccgcatctacactaatcgttccatctaataagattgctgatcctgaggctggttcaagattaattgctccacctgaatctaatgttattgtagtaccgactgcttcaaaagttccgtctgctgtaagtgtcatgttcgctgcagcggctgcagtatcaacagttgttatatctaatgtaccatttgtgcctactgtcaatattgctgtatcaccactagatccagtcattgtaacaacttttccgtctattgctacatcatcaacagtcaaagctgttagagttcctaaacttgtaacatttccttgtgctgcagtatctaatgttcctacgaatgctgttgatgtaatacttgttgcacctgtaactacacctgcgtctacactaattgttccgtctaataagattgctgatccagctgctggctcaagattaattgctccacctgaatctaatgttactgtagtaccaattgcttcgaaagttccgtctgcagtaagtgtcatgtttgcagcngctgctgctgtatcaacagttgttatagctaatgtaccatttgcacctacagttaatgctgctgtatcaccactagatccagtcattgtaattactttaccattgatagctacatcatcaataaccgcgttagtaattggactgtttgttcctaatgtaactccatcaatagtaccagcattaatatctactgtatcggcaactaaggcatctgttgtgactgtnccatcaaagtaagcatctttaaattctaatgaacctgttcctaagtcnatatngttatctgntgtnggtttaagtactccatcngcnaatatnanntgnctnncngcactattacttacaccaatataaaatgttaatacatcttcgtcttgtcctgccgcactctcggctgtaatctttgtgtcttggtcaacatcaataactccacctaatgatccccaagcggaaccataaccttcaaaagtagaaagtgatgtgttgtatcttatttgtcctgctaccggtgaacctgctctttgtcctgtagttcctaccggtaatttaaatccgtcattcttgtttatgcttacaatacctgtaccgttaggtgtaagtgttaagtttccgtttgagtccgttgaagaaatgtcattaccattaatagttacattatcaatgttaataacatctagttttgaacttgaatcaactaacagagcacttgacgctgttgtagttccaagtgtatgatccattagatcagtaaaatatttaccacctattaaatgtatatctgctgcagaagcattgtttgttgcttctatgtataactttgctgatgctccatcgttagatgcatcgtaagcataagccatttctccgataactagatcactcgttgttggtgccgtagtaccggaatttcttttaatctgaattattgttgacatttattttttatccgtaatatccaccatctataccagatgaggcctcaaatttattagtagatgcatcaaacacaatacaatctccatcagatgctgtaacagtagttgtatctacatttcttaaatcatttaaatcaatattctctgcagcaacttggccaatagctatctgttttactttacctgtagttactgaatttacttttacattaatatttgccattattatctacttacgcttggtgttactgttgcatgtccttctaaaattcttgttttatctcctgaagaatctgttaataaaatatcataaacatatcttccacttgtcatagcagctgtagcaacatctgttaatgtcaatgttacttggccagttgtcggtgccaatgcagttgtgaaagtagccgctactgtacttgaactaaaggtttttcttacctgtcctgtagcactatagcctgtcaagttcaaaacatctccatttgagtcagttaaactcaaagttgtagagaaatctgctccctgatcaatatataaatttgatactgctgccatccctcttattactatttatgaattagaagattttaagtcatctaattctgtttttagctccttaattgattctactaataatggaataagtttcatgtaattaacagcttttattccagtttttcttaattcaacaatttctggtaatatttcttctatctcttgtgccaaaattcctgtgtcatgtccttcnccaagaacancttcnacnttatgatcnttnnnnnnannnannnnnnnnccannnntnnnnnntnnntnnnnnnnannannnnnnntnntnatantntnttnnnnnnntnnnnnnnnnnnantannnaatgnnntannatcncctgntgctantnntgtnnnnnntgnnnnnnntnnncnannnnnannnnntgnnnnntntnntannnnnntnnnannnncnnnannnnnancnnnnncnncannnnnagnannnnntnntnntnnnncannannnnctgnannnnnnaannntntancngcnncgtnngnnnannntnnntnnnnnnn

SEQ ID NO: 975 - DNA, 4000 bp, Escherichia coli
  misc_feature (499)..(499): n is a, c, g, or t
  misc_feature (553)..(553): n is a, c, g, or t
  misc_feature (619)..(619): n is a, c, g, or t
  misc_feature (736)..(736): n is a, c, g, or t
  misc_feature (784)..(784): n is a, c, g, or t
  misc_feature (859)..(859): n is a, c, g, or t
  misc_feature (1101)..(1101): n is a, c, g, or t
  misc_feature (1991)..(1992): n is a, c, g, or t
  misc_feature (1995)..(1995): n is a, c, g, or t
  misc_feature (2581)..(2581): n is a, c, g, or t
  misc_feature (2746)..(2746): n is a, c, g, or t
  misc_feature (2785)..(2785): n is a, c, g, or t
  misc_feature (2787)..(2787): n is a, c, g, or t
  misc_feature (3364)..(3364): n is a, c, g, or t
  misc_feature (3767)..(3772): n is a, c, g, or t
  misc_feature (3774)..(3774): n is a, c, g, or t
  misc_feature (3777)..(3779): n is a, c, g, or t
  misc_feature (3783)..(3785): n is a, c, g, or t
  misc_feature (3787)..(3787): n is a, c, g, or t
  misc_feature (3790)..(3790): n is a, c, g, or t
  misc_feature (3792)..(3793): n is a, c, g, or t
  misc_feature (3795)..(3800): n is a, c, g, or t
  misc_feature (3802)..(3803): n is a, c, g, or t
  misc_feature (3805)..(3808): n is a, c, g, or t
  misc_feature (3811)..(3813): n is a, c, g, or t
  misc_feature (3815)..(3818): n is a, c, g, or t
  misc_feature (3820)..(3820): n is a, c, g, or t
  misc_feature (3822)..(3822): n is a, c, g, or t
  misc_feature (3824)..(3824): n is a, c, g, or t
  misc_feature (3826)..(3830): n is a, c, g, or t
  misc_feature (3832)..(3834): n is a, c, g, or t
  misc_feature (3836)..(3840): n is a, c, g, or t
  misc_feature (3842)..(3843): n is a, c, g, or t
  misc_feature (3847)..(3851): n is a, c, g, or t
  misc_feature (3854)..(3858): n is a, c, g, or t
  misc_feature (3861)..(3863): n is a, c, g, or t
  misc_feature (3865)..(3874): n is a, c, g, or t
  misc_feature (3877)..(3878): n is a, c, g, or t
  misc_feature (3880)..(3885): n is a, c, g, or t
  misc_feature (3889)..(3889): n is a, c, g, or t
  misc_feature (3894)..(3895): n is a, c, g, or t
  misc_feature (3897)..(3900): n is a, c, g, or t
  misc_feature (3902)..(3902): n is a, c, g, or t
  misc_feature (3904)..(3905): n is a, c, g, or t
  misc_feature (3907)..(3907): n is a, c, g, or t
  misc_feature (3910)..(3926): n is a, c, g, or t
  misc_feature (3930)..(3932): n is a, c, g, or t
  misc_feature (3934)..(3934): n is a, c, g, or t
  misc_feature (3936)..(3936): n is a, c, g, or t
  misc_feature (3938)..(3944): n is a, c, g, or t
  misc_feature (3947)..(3967): n is a, c, g, or t
  misc_feature (3969)..(3972): n is a, c, g, or t
  misc_feature (3975)..(3982): n is a, c, g, or t
  misc_feature (3984)..(3985): n is a, c, g, or t
  misc_feature (3987)..(3987): n is a, c, g, or t
  misc_feature (3990)..(3995): n is a, c, g, or t
  misc_feature (4000)..(4000): n is a, c, g, or t
gctgattgtgttgccggatgttgggcattccacctttccactcctgctagccgccgtcgttttgtacttcgtggggcctaatattggcgcgccactctgggcagggctcatggggcagctggtcccagagtctagtcgaggtcgcttcttcgcgcgccgaacccggttatcaaccattgcctcatttagcggcttgatcatcgccgggggcctactgcagtggttcgatcagctcgatctggctcgatacggtttcacctgtattttcgccattggtttgaccgcccgattgatctcggcctattacctcagtcgagttcaggatccgcagaaacaactactgagcacagccgccgcttttccatcgattaagcaaatcgcagcagatccggcttacttaagatttacggctttctttgccatgatgcagttttcggtcgcaatctctggacctttcgtcgtggtatacctgctcacgacgttacattactcctacttngcgctcaccctgaataccgccgcatccgttttcgttcagttcgttgtgctgagncgatggggccggttatcagacctgttcggcaatcgcattattcttagagtcaccggattttcgatnccattcgtgccgctgctttggacgctcaatgaccacttcagctatctcatcggtctgcaaatgctgagcggactcatttggtccggttttaccctgagcgcaaataacgcgttattngacttaacgacaggcagcggtcgcacggggcgcgtcgccctgcataanttactgtcgagcttcgcggtcttttcgggtgctgcatttggcagcctcatcctgctcaactggtcctggattganccccatctaatgggccttatcaccctgccaaccctcacctttaccggcgtctttttagcctcggcgacgcttcgactcgcgacagccgccgcttttttacccaggattacagagccgcgtgcggttcgccggatgacctatcatggcctaatttttcgagtcactcggttttcgccgatctccggcgtcattttcgaaggcattacccgagtcagaaagcgagacgacccaacgaattaaangggctctaaaggcggacccgagccgagttgacccatgaaagggtgccatggttgactccgaagacccttcaaagactaggacgaatcatgaaccctttatctggcctcacggcactcgactttggccaagtctacaacggtccttattgcggctttttaatggcccaagccggcgcgactgtcataaaggttgaatcattgaagggcgaaacactgcgctcgagcaatcccaaagcgtccgcgacctatccctttgcattgctgaacggcaataaaaagagcctcgcaatcaacattaaatcagagcatggccaggcgctcatacaacaacttgctcaaaaggttgatgtgatctcagaaaattttgccccaggcacgatgagcaaatatgggatcggcgggccggcgctgaccgcgcttaacccccgattaatttatgcctccagcaccggctacggcaatgccgatggaccctatcgagactacttgggtatggacatcacgctccaggccatcagcggtgtcatgagcgtcactggtgaagaaggcggcccgcccctcaaaaccgccgccgcgtttgccgactttatcgcggggacccatctttatgcggcgattgtgaccgccctttttcggcgagaaacaaccggtcaaggcgcgatcgtcgatatctcaatgcaggattgcgtgttccccacgcttgccaccaccatcggtagtttctatgcccaaggcaagcaaatgcctcgagccggcaaccgtcatacgggcaatacccttgcgccttacaacacctacgtcgccagtgatggctatatcgccatcatttgcattcgggagggtcattttaagaagctttgccaagcgatggaccgacctgaactcgcagnnganccaaggttccataactttgcagcgcgatgtcagaatgtcacggagcttgatgctgaaattacgcgctggagtgcgcctaaatcccgtcaaaccttgctcgccttaacccaagcccacggcgtcatctgcgccccggtgaatcatttatccgaagttgtaaccgacccacacatgaccgctcgcggcagcttgcaccaaagaccccatgagacgctgggcatgattgcccaaatgcagaccccgttgcggctttcaggtgatacgccgcccgctctgaccagccctgcagcgctcggggccgactcaagcgaggtattgcacgaattgcttgggctctcccaggcggatatggcgaccctcgttgagcagggcgccatcgcactatgagtgccttggcgcccaattagcggtcattgagcgcgagtgggcaacgcgccttagaaattaatccggtaggcccaagacccgtttagcgataatgttcatctggacttcattggtgccaccgtagatcgtgaccgcgcgatcgcgcagccaaccccgggttgcctccagctcgtcttgattaaatccttcgccttcccanccgacacccgccaaaccccgtagctcagatttcaaagcggacgcttctttggcgatcgttgacccaaccagtttaaagattgaggttgtagcgcccggggcgcgacccgatttggcttccgccataacgcgctgcacggtcaactgcatggatttttccaacatnacctgcttggtgatcttttctcgcgcttctaggtcgctnangcggtccccagtttggcccaaatattcgacgccaatctgagcgtacgggttcagcgttttgacggtctttttccgtcttggcgcgggcgctgctgatcgttcgtactgcaacaaccgcttacccacggtccaacctttgttgagctcaccgatcaaatttgagcgcaatgcgatggcgttatcaaaaaatgtttcacaaaacggtgacgatccagagatcagcggaattggtttgaccgtgacaccggcttgatgcatatctaacaagacaaaactaatgccatcgtgcttcgaggcattggggtctgttcgcaccaaagcaaacatccaatcggcgtgatcggccccggatgtccaaatcttttggccattaatgacgaaatgatcaccctccatcaccgctttcgtttgcaaactggcaaggtctgaaccggacccgggttcactataaccctgacaccaacgcacttcgccagaggctattttcggtaggtgctgctgcttctgctcctcagtcccaaactccatcaaggttggaccaatcatggcaaggcccatccccgtttccggcggcaangctttaatcgcggccatttcctcttgaaaaacccggtactcctcgcccgtcatttcggcgccaccataaactttcggccacagcggcgccgtccaaccccgtgctgagcaggcatctcgccaggcccgtgcctcatcggtatcgtagatttcaaaggcatcctcaaagtgaaccggtcggtctcgcatgctcataggacagttggcgccaagccaggctctggtttcttctctaaacgcgtctatcgtcataactcttcctttcgttactcattcaaattctactttagtgccgctggtcttgcagatcgccgtggcggttatcagcgtctcattagcctcatgcgcccctgctgcttgtcctgccaaccaatgtccctttcctctcaggggaaaatcacccnnnnnncnaannntttnnnanccngnntnnnnnngnntnnnnccnnngnnnncnancnannnnnannncnnnnncnntttnnnnnggnnnnnccnnncnnnnnnnnnnaanncnnnnnncctnttttnncnnnncnanncnggnnnnnnnnnnnnnnnnncccnnncngncnnnnnnnaannnnnnnnnnnnnnnnnnnnnannnnttnnnnnnnnannanccnnnnnnacaan

SEQ ID NO: 976 - DNA, 4000 bp, Escherichia coli
  misc_feature (1989)..(1990): n is a, c, g, or t
  misc_feature (2022)..(2022): n is a, c, g, or t
  misc_feature (2474)..(2475): n is a, c, g, or t
  misc_feature (3324)..(3324): n is a, c, g, or t
  misc_feature (3385)..(3385): n is a, c, g, or t
  misc_feature (3667)..(3667): n is a, c, g, or t
atcgatacccccggtcacgtggactttaccgttgaggtagaacgttccatgcgtgttttggacggtttgattgctctcttttctgctgttgatggcgttgagcctcaatcggagacagtttggcgccaggcaaaccgttacggagtacctcgtattggatttgtgaataaaatggatcgtgcgggtgccgactttctgaatgtggtaaagcaggttcgcgaaatgctcggctccaaggctgttcctctacagcttcctattggcgctgaagataatttcaagggtgtggttgatttgatcaagatgaaaggaattatttggcatgctgaaacagagggaatgacttttgatgagattgatgtgcctgctgatatgatggaagaagcaatggagtggagagctaacttggttgaggctgttgccgaatatgatgatacacttatggaaaaattcttcgaagatcctaagagcatctccgaagctgaaattcatgaagcaatccgtaaggctacgatcgatctttctatcgttcctatgatgtgcggttcgtcatttaaaaacaaaggcgtacaaactgcattagatgctgtttgtcgttatttgccttcacctatagatattccagatacaaaaggaacgcatccagatactggtgaagagctgcttcgtaaagctgatccaaaagagccatttgcggcccttgctttcaagatcatgactgacccctttgtaggtcgtttggcgttcttccgtgcttattctggacgtttggatgcaggttcttatgtgcttaacgtacgcagtggtaaaaaagagcgtatcagccgtattatgaagatgtttgccaataagcaaaatccaattgattttattgaggcgggtgatatcggtgcagcagttggttttaaagagatcaaaacaggggatacgctttgtgatgaagatcatccaatcacactggagaacatgttcatccctgagccggtaattgccattgcagttgagcctaaaacacaggctgacgttgataaaatgggtatggctattgcaaagttggtggaagaagatccaacacttcgtgtgaatactgatgaagaaactggtcaaactattcttcgcggaatgggagagttgcacttggaaattatcattgaccgtatgcgtcgtgaattcaaggtggaagtaaaccaaggagcaccacaggtagcttacaaggaagcattcactgctactgttgaacatcgcgaaacgttgaagaagcaaacgggtggtcgtggtaagttcgctgatattattttcagcattggacctgttgatgcagaatggcaaactgagaatcctgacaaacattaccaatttgtaaatgatatttttggaggatctattccccgtgaatttgttccttctattcaaaaaggttttgagcagtccatgacaactggcgtactggcaagttatcctgtagcgaatatgaaaattcgtgtgtatgatggaagcttccacgcggtagactccgactctatgtcctttgaattgtgtgccaagcaaggtttccgtgaagcagctagaaaagctaagcctgtattgcttgagccaatcatgagagtggaagttgttactcctgatcaatacatgggagatgttaccggggacttgaatcgtcgtcgtggtatgatggaaggtatggacagtcgtgcgggtgcacaggtgattaaggcaaaagttccactgagtgaaatgttcggatatgtaacacagcttcgttcactttcttccggacgtgcttcttctaccatggaattctctcactactccccagcgcctaacaacattgctgaggaagtgattgccaaggtaaaagggaaggctactgcctaattttaattgtcttcaactagttgagaccgcttcgaaagaggcggtctttttttgtccaattcatccaaattctcatttgcctgcctgatttgcaatgacttttgtaaaatnntgtatatcaaatagttacattaataacccaanaaaagggaattattatcgaagcgtcctaaaaaatagcgtataactatttggttggtacggacttctcgcttacctttgcatcccctaaagaaaaaggggtacgtacacatgtcgcagcgcattcgaatcaaattgcaatcttacgatcataatctggtggacaagtctgcagataagatcgttaaaactgttcgcagtactggcgcagttgtaacagggcctattcccctgccaactcgcacgaaaattttcactgtattgcgttctcctcacgttaacaagaaaagtcgtgagcagtttcaattagcaacgcataagcgtctattggatatttacacctccactagccgtaccgttgatgcgcttagcaaattggatttgcctagcggtgtggaagtagaaattaaagcgtaatcgctttcaatatgcgtaagggaattcgcaactcccannagttcttattattgatttttgaaacaattgctatctctcaaccggaagtaaaactccgataaaagagcgctggcttttaaacataaaacaagccattcagggtttgtttactaccggtacttccccataaaggaaaaggtcggtggcaaacggggattgaagtccaaacgatcgtgtttggattgtcccaataaccttgcaggcacaaaacctaacgaacatgaaaggtattattgggaaaaaactgggaatgaccagtgtattcgatccctccggtaagcagaccccctgcacgatcatcgaggcgggtccctgtgtagttactcaggtaaagtccaaagagactgatgggtacagcgctctccaattatcttttggagagaaaaaagaaaagcgcgctactaaagccgctgttaatcacttttccaagtcacaaaccactcctaagcgtttctctatagagtttcgcaattattctattgaaaaaaatctgggtgaaaccgtaactgtagacattttctctgaaggagagactgttgaggttgtgggtactaccaagggtaaaggattccagggtgttgtaaagcgtcatggttttagtggtgtgggtcagcagtcgcatggtcagcatgatcgtcagcgtgctcccggatcacttggtaactcctctgatgcgagccgtgttatgaaaggaatgcgcatggctggacgtatgggtaatgatcgtgtgaaaatgaaaggtctgaaagtggtgaaagttttcactgagaaaaattacatccttgtgagcggatctgttccgggtcacaacggttccatcgttcttattcaaaaataatcgcgtacaanacaatcataaactgaacgcaacatgaaactcgacgtcttaaatacaaaaggtactgcaacnggtcgctccgtggaattacccgaggagatctttggtgctgaaccgaacaatcatgtgatttacttagctgtaaagcaatatttagctgcacagcgtcaaggtacacacaaggttaaaacacgtgctgaagtaaagggtgccagccgcaaattgcataagcaaaaaggaacaggcggaagccgtaaaggaaatatccgtaacccattgtacaagggtggtggtaccatttttggtcctaagcctcacagctatgacattaaggtaaaccgtaaggtgaaaganctcgcaaagatttccgcacttagttacaaagcaaaggataacgcaattctggttgttgaggatatcaacatggaaaagccaaagactaagcaactcttggagatcttgggtaacttaaaagtatctgataagaaaactctttttgttactccggactataatgataatgtagagttgtcaatccgtaacgtgccctctgtgatgggtgtattactgagtgatatcaatacctatgacatcatgaactctgaggtgttagtgatgacggagagtgccgcaaagattttcgccgacgatgaaaaaactgaagcttaattaacagcataaaacaag

SEQ ID NO: 977 - DNA, 4000 bp, Escherichia coli
  misc_feature (5)..(6): n is a, c, g, or t
  misc_feature (35)..(35): n is a, c, g, or t
  misc_feature (59)..(59): n is a, c, g, or t
  misc_feature (71)..(71): n is a, c, g, or t
  misc_feature (90)..(90): n is a, c, g, or t
  misc_feature (158)..(158): n is a, c, g, or t
  misc_feature (182)..(182): n is a, c, g, or t
  misc_feature (233)..(233): n is a, c, g, or t
  misc_feature (235)..(235): n is a, c, g, or t
  misc_feature (260)..(260): n is a, c, g, or t
  misc_feature (269)..(269): n is a, c, g, or t
  misc_feature (453)..(453): n is a, c, g, or t
  misc_feature (697)..(697): n is a, c, g, or t
  misc_feature (1324)..(1324): n is a, c, g, or t
  misc_feature (1707)..(1707): n is a, c, g, or t
  misc_feature (1962)..(1962): n is a, c, g, or t
  misc_feature (1986)..(1986): n is a, c, g, or t
  misc_feature (2154)..(2154): n is a, c, g, or t
  misc_feature (2157)..(2157): n is a, c, g, or t
  misc_feature (2162)..(2162): n is a, c, g, or t
  misc_feature (2177)..(2177): n is a, c, g, or t
  misc_feature (2199)..(2199): n is a, c, g, or t
  misc_feature (2225)..(2225): n is a, c, g, or t
  misc_feature (2295)..(2295): n is a, c, g, or t
  misc_feature (2436)..(2436): n is a, c, g, or t
  misc_feature (2520)..(2520): n is a, c, g, or t
  misc_feature (2685)..(2685): n is a, c, g, or t
  misc_feature (2709)..(2709): n is a, c, g, or t
  misc_feature (2943)..(2943): n is a, c, g, or t
  misc_feature (2955)..(2955): n is a, c, g, or t
  misc_feature (3018)..(3018): n is a, c, g, or t
  misc_feature (3448)..(3448): n is a, c, g, or t
  misc_feature (3496)..(3496): n is a, c, g, or t
  misc_feature (3538)..(3538): n is a, c, g, or t
  misc_feature (3595)..(3595): n is a, c, g, or t
  misc_feature (3679)..(3679): n is a, c, g, or t
  misc_feature (3898)..(3898): n is a, c, g, or t
  misc_feature (3997)..(3997): n is a, c, g, or t
tttgnnctgttgtaagaggattaacggttagggtnacacttgaagaagaggttttgccngcctctaccacnacttcattagcagaaaggntaaaacctgttgtaggaagtgctacgtattcggtttcgttgcgcttgttatattctgccaaagcaagngtatcgtaaaccaattcaaaggcnctattagctgtagcaggctctgaaagtgttacgttaatatcttgagttacntntgttgttccgatggttaactttgtngaactgttnccatctgtctttgtttgagcgatgtatgcttgattatctaaagtgggataatcggcgttgttacatgcaacaaacgccatagagccaaacaacactccaccaattacacttaatatattgtatttcatattataattcgttttgagagttgatgcttggtaggatcgaagtcctaccaaacaanattccattatttaaatgagggattcataatttgaatggcttggcgcaaccacttgtaagttccgtttgccgaagatttgccataatcgtattccatgtgataggttcccactccacctttggtgtaagtttgtccgttataggtaggaatccagtaggccatacctaacaacgaaggcacaacaacaccgttgcgagctgtgaagtttgatccacctgtgcttgaatgttgctcgaagtcttcncaaacgataatcttcttagctacctcttctgttgtaagcacgccttggaagtggtctacttgggttttgaaacgactatcaagttgagagtctaagcttgtgttataggcttgaagtaggaagtaatcgaagtgtgttcccaattcttttgggaaggcatcgggctctccatcgacaacaagcatacgaccagtgcctgatttaggaccaattcttttagacagagtttcaacgaacttctgaataaggtcatcgccattggtccacaactctttgtcggtagcaaatggttgagcgtagtttggctcagcatcgatatcgaatccatcgtaattatacttgtctatggtgtcgcaaatggcatttgcatatttttcaaccgcagcaagtttagatgctttatcgcttccccaaccccagaattcgtgtctccattgcttccaagttgtgcctgcagcagctttatcttcaggtatagaaggagtgatttggtcgccaatatcaaatacaaggaaacacattagcactttagtacctttcttttgttgaacaatcttaaggtcttctttttgtgcagtagttaggtttttccagttaccccatagcgaaacgaagtctacactgtcnggtaatccttgcaaagagttttctaagctaacaccagcaccagtccagttaccaaaccaaccgaatgccttttggtggtcagactttttatattcacgcaattttgcataataagcttccgacttattgctacgagttaggtcggcagggttcttcaactccatatcagtagcatcgctacatgcagccaaagtaaataaacctccgaataatgcaagtaatgctttatttagttttttcattttttcgaactttaaatattacacatttatttcttttgccaccacatctttgtagcgtagttgtctgctcctccaagcatttgaaccgcctcttcgtacgaagctcggttgttaatgagctcatcactgtcgaaaggtatncggttaggaacctttattgtgtatccagaagttgactgagcaacagggaatacctttggatatccagtgcgtctaatctcattccagccctcttgtccatcagggaaaagagcaatccacttttgagttataagtctttctaacttcacttcgtctgtagcagagtcgtcccaagcaatggttatgttgctcactgcagtttggttgctaccaaatccgtttgcagcatcttcgtagttagcttgtacagaggtnttgtctgcaagataagcgctcacntttgcggctccccattgttcgaaagaaagagtaattgcttgctcatatagactcttaactgtgcctcccatgttgctccaaccagccaaagcgccttctgctctacagaaagttacttccgaagcagttaaccaaacgcctcgagttgattgctcaacgttagccgcngantatanttttccagcaatagntttatttcctacagctgcaccngctaaacaaccgataaccgaacgagntccttttgtttctgtatctttaaagtatttagagatacgtgggtcgctataaccagtcatatagctttcnatatcagcacaagcacggctatctccccattcaatagaggttttatattgtccgtttggaacgtaagttatagcgcagttttcagagttttgtgttataacaccagcttgcacagcagcttcgcccacttgttttgcatangaagggtcggcaaaacgcattctgatagccatacgaagctttaacgaattggcaagtttaaaccagttagaaagctttccaccntacactttatcatactcttcgttggcctttgcatctgcagaagcaatgatgattggctgaataatatctgtagcagtatttaagttggcaatcaaagtcttataaactttctcttgagaagaatatgcattgacgttagactcttcgccaatgggaagtggtccntacatatctgtaagacgaagaagngcttgtgccttcaaaattaatgcctgagcataagtcactcccgatttatttgtaagacgttcgatatctttaaacgccgaagttaccttaggaagagcatctctaaatgggtaacgtacccagccattaggcgcattaaagcgagcaaagttcttgtcagagaaaccgttattggcataagtcatatagcgaccaaggtagtttccaatcaaatcttcgttcatttgataagcnttttcctgttcngggaaagcgttattctgcatttgaatgaagaaagaaccagttgaatagttgtctcttcccaantcatctgccgatgctctgttgccttgtctgttagcttcttcaaagccatctgtacacgaagccattgttcctacacccatagttacaattaaaccataggtaagagatttaaggattttattgtatttcatatctttttcttgcttttaaaagttcatttactccttagaatttcacctttacgttgaaaccaatagtgcgaagacttggttgcatgaagtaatcaaagccctgatagtaggttcctgttgatgcaactgcttcgggatcgaatggagctttgttataaataaagaacaagttgttcgctgttaagcctaaagaaagctcagctcctttcaagaatttcttagggaatgtgtagccaatgtgtgcttcttgcaaacgagcattggtagcactatagatgtattcgctccaaattgggttntcaccacctactactgaatagtagctttcagcgtttacacgacctccnttcactgcaattccaccattatcacgtgctacagcagatgcnttagacacgccataagagtctaatatcgcttgagtttgtgaaagcacaatacctccnaagcgtgcagtaattaagaaaccgaagttaaatcctttccatgcaaactcgttagagaaaccgatgttagccttaggaagtacngaaccacgatacaatggattgttaaggttggtttgaagaacgcccttcttgtcgtcaacagcaatgtttccttctgcatctcttgcgaaatcagtagtcatatacacgtctcccatggtgccacccttcttcaaaatgatctcagctccactcaaaccgccttgtttaagcacttcgttttcgtcgtcaagaagcttgataatcttgttacggttagcnctataagtgaatgaagtgttccaagataggtcgccaaagttgcggttatagccaatagctagctcgataccacggttacgaacgttacctgtttggatntat

SEQ ID NO: 978 - DNA, 4000 bp, Escherichia coli
  misc_feature (563)..(563): n is a, c, g, or t
  misc_feature (3815)..(3815): n is a, c, g, or t
ttaccaccttaaatccttccatagctgcttgtaatgcacatataggatcaatttctgtaatccaaacaatcgcgccagcatttctcaaggattgagcagagccttttccgacatctccaaaaccacataccaatgctgtttttccagaaatcattacatctgttgctcttttaatgccatcaactaatgattctctgcaaccataaagattatcaaattttgattttgttacggaatcatttacattaaatgctggtacttttaattcatttttttcaaccatttcatataatctatgaacaccggtagtagtctcctcggataaaccactaatatgactaagcatttcaggatatttcttgtgtattattgatgttaaatcaccgccgtcatctaatatcatattaggtttccagcttgggtcgcctataatagtttgatcaatacaccacaaatattcctcctcagtctcacctttccaagcaaaaacaggtatacctttttcggcaatagctgctgctgcatgatcttgagtggaataaatgttgcaagaagaccacctnacgcttgcaccaagcgcaactagcgtctcaattagaactgctgtttgaattgtcatatgaaggcaaccaacaatccttgctcctttaagtggttgctcttttgcatatttctctcttaaagccataagaccaggcatttctgtttctgcgatttttatttctttattaccccacgctgaaagcgaaatatctgcaaccttatagtctggtccaattttttcaacaaccttactcatactttactccgttataataaacttttaattttatctacctgatctattctttcccatggtaagtttaaatcacttctaccaaaatggccgtatgccgctgtacctttatatatcggctctagtaagttaagcatattaattatgccccaaggacgcaagtcaaatacttcctttataatatgtacaatttttgattcctcaatttttgaagttccaaaagtatcaatgctgatagaagttggttttgcaactccaatcgcatatgagacctgtaattcacatttgtctgctaatcctgcagcaacaatatttttgacgacatatcttgaagcataagccgctgatctatcaacctttgacggatctttacctgaaaaagctcctccaccgtgtcttgccattccaccatatgtatcaacaattatttttcttccagtcaaaccacaatctccaactgggcctccaatctcaaatgaaccagttgggttaatgtgaatttttgtatttttatttaaaaaactttttggcaatacttcttgaataactttctcataaacatattgttgaatttctttttgtttaacattaggagaatgctgggttgaaatcactatagtatctatagaatgtatcttttcattctcatatttaaatgttatttggctctttgcatccggtcttagccaacctacatctttttcttttctcaaaagagataactggtgaaccaatctatgtgaatatgttattggtgctggcatcaatacatcagtttcattattggcataaccaaacatcaatccttggtcacctgcgccttgatcttcatcaatttctctatcaacaccttgcgctatatctttagactgaatacctattttattaacaaattctacattatcgccactaaaacctaaatcctctgaattatatccaatatcattaattgtatttctaacaatgttctcataatcaatttgtgctgaggttgatatttctccgccaattacaacaataccttttgaaccttcttcagatttaactaacgcttcacaggcaactcttgcttttttatcttttgatattaccgcatctaaaatcgcatcggatatctgatcacataacttatctggatgaccctctgacactgattcagaagtaaacactttagaaaccataataatttccccgcaatagattaaaataataatatcataatcaaattttttgggctataaatattgccctcgatattggtggaaatccttctattgtctttccattaggtaataaaaaatcacttaaacttttaccagtcatccattttgtagatctttgctcattcttatctgtaaaactttcattaatacattcaatatttttaaaaccattttgtttaagtaaattaattatgtttttttttcttaaaattattttaatatttcgcattcctgcataagtttgatttttttcaataataatatcttcttttttagttgaaataattgattctagaattagatacccatttttttttaataatttatttatagtttgaaaatgagtaacaggatctttcgtgtgatatagaattcccatagataataacagatcaaaatcaaaactttttattaaaaaatcttcagcagtacaaggcaatataataatattatttagattcttggcataaaattttgtagataaaaattgataaatatataaaggagttctatccaacccaactattaaatctggttctagattcaataacttatatgaatagtagccgttgctacagcctaaatctccaatacgcataccttttaattttggaaaaaaatttttgagtctattccacttaatatccgatcgccattctgaatctatatcaataccaaataatgaaaagggtccttttctccaaggacttaaatttaataaacttttttcaagaatttttttttggttagtattaatttctgaagacctaccaaaaataattttattattttgtatattaaaataatttgtacttatacctggcagggaatttaagatattcctccatttttctgtatcaccatggttacagaaatttttattttctaaataaaaatcaaataaagatttgtattcattcattaaaatttcagaaaaatattcattaatttttaaatatgaaagaatatttattttattagcacccatgatgcaaaattataacatttaaaccattgataaaagttattgcacccaatatttttgaatcttttttcatgatctttttcactctctatgatcatagaatcagcaagcgcaagcttctttctatctatttcttctttagaatacccattattttctttaaagaaatcgtgaaaattttgtaataaaatattatcttgcatcttatttaattttactttttcggtaataattattacaccgccagtattaagttctttgaataatctccttaataaattttctcttttagttgtaggtacgaattgaagagttaaatttaaaataactactgaaggatttacgatattatattcgcatatatctgaattaataaaattaatttttgggtctttaatactttttttgcaaatatttatcattgcttttgatgaatcaatcgcaaatacttttccatctaaattttttacattcttgagtattgataaagaacaagcagacaatgaagatcccaaatcgtatacatttgtgcccggctggtaaaatttttttgcgactatgcctatattgttaattaaaaattcgtaccctggaacagatctttttaccatatcttcaaaaacatctgcaacttcgctattaaaagaaaatttatggttttttggatactgctttttgtataaattatcttttttatcgtttttcatttaattttttttggaacttttttatttttaaatgaagtatatattggagtaccattcctaaatttaggataatcttcgccttttattagtggttcaatataatncctacaagattttgtgatatggtacccatcagaagaaatatattttcttggcagtttcttttccacatttgctactttcgataatggaacggaagcaagtttccatctatatggtttatttgaaactctctttatgcttgccattacagcgttttttcctctgacagctatatcaaccgcatata

SEQ ID NO: 979 - DNA, 4000 bp, Escherichia coli
  misc_feature (1985)..(1985): n is a, c, g, or t
  misc_feature (1991)..(1991): n is a, c, g, or t
acaacgccgagcgaagcgccgaccccggggtcacggcgaggggctgccgacagatggatgcgctcgaggcgcgtttcgcgagactgcgcgccgacacggcgagagggatcgcgctgtacgcgtcaccgatgcgtcggtgcttgctcacggcgaacgcgatggcgcgagggatgcggacgcgggccaaggtgatgatcgacgcgcacgagcacggcggatgctttcgcggcgcgcgcggacgagacgcggacgcggacgggacgagtcgagcgatcggcgagcgcgggatgacgagagatgagatcgagagcgagttcgagctcgtggatgcgagcgatgtgccgacgatcgggtggtgggacgcctcgcgagggtgcgagacggtggcggaggcgcagacgcgcgcgcgcggcgtggcgaagtatttaatgcacaaggcgcgcgcgatggcggcgggtgaggaggaagagatggacgtgtgcatcgtcacgcacggaatgtttatcgatatgctgctcaagacgctgttcgatgtgccgagaacgcgaggaaagcagggggcgctgttttgctcgcaaaacgcgtgcgtgcacgaacttcatctcgacatcgccgaagacggcgattcggtgggattgcaggtgtttaacgacgtcacgcacattcccgaagaggcacgctcgggtggcaccgtcgacgggctctcggaggcgtacacgaacgaaggttcggcgtgagacgcgttcgagtcggcgtaagtttcgccgtaatattttacagtacatttgatgttgcaatatatctaggtttgagctaaacacgagcgcttgtcgtttgcgcactacagacgagccttcttcccgcttcgcatgaacggtcgcaggctccattcgatgtcgcaatcgtccatttccaccgtcccgagcttgatttggtacaagcgcatctcgaacctcggaccgatttccgtgagcgcgactgatttcgcccctttcggcatctcgtacatgtgatggcgcaaagaaatataatcagcatcgttcgcaaacgtcacgacgcgctttgacttcgccttgggctcggggaacaagtgcttcagcaccgtcgccgtgcgcttgccgagcggcgacgtaaaattttctaaaatcaagtgcggaaacacctcgctgacgtgaccgatgtcctgatccttgatatcgtgccgcatcaccgtgttggacaacccaaagtaacacgtcggcccgaacggtaggtgcgaaatcaccaacccatccggctcgccccggtgttcgtgcaccatgactaaatccgtgaacccgccgtttcgacacaaatccaccaaatccggcaagatttgactcccgcggttgatcctttgcgacgtgggaaacaacaacttgagctctttcgcgaattgttgcaaccgactcgacggatctcgcgacgtcgtcagaagcactctcggttcccgttccgccgccttcgcgtactcgtcgtcaatcacccctcgcgccccgtacgacgccgtcttcgcgtcttccgcgtgcacttcctcccgcaatcgcgcttcttccttccgcaactccgtcgggatcgccttgccgtcctccaggcactgtcgaatcgttcgtttcttttcgtacagctcgcgctccttgccttcgagcgattttcgatacacaaactctcgccgcaggcgcgccgtgcgtcgaagcatgccgacgaatcacggggcgttcgaacccgaacgcgtcgcgccgtcgcgtcggtccgtcgcgccgtcgcgtccgcgtcgacgtcgtcgccccgttcgacgcgtcgcgcacttcggccgccgccgccgcgcgcgacggcgcgacgtcgcccggcgccggacgcgccgcgcgcgccgtacgcgacgcgatcgaaccgccatcaaacgtcgcgcgtcgatcgcatcataaaacgacgaccgcgtcgaatgatggcgccgcgaaccacgaatntgcgcntggggtttacgcgatggatcgataaaaatcatccgcgcgcgatccgaacgcgcccgcgtcgtcccggcgcgcgcgcgcccgcgcggggcgtcacaacgcgcgcgcgctctctcgacacaccgatcgatcatggcgtctctcacgcaatccgccgtcttcggcaagaagttcacgaccgtgaaggcgtccacgaagcggtgcgtgcgcgcgcgcgcgtcgacgacgatcgaatcgcccgcgcgcgatcgatcgcgtatcccgttcgcgatagggtgatggcgacggcgatggccggcgcgccggcgcgcgtcgtcgcggcgtcgtcgcgatcgagcggaattccgcgcgaaaggaatttcacgcgtcgatcgcgcgacgccgcgagacgcgagacgcgtcgccgtcgccgtcgccgccgtcgacatcgatcgatccacgtccacgatcgcgcgtcgcgctcgatctcgagactgacgaacgtcgtcgcgttcgcgcgtctcgtccacagcgccaccaagaccacggtcgctcgcgcgtcgatgaacgacttcgcggagaaggtgtccaaggcgtccgtcgcgctcggcgtcgccggtgccgtgctcgcgcaggtgcgtcgaacgaatcgaatcctcgaacgagatacgagcgcgcgatacggttggggcgtgcgcgcgcgagggagagacgacgcgcgcgggtcggcgcgtcggacgtcgagtgggcgttcgtcggacgcagaaaattgcccgcgacgcggacggcgacgcgcggcgcgcgcgccgacggcgtcgacgtcgcgcgttcgcgcgttcgcgccatcgtgaaacgccccgtatcgcgagagatctctggactgacgaatttgaaacccttttgtatgcgcaaacagtctgcgggtgctgtcacgtacgacgaactccaaggcttgacgtacttgcaagtcaagggtactggcttggcgaacacgtgcccggtcgtcgaaggtggtgtgtccggcaaggaaatcaaggctggtgactacgccctcgagcgattctgcatggaaccgacctcgttcacggtgaaggaagagtcgcaattcaagcaaggcgaatccgagttctcgaagacgcgcttgatgacgcgcttgacgtacaccctcgacggcatgactggctccttcaaggttggctccgatggctccgtcaccgtccaagagaacgatggcctcgactacgccccggtcaccgtgcaattgccgggtggcgagcgcgtgccgttcttgttcacgctcaaggagttcactggcaagggtaacacgtcccagttcggcggcgacttcgtcgtcccgtcttaccgtggttcttctttcctcgacccgaagggccgtggtggttccactggttacgacaacgccgtcgccctcccggcgcgcgctgactccgaggaactccaaaaggagaaccaaaagaacaccgccgcgctcaagggctccgccgtgttcaacgtcgccaagtacgacccggccaccggtgaaatcgccggcgttttcgagtccatccagccgtctgacactgatcttggcgccaaggtgccgaaggatgttaagatcaccggcctttggtatgccaaccttggcagcaagtagacgacaggattacgctgtatgagctgcgcgatggcgatttagtgacgttgtgcgcgtcacgctgtatgcgaaccgagtagtcaatttggtgacgtacgaaatagagtaccttagaatgtgtcgatgatccgtgacgggcggtgtcgcgtcagcgattccacacgccgcgattatttcggcgcttgcgaaacctgatttctccgcaaagatatgtaacgaacagagtttcaacttccacaatccttaaaacgctaaatcatctactcgcttcgtcgctcgcgatagtatccgcctctcgcaggatcgagcgcggccaaattttgaaacatttcccgcgggtgttcgtctccgagcgacgcgagcgctaggagcggccact

SEQ ID NO: 980 - DNA, 4000 bp, Escherichia coli
  misc_feature (1510)..(1510): n is a, c, g, or t
  misc_feature (1990)..(1990): n is a, c, g, or t
  misc_feature (2320)..(2321): n is a, c, g, or t
  misc_feature (2324)..(2325): n is a, c, g, or t
  misc_feature (2328)..(2328): n is a, c, g, or t
  misc_feature (2332)..(2333): n is a, c, g, or t
  misc_feature (2339)..(2339): n is a, c, g, or t
  misc_feature (2345)..(2345): n is a, c, g, or t
  misc_feature (2348)..(2348): n is a, c, g, or t
  misc_feature (2350)..(2350): n is a, c, g, or t
  misc_feature (2352)..(2354): n is a, c, g, or t
  misc_feature (2359)..(2359): n is a, c, g, or t
  misc_feature (2361)..(2361): n is a, c, g, or t
  misc_feature (2363)..(2364): n is a, c, g, or t
  misc_feature (2367)..(2367): n is a, c, g, or t
  misc_feature (2373)..(2373): n is a, c, g, or t
  misc_feature (2375)..(2375): n is a, c, g, or t
  misc_feature (2377)..(2377): n is a, c, g, or t
  misc_feature (2379)..(2380): n is a, c, g, or t
  misc_feature (2382)..(2384): n is a, c, g, or t
  misc_feature (2386)..(2386): n is a, c, g, or t
  misc_feature (2388)..(2388): n is a, c, g, or t
  misc_feature (2391)..(2391): n is a, c, g, or t
  misc_feature (2393)..(2393): n is a, c, g, or t
  misc_feature (2396)..(2396): n is a, c, g, or t
  misc_feature (2400)..(2401): n is a, c, g, or t
  misc_feature (2405)..(2405): n is a, c, g, or t
  misc_feature (2408)..(2409): n is a, c, g, or t
  misc_feature (2412)..(2413): n is a, c, g, or t
  misc_feature (2415)..(2417): n is a, c, g, or t
  misc_feature (2420)..(2420): n is a, c, g, or t
  misc_feature (2423)..(2424): n is a, c, g, or t
  misc_feature (2428)..(2429): n is a, c, g, or t
  misc_feature (2431)..(2432): n is a, c, g, or t
  misc_feature (2436)..(2437): n is a, c, g, or t
  misc_feature (2443)..(2444): n is a, c, g, or t
  misc_feature (2449)..(2449): n is a, c, g, or t
  misc_feature (2453)..(2456): n is a, c, g, or t
  misc_feature (2458)..(2458): n is a, c, g, or t
  misc_feature (2460)..(2460): n is a, c, g, or t
  misc_feature (2462)..(2462): n is a, c, g, or t
  misc_feature (2464)..(2465): n is a, c, g, or t
  misc_feature (2467)..(2470): n is a, c, g, or t
  misc_feature (2473)..(2474): n is a, c, g, or t
  misc_feature (2476)..(2477): n is a, c, g, or t
  misc_feature (2482)..(2482): n is a, c, g, or t
  misc_feature (2484)..(2484): n is a, c, g, or t
  misc_feature (2486)..(2487): n is a, c, g, or t
  misc_feature (2492)..(2492): n is a, c, g, or t
  misc_feature (2495)..(2495): n is a, c, g, or t
  misc_feature (2499)..(2500): n is a, c, g, or t
  misc_feature (2503)..(2504): n is a, c, g, or t
  misc_feature (2506)..(2507): n is a, c, g, or t
  misc_feature (2509)..(2510): n is a, c, g, or t
  misc_feature (2512)..(2513): n is a, c, g, or t
  misc_feature (2515)..(2519): n is a, c, g, or t
  misc_feature (2521)..(2522): n is a, c, g, or t
  misc_feature (2525)..(2525): n is a, c, g, or t
  misc_feature (2528)..(2528): n is a, c, g, or t
  misc_feature (2531)..(2533): n is a, c, g, or t
  misc_feature (2536)..(2536): n is a, c, g, or t
  misc_feature (2538)..(2538): n is a, c, g, or t
  misc_feature (2540)..(2541): n is a, c, g, or t
  misc_feature (2543)..(2545): n is a, c, g, or t
  misc_feature (2547)..(2547): n is a, c, g, or t
  misc_feature (2549)..(2551): n is a, c, g, or t
  misc_feature (2558)..(2558): n is a, c, g, or t
  misc_feature (2560)..(2560): n is a, c, g, or t
  misc_feature (2564)..(2566): n is a, c, g, or t
  misc_feature (2568)..(2568): n is a, c, g, or t
  misc_feature (2571)..(2573): n is a, c, g, or t
  misc_feature (2577)..(2578): n is a, c, g, or t
  misc_feature (2582)..(2582): n is a, c, g, or t
  misc_feature (2586)..(2586): n is a, c, g, or t
  misc_feature (2588)..(2588): n is a, c, g, or t
  misc_feature (2590)..(2590): n is a, c, g, or t
  misc_feature (2592)..(2593): n is a, c, g, or t
  misc_feature (2595)..(2595): n is a, c, g, or t
  misc_feature (2597)..(2597): n is a, c, g, or t
  misc_feature (2601)..(2603): n is a, c, g, or t
  misc_feature (2605)..(2606): n is a, c, g, or t
  misc_feature (2610)..(2610): n is a, c, g, or t
  misc_feature (2612)..(2613): n is a, c, g, or t
  misc_feature (2616)..(2617): n is a, c, g, or t
  misc_feature (2620)..(2621): n is a, c, g, or t
  misc_feature (2623)..(2624): n is a, c, g, or t
  misc_feature (2627)..(2627): n is a, c, g, or t
  misc_feature (2629)..(2629): n is a, c, g, or t
  misc_feature (2631)..(2631): n is a, c, g, or t
  misc_feature (2633)..(2633): n is a, c, g, or t
  misc_feature (2635)..(2636): n is a, c, g, or t
  misc_feature (2640)..(2640): n is a, c, g, or t
  misc_feature (2642)..(2642): n is a, c, g, or t
  misc_feature (2644)..(2646): n is a, c, g, or t
  misc_feature (2648)..(2651): n is a, c, g, or t
  misc_feature (2653)..(2653): n is a, c, g, or t
  misc_feature (2658)..(2659): n is a, c, g, or t
  misc_feature (2661)..(2661): n is a, c, g, or t
  misc_feature (2663)..(2671): n is a, c, g, or t
  misc_feature (2673)..(2674): n is a, c, g, or t
  misc_feature (2679)..(2683): n is a, c, g, or t
  misc_feature (2686)..(2686): n is a, c, g, or t
  misc_feature (2688)..(2688): n is a, c, g, or t
  misc_feature (2691)..(2692): n is a, c, g, or t
  misc_feature (2694)..(2694): n is a, c, g, or t
  misc_feature (2697)..(2697): n is a, c, g, or t
  misc_feature (2699)..(2699): n is a, c, g, or t
  misc_feature (2703)..(2706): n is a, c, g, or t
  misc_feature (2710)..(2712): n is a, c, g, or t
  misc_feature (2715)..(2716): n is a, c, g, or t
  misc_feature (2719)..(2719): n is a, c, g, or t
  misc_feature (2723)..(2723): n is a, c, g, or t
  misc_feature (2725)..(2725): n is a, c, g, or t
  misc_feature (2728)..(2728): n is a, c, g, or t
  misc_feature (2730)..(2735): n is a, c, g, or t
  misc_feature (2737)..(2737): n is a, c, g, or t
  misc_feature (2739)..(2739): n is a, c, g, or t
  misc_feature (2742)..(2742): n is a, c, g, or t
  misc_feature (2744)..(2744): n is a, c, g, or t
  misc_feature (2746)..(2747): n is a, c, g, or t
  misc_feature (2749)..(2749): n is a, c, g, or t
  misc_feature (2751)..(2751): n is a, c, g, or t
  misc_feature (2755)..(2756): n is a, c, g, or t
  misc_feature (2758)..(2759): n is a, c, g, or t
  misc_feature (2761)..(2761): n is a, c, g, or t
  misc_feature (2764)..(2764): n is a, c, g, or t
  misc_feature (2767)..(2767): n is a, c, g, or t
  misc_feature (2769)..(2769): n is a, c, g, or t
  misc_feature (2771)..(2771): n is a, c, g, or t
  misc_feature (2773)..(2773): n is a, c, g, or t
  misc_feature (2776)..(2779): n is a, c, g, or t
  misc_feature (2781)..(2782): n is a, c, g, or t
  misc_feature (2784)..(2784): n is a, c, g, or t
  misc_feature (2786)..(2786): n is a, c, g, or t
  misc_feature (2788)..(2789): n is a, c, g, or t
  misc_feature (2792)..(2792): n is a, c, g, or t
  misc_feature (2797)..(2798): n is a, c, g, or t
  misc_feature (2800)..(2800): n is a, c, g, or t
  misc_feature (2803)..(2803): n is a, c, g, or t
  misc_feature (2806)..(2808): n is a, c, g, or t
  misc_feature (2813)..(2813): n is a, c, g, or t
  misc_feature (2815)..(2818): n is a, c, g, or t
  misc_feature (2820)..(2820): n is a, c, g, or t
  misc_feature (2822)..(2823): n is a, c, g, or t
  misc_feature (2825)..(2826): n is a, c, g, or t
  misc_feature (2832)..(2832): n is a, c, g, or t
  misc_feature (2839)..(2842): n is a, c, g, or t
  misc_feature (2845)..(2845): n is a, c, g, or t
  misc_feature (2848)..(2848): n is a, c, g, or t
  misc_feature (2850)..(2850): n is a, c, g, or t
  misc_feature (2854)..(2854): n is a, c, g, or t
  misc_feature (2856)..(2857): n is a, c, g, or t
  misc_feature (2859)..(2859): n is a, c, g, or t
  misc_feature (2861)..(2861): n is a, c, g, or t
  misc_feature (2868)..(2869): n is a, c, g, or t
  misc_feature (2871)..(2871): n is a, c, g, or t
  misc_feature (2876)..(2876): n is a, c, g, or t
  misc_feature (2879)..(2881): n is a, c, g, or t
  misc_feature (2883)..(2884): n is a, c, g, or t
  misc_feature (2886)..(2886): n is a, c, g, or t
  misc_feature (2888)..(2890): n is a, c, g, or t
  misc_feature (2892)..(2892): n is a, c, g, or t
  misc_feature (2895)..(2895): n is a, c, g, or t
  misc_feature (2897)..(2898): n is a, c, g, or t
  misc_feature (2900)..(2901): n is a, c, g, or t
  misc_feature (2903)..(2904): n is a, c, g, or t
  misc_feature (2907)..(2908): n is a, c, g, or t
  misc_feature (2910)..(2912): n is a, c, g, or t
  misc_feature (2914)..(2914): n is a, c, g, or t
  misc_feature (2916)..(2916): n is a, c, g, or t
  misc_feature (2919)..(2920): n is a, c, g, or t
  misc_feature (2925)..(2925): n is a, c, g, or t
  misc_feature (2928)..(2929): n is a, c, g, or t
  misc_feature (2931)..(2932): n is a, c, g, or t
  misc_feature (2935)..(2936): n is a, c, g, or t
  misc_feature (2938)..(2940): n is a, c, g, or t
  misc_feature (2943)..(2943): n is a, c, g, or t
  misc_feature (2946)..(2947): n is a, c, g, or t
  misc_feature (2950)..(2950): n is a, c, g, or t
  misc_feature (2954)..(2954): n is a, c, g, or t
  misc_feature (2956)..(2956): n is a, c, g, or t
  misc_feature (2959)..(2959): n is a, c, g, or t
  misc_feature (2962)..(2963): n is a, c, g, or t
  misc_feature (2967)..(2968): n is a, c, g, or t
  misc_feature (2970)..(2970): n is a, c, g, or t
  misc_feature (2972)..(2973): n is a, c, g, or t
  misc_feature (2975)..(2975): n is a, c, g, or t
  misc_feature (2977)..(2977): n is a, c, g, or t
  misc_feature (2981)..(2982): n is a, c, g, or t
  misc_feature (2984)..(2988): n is a, c, g, or t
  misc_feature (2990)..(2990): n is a, c, g, or t
  misc_feature (2993)..(2996): n is a, c, g, or t
  misc_feature (2998)..(3001): n is a, c, g, or t
  misc_feature (3004)..(3006): n is a, c, g, or t
  misc_feature (3009)..(3010): n is a, c, g, or t
  misc_feature (3012)..(3013): n is a, c, g, or t
  misc_feature (3017)..(3019): n is a, c, g, or t
  misc_feature (3021)..(3022): n is a, c, g, or t
  misc_feature (3024)..(3024): n is a, c, g, or t
  misc_feature (3028)..(3028): n is a, c, g, or t
  misc_feature (3031)..(3033): n is a, c, g, or t
  misc_feature (3038)..(3038): n is a, c, g, or t
  misc_feature (3040)..(3043): n is a, c, g, or t
  misc_feature (3045)..(3045): n is a, c, g, or t
  misc_feature (3048)..(3049): n is a, c, g, or t
  misc_feature (3051)..(3051): n is a, c, g, or t
  misc_feature (3055)..(3055): n is a, c, g, or t
  misc_feature (3058)..(3058): n is a, c, g, or t
  misc_feature (3060)..(3060): n is a, c, g, or t
  misc_feature (3064)..(3066): n is a, c, g, or t
  misc_feature (3068)..(3069): n is a, c, g, or t
  misc_feature (3071)..(3073): n is a, c, g, or t
  misc_feature (3075)..(3076): n is a, c, g, or t
  misc_feature (3078)..(3079): n is a, c, g, or t
  misc_feature (3081)..(3081): n is a, c, g, or t
  misc_feature (3084)..(3087): n is a, c, g, or t
  misc_feature (3089)..(3093): n is a, c, g, or t
  misc_feature (3095)..(3095): n is a, c, g, or t
  misc_feature (3097)..(3098): n is a, c, g, or t
  misc_feature (3100)..(3100): n is a, c, g, or t
  misc_feature (3102)..(3103): n is a, c, g, or t
  misc_feature (3107)..(3108): n is a, c, g, or t
  misc_feature (3110)..(3110): n is a, c, g, or t
  misc_feature (3112)..(3114): n is a, c, g, or t
  misc_feature (3118)..(3121): n is a, c, g, or t
  misc_feature (3123)..(3123): n is a, c, g, or t
  misc_feature (3126)..(3127): n is a, c, g, or t
  misc_feature (3131)..(3131): n is a, c, g, or t
  misc_feature (3135)..(3138): n is a, c, g, or t
  misc_feature (3143)..(3145): n is a, c, g, or t
  misc_feature (3148)..(3148): n is a, c, g, or t
  misc_feature (3150)..(3150): n is a, c, g, or t
  misc_feature (3152)..(3152): n is a, c, g, or t
  misc_feature (3156)..(3159): n is a, c, g, or t
  misc_feature (3163)..(3166): n is a, c, g, or t
  misc_feature (3168)..(3170): n is a, c, g, or t
  misc_feature (3179)..(3180): n is a, c, g, or t
  misc_feature (3182)..(3183): n is a, c, g, or t
  misc_feature (3191)..(3191): n is a, c, g, or t
  misc_feature (3194)..(3195): n is a, c, g, or t
  misc_feature (3203)..(3203): n is a, c, g, or t
  misc_feature (3206)..(3207): n is a, c, g, or t
  misc_feature (3216)..(3216): n is a, c, g, or t
  misc_feature (3218)..(3219): n is a, c, g, or t
  misc_feature (3223)..(3223): n is a, c, g, or t
  misc_feature (3228)..(3229): n is a, c, g, or t
  misc_feature (3239)..(3242): n is a, c, g, or t
  misc_feature (3246)..(3246): n is a, c, g, or t
  misc_feature (3250)..(3252): n is a, c, g, or t
  misc_feature (3254)..(3254): n is a, c, g, or t
  misc_feature (3257)..(3257): n is a, c, g, or t
  misc_feature (3260)..(3262): n is a, c, g, or t
  misc_feature (3264)..(3274): n is a, c, g, or t
  misc_feature (3276)..(3276): n is a, c, g, or t
  misc_feature (3279)..(3283): n is a, c, g, or t
  misc_feature (3285)..(3288): n is a, c, g, or t
  misc_feature (3290)..(3296): n is a, c, g, or t
  misc_feature (3299)..(3300): n is a, c, g, or t
  misc_feature (3302)..(3320): n is a, c, g, or t
  misc_feature (3323)..(3323): n is a, c, g, or t
  misc_feature (3325)..(3326): n is a, c, g, or t
  misc_feature (3329)..(3331): n is a, c, g, or t
  misc_feature (3334)..(3334): n is a, c, g, or t
  misc_feature (3336)..(3338): n is a, c, g, or t
  misc_feature (3341)..(3342): n is a, c, g, or t
  misc_feature (3344)..(3345): n is a, c, g, or t
  misc_feature (3348)..(3348): n is a, c, g, or t
  misc_feature (3350)..(3359): n is a, c, g, or t
  misc_feature (3362)..(3363): n is a, c, g, or t
  misc_feature (3365)..(3371): n is a, c, g, or t
  misc_feature (3374)..(3374): n is a, c, g, or t
  misc_feature (3377)..(3383): n is a, c, g, or t
  misc_feature (3385)..(3399): n is a, c, g, or t
  misc_feature (3401)..(3404): n is a, c, g, or t
  misc_feature (3406)..(3412): n is a, c, g, or t
  misc_feature (3414)..(3424): n is a, c, g, or t
  misc_feature (3426)..(3436): n is a, c, g, or t
  misc_feature (3439)..(3441): n is a, c, g, or t
  misc_feature (3445)..(3448): n is a, c, g, or t
  misc_feature (3450)..(3460): n is a, c, g, or t
  misc_feature (3462)..(3469): n is a, c, g, or t
  misc_feature (3471)..(3473): n is a, c, g, or t
  misc_feature (3475)..(3477): n is a, c, g, or t
  misc_feature (3479)..(3484): n is a, c, g, or t
  misc_feature (3486)..(3491): n is a, c, g, or t
  misc_feature (3493)..(3495): n is a, c, g, or t
  misc_feature (3497)..(3500): n is a, c, g, or t
  misc_feature (3503)..(3511): n is a, c, g, or t
  misc_feature (3513)..(3522): n is a, c, g, or t
  misc_feature (3527)..(3533): n is a, c, g, or t
  misc_feature (3535)..(3559): n is a, c, g, or t
  misc_feature (3562)..(3573): n is a, c, g, or t
  misc_feature (3575)..(3594): n is a, c, g, or t
  misc_feature (3596)..(3598): n is a, c, g, or t
  misc_feature (3600)..(3602): n is a, c, g, or t
  misc_feature (3604)..(3619): n is a, c, g, or t
  misc_feature (3622)..(3629): n is a, c, g, or t
  misc_feature (3631)..(3643): n is a, c, g, or t
  misc_feature (3645)..(3645): n is a, c, g, or t
  misc_feature (3647)..(3653): n is a, c, g, or t
  misc_feature (3655)..(3663): n is a, c, g, or t
  misc_feature (3665)..(3667): n is a, c, g, or t
  misc_feature (3669)..(3670): n is a, c, g, or t
  misc_feature (3672)..(3675): n is a, c, g, or t
  misc_feature (3679)..(3685): n is a, c, g, or t
  misc_feature (3690)..(3694): n is a, c, g, or t
  misc_feature (3696)..(3700): n is a, c, g, or t
  misc_feature (3702)..(3705): n is a, c, g, or t
  misc_feature (3707)..(3711): n is a, c, g, or t
  misc_feature (3713)..(3717): n is a, c, g, or t
  misc_feature (3719)..(3729): n is a, c, g, or t
  misc_feature (3731)..(3735): n is a, c, g, or t
  misc_feature (3738)..(3741): n is a, c, g, or t
  misc_feature (3743)..(3753): n is a, c, g, or t
  misc_feature (3756)..(3795): n is a, c, g, or t
  misc_feature (3797)..(3811): n is a, c, g, or t
  misc_feature (3813)..(3814): n is a, c, g, or t
  misc_feature (3816)..(3819): n is a, c, g, or t
  misc_feature (3821)..(3822): n is a, c, g, or t
  misc_feature (3825)..(3832): n is a, c, g, or t
  misc_feature (3835)..(3839): n is a, c, g, or t
  misc_feature (3841)..(3843): n is a, c, g, or t
  misc_feature (3845)..(3849): n is a, c, g, or t
  misc_feature (3851)..(3855): n is a, c, g, or t
  misc_feature (3858)..(3859): n is a, c, g, or t
  misc_feature (3862)..(3864): n is a, c, g, or t
  misc_feature (3866)..(3866): n is a, c, g, or t
  misc_feature (3869)..(3879): n is a, c, g, or t
  misc_feature (3881)..(3884): n is a, c, g, or t
  misc_feature (3886)..(3889): n is a, c, g, or t
  misc_feature (3891)..(3895): n is a, c, g, or t
  misc_feature (3897)..(3907): n is a, c, g, or t
  misc_feature (3910)..(3910): n is a, c, g, or t
  misc_feature (3912)..(3912): n is a, c, g, or t
  misc_feature (3914)..(3918): n is a, c, g, or t
  misc_feature (3924)..(3924): n is a, c, g, or t
  misc_feature (3926)..(3926): n is a, c, g, or t
  misc_feature (3928)..(3931): n is a, c, g, or t
  misc_feature (3938)..(3938): n is a, c, g, or t
  misc_feature (3940)..(3945): n is a, c, g, or t
  misc_feature (3947)..(3948): n is a, c, g, or t
  misc_feature (3955)..(3961): n is a, c, g, or t
  misc_feature (3963)..(3964): n is a, c, g, or t
  misc_feature (3966)..(3980): n is a, c, g, or t
  misc_feature (3982)..(3984): n is a, c, g, or t
  misc_feature (3986)..(3988): n is a, c, g, or t
  misc_feature (3992)..(3992): n is a, c, g, or t
  misc_feature (3994)..(3995): n is a, c, g, or t
  misc_feature (3997)..(3998): n is a, c, g, or t
  misc_feature (4000)..(4000): n is a, c, g, or t
tggacagaatgtcttggggccaattgttatttttgacatattccccattaggctttgttgtcttgtcggtaatgattgctttaggtgcgtttcattgcattaacggcatcagattgatgttaaatcaaggagggataggaataggaactccaactagacccgattacccatatcaaattcaatcaatgggaaaaaagaacagattgtgcatttacgttaccatgggtgtttcagcattggcattatacgctgcattaggggtgtttttcaaattttgagagtaagggaaagccatattcgaaaaatccattacggtacagctttaggcgccatagggttagtcgcattacacatttcagttagatttgcaacggggaattttgcatcttcattatcgtacgagtatgtaatttctaattatcaaaatttcacttatgcattacttttggaaatgatattaattttagtgtcagttcatggtttcaatggtcttcgaggtattttgcttgattatagaagtggatacaaatatgaaaaagctgtgaattggggatgtttcatttcggtcatatcattagtcacctatggaactatcaccataattcttgcaaaccaaattaaaatttgattgtgatggatagtttaatcttggaggatttgatttagaatatcttttagttttggatgggtaatctcgttttctgcagatttaaaaaaagactcaactgcatcttttgatgacccttgtttttgatacatttttgcttgtaatgccatttctaatttatcaatttgatgtacaattattgattcaggagattcttgatcttgatactcattccaaatttgagtatattgcaattttatagattctggcaaggtgctgagaattttaccatatgcattattttcaattattattttatcttctttgcttatttggtttggagtataatctccaatttctgattcagccaaatcatgcaataatatcattttgagtattttctcagaattgtaatttcctaaatcagatattatcattcccattatggccatagagtaactatgatcagccacggattcagggttctttagagataatttgtccatccacccctgtctggaaatatttttcaaatttactgcagttttaaaaaaatctaaaatcatgattacattatagataatattttgtcctaatgaattttcatatgtggtttttcgaatcacataataattaagttaaattaaacaagatgtgaaaatttacacaaaaacaggggatgacggaaatacaggtttgcagggtaattttagaattgcaaaatcacatccaagaattatggcatatgggacagtggatgaagcgaatgccgcaattggggttatcttgacaaatgtgttggatgatgatgtcagtcaacttttgagtcaaattcaaaatgatttatttttactgggttccgatttatccaaccagaatctaaacgatcttaaaaacagggtntccttggagatgattgaaaaattagaaaaatcaattgatctgtttgaattagaattatccccgctaacaaattttattctacctggtggggatttagcagctgcacagacacatcaagttagaacaattgtaagaagggcagaaacactggtagtaaaattaagcgataaggatgaaattaattctaattgcataaaatatctgaacagattatctgatttgatgtttgtattgggtcgcttgatcaataagcgaaaaggaatagaggacatcctctggaaaccataaaaagacaaactttaatgtctcatcttgagtattttttttagtgccagggtagctcagcctggaagagcactcggctgaagaccgggctgtcgcttgttcaaatcatgcccctggcactcttgatttaatttactttagatccaatattctcaaaaatcattaatttgataaatatctaatattcatccacangattcaaaaaatttattcctgttttttatgttaattagaattaatgaacacacttgagttagatgttgttatcatttctactgctttaattgacatattttctttttttgaaattttcaatagttcatcagaatgttcttccttcaaatgtttgagaaattctatttcttcgacattattacacttaaaatgacataaggggaacacacaattaaaattcaataaaataagtatagtcatctaataaaaaaattcatctaatgataaaatttactgtgaattaggatgtatttttaaaaaaatcccattagaattagaaataaaattaannttnnaanattnnagaaanaaaaanatngnannngaaantnanntcnaaaaantntntnngnnnancnaantnaanaaanntttnccnnaanntnnnttntcnnaaanncnntttnnacaaanngtttntttnnnngnantnanntnnnnccnnannttttngntnnaaaanttntttnnaanngnnanncnngnnnnntnnaanttnttnnnttngntnncnnntntnnnaaaaaantntttnnntnttnnntttnncccntttntnananncncncccnnngnntaantnnaannttnnanntgngntntngnnaaanantnnncnnnnanttttnncnannnnnnnnnannttttnnnnnaananaanntnttnantttnnnntttnnnttnnccncccnanaanannnnnnantnttnantnnananaaanngnnanaanagncnantnttnnnntnnananannctnttttnnanaanttnnnaaaanannnnananntnnaaaaanaaaaaannnncanaananaaantnnananaaaaaanncnaaaanatnnntnnanannnanagntnngnnannggnntnnngnanttnnccccncanntnnaanngnnnttntcnnggngttnanagnccnngttnnananncnanattnnannnnntnaannnnannnnttnnnggnnanngggnnncnnanaggnaannnaaaangnnnntnttnnanaaanaananagannncnnannnanncnnanaannnnannnnnantnngngnnaaanntncnnnaaannnnanaanntttnaaannnncaccnnnccnanantttnnnnattnnnngnnnaaaaaaaanntnnaaaaaaanttnnaaaaaaanttnnaaaaaaaantnnaaanaaaannaaaaaaaaannnnaaanaaannntnaanaannnannnnnnnnnnnantgnnnnngnnnntnnnnnnnttnntnnnnnnnnnnnnnnnnnnnaanannaannnaangnnnaanntnnagnannnnnnnnnnaannannnnnnnaanaannnnnnnannnnnnnnnnnnnnntnnnntnnnnnnnannnnnnnnnnnannnnnnnnnnnaannncaannnnannnnnnnnnnnannnnnnnntnnnannnannnnnntnnnnnnannnannnnttnnnnnnnnnannnnnnnnnnaaaannnnnnngnnnnnnnnnnnnnnnnnnnnnnnnnaannnnnnnnnnnncnnnnnnnnnnnnnnnnnnnngnnngnnntnnnnnnnnnnnnnnnnaannnnnnnngnnnnnnnnnnnnngnannnnnnnannnnnnnnntnnntnntnnnntaannnnnnnaaaannnnnannnnntnnnntnnnnntnnnnntnnnnnnnnnnntnnnnnttnnnntnnnnnnnnnnnttnnnnnnnnnnnnnnnnnnnnnnnnnnnnnnnnnnnnnnnncnnnnnnnnnnnnnnntnntnnnntnnttnnnnnnnnttnnnnncnnnannnnnannnnnatnnaannnanaannnnnnnnnnnannnnannnncnnnnntnnnnnnnnnnnttnanannnnnatttantntnnnnttttaantnnnnnntnnatttttnnnnnnntnntnnnnnnnnnnnnnnnannncnnnaaanannanncn

SEQ ID NO: 981 - DNA, 4000 bp, Escherichia coli
  misc_feature (835)..(835): n is a, c, g, or t
  misc_feature (1325)..(1325): n is a, c, g, or t
  misc_feature (1334)..(1334): n is a, c, g, or t
  misc_feature (2123)..(2123): n is a, c, g, or t
  misc_feature (3040)..(3040): n is a, c, g, or t
  misc_feature (3984)..(3984): n is a, c, g, or t
  misc_feature (3990)..(3990): n is a, c, g, or t
cgcatggtggctatgttggccaaaagcctgatgcatggtttgttgcaagcgggcatggccaattgcggcaagcatttcccaggccacggctatgtgaaagccgattcacacaccgacattcctatcgacacgcgcagcttgaaaaccatcttgcatgacgacgctttgccttatgcgtggcttagcaccagtttgagcagtgtcatgcccgcgcatgtgatttaccccaaggtagaccagcgccccgccggtttttctgcgcgctggctcaaagacatactgcgtcatcaactggggtttcagggcgcggtgttcagcgatgacttgtcaatggcaggcgcgcgtttgattgatggccaagaggtgagttacacccaagctgcggtcaccgctttgcaagcgggctgcgatttggtgttgttgtgcaaccaaagcaacccagacagcgcgggcggcggtcaagccttggatgatttactggcgggcctcgcccaagcgcagcaggcatctgcgtggcaacccagccctgtcagtgagcagcgccgcttggcactgctgccagcctgcaaggccttggattgggaagctttgatgcaatccccaagctatttgaatgctttaagcctgctgccctgacaaaactgggcctagggagtacccaccccagagcctcgtcaaaacagttaaaatagataacttaccccgacgacaacgggggcttaagcaggactaaaggaaacccatggcaaccaaatctggcaaaacctctgttgacgagagcggtcttcgttttaccagtcgtgagaatggctctcccttcgctggcatgggcaanatgggtgaaaccatgtcttgcatcaagtgcggcatgcacaaaccccgacgtcaaggcagccagcagcgctttgcaggcagcttggcttttttctgccacgactgcaaaccacctaagcccgctgtgccagcaacccctgccgccgccaaagcagcttaagcctatttcagcttattgatggcccaggttttcccgacgcaaggcggggaacaaaatcacgtcccgaatactggggctgtcggttaagagcatcatcaaacggtcaatgccaatgccgcaaccaccggcgggcggcatgccgtactccagtgcacgcacaaaatcatggtcaaacaacatggcctcatcgtcgccactgtctttggcattgacctgcgcatgaaagcgagcggcttggtcttctgcatcattcaactcgctgaaaccattgccaaattctcgtcctgtgatgtagagctcaaagcgctcggtcacctcggggtggctgtcnctggcgcgngccaagggtgaaatttccaccgggtgctcgcaaatgaaggtgggctcccagagtttttcttccacggtttcttcaaagtaaagaacctgcaagctggccaaactgcgtgccgacagtttgtgtttttcttcggagtggcccagctttttcagggcatgaaccaaccatgcactgtcgtcaacatggtctgcggcttcggtgtgcgccatgatggcttcgcggatggtgagtcgggcaaagggcttggacaagtccaccggtttgccgtcataggtcagcagcaaagtgcccacggctttgtgggcggcgtcgcggatcaggctttcggtgaactgcatcaggtcttggtagttccaataggccgcgtaaaactccatcatggtgaattcggggttgtgccgcacggaaataccttcattgcgaaagttgcggttaatttcaaacacccgctcgaacccgcccaccaacaggcgcttcaagtacaactcaggcgcgatgcgcaagaacatttgctggtcgagtgcgttgtggtgagtctcgaaaggcctggcattggcgccccctgggatggggtgcaacatgggtgtttcgacttccaaaaagtcatggttcaccatgaactcgcgaataccgctgaccgctttgctgcgcgcgatgaagcgctggcgagcggtctcatcggtgatcaagtcgatatagcgttggcggtatttaatttcttggtcgtggatgccatggaatttgtctggcaggggacgcaggcttttggtcagcatgcgaagggacgtnacatgcaccgacaattcaccggttttggttttgaacagatagccttcagcgcccacgatgtcacccaaatcccagtgtttgaagtcttcataaacctcaacgcctacttcctcacctttgacatacacctgcatgcgctcggtgctgtcttgcaaggtggcaaaactggccttgcccatgacgcgtttcaaaaccatgcgaccggcaatacgcaccgtgtgtttttcttctgccagcacctcggcggttttggcaccgtgcgcggtgtgcagggattgcgcgtggtgcgcgggtttgaagtcgttggggaaagccaccgggccgccaagggcttggcgagcgcgcatggcgctcaatttttcgcggcgttctgcgataagttggttttcgtcttggggttcgggggagcttgtgttttcggacatccaaggattctaagagttcgcagacaatagaagctgtctcctagcagaacgaactgaaacaccatgagcgacacgcctacccgtcccgaactccctgaccgtttgtctatcgatgcacgcagtccgcactacctagaagcggtgttccaccacgacatcggcattcgttttaacgacaaagagcgccacgatgtggaggagtactgcatcagcgagggctgggtgaaagtgcctgcgggtaaaaccttggaccgcaaaggcaagcccttgctgattaccttaaagggcagggttgaggtgtactaccgctgaagtcaggcgactgaatccgcgggttgcttggtcagcatggccaaagcattggcaatggttttgcgcaggtcgcggcggtcgcaaatcaggtcgagtgcacccttttccagcaaaaattccgaacgctgaaacccttcaggcagggtcacgcgcaccgtgctttcaatcacccttggcccngcaaagccaatcagcgctttgggttcggcaatcaccaagtcgcccatgaaagcaaagcccgccgacacgccgcccatggtggggtcggtcagtacgctgatatagggcaggcctttttgcgccaaacgggtgagggaggcattggttttggccatttgcatcagcgacagcaagccctcttgcatgcgcgcgccaccggtggcggtgaagcaaatgaaaggcactttttgttcgatggcggtatgcacgccgcgcacaaagcgctcgccaaccaccgagcccatagagccacccatgaagtcgaactcgaaacaagccgccaccacattgatgctgtgcaccgcaccgcccatgaccaccagcgcatcggtctcgccggtattctctaaagcttctttcaagcgttcggggtatttgcggctgtccttgaatttcaaggggtccatgggcaacacctcttggccaatttcatagcggccttcggggtcgaggaaggcgtctagacgctttcgggcggtaatacggtgatggtggctgcacttgggacagacattttggttttcttccaaatcgtttttgtagagcaccgtctcgcagctggggcacttaacccacaagccttctggcacggttcgccgatccgaaggatcggtttgctggattttggagggcagcagtttttcaagccagctcatcggtattccttaatcaaagtgcaaaggcattatgcgtccagcgcttggcgaatctcggccatgaagctgcgcgcttgttcgggtgcatggcccggtgcggcggcctcgaccagctgaatcagcttgctgccaatcaccaccgcgtcggccacttgaccaatggtgcgcgctgtggccgcgtcgcgtatgccaaagcctacgcccacgggaatatgcacatgctggcgaatgcgcggcagcatggcttcnacctcntcggtattga

SEQ ID NO: 982 - DNA, 4000 bp, Escherichia coli
  misc_feature (1)..(30): n is a, c, g, or t
  misc_feature (32)..(74): n is a, c, g, or t
  misc_feature (76)..(77): n is a, c, g, or t
  misc_feature (79)..(80): n is a, c, g, or t
  misc_feature (82)..(83): n is a, c, g, or t
  misc_feature (85)..(86): n is a, c, g, or t
  misc_feature (88)..(89): n is a, c, g, or t
  misc_feature (91)..(92): n is a, c, g, or t
  misc_feature (94)..(95): n is a, c, g, or t
  misc_feature (97)..(98): n is a, c, g, or t
  misc_feature (100)..(100): n is a, c, g, or t
  misc_feature (103)..(104): n is a, c, g, or t
  misc_feature (106)..(107): n is a, c, g, or t
  misc_feature (109)..(110): n is a, c, g, or t
  misc_feature (112)..(113): n is a, c, g, or t
  misc_feature (115)..(115): n is a, c, g, or t
  misc_feature (117)..(142): n is a, c, g, or t
  misc_feature (144)..(159): n is a, c, g, or t
  misc_feature (161)..(162): n is a, c, g, or t
  misc_feature (164)..(165): n is a, c, g, or t
  misc_feature (167)..(168): n is a, c, g, or t
  misc_feature (170)..(170): n is a, c, g, or t
  misc_feature (172)..(176): n is a, c, g, or t
  misc_feature (178)..(185): n is a, c, g, or t
  misc_feature (187)..(197): n is a, c, g, or t
  misc_feature (199)..(214): n is a, c, g, or t
  misc_feature (216)..(256): n is a, c, g, or t
  misc_feature (258)..(259): n is a, c, g, or t
  misc_feature (261)..(296): n is a, c, g, or t
  misc_feature (298)..(310): n is a, c, g, or t
  misc_feature (312)..(348): n is a, c, g, or t
  misc_feature (350)..(355): n is a, c, g, or t
  misc_feature (357)..(388): n is a, c, g, or t
  misc_feature (390)..(391): n is a, c, g, or t
  misc_feature (393)..(393): n is a, c, g, or t
  misc_feature (396)..(397): n is a, c, g, or t
  misc_feature (399)..(403): n is a, c, g, or t
  misc_feature (405)..(412): n is a, c, g, or t
  misc_feature (415)..(424): n is a, c, g, or t
  misc_feature (426)..(427): n is a, c, g, or t
  misc_feature (429)..(479): n is a, c, g, or t
  misc_feature (481)..(491): n is a, c, g, or t
  misc_feature (493)..(516): n is a, c, g, or t
  misc_feature (518)..(518): n is a, c, g, or t
  misc_feature (520)..(520): n is a, c, g, or t
  misc_feature (523)..(529): n is a, c, g, or t
  misc_feature (531)..(559): n is a, c, g, or t
  misc_feature (561)..(568): n is a, c, g, or t
  misc_feature (570)..(572): n is a, c, g, or t
  misc_feature (574)..(574): n is a, c, g, or t
  misc_feature (576)..(576): n is a, c, g, or t
  misc_feature (578)..(581): n is a, c, g, or t
  misc_feature (583)..(587): n is a, c, g, or t
  misc_feature (589)..(593): n is a, c, g, or t
  misc_feature (595)..(596): n is a, c, g, or t
  misc_feature (598)..(641): n is a, c, g, or t
  misc_feature (643)..(680): n is a, c, g, or t
  misc_feature (682)..(935): n is a, c, g, or t
  misc_feature (937)..(954): n is a, c, g, or t
  misc_feature (956)..(967): n is a, c, g, or t
  misc_feature (969)..(1021): n is a, c, g, or t
  misc_feature (1023)..(1078): n is a, c, g, or t
  misc_feature (1080)..(1114): n is a, c, g, or t
  misc_feature (1116)..(1117): n is a, c, g, or t
  misc_feature (1119)..(1121): n is a, c, g, or t
  misc_feature (1123)..(1123): n is a, c, g, or t
  misc_feature (1125)..(1126): n is a, c, g, or t
  misc_feature (1129)..(1129): n is a, c, g, or t
  misc_feature (1132)..(1132): n is a, c, g, or t
  misc_feature (1135)..(1135): n is a, c, g, or t
  misc_feature (1138)..(1142): n is a, c, g, or t
  misc_feature (1144)..(1145): n is a, c, g, or t
  misc_feature (1147)..(1160): n is a, c, g, or t
  misc_feature (1162)..(1166): n is a, c, g, or t
  misc_feature (1168)..(1253): n is a, c, g, or t
  misc_feature (1255)..(1327): n is a, c, g, or t
  misc_feature (1329)..(1330): n is a, c, g, or t
  misc_feature (1332)..(1362): n is a, c, g, or t
  misc_feature (1364)..(1365): n is a, c, g, or t
  misc_feature (1367)..(1370): n is a, c, g, or t
  misc_feature (1372)..(1450): n is a, c, g, or t
  misc_feature (1452)..(1461): n is a, c, g, or t
  misc_feature (1463)..(1492): n is a, c, g, or t
  misc_feature (1494)..(1539): n is a, c, g, or t
  misc_feature (1542)..(1542): n is a, c, g, or t
  misc_feature (1544)..(1570): n is a, c, g, or t
  misc_feature (1572)..(1636): n is a, c, g, or t
  misc_feature (1638)..(1642): n is a, c, g, or t
  misc_feature (1644)..(1675): n is a, c, g, or t
  misc_feature (1677)..(1677): n is a, c, g, or t
  misc_feature (1680)..(1681): n is a, c, g, or t
  misc_feature (1684)..(1687): n is a, c, g, or t
  misc_feature (1690)..(1701): n is a, c, g, or t
  misc_feature (1703)..(1704): n is a, c, g, or t
  misc_feature (1707)..(1707): n is a, c, g, or t
  misc_feature (1709)..(1709): n is a, c, g, or t
  misc_feature (1711)..(1714): n is a, c, g, or t
  misc_feature (1716)..(1720): n is a, c, g, or t
  misc_feature (1722)..(1722): n is a, c, g, or t
  misc_feature (1724)..(1727): n is a, c, g, or t
  misc_feature (1729)..(1731): n is a, c, g, or t
  misc_feature (1733)..(1739): n is a, c, g, or t
  misc_feature (1742)..(1743): n is a, c, g, or t
  misc_feature (1745)..(1750): n is a, c, g, or t
  misc_feature (1752)..(1755): n is a, c, g, or t
  misc_feature (1757)..(1757): n is a, c, g, or t
  misc_feature (1761)..(1768): n is a, c, g, or t
  misc_feature (1770)..(1770): n is a, c, g, or t
  misc_feature (1774)..(1774): n is a, c, g, or t
  misc_feature (1776)..(1779): n is a, c, g, or t
  misc_feature (1781)..(1782): n is a, c, g, or t
  misc_feature (1784)..(1787): n is a, c, g, or t
  misc_feature (1789)..(1790): n is a, c, g, or t
  misc_feature (1792)..(1797): n is a, c, g, or t
  misc_feature (1799)..(1799): n is a, c, g, or t
  misc_feature (1805)..(1805): n is a, c, g, or t
  misc_feature (1808)..(1808): n is a, c, g, or t
  misc_feature (1811)..(1811): n is a, c, g, or t
  misc_feature (1816)..(1817): n is a, c, g, or t
  misc_feature (1819)..(1820): n is a, c, g, or t
  misc_feature (1825)..(1825): n is a, c, g, or t
  misc_feature (1828)..(1828): n is a, c, g, or t
  misc_feature (1834)..(1839): n is a, c, g, or t
  misc_feature (1847)..(1852): n is a, c, g, or t
  misc_feature (1854)..(1858): n is a, c, g, or t
  misc_feature (1860)..(1860): n is a, c, g, or t
  misc_feature (1862)..(1863): n is a, c, g, or t
  misc_feature (1869)..(1869): n is a, c, g, or t
  misc_feature (1875)..(1877): n is a, c, g, or t
  misc_feature (1989)..(1989): n is a, c, g, or t
  misc_feature (1995)..(1995): n is a, c, g, or t
  misc_feature (2268)..(2268): n is a, c, g, or t
  misc_feature (3232)..(3232): n is a, c, g, or t
  misc_feature (3410)..(3410): n is a, c, g, or t
  misc_feature (3412)..(3413): n is a, c, g, or t
  misc_feature (3416)..(3416): n is a, c, g, or t
  misc_feature (3419)..(3421): n is a, c, g, or t
  misc_feature (3423)..(3424): n is a, c, g, or t
  misc_feature (3426)..(3432): n is a, c, g, or t
  misc_feature (3434)..(3450): n is a, c, g, or t
  misc_feature (3452)..(3456): n is a, c, g, or t
  misc_feature (3459)..(3462): n is a, c, g, or t
  misc_feature (3464)..(3475): n is a, c, g, or t
  misc_feature (3479)..(3480): n is a, c, g, or t
  misc_feature (3482)..(3483): n is a, c, g, or t
  misc_feature (3485)..(3485): n is a, c, g, or t
  misc_feature (3487)..(3489): n is a, c, g, or t
  misc_feature (3491)..(3498): n is a, c, g, or t
  misc_feature (3500)..(3504): n is a, c, g, or t
  misc_feature (3506)..(3508): n is a, c, g, or t
  misc_feature (3511)..(3517): n is a, c, g, or t
  misc_feature (3519)..(3519): n is a, c, g, or t
  misc_feature (3523)..(3524): n is a, c, g, or t
  misc_feature (3527)..(3527): n is a, c, g, or t
  misc_feature (3530)..(3530): n is a, c, g, or t
  misc_feature (3532)..(3536): n is a, c, g, or t
  misc_feature (3538)..(3547): n is a, c, g, or t
  misc_feature (3550)..(3552): n is a, c, g, or t
  misc_feature (3554)..(3556): n is a, c, g, or t
  misc_feature (3561)..(3568): n is a, c, g, or t
  misc_feature (3570)..(3572): n is a, c, g, or t
  misc_feature (3574)..(3574): n is a, c, g, or t
  misc_feature (3578)..(3578): n is a, c, g, or t
  misc_feature (3580)..(3584): n is a, c, g, or t
  misc_feature (3586)..(3587): n is a, c, g, or t
  misc_feature (3590)..(3590): n is a, c, g, or t
  misc_feature (3593)..(3593): n is a, c, g, or t
  misc_feature (3598)..(3599): n is a, c, g, or t
  misc_feature (3601)..(3603): n is a, c, g, or t
  misc_feature (3607)..(3607): n is a, c, g, or t
  misc_feature (3609)..(3615): n is a, c, g, or t
  misc_feature (3617)..(3629): n is a, c, g, or t
  misc_feature (3631)..(3631): n is a, c, g, or t
  misc_feature (3633)..(3646): n is a, c, g, or t
  misc_feature (3650)..(3653): n is a, c, g, or t
  misc_feature (3655)..(3655): n is a, c, g, or t
  misc_feature (3657)..(3659): n is a, c, g, or t
  misc_feature (3662)..(3662): n is a, c, g, or t
  misc_feature (3665)..(3665): n is a, c, g, or t
  misc_feature (3667)..(3670): n is a, c, g, or t
  misc_feature (3672)..(3698): n is a, c, g, or t
  misc_feature (3701)..(3702): n is a, c, g, or t
  misc_feature (3704)..(3704): n is a, c, g, or t
  misc_feature (3706)..(3711): n is a, c, g, or t
  misc_feature (3713)..(3723): n is a, c, g, or t
  misc_feature (3725)..(3729): n is a, c, g, or t
  misc_feature (3731)..(3732): n is a, c, g, or t
  misc_feature (3735)..(3739): n is a, c, g, or t
  misc_feature (3741)..(3765): n is a, c, g, or t
  misc_feature (3767)..(3772): n is a, c, g, or t
  misc_feature (3774)..(3774): n is a, c, g, or t
  misc_feature (3776)..(3779): n is a, c, g, or t
  misc_feature (3781)..(3781): n is a, c, g, or t
  misc_feature (3783)..(3786): n is a, c, g, or t
  misc_feature (3788)..(3792): n is a, c, g, or t
  misc_feature (3794)..(3798): n is a, c, g, or t
  misc_feature (3800)..(3800): n is a, c, g, or t
  misc_feature (3802)..(3807): n is a, c, g, or t
  misc_feature (3809)..(3823): n is a, c, g, or t
  misc_feature (3825)..(3827): n is a, c, g, or t
  misc_feature (3829)..(3836): n is a, c, g, or t
  misc_feature (3838)..(3863): n is a, c, g, or t
  misc_feature (3865)..(3877): n is a, c, g, or t
  misc_feature (3879)..(3880): n is a, c, g, or t
  misc_feature (3882)..(3882): n is a, c, g, or t
  misc_feature (3884)..(3889): n is a, c, g, or t
  misc_feature (3891)..(3891): n is a, c, g, or t
  misc_feature (3893)..(3893): n is a, c, g, or t
  misc_feature (3895)..(3898): n is a, c, g, or t
  misc_feature (3900)..(3906): n is a, c, g, or t
  misc_feature (3908)..(3914): n is a, c, g, or t
  misc_feature (3916)..(3917): n is a, c, g, or t
  misc_feature (3919)..(3922): n is a, c, g, or t
  misc_feature (3924)..(3943): n is a, c, g, or t
  misc_feature (3945)..(3955): n is a, c, g, or t
  misc_feature (3957)..(3957): n is a, c, g, or t
  misc_feature (3959)..(3960): n is a, c, g, or t
  misc_feature (3962)..(3962): n is a, c, g, or t
  misc_feature (3964)..(3964): n is a, c, g, or t
  misc_feature (3969)..(3970): n is a, c, g, or t
  misc_feature (3972)..(3975): n is a, c, g, or t
  misc_feature (3980)..(3980): n is a, c, g, or t
  misc_feature (3982)..(4000): n is a, c, g, or t
nnnnnnnnnnnnnnnnnnnnnnnnnnnnnnannnnnnnnnnnnnnnnnnnnnnnnnnnnnnnnnnnnnnnnnnnannannannannannannannannanaannannannannanannnnnnnnnnnnnnnnnnnnnnnnnnannnnnnnnnnnnnnnnannannannanannnnnannnnnnnnannnnnnnnnnnannnnnnnnnnnnnnnnannnnnnnnnnnnnnnnnnnnnnnnnnnnnnnnnnnnnnnnnannannnnnnnnnnnnnnnnnnnnnnnnnnnnnnnnnnnnannnnnnnnnnnnnannnnnnnnnnnnnnnnnnnnnnnnnnnnnnnnnnnnnannnnnntnnnnnnnnnnnnnnnnnnnnnnnnnnnnnnnnannanaannannnnnannnnnnnnaannnnnnnnnnannannnnnnnnnnnnnnnnnnnnnnnnnnnnnnnnnnnnnnnnnnnnnnnnnnncnnnnnnnnnnncnnnnnnnnnnnnnnnnnnnnnnnntntnttnnnnnnntnnnnnnnnnnnnnnnnnnnnnnnnnnnnntnnnnnnnntnnntntntnnnntnnnnntnnnnntnntnnnnnnnnnnnnnnnnnnnnnnnnnnnnnnnnnnnnnnnnnnnnannnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnannnnnnnnnnnnannnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnntnntnnncntnntcntcntcntcnnnnncnncnnnnnnnnnnnnnncnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnannannnnnnnnnnnnnnnnnnnnnnnnnnnnnnntnntnnnntnnnnnnnnnnnnnnnnnnnnnnnnnnnnnnnnnnnnnnnnnnnnnnnnnnnnnnnnnnnnnnnnnnnnnnnnnnnnnnntnnnnnnnnnntnnnnnnnnnnnnnnnnnnnnnnnnnnnnnncnnnnnnnnnnnnnnnnnnnnnnnnnnnnnnnnnnnnnnnnnnnnnnaanannnnnnnnnnnnnnnnnnnnnnnnnnnannnnnnnnnnnnnnnnnnnnnnnnnnnnnnnnnnnnnnnnnnnnnnnnnnnnnnnnnnnnnnnnnannnnnannnnnnnnnnnnnnnnnnnnnnnnnnnnnnnnancannagnnnngannnnnnnnnnnntnnttntntnnnnannnnntntnnnnannntnnnnnnnttnntnnnnnncnnnngngggnnnnnnnntnttcntnnnnannannnntnntnnnnnnantagtantantantactnntnnttctnctncttctnnnnnntcttcttnnnnnngnnnnntntnntcatcntcgtcnnnacgaaaagcggcgacgagtaagaataggacgacgacgagaattattcggtgcgaacaacaaacggtgatgcgggaaattaaagtgtgcacgaagaaagagtgcagacgattngggtcncaaaaaacgctcgagtttctggaagcgcgaggagaaaagtttgatttaaaagtcaccgcggtgaagtgcctctcggaatgtgggatgggaccgaacgtggaacttccgtgcggaacaatcttgaacagagtgaaaggagaggagagctgcttgaaagctttggcgagaacggtgaacgaaggcgaggagtgcggcgcatttatgtgacgtaggaagagggtgtgagttcgcgtttaaatccgttgttgttacttcgctgtgtattgttatatntgtattttattttgcctgtttatattgcctgtctacgcgtcatcaacttcttcttcatcgttatcgttttcatcatcactaatgtccgccgccgccgcccgagctttctaacagccctctctccttcaactcatctttcaaaatcttcgcccctgtgaccataaacagcgtctgccaaatgcctaaaccgactcttggaacgatcccgcgaaacaacccgccgacgccgttctctttgacgatgtccttcatcacgctcaccatgctcccggtttcttgtcccaaactccctctggtttgcgcttctattcgagcgacttcaaacggatggttccaacacgccatcgtcccgccaattaccccgcatataacttcttgtcctttcgtcatcttcacttctttcgaatcgacgtccgggtaccaaaccgccttcgctttctcgcgaacgatttcggtgaaaccttgacgactggcccagttcgtcgcctgtcgaaacgcgatggcggttcctcccgggtaaaaccctttcactccagatctcgcgtacgtttcttttattctctccacgctcgatttcccggacggatcgttcaccgcgccggtgactaaatacgtgcacggacccatgacggaaacttgcgcgatccctccaccggcgccggcgagaaccccggcgacgcctggatccacgtcgtttttcaacaaactctcgtttattccctctttcgcgtacatcaatatcgcgcctttcgtcccactttcgaccattttcgccgacgtgcctctccaaaacgcgtgtattccgcctccggatttgtacacgtttttcaacgcctccacagttccttccgttcggtgtcttcccattcgtgttttccagacttcgaaaggcatgcctaaagacgccgcttcggccatttggatagccggaccgatgatgatatcaatcgcaggcattttatantatttatttgtgtgtgtgctcttctatgatctatctttattaaactactatagtgtgtaagtgttaagtgtgtacgactaatgtggaaagacttgtctgttcgtttgttttcataaaagtatatagaaaattttacattttgctgctaaaaaaaagtaatacaaagagaacctccttncnntcntcnnntnnannnnnnnannnnnnnnnnnnnnnnncnnnnntgnnnnannnnnnnnnnnngttnntnntntnnntnnnnnnnntnnnnnannnatnnnnnnntntatnntanatntnnnnncnnnnnnnnnnttnnnannnaaaannnnnnnncnnncngcgncnnnnnannaanaanaaaanntnnntccncnnnnnnnannnnnnnnnnnnncncnnnnnnnnnnnnnntctnnnntntnnntcnttntnnnntnnnnnnnnnnnnnnnnnnnnnnnnnnnaanncncnnnnnncnnnnnnnnnnncnnnnncnnccnnnnncnnnnnnnnnnnnnnnnnnnnnnnnncnnnnnncncnnnncncnnnntnnnnncnnnnncncnnnnnncnnnnnnnnnnnnnnncnnntnnnnnnnntnnnnnnnnnnnnnnnnnnnnnnnnnncnnnnnnnnnnnnncnncncnnnnnncncncnnnncnnnnnnncnnnnnnncnncnnnncnnnnnnnnnnnnnnnnnnnncnnnnnnnnnnntntnntntntttcnntnnnntctcncnnnnnnnnnnnnnnnnnnn

SEQ ID NO: 983 - DNA, 4000 bp, Escherichia coli
  misc_feature (2)..(4): n is a, c, g, or t
  misc_feature (7)..(7): n is a, c, g, or t
  misc_feature (10)..(10): n is a, c, g, or t
  misc_feature (13)..(13): n is a, c, g, or t
  misc_feature (18)..(20): n is a, c, g, or t
  misc_feature (30)..(30): n is a, c, g, or t
  misc_feature (38)..(39): n is a, c, g, or t
  misc_feature (42)..(42): n is a, c, g, or t
  misc_feature (45)..(50): n is a, c, g, or t
  misc_feature (54)..(64): n is a, c, g, or t
  misc_feature (67)..(67): n is a, c, g, or t
  misc_feature (74)..(74): n is a, c, g, or t
  misc_feature (83)..(84): n is a, c, g, or t
  misc_feature (181)..(181): n is a, c, g, or t
  misc_feature (286)..(286): n is a, c, g, or t
  misc_feature (307)..(307): n is a, c, g, or t
  misc_feature (421)..(421): n is a, c, g, or t
  misc_feature (460)..(460): n is a, c, g, or t
  misc_feature (880)..(880): n is a, c, g, or t
  misc_feature (916)..(916): n is a, c, g, or t
  misc_feature (948)..(948): n is a, c, g, or t
  misc_feature (1141)..(1141): n is a, c, g, or t
  misc_feature (1596)..(1596): n is a, c, g, or t
  misc_feature (1644)..(1644): n is a, c, g, or t
  misc_feature (1971)..(1971): n is a, c, g, or t
  misc_feature (2353)..(2353): n is a, c, g, or t
  misc_feature (2520)..(2520): n is a, c, g, or t
  misc_feature (2992)..(2992): n is a, c, g, or t
annnaanttnttnaaggnnntttaaaattnttttgggnnaanttnnnnnntttnnnnnnnnnnnaanttttaanttttttaannaaaaaattaagaaagaactggaattgtaaactctggaccactattatcttccgaccatgttactgttgcagttttcaatttagtatagaatcttacnccttcaggaccatgcatagaatgatccccaaataatgatctcttccaaccaccaaagctatggtacgcaacaggtacaggaatgggaacatttactcctatcatnccaatttttgcattttcagtnaaatgttttgctatcataccactttttgtaaatacagcagctccatttcctaattcatgatcattgactaattttaaagcttcttcataagtatctgttgtcatcatgctgagnactggaccaaaaatttcttctttataaattttcatatcnggttttacatcttcaaaaatggtaggacctacaaaatatccattctcatacccttgtagtttcatatttcttccatctgcaagaagcttagctccttctttttcacccgtatctatgtatcccaaaactttttcatagtgagctttgttattaagtgggccaaaatcacttttttcgtctgtgtatggtccaacatttagttttagtgtttcttctaataatttagtttttaaattttcagcagtcttttttcctacacaaacagcaacagaaatagccatacatctctcaccagcagacccaaaagcagagcctataatagcgtctgttgttttattaacatctgcgtcaggcatcacaaccatatggtttttagctccaccaagagcttgaactcttttattgttttttgttcctgtntgataaacatattccgcaattggagtcgaacctacnaaactaatcgcttgaacatctttactctctantagagtatcaacagattctttatcaccatttacaacatttaaaacacccggtggcataccagcttcaatagctaattctccaagtctaattggacaactcggatctttttctgatggtttaagtacaaaagtatttccacatgcaatagcaactgggtacatccacataggtaccattgctggaaaattaaanggagtaattccagcacaaacacccaagggctgtctcattgaataagagtcaacattagttcccacacttgcagagtgatctccttttaaagaatcggtgataccagttgcatactcaacaacttcaattcctctttgaatagaaccttttgcatctggaatagtttttccatgttgttcggaaaccattacagccatatcttccatattttttattaataaatctttatattttgctaaaattcttgctctgtttataggtgtggttttagaccattttaaaaaagctttcttagagctctctatagccatttcaacagtagctttacttgctaattcaacttctgctatttgttctccaatagcggggttaaaaattggaccggttctagaatcttttacagtaaaaacttttccatcaatgaaatgactaacttttttcatacttctcctttnatatataatttaaagttatactagctcaattttctttgcaatatattnttccttaaatgagaaaaatattatcaattaaaagctttcagttgttgactcctaaaattacttaagtttagattaagcattaacaaattagatgaaaagagagaggaccgtttgattaaaagagaaaatgttcgtatttgtgttcctagatacttgcaaattggcaagggtagcttgaatgaactccctgatataataaaaattttaggatctataaaatcattactaattgtaactgataaacaaatggtatcatttggttatgtaaaaaaactacaagatgttttaactaaagcaggattaaattctgatgtttttgatgacacngttcctgatccaacagactcagtagttttaaatggaattaaatttttagaaaaatgtaaaaatgatgccgtaattggttttggtggaggaagtccaatagatactgcaaaagcaatagccgcaatggctaaatttagtaaaaatattcaagattataagccaccatcaatgtttgataaaaagggtcttccaataattgcaatccctactacagctggtacaggctcggaagtaacacatcacgcagtagttatagactcaaataataatgaaaaaatttcttgtagaggagaaggatttgtccctatagttgcaattgttgattatgatttaactttatcgaaacccagaagattaactattgatagcgcaattgacactntaactcatggaatagaagcatacgtaagcaaaaaagccacactcttttctgatcgaatggctttagacacaataagacttgttacccaaaatatttatgcagttgataaaaatccaaaagatttaaaagcaagagaaggcttaatgttagctgctacattaggaggnttagcattttccaatgcttcaatatgtttggtgcatggaatgagtaggccgctaggtagtaatttcaaagttcctcatggacttagtaatgcaatgttactaccaactataactaaattttcgatagatcatgcaaaaagtagatatgcagattgtagtcgtgctggagattttgcactacctggtgacaatgatgatgtggcctgtgataaattgattaaaggtctgtacaaaattaataatgattttgaagttccatcaatgcaaaattttggaattaatcaaaaaaattttgaggaagagttaaaaaatatggcaactgatgcagaaaattcaggggcgccaaacctcaatccgagagtgccttctgtaaatgagatggtagatctttacagacaagcatggagagcattttaaaatgagttggaaatgcacttcttttagacgaacaactcgaaacaaaagagagggnaaaaatatgatagataaatcaaaatcactaatgaaatcgttcgttagtattttggctgtatttgctttaatgataactttttcatttcagcaggtaaatgcagctgaaaaaatcagatggaaagtacaatctactttcaatactggttggccagcgctgggtgacccagttgctcgtttagcagacactttagataaagctacagatggaagaataaaattaaaggtttatgagcctggaaaaattcttcctccattagagatctcaccatcaattagtaaaggtgatttgcctgcagcttataactatatggcttatgaccaaggtagaattccagcggccgttttatttgcggcagtaccgttcggaatggaaccatgggagtatgctgcatggtggtttgaaggagaaggttcaaagttagcaaatgaaatttacaacaagcaaaatattaaagttttgttatgtagtacaattggacctgaaactgctggttggtatagaaatccaatcacaagtttagatgatcttaaaggtttaaaaattcgtttctcaggattaggaggaatggttttaaatgaaataggagcatctgcaactttaatggccggtggtgaaatttttgctgctttagaaaaaggaactctagatgcaacagaatattcgatgccagcaattgatgaagttcttggttttcacaaaattactaagttcaacttgtttccaggttggcaccaagtatcaacatctactcacttcatggtcaacttagacttatggaaaaaaatgggtgcagctgaccaagctttattcgaaatggcttgtacagcagcagctatgagagcaattacaactggtgaatttttacaaggaaaacaaattgcaagtttcccttctaaaggtgtaacagctgctagattgcctgatagtgtattgagagaacttcaaaaagttagtgcaaaagttatggcagaacagtctgctaaagatgctgactttaaaaaagtt

SEQ ID NO: 984 - DNA, 4000 bp, Escherichia coli
  misc_feature (241)..(241): n is a, c, g, or t
  misc_feature (311)..(311): n is a, c, g, or t
  misc_feature (904)..(904): n is a, c, g, or t
  misc_feature (948)..(948): n is a, c, g, or t
  misc_feature (1290)..(1290): n is a, c, g, or t
  misc_feature (1299)..(1299): n is a, c, g, or t
  misc_feature (1386)..(1386): n is a, c, g, or t
  misc_feature (1422)..(1422): n is a, c, g, or t
  misc_feature (1449)..(1449): n is a, c, g, or t
  misc_feature (1479)..(1479): n is a, c, g, or t
attcttagacgacatgcatcgtccagcgcttccatacaaaatgaaatttaaagtttcaggttgtgcgaacgattgtatgaattcagttcaacgtgctgactttgccgtgattggtacttggagagacgacattaaaatcaaccaagatttatggaagaaaatggttgccgataaaggtactcaatacgtggttgataacatcacttctcgttgtcctacttcagcgatgactttaaatgangacagttctttaaccatcgataataagaactgtgtgaaatgtatgcattgtttaaatgcaacttcacctntgactcataactacattgctaaaggtgatatagagcctatcttagcaacgggtgacgacaaaggcgttagcattatcatgggtggtaagcgtacactgaaaattggtgacttatttggcacagtggttgttccatttatgaaactagagactgaagacgattacgaagaaatcgaagaattagccggtgaagtgattgacttttttgctgaaaacgcactagagcatgaaagaacaggtgaaatgatcgagcgtattggcattgtaaacttccttgatggcattggtcttaaggttgatcctaacatggttaactcgactcgtactatctcttatgttcgtatggaccaatgggatgaagaagctgttaagtggtttgaaaacaaagccgaagcaagcgcgtaatttaattttaaagaacaatacacggagaaaatattatggctgaagcaccaagaatgccaatcgaatcaggttgccctgatcctattcaatacatgcacccaaccatgcgtcgtaactacggccaatgggcttatcacgatcgtccacgtccaggtgtattgcaccacacttcaaagaacagtgaagaantttggacagttcgttgtggtactgcacgtcaaatggatgttcanacgattaaaaaattagctgatattgctgatgagtttgccgatggctacgttcgttttaccatgcgctcaaacgttgagtacatggtggctgatgaagctaaagttgaaccactgattaaaacattaacagacgctggtttcccagtgggtggtactggtccatcagtgactatgatttcacacactcaaggctggttacactgtgatattccaggtactgatgcatcaggcgtggttaaatcattaatggacgatttacacgaagagtacattaaagaagaaatgccaaaccgtgtacacatgactacctcttgttgtcaaattaactgtggtggtcaaggngatatcgcncttaacattcaacacactaagccacctaagattaatcatgatttagtggctaacgtttgtgagcgtccaacggttgttgcacgttgnccagtagcggcgattcgtcctgcgatggtaaacggnaaacctactttggaagttgatgagaanaaatgtatctgttgtggtgcatgtttcccnccgtgtcctccaatgcaaattaacgatcctgagcattctaagattgcagtatggattggtggcaagaactctaacgcaagaagcaagccttctttccacaagttagtagcgtctaaccttcctaataacccaccaagatggccggaagttggtgccgttgttaagaaaattttaggtgtttataaagaagatgctcgtgattgggaaagaatgggtgagtgggttgaccgtattggttggccagcgttctttgaaaagaccggtttgccgtttactaaattccacatctctgattggaaaggtacacgtcaccagttgaattcttctgcacacattcgtttctaggcaattaataagatatgaaaatttctattcaaattaacgaaggcccgtatcagcaccaagcgtctgatacggcgtatcaatttgccaaagcggcgattgacaaagggcacgagattttccgtgtatttttctatcatgacggcgtaaataatgcatcacgctttaccttgccaccgcaagatgatcgtaacgttgtaaaccaatgggccgaattaggcattaagaatgccgatggcgagcctgagcttgtggtttgtattgcagcagcgcttcgtcgcggcatgcttgacgagtctgaagccagtaagaatggcattgatggtaataatattcatcctgcgttccgtatttctggcttgggtcagttgattgaggccggtattcaatcggatcgtttagtggtatttggagattaagatggcaataaagaaatttatgtatttaaatcgtaaggcttcttacggcactgtgtacgccattgaatctttagaagtggtgttaatcgctgcagcgtttgagcaagatgtatctttagcttttgttgacgatggtgtttatcaaatcgtagaaggtcaaaatacggatggtattggcatgaaaaatttttctaaaacctatcatgcattaggtgattacgacattaacaaactttatgtatccgctgaatctctagaagaaagaggcttgactgaagcagatcttatgcctttggtgtatgaagatgaagacgatgattgggcagaaaaaccttcgattaaggttgtgtctaatgctgatcttacaaaaatcatgtctgagcaagacgtttgtttaagtttttaaaggatatttaatatgctacacacagtaaataaatcatctttcgagcgtaattcattacagtcttgtcttaatattattgatgacactagtgtcatcttattgattgaagacggtgtaatttccgctgcgaataatgctaactcatccatgctagctgaacttgccacacaaggtagagtttatgcattgcaaggcgatgtggaagcaagaggaatttcatcaaaagttgcagataatatcaaattagttgattatgcaggttttgttgatttagttgttgaacacggaactgcggtttcttgggtttaacgtaatttatatataggagtaaaactatggctgatattttaggcgcagaagtagacgaagaaggttttttagtaaaccttagtgattggacaaaagaaattgccgatagtatggcaaaagacgatgacattgaattgtctgaagagcattgggatgttattaatttcttacgtgattattttgaagagtatcaaattgcaccagcagtacgtgtactaacgaaagcaattggtaaaaaattcggtaaagaaaaaggtaactctaagtacttgtattctttattcccttatggtcctggtaagcaaggttgtcgtttcgccggtcttccaaagccaacgggctgtatctaaacgatacaaagcactgaaaacacctgccttggtaggtgtttttatcttatttaacacattgagtttgagagcaatatgtctgcaataagcattttttttacggctttattttacatttcattatttgtattccttattggaatggcaagaaaaatctatcagtattggattacgccagctcctttaaagatccctactgcaccaaccccattaacacaaacaggtgtggttatgcgcatggctcgcgaagtagtcttgttcgaaagtttatttaaatccaacaaatggacttggctgttcggttggttgtttcacattggtttattgttagtactagttcgtcatgtccgatatttttggccgggtgatttacctgagatttttttattaattcaaccgtttaaatacgcagcctttgcgatggtgattggcttgacaggacttatgggtcgccgtatttttgttgaacgtattcgttacatttcagcaccatcggattatttaatgctaattttattgctgattattggcgtgagtggcgtggtaatgacctttaccagtaatcatactgatgtgatgatggtgaaagagtttgcttcgggattgatcgctttcccatggattggttggtcaaacttaccaacagaagtgcactttttaactcatattttcttagtatttgtgctgatggcaat

SEQ ID NO: 985 - DNA, 4000 bp, Escherichia coli
  misc_feature (160)..(160): n is a, c, g, or t
  misc_feature (313)..(313): n is a, c, g, or t
  misc_feature (377)..(377): n is a, c, g, or t
  misc_feature (400)..(400): n is a, c, g, or t
  misc_feature (403)..(403): n is a, c, g, or t
  misc_feature (796)..(796): n is a, c, g, or t
  misc_feature (982)..(982): n is a, c, g, or t
  misc_feature (1223)..(1223): n is a, c, g, or t
  misc_feature (1337)..(1337): n is a, c, g, or t
  misc_feature (1985)..(1985): n is a, c, g, or t
  misc_feature (1991)..(1991): n is a, c, g, or t
  misc_feature (2041)..(2041): n is a, c, g, or t
  misc_feature (2141)..(2141): n is a, c, g, or t
  misc_feature (2198)..(2198): n is a, c, g, or t
  misc_feature (2200)..(2200): n is a, c, g, or t
  misc_feature (2294)..(2294): n is a, c, g, or t
  misc_feature (2306)..(2306): n is a, c, g, or t
  misc_feature (2315)..(2315): n is a, c, g, or t
  misc_feature (2687)..(2687): n is a, c, g, or t
  misc_feature (2722)..(2722): n is a, c, g, or t
  misc_feature (2726)..(2727): n is a, c, g, or t
  misc_feature (2729)..(2732): n is a, c, g, or t
  misc_feature (2734)..(2735): n is a, c, g, or t
  misc_feature (2737)..(2737): n is a, c, g, or t
  misc_feature (2740)..(2741): n is a, c, g, or t
  misc_feature (2743)..(2743): n is a, c, g, or t
  misc_feature (2745)..(2746): n is a, c, g, or t
  misc_feature (2748)..(2749): n is a, c, g, or t
  misc_feature (2751)..(2752): n is a, c, g, or t
  misc_feature (2756)..(2761): n is a, c, g, or t
  misc_feature (2764)..(2768): n is a, c, g, or t
  misc_feature (2770)..(2771): n is a, c, g, or t
  misc_feature (2773)..(2776): n is a, c, g, or t
  misc_feature (2779)..(2781): n is a, c, g, or t
  misc_feature (2783)..(2785): n is a, c, g, or t
  misc_feature (2787)..(2789): n is a, c, g, or t
  misc_feature (2791)..(2794): n is a, c, g, or t
  misc_feature (2796)..(2797): n is a, c, g, or t
  misc_feature (2799)..(2803): n is a, c, g, or t
  misc_feature (2805)..(2810): n is a, c, g, or t
  misc_feature (2812)..(2812): n is a, c, g, or t
  misc_feature (2814)..(2814): n is a, c, g, or t
  misc_feature (2817)..(2821): n is a, c, g, or t
  misc_feature (2823)..(2823): n is a, c, g, or t
  misc_feature (2826)..(2827): n is a, c, g, or t
  misc_feature (2829)..(2832): n is a, c, g, or t
  misc_feature (2834)..(2840): n is a, c, g, or t
  misc_feature (2845)..(2845): n is a, c, g, or t
  misc_feature (2847)..(2851): n is a, c, g, or t
  misc_feature (2853)..(2863): n is a, c, g, or t
  misc_feature (2867)..(2872): n is a, c, g, or t
  misc_feature (2875)..(2876): n is a, c, g, or t
  misc_feature (2881)..(2881): n is a, c, g, or t
  misc_feature (2883)..(2884): n is a, c, g, or t
  misc_feature (2886)..(2890): n is a, c, g, or t
  misc_feature (2892)..(2894): n is a, c, g, or t
  misc_feature (2896)..(2896): n is a, c, g, or t
  misc_feature (2898)..(2898): n is a, c, g, or t
  misc_feature (2900)..(2902): n is a, c, g, or t
  misc_feature (2904)..(2906): n is a, c, g, or t
  misc_feature (2909)..(2910): n is a, c, g, or t
  misc_feature (2912)..(2917): n is a, c, g, or t
  misc_feature (2919)..(2919): n is a, c, g, or t
  misc_feature (2921)..(2923): n is a, c, g, or t
  misc_feature (2925)..(2931): n is a, c, g, or t
  misc_feature (2933)..(2935): n is a, c, g, or t
  misc_feature (2937)..(2938): n is a, c, g, or t
  misc_feature (2940)..(2940): n is a, c, g, or t
  misc_feature (2943)..(2945): n is a, c, g, or t
  misc_feature (2947)..(2949): n is a, c, g, or t
  misc_feature (2952)..(2958): n is a, c, g, or t
  misc_feature (2960)..(2969): n is a, c, g, or t
  misc_feature (2972)..(2977): n is a, c, g, or t
  misc_feature (2979)..(2981): n is a, c, g, or t
  misc_feature (2983)..(2986): n is a, c, g, or t
  misc_feature (2988)..(2990): n is a, c, g, or t
  misc_feature (2992)..(2994): n is a, c, g, or t
  misc_feature (2996)..(2998): n is a, c, g, or t
  misc_feature (3000)..(3001): n is a, c, g, or t
  misc_feature (3005)..(3006): n is a, c, g, or t
  misc_feature (3008)..(3010): n is a, c, g, or t
  misc_feature (3012)..(3013): n is a, c, g, or t
  misc_feature (3016)..(3017): n is a, c, g, or t
  misc_feature (3019)..(3020): n is a, c, g, or t
  misc_feature (3023)..(3024): n is a, c, g, or t
  misc_feature (3028)..(3028): n is a, c, g, or t
  misc_feature (3031)..(3038): n is a, c, g, or t
  misc_feature (3040)..(3040): n is a, c, g, or t
  misc_feature (3042)..(3043): n is a, c, g, or t
  misc_feature (3046)..(3047): n is a, c, g, or t
  misc_feature (3053)..(3057): n is a, c, g, or t
  misc_feature (3061)..(3062): n is a, c, g, or t
  misc_feature (3065)..(3067): n is a, c, g, or t
  misc_feature (3070)..(3073): n is a, c, g, or t
  misc_feature (3075)..(3076): n is a, c, g, or t
  misc_feature (3079)..(3082): n is a, c, g, or t
  misc_feature (3084)..(3085): n is a, c, g, or t
  misc_feature (3087)..(3088): n is a, c, g, or t
  misc_feature (3090)..(3090): n is a, c, g, or t
  misc_feature (3092)..(3092): n is a, c, g, or t
  misc_feature (3094)..(3101): n is a, c, g, or t
  misc_feature (3103)..(3103): n is a, c, g, or t
  misc_feature (3106)..(3113): n is a, c, g, or t
  misc_feature (3115)..(3119): n is a, c, g, or t
  misc_feature (3121)..(3121): n is a, c, g, or t
  misc_feature (3123)..(3126): n is a, c, g, or t
  misc_feature (3128)..(3130): n is a, c, g, or t
  misc_feature (3132)..(3135): n is a, c, g, or t
  misc_feature (3137)..(3139): n is a, c, g, or t
  misc_feature (3141)..(3141): n is a, c, g, or t
  misc_feature (3143)..(3143): n is a, c, g, or t
  misc_feature (3145)..(3146): n is a, c, g, or t
  misc_feature (3148)..(3148): n is a, c, g, or t
  misc_feature (3150)..(3150): n is a, c, g, or t
  misc_feature (3152)..(3152): n is a, c, g, or t
  misc_feature (3154)..(3155): n is a, c, g, or t
  misc_feature (3157)..(3158): n is a, c, g, or t
  misc_feature (3160)..(3161): n is a, c, g, or t
  misc_feature (3163)..(3168): n is a, c, g, or t
  misc_feature (3170)..(3170): n is a, c, g, or t
  misc_feature (3172)..(3172): n is a, c, g, or t
  misc_feature (3175)..(3176): n is a, c, g, or t
  misc_feature (3178)..(3183): n is a, c, g, or t
  misc_feature (3186)..(3186): n is a, c, g, or t
  misc_feature (3188)..(3190): n is a, c, g, or t
  misc_feature (3192)..(3194): n is a, c, g, or t
  misc_feature (3196)..(3196): n is a, c, g, or t
  misc_feature (3201)..(3201): n is a, c, g, or t
  misc_feature (3203)..(3208): n is a, c, g, or t
  misc_feature (3210)..(3213): n is a, c, g, or t
  misc_feature (3215)..(3217): n is a, c, g, or t
  misc_feature (3219)..(3223): n is a, c, g, or t
  misc_feature (3225)..(3234): n is a, c, g, or t
  misc_feature (3236)..(3236): n is a, c, g, or t
  misc_feature (3238)..(3238): n is a, c, g, or t
  misc_feature (3241)..(3241): n is a, c, g, or t
  misc_feature (3245)..(3246): n is a, c, g, or t
  misc_feature (3248)..(3248): n is a, c, g, or t
  misc_feature (3253)..(3254): n is a, c, g, or t
  misc_feature (3259)..(3261): n is a, c, g, or t
  misc_feature (3263)..(3265): n is a, c, g, or t
  misc_feature (3268)..(3273): n is a, c, g, or t
  misc_feature (3275)..(3278): n is a, c, g, or t
  misc_feature (3280)..(3281): n is a, c, g, or t
  misc_feature (3283)..(3287): n is a, c, g, or t
  misc_feature (3290)..(3293): n is a, c, g, or t
  misc_feature (3296)..(3297): n is a, c, g, or t
  misc_feature (3300)..(3304): n is a, c, g, or t
  misc_feature (3308)..(3313): n is a, c, g, or t
  misc_feature (3317)..(3317): n is a, c, g, or t
  misc_feature (3319)..(3319): n is a, c, g, or t
  misc_feature (3321)..(3324): n is a, c, g, or t
  misc_feature (3327)..(3332): n is a, c, g, or t
  misc_feature (3334)..(3338): n is a, c, g, or t
  misc_feature (3340)..(3344): n is a, c, g, or t
  misc_feature (3346)..(3346): n is a, c, g, or t
  misc_feature (3348)..(3348): n is a, c, g, or t
  misc_feature (3350)..(3357): n is a, c, g, or t
  misc_feature (3364)..(3365): n is a, c, g, or t
  misc_feature (3367)..(3367): n is a, c, g, or t
  misc_feature (3369)..(3374): n is a, c, g, or t
  misc_feature (3377)..(3377): n is a, c, g, or t
  misc_feature (3379)..(3380): n is a, c, g, or t
  misc_feature (3383)..(3386): n is a, c, g, or t
  misc_feature (3388)..(3389): n is a, c, g, or t
  misc_feature (3391)..(3391): n is a, c, g, or t
  misc_feature (3393)..(3393): n is a, c, g, or t
  misc_feature (3397)..(3404): n is a, c, g, or t
  misc_feature (3406)..(3410): n is a, c, g, or t
  misc_feature (3412)..(3412): n is a, c, g, or t
  misc_feature (3414)..(3418): n is a, c, g, or t
  misc_feature (3421)..(3421): n is a, c, g, or t
  misc_feature (3423)..(3423): n is a, c, g, or t
  misc_feature (3425)..(3432): n is a, c, g, or t
  misc_feature (3434)..(3435): n is a, c, g, or t
  misc_feature (3437)..(3437): n is a, c, g, or t
  misc_feature (3439)..(3440): n is a, c, g, or t
  misc_feature (3442)..(3442): n is a, c, g, or t
  misc_feature (3444)..(3444): n is a, c, g, or t
  misc_feature (3446)..(3449): n is a, c, g, or t
  misc_feature (3451)..(3453): n is a, c, g, or t
  misc_feature (3456)..(3458): n is a, c, g, or t
  misc_feature (3460)..(3469): n is a, c, g, or t
  misc_feature (3471)..(3474): n is a, c, g, or t
  misc_feature (3477)..(3482): n is a, c, g, or t
  misc_feature (3484)..(3484): n is a, c, g, or t
  misc_feature (3490)..(3493): n is a, c, g, or t
  misc_feature (3495)..(3495): n is a, c, g, or t
  misc_feature (3497)..(3497): n is a, c, g, or t
  misc_feature (3499)..(3499): n is a, c, g, or t
  misc_feature (3501)..(3502): n is a, c, g, or t
  misc_feature (3504)..(3507): n is a, c, g, or t
  misc_feature (3509)..(3510): n is a, c, g, or t
  misc_feature (3512)..(3527): n is a, c, g, or t
  misc_feature (3529)..(3530): n is a, c, g, or t
  misc_feature (3532)..(3532): n is a, c, g, or t
  misc_feature (3535)..(3536): n is a, c, g, or t
  misc_feature (3538)..(3540): n is a, c, g, or t
  misc_feature (3543)..(3548): n is a, c, g, or t
  misc_feature (3551)..(3554): n is a, c, g, or t
  misc_feature (3556)..(3557): n is a, c, g, or t
  misc_feature (3560)..(3567): n is a, c, g, or t
  misc_feature (3569)..(3569): n is a, c, g, or t
  misc_feature (3571)..(3579): n is a, c, g, or t
  misc_feature (3583)..(3591): n is a, c, g, or t
  misc_feature (3596)..(3606): n is a, c, g, or t
  misc_feature (3608)..(3611): n is a, c, g, or t
  misc_feature (3615)..(3622): n is a, c, g, or t
  misc_feature (3628)..(3631): n is a, c, g, or t
  misc_feature (3634)..(3638): n is a, c, g, or t
  misc_feature (3640)..(3643): n is a, c, g, or t
  misc_feature (3645)..(3648): n is a, c, g, or t
  misc_feature (3652)..(3657): n is a, c, g, or t
  misc_feature (3660)..(3662): n is a, c, g, or t
  misc_feature (3664)..(3667): n is a, c, g, or t
  misc_feature (3670)..(3670): n is a, c, g, or t
  misc_feature (3674)..(3676): n is a, c, g, or t
  misc_feature (3678)..(3678): n is a, c, g, or t
  misc_feature (3680)..(3683): n is a, c, g, or t
  misc_feature (3685)..(3686): n is a, c, g, or t
  misc_feature (3688)..(3688): n is a, c, g, or t
  misc_feature (3691)..(3691): n is a, c, g, or t
  misc_feature (3693)..(3693): n is a, c, g, or t
  misc_feature (3695)..(3696): n is a, c, g, or t
  misc_feature (3698)..(3698): n is a, c, g, or t
  misc_feature (3702)..(3703): n is a, c, g, or t
  misc_feature (3705)..(3706): n is a, c, g, or t
  misc_feature (3709)..(3710): n is a, c, g, or t
  misc_feature (3714)..(3716): n is a, c, g, or t
  misc_feature (3718)..(3721): n is a, c, g, or t
  misc_feature (3728)..(3728): n is a, c, g, or t
  misc_feature (3730)..(3730): n is a, c, g, or t
  misc_feature (3733)..(3734): n is a, c, g, or t
  misc_feature (3736)..(3739): n is a, c, g, or t
  misc_feature (3741)..(3741): n is a, c, g, or t
  misc_feature (3744)..(3744): n is a, c, g, or t
  misc_feature (3746)..(3749): n is a, c, g, or t
  misc_feature (3751)..(3751): n is a, c, g, or t
  misc_feature (3753)..(3753): n is a, c, g, or t
  misc_feature (3755)..(3756): n is a, c, g, or t
  misc_feature (3760)..(3762): n is a, c, g, or t
  misc_feature (3765)..(3766): n is a, c, g, or t
  misc_feature (3768)..(3771): n is a, c, g, or t
  misc_feature (3774)..(3776): n is a, c, g, or t
  misc_feature (3780)..(3781): n is a, c, g, or t
  misc_feature (3783)..(3783): n is a, c, g, or t
  misc_feature (3786)..(3787): n is a, c, g, or t
  misc_feature (3789)..(3791): n is a, c, g, or t
  misc_feature (3793)..(3794): n is a, c, g, or t
  misc_feature (3796)..(3800): n is a, c, g, or t
  misc_feature (3803)..(3806): n is a, c, g, or t
  misc_feature (3808)..(3811): n is a, c, g, or t
  misc_feature (3813)..(3814): n is a, c, g, or t
  misc_feature (3816)..(3817): n is a, c, g, or t
  misc_feature (3820)..(3821): n is a, c, g, or t
  misc_feature (3823)..(3828): n is a, c, g, or t
  misc_feature (3834)..(3836): n is a, c, g, or t
  misc_feature (3840)..(3841): n is a, c, g, or t
  misc_feature (3843)..(3850): n is a, c, g, or t
  misc_feature (3852)..(3853): n is a, c, g, or t
  misc_feature (3855)..(3855): n is a, c, g, or t
  misc_feature (3857)..(3857): n is a, c, g, or t
  misc_feature (3859)..(3862): n is a, c, g, or t
  misc_feature (3865)..(3865): n is a, c, g, or t
  misc_feature (3867)..(3867): n is a, c, g, or t
  misc_feature (3870)..(3870): n is a, c, g, or t
  misc_feature (3873)..(3875): n is a, c, g, or t
  misc_feature (3877)..(3879): n is a, c, g, or t
  misc_feature (3882)..(3883): n is a, c, g, or t
  misc_feature (3887)..(3889): n is a, c, g, or t
  misc_feature (3891)..(3891): n is a, c, g, or t
  misc_feature (3893)..(3893): n is a, c, g, or t
  misc_feature (3895)..(3896): n is a, c, g, or t
  misc_feature (3898)..(3898): n is a, c, g, or t
  misc_feature (3901)..(3901): n is a, c, g, or t
  misc_feature (3903)..(3909): n is a, c, g, or t
  misc_feature (3911)..(3913): n is a, c, g, or t
  misc_feature (3915)..(3918): n is a, c, g, or t
  misc_feature (3920)..(3920): n is a, c, g, or t
  misc_feature (3922)..(3923): n is a, c, g, or t
  misc_feature (3925)..(3927): n is a, c, g, or t
  misc_feature (3929)..(3931): n is a, c, g, or t
  misc_feature (3934)..(3936): n is a, c, g, or t
  misc_feature (3938)..(3944): n is a, c, g, or t
  misc_feature (3947)..(3950): n is a, c, g, or t
  misc_feature (3952)..(3952): n is a, c, g, or t
  misc_feature (3955)..(3958): n is a, c, g, or t
  misc_feature (3961)..(3962): n is a, c, g, or t
  misc_feature (3964)..(3964): n is a, c, g, or t
  misc_feature (3966)..(3968): n is a, c, g, or t
  misc_feature (3970)..(3977): n is a, c, g, or t
  misc_feature (3979)..(3981): n is a, c, g, or t
  misc_feature (3983)..(3991): n is a, c, g, or t
  misc_feature (3993)..(3997): n is a, c, g, or t
  misc_feature (3999)..(4000): n is a, c, g, or t
aaatggtctcattaaaaaatatcttgtaaagctttctaatcagattttagttcaagaaaatgattttattaaagctggtatgccaatgtcagatggatctattactccaaacgatatattaaacatcaaagggccttcagctgttcaacaatacttagtnaatgaagttcaagaagtttaccgattacaaggtgtaaagataaatgataaacacttcgaagttgttgtaagacaaatgatgagaaaagtaagaatccaagattctggagatactatatttttagaagaccaattagctcacaaatcagatttnattcaagaaaatgattctatatttggtatgaaagtaattgaagattctggtgaatctgaaaacntaaaagcaggtcaaataatatcngcncgagaattaagggatgaaaattcaatccttaaaagagaagacaaaaagttagttgttgctagagatgcaagtccagcgactgctactccaattcttcaaggaattacaagagcttcattacaaaccaaatcatttatttctgctgcctctttccaagagactactaaagttttaaatgagtcggctgttaatggtagaattgataatttagaaggcttaaaagaaaatgttatcgttggtcatagaattcctgcaggaaccggattacgtaaatatgaagatattttagttggttctaaagaggaaattgaagaacttaataaggttaaagaagaagaagaattaaatattaattaattataatttttcatgagtaacaacgatagtaaaccnaagtctaatataaacattgaaattgatgaaaaaatagctgaaggaacatattcaaatctagctattattaatcattccgtttcagagtttgttttagactttatatgtattatgcctggtacccctaaaaataaggttaaatcaagaattattatcacccctcagcatgctaaacgtttagtaaangctttgaatgataatgttgttagatttgaaaagaaacacggagaaattaaagaaaatcaacagccaccaaatgtccagcttaattttggacaaacaggtgaagcgtaagttttaaaactctgatgaattgtgaaattgtatagttgggtatttttcaatagtcatatttaatgaaaatacagagtcagctaagaacactagattaccgttcttatctttagctaaatatctctgttttatncttttaaactccataaactcatctccttttttgtttttacactcaatccagcatgctttaaatacatttaggttttcatagctacatttagctccatattcgtgttctagcctntactgaataacttcgtactgtagagctccaacagtgccaatgacttttctaccgtttagatctagtgtaaatagttgtgcaacaccctcatccatcaattggttaatcccttttgatagttgtttacttttcattggatcagcattgtttatatacctaaaatgttcaggtgaaaaacttggtattccttcgtaaactaaattttcacctgaagttaatgtgtctcctattttaaaatttcctgtatcatgaagtcctactatatctccggggtaagaaatgtcaacaatttctttcttatctgcaaaaaatgcatttggactagagaattttaatttttttgacaatctcacatgtaagtatggagtattccttttaaattctccagaaacaatctttataaatgctaatcgatctctatgttttggatccatattagcatgaattttaaatacaaaacctgtaaatttatcttcatcaggttttacaattctaactgaactttcctttggctgcggagtaggagctatatcaataaaacagcgtaataaatcctctaccccgaaattatttaatgctgaaccaaaaaatactggttgaatcttgctcattaaatattcatttttatcaaattttggatataccatntcaagnaattctacattttctataaattgattatttaaatctgaacttatattatnttttacttggtctttttctatgaactttatttcatttcctttgagtagagaaaccgtattttcaaaaatgttatatatcccagaaaaatcatatcccatnccgataggaaaacttaaaggacacacttttaattttaattttaattcaatttcgtcnanaagatcaaaagcatcttttccttctctatctaatttattaataaacactataataggaatttgtctcattttacaaacctcaacaagtttttcngtttgttcctcnactcctttngcaacatcaataactacgattacactatcaacagcagttagtgttctgtatgtatcttcagcaaaatctttatgacctggtgtatctaaaatatttatttttattcctttatattcaaatgctaaaacagaggttgcaacagaaattcctctctgtctttctatttccataaaatcacttgtagcccctttttttattttattactttttacagctccagcttcttgaatagcaccaccatataataataatttttcagtaagagttgttttaccagcatctggatgagaaattatcccaaaagttcttcttcttttaatttcttcattaaaattcattgagatattttttgctaatataagctttatgctntgatcattttatcaaaaaaaaagcttttttatttntttnnannnntnntnaannantnntnntnntttnnnnnnttnnnnntnnannnnaannnannntnnntnnnnannannnnnannnnnntngnttnnnnncnaanntnnnngnnnnnnnaaaangnnnnntnnnnnnnnnnntttnnnnnnttnnttttnannannnnngnnnantnannntnnnaannannnnnntnannnannnnnnntnnncnngnttnnngnnnaannnnnnntnnnnnnnnnnaannnnnngnnnannnnannntnnntnnngnnaaannannntnnaannannaanngggnttnnnnnnnnantnnttnnaaaaannnnntttnnttnnnaannnnannttnnnnanngnntnantnnnnnnnnanttnnnnnnnntnnnnntngnnnntnnnannnntnnncnantnntnantncnntnnanntnnnnnntngnaanngnnnnnnttngnnnannntnaaaangnnnnnnannnncnnncnnnnnannnnnnnnnntngnttnaaannanttttnnaaaannntnnnaannnnnnannnnannannnnnaannnnaannttnnnnnaaannnnnntttnantnnnnccnnnnnntnnnnnannnnnantngnnnnnnnnaaaaaannangnnnnnnttngnnaannnnannancnaaannnnnnnngnnnnnantnnnnnttnantnnnnnnnntnncngnntnantnnnncnnnaannngnnnnnnnnnngnnnnttnnnnnntnaaaaannnnantnangnncnnnntnnannnnnnnnnnnnnnnnannanttnnannntgnnnnnnccnnnntnnaannnnnnnntncnnnnnnnnnaaannnnnnnnnttttnnnnnnnnnnntnnnnaaannnnnnnnaaaaannnnttnnnnntnnnngnnnntttnnnnnnaannncnnnnaantttnnnancnnnnanngnaantnanngnaaannannttnnaaannntnnnnaaaaaantnaannannnngnttncnnnntnantnnaaannnttnnannnnccnnngggnngnttnntnnntnntnnnnnaannnnannnnannannttnntnnnnnntttttnnnaaanntnnnnnnnnanntnantnnnnaangnttnaannntnnnccnnaaannntnantnntnaancnnnnnnnannntnnnntngnnannncnnnttnnnannnnnnnaannnngnaannnnttnnangnnnannnnnnnntnnnannnnnnnnnannnnnann

SEQ ID NO: 986 - DNA, 4000 bp, Escherichia coli
  misc_feature (1949)..(1950): n is a, c, g, or t
  misc_feature (1980)..(1980): n is a, c, g, or t
  misc_feature (1991)..(1991): n is a, c, g, or t
  misc_feature (1993)..(1993): n is a, c, g, or t
  misc_feature (3984)..(3984): n is a, c, g, or t
cgaccctcttctgtggcggcctgccaaaggcggcggtcttgatcaggccagtcagtaaggggcagggatgtgcgttcgatcttactcatgacgccttcccctttggcttacccatcaaagctaaaggatccatgaacagatcctcatgacgctttgggttttgcttttgtgcgcgaaaggcttcggctacgccatcccgccgtgtcttggtaatcacctcgccgtaaagctcgatcgccttttgggtctcagcgcccgcgtaatgtgcataggtggtcgtgagcgccttatgacccagaagcttgcgcacgacctcataatgaccgggcaggcggtccaagaggagcttggccgccgcatgacggaactggtgcggggttagacggatcgcggcatgggaccaaagcgtgttcgtgatgagcttgcgcaaggctgagcagtcctttgcagcccccttgcggccagggaagagataggggcttgcgccaggggtgaacaacatgcgccagtcatcgatgtagcgcttcacccgctcggtcgtggcctctggcaagaggaagtcgagtgcaaccttgttcttcacctcttccatgggcacgacaatgcgcagacacttcccatgccagatgaagtgctgatcaagacgcagagcgttaagattgcggatccgcatcggcgcgaactgcaggatctcgatggcaacagccgcctgtatcaagagatgcgcatccttgcgcacactgccctgctcaaccgtctttgacataacgagggcgcggtcccagagcacttggggtaaggtgaggaagcgcagaacggcctttggatcatcaaactgatgcatagaggctgcattcttctcggagagcccgtcatgggagaggcgcagcttgggcatatgctctgcaaagaaggccacatcttcatcagatggatcacagtgcttgacggcgtaacagcgcacactccaggcaagctctccgatatgcttcgaggtctcaccgccattgcgatcgagaagccagctgatgccggtctcaaacatggcaggcgtgaccagatcgcggagggatagagcgctgcccacatccacgcccttgtaagagagcgcagagatatagcgatgaagctgccaccgcaccgcatcaatgctgatcggtgcaaatggcttcttcaaacccttgctgaagacatccttgcttgagagatgatctagataggcatcgatatccaccctgacggcatcagagacgagcgaccagtcgatcgcataaagccgctcgtcatagcgcggcacgtcaagcgtgacctgtggccagcccgcatcgcgatgcgtctccaccatttggttccacacacgacaggatgactgatgccgcacgcgcgggtgtttgatcaggctctcggtctcgagggctaagagatagccgtcagcaacgatgtctgagacatcatcgggcgcaacagcttggtttgagcagtagcgcataaagcggctgagctcagacttacgataagtatcgccctcaagtaggtcataaagcatctgccactcagccgtaagctttgctgaagctggcgcaagcttggtgttgatcttcaaatgccgcatcgcgcccaatatcaaggaccgcacattctgcacacggcggcgcgtcacattgatcaacgttggatgcacacgctcaagcttctcacggatataaggcgcagaggctgggatgctggtctcgggtaagtggaaccactccgccaagctgcggcaggcggaggcgatatcgcggcgcttatacacggatagctcatgatccgcttcgatgcgcacgcgcagctcagccaagctcatctgattggcgtcaaggaacgggttatgcatggtcatggcagttactccaagaagacgtgaaggaagatgcaggacagtttgggtcacgtgaagccatctgagnnaaaatactacatatagtgcaaatataccanaattgatagtnangataacaacatatagatttgcacgattgtgcgtgactgagggtcaaagcagaccagaaggggacagtcagggtcatccgaacatcccccctgagcggttgcgggcgatgaaggcctcaaggtctgcaaaggcaaaccgcaaggcattgcccacacgaatgcagggcagatcaccgcgcgcgatgaggcgcttgatcgagcgctcggatacagaaagatactccgccgcctcaccgatcgtgagcaggcggatgggttttgaactgctcatgggcaggtcctctgttgcgatgttcacaagatgcgcccgctacatccgcccgtgcgcagtgccgcgccatcaggcacgcaagcgcctcaagcgtggcacaaagatcagccgaagctgactgtgcagaagggggggtatgaggacgcgactcagtcatacgcccagaataaatctgcgctttgagccgctctaacttaggcggcgtaagcagattttataaatttatatcagacccttaaggtctgcgcgtcattgcggcgtcataggcttgggccgcgactttaaattttgctttttccctgacgatcagctttttgcctttaaaatcttgagtttgataatcacccagcggtttacccatgcgataggtggcgaggatagctttgtcgtaagaactttttgcaagattgtcgtaagtggcagacagccgcgccggttggccggtggcggcctcatatacatctgcgaggcaatagaaggctttatccaatgcttggttaaactgtgggtcatcgaactcgtttagcgagcagcgcatgcccttaatggcatctagtagtgtctgtcggtgcgcagggttcgccaagtcaatttggacaaaatcctcaacttgagaatacatgcggctcttaaaggcagcgtttaggattgcctttgtgtctgcagagagcctatcaaactgctgctcggtgcgagcatggttcggctttttatgacgctcgacggcctccttcagcatactgagctccttgcgcatttggggtagtctgttggcttgggcctgcttcttgccgctcttgcgcgatgcggcgcgctgaacaagtatagcttcggcccaacgatgtagcccgtcgcggagcatacgttcagcctcagctggtaaaggcgtccccaagcggcacatgtgatagtaagctgcattgaggttgcgctgaaggaattttgggattttcggcgtcattgcaaaagtgctcaggcaagtaatcttacgagaccactttatattaaaatggcgtctggttggtgttctttgggaataccagattgatcttcctaatcctccatacgatcgaacgctttgaagctcgttccccagctatggcttatgttcgaagttgatggacgaaaccattgcagttactggaccgcctggagagtacaattctaatagggtgcggcttttcacttaggtatatcaattcaacatatcgggttggtctaggacaagttggttccatatggtttgaaagtgaagccacccaatgtactcgctaccgacatgctcccggctgtatcgagcacgctcatcaggaattcggattggcgtaattccgcttgcggcgatatcaagctgctgtttgcagcaacgctcaagtgcgataaaccagaaggccgcactctcgatagagtggcgcgatgcagtcaaaaggccgtggttttgatggagcgccgccttaacccctttgaatgctttagcgacatccgagccagcatgggtctcaactgcaactgctccagcctgttccccaactacaacgtgatcctcaaagaatgcgcacgcgtcttgagttatcggatcgattgggcgcccggtagcacaccaagcggtcccataggtcgtatgagcatggcacatcgcgataatatcagggtgctgctcatggacgttagcatgcagtacaaacccagctcggttaactgcgtattcaccttcgattacngtgccattgtgatcca

SEQ ID NO: 987 - DNA, 4000 bp, Escherichia coli
  misc_feature (720)..(720): n is a, c, g, or t
  misc_feature (1452)..(1452): n is a, c, g, or t
  misc_feature (1619)..(1619): n is a, c, g, or t
  misc_feature (1668)..(1668): n is a, c, g, or t
  misc_feature (1990)..(1990): n is a, c, g, or t
  misc_feature (2695)..(2695): n is a, c, g, or t
  misc_feature (3253)..(3253): n is a, c, g, or t
  misc_feature (3259)..(3259): n is a, c, g, or t
  misc_feature (3325)..(3325): n is a, c, g, or t
  misc_feature (3343)..(3343): n is a, c, g, or t
  misc_feature (3696)..(3696): n is a, c, g, or t
ttcaccttggtgggcaactcggccgcctgatccaggttgacctcggggccctccagggcgtgctgcaccaggtgggccagcccctcgatgaacgccggggtggtgtccagcgccggcacgcgccggaagttggtgatgccggcttcggtggcgatctcgcggtactcgatgtcgatctcctcgagagtctcgatgtgctcgctcacgaagctgatcggtaccaccaccagatctttcaccccctgggcgccgaggtcgtggagggcctcgtcggtgtaaggcttgagccactccaccggaccgacacggctctggtaggccagggtgaagggattggcgtggcccagatcccgctccagccgctgcatgatcagccctgcgcaggcctgaatctcctgctggtacgggtcgcccgcctcctccacatagctcttgggcacgccatgggcgctgaagaacacatgggccgtggccggttcggggcaggcctggatctccttggtaatcaggctggccatggcgccgatgtagcccggatcgtcgaagtagctgcggatgcagcggatcggcaggcgtgcgaagttggggtcggactggcgcaggcgttgcagttcgcggaagctggagccgctggtgctgatcgagaagtgggggtagagcggcagcaccaccacttcatcgatcccgtcggccttgatgtcggccacggcggattcggtnaaggggtgccagtagcgcatggccacgtagctcgtggcctcgatgccccgctggcgcaggttgctctgcagttcccgcgcctgctgctcggagggggccccgtccgctgatcagctccagcaggaaagcggaaaaacccaccatcgccaagcgaccattccagacctcggagctgttgttccagccccaggcccacttgtcctggggatagagcttcgccttggtgggcaactcggccgcctgatccaggttgacctcggggccctccagggcgtgctgcaccaggtgggcagcacaccgaccttgccgcaccccatggacatggcctaccgatccagctatcccttcatggtatgaccggatctgggctcaacagtgagatctcaatggaacgggatcagccgcggaaatgcagacatggtgttgcagcagagatgacgacaatcactgcccactgccagagagaatcatctttcatctgtaggagttgaagggcaagcattcatctgaggcgatcaccagcctgccaaaatgcgacagtcaaaaaccaaggatgatctcatgaccgaggggggcttatcccaacagactcgatcaggttctgatcggcagtgggacttaatgcaagccagcttcgatggcgactggctggggatgacgacgtggtacgacagaaatgccaacggcatggatctgaaccacggcacgtgcagctctaccgaatcgctgtangccattcggttttctgatgctgatacaggagagtggcatggaacaggtcttcgatttgccccgggtggagaacgccgattccccctggatcgacaccactacaacctcggccatcactgctggcatttcccggagaccgcaggtcagtcaagccttgaggttggcgngagcacaacgcgagcgggccatgaagtgaattttttcaatggccgctcncgatcgatgcttgttgccctctatcagcgccagggtgacggccggatgatcctggattcaatcgcagccaccccgtttcgctgtcaacgggcaagccccgatccctcccgtgaacagatgcagtctgtagacgccttattgtcggttgtcgcaggatggcgtgggatcgagcaggagctgagaccgggcgtgcagaatggagcgcttgaaacaaccaaagtggcacctgaattcgatgcagacagcttttgctcgcaggatgtgaatggcgtgtttgcagataatttgatttgcggccttcccgataaaatgccaaagggtnctttcgatctccaatttggatgtttgttaaatccaaagagttttacccatctcatcatcgcttacgatgcaaataatagactgagtcgctggatagagcgtcgatatcaaccaaccatgcacggataactgaagctgaagccaatttgcttcagcttttcgttgctaacgcgcgcattaagaacccgatcagttgtatctattgtcaaccacttggccaatggcaagccagctcgctcacagaggcgatccgtaagctcttggccactcagttgtgtatcgttaacaagattataggtttcatccaggccttgatcgaatgcgaagcaaacaccccggacaatgtcatcgcggtgaatccagcacggaacatttaggccgttgcgttgcaccaggcccccagccgctgacaacagcatggatggaatgtcacgcccggggccgtagatgcctcccaggcggagcacacagaccttgatcctgtcagagcggatggcccccatcatctcttcagcctggagaagaacctgattgacagggtggggatcggcgatcggagccgtttcgttggtgagggcaccgtggcggttgccgtacacgccgcagctgctcagatggacgatctgcagaggtgtgttgcgggggcgtcgatccagcgtctcgacgagtcgttgcaaaccaccgaggaaggttttccggtattggnccagatcaacctcggaacccttcgagggcgcgaaggaaaccagaatgccatccagatcagcggtgaagtcaaggttggtgctggggtccgtcgagtcaaagatcagcggggtttccacaagctcggccaactcgccgaggcgctcacgccgggtggtggtagcccacagctcatgaccctcctgcttccaagccctggccacctcctcgcccacgtagccgtagccgaggatggcacgccgttcacccgagggcagggcgggtctctcctgcttggccagcagctggtagagagaggccaaatctggagaagatgtcacagctagcaactcaacaagtaaatatttgtaaagcataggagcccaggtcgctgccggtgtgctgatgaataccgtcttgccaggacaggctgaaaaggccctcccatgagagggttgatcaccgatgcggtgctttcatgcccacctatcgcgttgctgccgcaggcctggaggccatgcaggtcaacgtgcccggctgcagtggagatgctctcagcctggcactggggccgctgggnctcagngacttcagggtcgaacggcgcagtcaggacgggcgccaatggttttttcaggcaaccttcaagccnggcggcatcgagcccccngccgccgggcttgtcacgagggcggtaagcgtcgatcgcattctcgactgacgccatggggtccccgcaatggcccacggcctctgcgcagctgtggatcgcctgcctggcctgcaacagccctgcaggaagctggtcctggaggggacaccagctcggagcccgcctcagcccccaatcaatcgcgagctggtacggaagattaacttccttatggtttttacttgccccaagcctgagcccatcgcagcattcaatactttcttttgattgcttcctgtctgctcaatgaccctgcctgttctggccaccaaacctctcaccagcaacgccagggtcagcaattttctggnagctagcgaacagacctctcgccagattggtcggcaggccagtcagcttgatggagctgccgccgatgccctgatcgagcaggcctatcgccaggtgtacttccacgccttcaagcgcgaccgcgatgcgatgcttgagtcgcagctgcgctccggccagatcagcacccgcgagttcgtgcgccagctgctgcgctcggagaaattccgcaacgacttctaccgctgcaacagcaattaccgcgtggtggaacaggtggtgggccgggtgctcggccggccggtgcacggggagcaggagcgc

SEQ ID NO: 988 - DNA, 4000 bp, Escherichia coli
  misc_feature (1)..(74): n is a, c, g, or t
  misc_feature (76)..(82): n is a, c, g, or t
  misc_feature (84)..(96): n is a, c, g, or t
  misc_feature (98)..(118): n is a, c, g, or t
  misc_feature (120)..(127): n is a, c, g, or t
  misc_feature (129)..(135): n is a, c, g, or t
  misc_feature (137)..(144): n is a, c, g, or t
  misc_feature (146)..(171): n is a, c, g, or t
  misc_feature (173)..(191): n is a, c, g, or t
  misc_feature (193)..(222): n is a, c, g, or t
  misc_feature (224)..(234): n is a, c, g, or t
  misc_feature (236)..(261): n is a, c, g, or t
  misc_feature (263)..(263): n is a, c, g, or t
  misc_feature (265)..(265): n is a, c, g, or t
  misc_feature (267)..(271): n is a, c, g, or t
  misc_feature (273)..(288): n is a, c, g, or t
  misc_feature (290)..(292): n is a, c, g, or t
  misc_feature (295)..(317): n is a, c, g, or t
  misc_feature (319)..(320): n is a, c, g, or t
  misc_feature (322)..(347): n is a, c, g, or t
  misc_feature (349)..(392): n is a, c, g, or t
  misc_feature (394)..(410): n is a, c, g, or t
  misc_feature (412)..(414): n is a, c, g, or t
  misc_feature (416)..(456): n is a, c, g, or t
  misc_feature (458)..(462): n is a, c, g, or t
  misc_feature (464)..(471): n is a, c, g, or t
  misc_feature (473)..(528): n is a, c, g, or t
  misc_feature (530)..(530): n is a, c, g, or t
  misc_feature (532)..(569): n is a, c, g, or t
  misc_feature (571)..(574): n is a, c, g, or t
  misc_feature (576)..(586): n is a, c, g, or t
  misc_feature (588)..(593): n is a, c, g, or t
  misc_feature (595)..(608): n is a, c, g, or t
  misc_feature (610)..(612): n is a, c, g, or t
  misc_feature (615)..(624): n is a, c, g, or t
  misc_feature (626)..(632): n is a, c, g, or t
  misc_feature (634)..(634): n is a, c, g, or t
  misc_feature (636)..(638): n is a, c, g, or t
  misc_feature (640)..(641): n is a, c, g, or t
  misc_feature (643)..(663): n is a, c, g, or t
  misc_feature (665)..(665): n is a, c, g, or t
  misc_feature (667)..(674): n is a, c, g, or t
  misc_feature (677)..(682): n is a, c, g, or t
  misc_feature (684)..(688): n is a, c, g, or t
  misc_feature (690)..(700): n is a, c, g, or t
  misc_feature (702)..(716): n is a, c, g, or t
  misc_feature (718)..(726): n is a, c, g, or t
  misc_feature (728)..(731): n is a, c, g, or t
  misc_feature (733)..(738): n is a, c, g, or t
  misc_feature (740)..(777): n is a, c, g, or t
  misc_feature (779)..(791): n is a, c, g, or t
  misc_feature (793)..(798): n is a, c, g, or t
  misc_feature (800)..(807): n is a, c, g, or t
  misc_feature (809)..(821): n is a, c, g, or t
  misc_feature (823)..(840): n is a, c, g, or t
  misc_feature (842)..(842): n is a, c, g, or t
  misc_feature (844)..(871): n is a, c, g, or t
  misc_feature (873)..(881): n is a, c, g, or t
  misc_feature (883)..(895): n is a, c, g, or t
  misc_feature (897)..(907): n is a, c, g, or t
  misc_feature (909)..(909): n is a, c, g, or t
  misc_feature (911)..(911): n is a, c, g, or t
  misc_feature (913)..(931): n is a, c, g, or t
  misc_feature (933)..(938): n is a, c, g, or t
  misc_feature (940)..(944): n is a, c, g, or t
  misc_feature (947)..(957): n is a, c, g, or t
  misc_feature (964)..(965): n is a, c, g, or t
  misc_feature (967)..(967): n is a, c, g, or t
  misc_feature (969)..(969): n is a, c, g, or t
  misc_feature (971)..(971): n is a, c, g, or t
  misc_feature (975)..(975): n is a, c, g, or t
  misc_feature (978)..(985): n is a, c, g, or t
  misc_feature (987)..(987): n is a, c, g, or t
  misc_feature (989)..(989): n is a, c, g, or t
  misc_feature (991)..(992): n is a, c, g, or t
  misc_feature (994)..(995): n is a, c, g, or t
  misc_feature (997)..(998): n is a, c, g, or t
  misc_feature (1001)..(1001): n is a, c, g, or t
  misc_feature (1003)..(1005): n is a, c, g, or t
  misc_feature (1007)..(1009): n is a, c, g, or t
  misc_feature (1013)..(1016): n is a, c, g, or t
  misc_feature (1018)..(1019): n is a, c, g, or t
  misc_feature (1021)..(1021): n is a, c, g, or t
  misc_feature (1025)..(1027): n is a, c, g, or t
  misc_feature (1032)..(1037): n is a, c, g, or t
  misc_feature (1039)..(1040): n is a, c, g, or t
  misc_feature (1043)..(1043): n is a, c, g, or t
  misc_feature (1045)..(1049): n is a, c, g, or t
  misc_feature (1051)..(1053): n is a, c, g, or t
  misc_feature (1057)..(1064): n is a, c, g, or t
  misc_feature (1068)..(1074): n is a, c, g, or t
  misc_feature (1077)..(1079): n is a, c, g, or t
  misc_feature (1081)..(1083): n is a, c, g, or t
  misc_feature (1085)..(1086): n is a, c, g, or t
  misc_feature (1090)..(1090): n is a, c, g, or t
  misc_feature (1092)..(1096): n is a, c, g, or t
  misc_feature (1098)..(1105): n is a, c, g, or t
  misc_feature (1107)..(1115): n is a, c, g, or t
  misc_feature (1117)..(1119): n is a, c, g, or t
  misc_feature (1121)..(1128): n is a, c, g, or t
  misc_feature (1130)..(1135): n is a, c, g, or t
  misc_feature (1142)..(1142): n is a, c, g, or t
  misc_feature (1144)..(1144): n is a, c, g, or t
  misc_feature (1146)..(1146): n is a, c, g, or t
  misc_feature (1149)..(1150): n is a, c, g, or t
  misc_feature (1152)..(1154): n is a, c, g, or t
  misc_feature (1156)..(1156): n is a, c, g, or t
  misc_feature (1159)..(1159): n is a, c, g, or t
  misc_feature (1163)..(1163): n is a, c, g, or t
  misc_feature (1165)..(1165): n is a, c, g, or t
  misc_feature (1167)..(1170): n is a, c, g, or t
  misc_feature (1173)..(1177): n is a, c, g, or t
  misc_feature (1179)..(1187): n is a, c, g, or t
  misc_feature (1190)..(1192): n is a, c, g, or t
  misc_feature (1194)..(1198): n is a, c, g, or t
  misc_feature (1201)..(1202): n is a, c, g, or t
  misc_feature (1204)..(1205): n is a, c, g, or t
  misc_feature (1209)..(1209): n is a, c, g, or t
  misc_feature (1211)..(1211): n is a, c, g, or t
  misc_feature (1214)..(1214): n is a, c, g, or t
  misc_feature (1217)..(1219): n is a, c, g, or t
  misc_feature (1221)..(1225): n is a, c, g, or t
  misc_feature (1227)..(1229): n is a, c, g, or t
  misc_feature (1232)..(1232): n is a, c, g, or t
  misc_feature (1236)..(1236): n is a, c, g, or t
  misc_feature (1238)..(1238): n is a, c, g, or t
  misc_feature (1241)..(1241): n is a, c, g, or t
  misc_feature (1243)..(1245): n is a, c, g, or t
  misc_feature (1247)..(1248): n is a, c, g, or t
  misc_feature (1250)..(1251): n is a, c, g, or t
  misc_feature (1253)..(1255): n is a, c, g, or t
  misc_feature (1257)..(1257): n is a, c, g, or t
  misc_feature (1260)..(1260): n is a, c, g, or t
  misc_feature (1262)..(1263): n is a, c, g, or t
  misc_feature (1265)..(1265): n is a, c, g, or t
  misc_feature (1267)..(1272): n is a, c, g, or t
  misc_feature (1275)..(1277): n is a, c, g, or t
  misc_feature (1279)..(1279): n is a, c, g, or t
  misc_feature (1286)..(1287): n is a, c, g, or t
  misc_feature (1292)..(1297): n is a, c, g, or t
  misc_feature (1300)..(1300): n is a, c, g, or t
  misc_feature (1304)..(1307): n is a, c, g, or t
  misc_feature (1309)..(1309): n is a, c, g, or t
  misc_feature (1311)..(1312): n is a, c, g, or t
  misc_feature (1314)..(1314): n is a, c, g, or t
  misc_feature (1321)..(1323): n is a, c, g, or t
  misc_feature (1326)..(1327): n is a, c, g, or t
  misc_feature (1331)..(1332): n is a, c, g, or t
  misc_feature (1336)..(1337): n is a, c, g, or t
  misc_feature (1339)..(1339): n is a, c, g, or t
  misc_feature (1347)..(1347): n is a, c, g, or t
  misc_feature (1352)..(1352): n is a, c, g, or t
  misc_feature (1357)..(1358): n is a, c, g, or t
  misc_feature (1361)..(1362): n is a, c, g, or t
  misc_feature (1364)..(1365): n is a, c, g, or t
  misc_feature (1376)..(1377): n is a, c, g, or t
  misc_feature (1381)..(1382): n is a, c, g, or t
  misc_feature (1387)..(1387): n is a, c, g, or t
  misc_feature (1389)..(1389): n is a, c, g, or t
  misc_feature (1392)..(1393): n is a, c, g, or t
  misc_feature (1395)..(1395): n is a, c, g, or t
  misc_feature (1399)..(1399): n is a, c, g, or t
  misc_feature (1402)..(1406): n is a, c, g, or t
  misc_feature (1414)..(1414): n is a, c, g, or t
  misc_feature (1418)..(1422): n is a, c, g, or t
  misc_feature (1425)..(1425): n is a, c, g, or t
  misc_feature (1427)..(1427): n is a, c, g, or t
  misc_feature (1431)..(1431): n is a, c, g, or t
  misc_feature (1433)..(1433): n is a, c, g, or t
  misc_feature (1435)..(1435): n is a, c, g, or t
  misc_feature (1438)..(1438): n is a, c, g, or t
  misc_feature (1444)..(1444): n is a, c, g, or t
  misc_feature (1446)..(1447): n is a, c, g, or t
  misc_feature (1449)..(1449): n is a, c, g, or t
  misc_feature (1452)..(1452): n is a, c, g, or t
  misc_feature (1456)..(1456): n is a, c, g, or t
  misc_feature (1459)..(1460): n is a, c, g, or t
  misc_feature (1462)..(1463): n is a, c, g, or t
  misc_feature (1465)..(1467): n is a, c, g, or t
  misc_feature (1469)..(1469): n is a, c, g, or t
  misc_feature (1472)..(1473): n is a, c, g, or t
  misc_feature (1477)..(1479): n is a, c, g, or t
  misc_feature (1481)..(1482): n is a, c, g, or t
  misc_feature (1484)..(1484): n is a, c, g, or t
  misc_feature (1486)..(1490): n is a, c, g, or t
  misc_feature (1492)..(1492): n is a, c, g, or t
  misc_feature (1498)..(1500): n is a, c, g, or t
  misc_feature (1503)..(1503): n is a, c, g, or t
  misc_feature (1509)..(1512): n is a, c, g, or t
  misc_feature (1516)..(1516): n is a, c, g, or t
  misc_feature (1518)..(1518): n is a, c, g, or t
  misc_feature (1521)..(1521): n is a, c, g, or t
  misc_feature (1524)..(1526): n is a, c, g, or t
  misc_feature (1529)..(1535): n is a, c, g, or t
  misc_feature (1542)..(1549): n is a, c, g, or t
  misc_feature (1552)..(1553): n is a, c, g, or t
  misc_feature (1555)..(1556): n is a, c, g, or t
  misc_feature (1561)..(1561): n is a, c, g, or t
  misc_feature (1564)..(1566): n is a, c, g, or t
  misc_feature (1568)..(1568): n is a, c, g, or t
  misc_feature (1571)..(1571): n is a, c, g, or t
  misc_feature (1573)..(1573): n is a, c, g, or t
  misc_feature (1575)..(1575): n is a, c, g, or t
  misc_feature (1577)..(1577): n is a, c, g, or t
  misc_feature (1581)..(1584): n is a, c, g, or t
  misc_feature (1586)..(1586): n is a, c, g, or t
  misc_feature (1589)..(1594): n is a, c, g, or t
  misc_feature (1596)..(1597): n is a, c, g, or t
  misc_feature (1599)..(1604): n is a, c, g, or t
  misc_feature (1606)..(1608): n is a, c, g, or t
  misc_feature (1610)..(1610): n is a, c, g, or t
  misc_feature (1615)..(1615): n is a, c, g, or t
  misc_feature (1618)..(1620): n is a, c, g, or t
  misc_feature (1622)..(1624): n is a, c, g, or t
  misc_feature (1628)..(1629): n is a, c, g, or t
  misc_feature (1634)..(1637): n is a, c, g, or t
  misc_feature (1642)..(1648): n is a, c, g, or t
  misc_feature (1650)..(1651): n is a, c, g, or t
  misc_feature (1656)..(1659): n is a, c, g, or t
  misc_feature (1664)..(1672): n is a, c, g, or t
  misc_feature (1677)..(1681): n is a, c, g, or t
  misc_feature (1687)..(1694): n is a, c, g, or t
  misc_feature (1696)..(1696): n is a, c, g, or t
  misc_feature (1699)..(1702): n is a, c, g, or t
  misc_feature (1708)..(1715): n is a, c, g, or t
  misc_feature (1718)..(1719): n is a, c, g, or t
  misc_feature (1724)..(1727): n is a, c, g, or t
  misc_feature (1730)..(1733): n is a, c, g, or t
  misc_feature (1736)..(1738): n is a, c, g, or t
  misc_feature (1742)..(1747): n is a, c, g, or t
  misc_feature (1750)..(1755): n is a, c, g, or t
  misc_feature (1760)..(1760): n is a, c, g, or t
  misc_feature (1767)..(1769): n is a, c, g, or t
  misc_feature (1771)..(1773): n is a, c, g, or t
  misc_feature (1776)..(1776): n is a, c, g, or t
  misc_feature (1779)..(1785): n is a, c, g, or t
  misc_feature (1790)..(1793): n is a, c, g, or t
  misc_feature (1797)..(1798): n is a, c, g, or t
  misc_feature (1807)..(1807): n is a, c, g, or t
  misc_feature (1819)..(1820): n is a, c, g, or t
  misc_feature (1822)..(1823): n is a, c, g, or t
  misc_feature (1827)..(1827): n is a, c, g, or t
  misc_feature (1832)..(1832): n is a, c, g, or t
  misc_feature (1835)..(1835): n is a, c, g, or t
  misc_feature (1838)..(1838): n is a, c, g, or t
  misc_feature (1841)..(1841): n is a, c, g, or t
  misc_feature (1862)..(1862): n is a, c, g, or t
  misc_feature (1966)..(1966): n is a, c, g, or t
  misc_feature (1971)..(1973): n is a, c, g, or t
  misc_feature (1989)..(1990): n is a, c, g, or t
  misc_feature (2005)..(2005): n is a, c, g, or t
  misc_feature (2009)..(2009): n is a, c, g, or t
  misc_feature (2212)..(2212): n is a, c, g, or t
  misc_feature (2245)..(2245): n is a, c, g, or t
  misc_feature (2865)..(2865): n is a, c, g, or t
  misc_feature (3880)..(3880): n is a, c, g, or t
nnnnnnnnnnnnnnnnnnnnnnnnnnnnnnnnnnnnnnnnnnnnnnnnnnnnnnnnnnnnnnnnnnnnnnnnnntnnnnnnntnnnnnnnnnnnnngnnnnnnnnnnnnnnnnnnnnngnnnnnnnnannnnnnngnnnnnnnnannnnnnnnnnnnnnnnnnnnnnnnnntnnnnnnnnnnnnnnnnnnnannnnnnnnnnnnnnnnnnnnnnnnnnnnnnannnnnnnnnnncnnnnnnnnnnnnnnnnnnnnnnnnnncnancnnnnnannnnnnnnnnnnnnnncnnnctnnnnnnnnnnnnnnnnnnnnnnntnntnnnnnnnnnnnnnnnnnnnnnnnnnntnnnnnnnnnnnnnnnnnnnnnnnnnnnnnnnnnnnnnnnnnnnntnnnnnnnnnnnnnnnnncnnntnnnnnnnnnnnnnnnnnnnnnnnnnnnnnnnnnnnnnnnnnannnnnannnnnnnntnnnnnnnnnnnnnnnnnnnnnnnnnnnnnnnnnnnnnnnnnnnnnnnnnnnnnnnnantnnnnnnnnnnnnnnnnnnnnnnnnnnnnnnnnnnnnnncnnnncnnnnnnnnnnngnnnnnntnnnnnnnnnnnnnngnnngtnnnnnnnnnntnnnnnnntngnnntnncnnnnnnnnnnnnnnnnnnnnnantnnnnnnnntgnnnnnngnnnnntnnnnnnnnnnngnnnnnnnnnnnnnnnannnnnnnnngnnnncnnnnnntnnnnnnnnnnnnnnnnnnnnnnnnnnnnnnnnnnnnnnannnnnnnnnnnnngnnnnnntnnnnnnnngnnnnnnnnnnnnntnnnnnnnnnnnnnnnnnntngnnnnnnnnnnnnnnnnnnnnnnnnnnnncnnnnnnnnncnnnnnnnnnnnnntnnnnnnnnnnncnancnnnnnnnnnnnnnnnnnnngnnnnnngnnnnngannnnnnnnnnnggctcanncntncngatntannnnnnnncngntnncnnannccntnnnannnttgnnnnanncnatgnnncagannnnnnanntcngnnnnntnnnacannnnnnnngagnnnnnnnttnnngnnncnntatntnnnnngnnnnnnnntnnnnnnnnncnnnannnnnnnngnnnnnnatattcntnanacnntnnntntcncggngnannnngannnnntnnnnnnnnngannntnnnnntgnnanngctncnaanctnnnannnnncnnnccnagtngnttncnnnanngnntnnncnctngnngncnnnnnnccnnngnctattcnntaaannnnnntantctnnnntncnncnatccttnnnatnnatanncgtnnanatagatgntttanctctnnttnnannaggtcactatnntatnncatangnctnnantacngannnnntaacgatncacnnnnntcngngaantncngcncatcancnncncanattnagnnannannnantannaatnnncnncngnnnnngnctcccnnnccnaagggnnnngggngnaanagnnntcnnnnnnnccccccnnnnnnnnccnntnncccanccnnncnggngnangntgtnnnnanctnnnnnngnncnnnnnncnnncntatanggnnngnnngcgnnccaannnnggttnnnnnnngnnccaannnnggttnnnnnnnnnaccannnnnggtttnnnnnnnntnccnnnnttggtnnnnnnnnggnnccaannnnggnnnnaannnaaannnnnnttnnnnnnccccnccccccnnntnnnccnccnnnnnnnccccnnnnaaanncccccttcngcagtgcatctnnannagangcacngcnganggnaaaagcaaccagtactggtcngcatcgtgaccagtactggtaagtggtggtgaccagtactgcttgctgaagtgaccagtactgatccgatcggcgaccagtactggtcacttttgcccctcccnagagnnnctctatctcagcccgnnaggaaggagagccanatgngcgaaagcaaaagtgcccgctgcgaccgaagtcacagcgggcactcgccgatagaatatcgaaggggggagagctactattctgcgctttcagcagcaggagcttcagccgtagccttcgtagagcggcgtgaacgacgcgtcttaggagcagccttcttgtcagccttttccttgagcatgttctcgttgaagtctacgagntcgatgaagcagacagcagcgttgtcaccgagncggttacccgtcttgaggatacgagtgtagccaccgggacggtcagcgatcttttcagcaacggggccgaagagttccttgacagcaaacttattctgcagctcagcgaagacgatacgacgtgcgtgcgtggagtcttccttagcgcgggtcagcaggggctcgacgtatacgcgaagagccttagccttagcgaccgtggtgaagatgcgcttgtgcaggatgagcgatgcagccatgttggaaagcatagcctcgcggtgcgccttcttacgaccgagatgattgaatttcttattatgtctcatctttctacttagtcattatctaaattgtacttgctaacatccatcccgaaggtgagtccgagtcgctccatcagctcgttgagctcgtccatagacttcttaccgaagttgcggaacttgctgagcgtatcagcgtcgaggacgacgaggtcggccagacggaatacgttgccggagcggaggcagttctgcgcacggacggagagatcgagatccttgagatcagtacggagcagctgagatacgcgatcgatctcctgcatgtccagtacctcctcgtcgccttcctcgatgactgcattctcttctacntcgacagggtcagagatgaagaggctgaagtgctcgatgaggatagctgctgcgtccttgagagcctgctggggatgaatgctcccgtcagtggtgatctcgagggtcagcttctcgtagtcagtcttctgctctacacgatagttctccgtgaagtacttgacattacggataggcgtatagatcgagtcgatagcgatcgtctgcagctcattctcctgagccgtgtcgaccagcttctcatcagcggggatgtaaccacgccccttgttgatggagagctcgatagtaagggtatacgcctcatcgatgtggcagatgaccagctcgggattgaggacttcgaaggaagtaagcttgccgttgagctcgccagcgaggaactgctgctgaccagagatcgtcaggctgacggtctcctcagtagcgtcctggacgagggcacggaagcggacttgcttcaggttgagaatgatgttagttacatcctccaagacacccggaatagtagcaaattcatgattgacaccttcgatcttgatggtcgagatggcgtagccttcgagtgaagaaaggagtatacgacgcagggcattaccgacagtggtaccatatcccggctcaagagggcggaactcgaacttagcgtacgagtccgtcgcatccatcatgaggacgttttcgggcttctgaaatgctaatattgccatgtgagtgagataatagggattattacttagagtatagttcgacgatcagctgctccttgatctcttcggggatgtcttcacgctgaggagcgctgaggaacttaccggagagagaagcctgattccactcgagccagctgtagctgctgtggctacgaccagccagagagtcggtgatgacctctaagctcttcgccttctcacggacgccgacgacctggccgggcttgagggtgtaagaagggatgttgactacctgaccatcgacggtgatgtgacggtgcgagacgagctgacgagcagcngcacgcgtcttagcgatgccgaggcgatagacgacgttgtcgaggcggctttccaggagctggaggagcacttcacccgtgacacccttcgtgcgctgagccttttcgaagaggttgcgg

SEQ ID NO: 989 - DNA, 4000 bp, Escherichia coli
  misc_feature (319)..(319): n is a, c, g, or t
  misc_feature (459)..(459): n is a, c, g, or t
  misc_feature (475)..(475): n is a, c, g, or t
  misc_feature (487)..(487): n is a, c, g, or t
  misc_feature (490)..(490): n is a, c, g, or t
  misc_feature (528)..(528): n is a, c, g, or t
  misc_feature (559)..(559): n is a, c, g, or t
  misc_feature (595)..(595): n is a, c, g, or t
  misc_feature (619)..(619): n is a, c, g, or t
  misc_feature (637)..(637): n is a, c, g, or t
  misc_feature (724)..(724): n is a, c, g, or t
  misc_feature (727)..(727): n is a, c, g, or t
  misc_feature (739)..(739): n is a, c, g, or t
  misc_feature (742)..(742): n is a, c, g, or t
  misc_feature (817)..(817): n is a, c, g, or t
  misc_feature (868)..(868): n is a, c, g, or t
  misc_feature (3880)..(3880): n is a, c, g, or t
cgtatcgggcaaagtcgtgatgaaggagctgtcgatcatgtaccagttctcgcggtcgttctgctgtttctgattgacgatcgagtagagggtcgcgccgctttcgccgacggtaaacgatccgaattcagtgaatatgtgcggttcgtcgattccgttgcgggtacagatgttcttgatctgcgcgatgatctcttcggtcaggtactcgtagtcgtacgagaagtcgagcgagtttttgatcggaaagccgcctccgatgttgaggctgtccagatcggggcaaatggccttcaattcgcagtagatgttcaggcanttcgacagttcgttccagtagtaggccgtgtccttgataccggtattgatgaagaagtgcagcattttgagcttgaacttcttgtttttctggatcttggttttgtagaagttgatgatgtcgttgtagcggatccccangcgcgaggtgtagaantcgaatttgggntcntcctcgctggcgatccggatgccgattttgcatttttnggtaatggcatcgtcgtagaggtcgatctcntccttgttgtcgatcacggggatcgtgttttcgaanccgtcgttgatcaactgggcgatnttttcgacgtattgcggncgtttgaagccgttgcagatgatatagcggtccttgtcgatcacgccgctgtcgtacagggcgttgatgatgtgaatgtcgtaagcngangaggtttcgagntgnatgtcgtttttcatcgcctcttccagcacgaacgagaagtgactcgacttggtacagtagcagtagttgtatgtncccttgtaatcgaccttcgccatcgctacgttgaacatgcgcttggcccgnttgatctgctgggagatcttcggcaggtaggttatcttgagcggagtgccgtactgcttgattaattccatcaggggaatgtcgtggaagttcaattcgttgtcctcgacggtaaattcatcctgcgggaaatcgaacgtctgttcgatcaggtcgatgtacttgtctttcatggctcgtttgtgttttttgcggtataatccgagcgagctacattgtaaattccggagtaaagtagctcgtgcggattgttttttattttgggatgcaaagtaggtaattattttcgagatcggcaatggtttatccgtatattttgaaaaaacaggtgaattttttcgtttttgtccgatgaaaattgtatttttgggtcgaattttaatcgggacagaacggtgttgactggaatcataacgaattacctgacccagcacaggaggctggtcgtgccgcaactgggaacttttgtcgtgaaggttcccgaaggcggtgtggtcttttcggagttgcttaagcgcgacgacggcatcttgcgcgggttgctggtgcagcagggtggaatgaacgatctggaggctgccggtgcgatcgaccgcttcgtgtttgaagtgcgtcatgccctcgagcatgagggggcctatgcaatcgagggcttcggtcgtctgaccctttcaccgggcggtgcaatcgtctttcaggcggttctggctacgcctgtagctgctgcgggacctgttgtcggggaatcggctccggaggaaggaaataaaatttcctcggccgcagctcttcatcccgcttccgtcgctgcgtctgcggagtccgttgcaccccgtgtgcgatcccgttccgaagcgaaggcttctcctgtaatcgacggcggtatttccgaacctcggatttccgtttctgccaagcgcaaacccgcaccttatgtaaagggattgcaatacggcaaaccgcttaaaaccaccgagggatatacctatgtgggttccaagccccgccggaggatcgataaatttatggtcatcgccatcgtggtcgctgtgttggccgtaggcgtcatcgtttacggttatctacgccgggcgaagatcgagcgtctggagcgcgaatacctcgaacaactcgcacctgccgtgccggagcccgtggctgccggaacggacgggggtgtggagtccgttccggatacgactcaggaatagtttgcctgtattggctgtaaaacaggattgatagagtaggaatgacagatctgacatccataaaaaaccgtttcgggatcatcggtaactccgaggcgctcaaccgtgcgctggaggttgccctgcgtgtggcgccgaccgatctttcggtactcgttacgggtgaaagcggcgtcggcaaggagtttttcccgcaggtgatccatgcctattcggcacgtaaacacaataaatatatcgccgtgaactgcggcgccattcccgaaggaacgatcgattccgaattgttcggacacgagaagggggccttcaccggagcagtcgaagcccgcaagggttatttcgaggaggcggacggcgggacgatctttctggacgaggtggccgagctgcctcattcgacccaggtgcggttgttgcgtgtgttgcagaccggcgagttcatccgcgtcggttcggccaaggtgcagaagaccaacgtgcgcgtggtggcggcgacgaatacgaatttgcaggatgcgatccaggcggggcgtttccgcgaggatctctattaccggctcaatacggtgccgatccaggtgcctcctctgcgggaacggaaggaggatattttcttgcttttccgcaagttcgcggccgatgtagcggcccagtaccgtatgccggctatttctctggaccccgaggcccggcagatgctggagaattactattggcggggcaatatccgtcagttgaaaaatgtcgccgaacagatttcggccatcgaggaggcgcggctcattacgcctgccatcctgacgaagtacctgcccgcacaatctcaaagcggagcatctacgtcgatgagtacggccttgcatagcggtccgggcgacggcgtgtctttcgaacgggagttgctttacaaagtgcttttcgacctgcgggccgacgtcaatgacctgaagcggatgcttaccgagctgatgcagcgtgccgagcgtcctgccgagccgaccaaagacctggcggggttgttgccggcttccgcccacagtatcgcttctccggactatacggagagcgaggaggtggtcgatgaacagccttcgcgggaactgaccaaagccgatgtgctgcgggagcagatccttcgggccctgcggcgcaacaacggccgccgccgggaagccgctgccgagctgtttatgtcggagagaactctttaccgtaaaatcaaggagctcggcatcgacgagaactcctgaaaaatatcgtttataatcgaatgaaagctgtactcaaatatgcgatcgtcgtcgcagcgggcctcttgctggccggttgcgggtacaaggtgaactattcgttgtcgggcgcttcgattccgcccgatgccaagaccttcagtgtggcctacttcccgaacaacgccccgatggtggctccgatcctgagctcgacgctgacggatgccttgcgggacaagtttacgcgccagacgcgtttgacgcaggtggacgaaggcggcgatttcgctttcgaaggcgagatcaccggttatacttcgacgacggcttcggtttcgggttcgtccgaaacggccctgttgaaccgattgaccattaccgtcaatgtgcgcttcaccaatgcggtggacgagagcatgtcgtggaaaaagacgttttcggcgttcgaggatttcgattcttcgaaactgctgaatgaaatcgagggcgaactgatcccccaaatcgtcgataaactggtgacggacattttccaggcatcggcggcaaactggtagcggatggcngatttcaaggaatatacgatgtccggaggcacggtaggcccggtcgatgaagcgcagctcgatgcgctcgtcgggcgttacgagtggtttactcccgcccgtatcctgcgcgtgcttcaa

SEQ ID NO: 990 - DNA, 4000 bp, Escherichia coli
  misc_feature (1)..(1): n is a, c, g, or t
  misc_feature (3)..(3): n is a, c, g, or t
  misc_feature (5)..(5): n is a, c, g, or t
  misc_feature (9)..(10): n is a, c, g, or t
  misc_feature (13)..(14): n is a, c, g, or t
  misc_feature (17)..(25): n is a, c, g, or t
  misc_feature (27)..(27): n is a, c, g, or t
  misc_feature (29)..(30): n is a, c, g, or t
  misc_feature (32)..(32): n is a, c, g, or t
  misc_feature (34)..(40): n is a, c, g, or t
  misc_feature (42)..(42): n is a, c, g, or t
  misc_feature (44)..(44): n is a, c, g, or t
  misc_feature (48)..(49): n is a, c, g, or t
  misc_feature (51)..(51): n is a, c, g, or t
  misc_feature (55)..(56): n is a, c, g, or t
  misc_feature (58)..(58): n is a, c, g, or t
  misc_feature (60)..(60): n is a, c, g, or t
  misc_feature (62)..(62): n is a, c, g, or t
  misc_feature (64)..(65): n is a, c, g, or t
  misc_feature (69)..(69): n is a, c, g, or t
  misc_feature (71)..(72): n is a, c, g, or t
  misc_feature (74)..(74): n is a, c, g, or t
  misc_feature (77)..(77): n is a, c, g, or t
  misc_feature (79)..(79): n is a, c, g, or t
  misc_feature (81)..(81): n is a, c, g, or t
  misc_feature (83)..(83): n is a, c, g, or t
  misc_feature (86)..(86): n is a, c, g, or t
  misc_feature (90)..(91): n is a, c, g, or t
  misc_feature (93)..(93): n is a, c, g, or t
  misc_feature (96)..(97): n is a, c, g, or t
  misc_feature (99)..(101): n is a, c, g, or t
  misc_feature (105)..(107): n is a, c, g, or t
  misc_feature (110)..(110): n is a, c, g, or t
  misc_feature (114)..(114): n is a, c, g, or t
  misc_feature (116)..(116): n is a, c, g, or t
  misc_feature (122)..(127): n is a, c, g, or t
  misc_feature (130)..(130): n is a, c, g, or t
  misc_feature (134)..(134): n is a, c, g, or t
  misc_feature (136)..(143): n is a, c, g, or t
  misc_feature (147)..(150): n is a, c, g, or t
  misc_feature (152)..(153): n is a, c, g, or t
  misc_feature (156)..(157): n is a, c, g, or t
  misc_feature (160)..(164): n is a, c, g, or t
  misc_feature (166)..(170): n is a, c, g, or t
  misc_feature (173)..(175): n is a, c, g, or t
  misc_feature (179)..(180): n is a, c, g, or t
  misc_feature (182)..(184): n is a, c, g, or t
  misc_feature (188)..(190): n is a, c, g, or t
  misc_feature (193)..(193): n is a, c, g, or t
  misc_feature (197)..(200): n is a, c, g, or t
  misc_feature (202)..(205): n is a, c, g, or t
  misc_feature (207)..(210): n is a, c, g, or t
  misc_feature (212)..(212): n is a, c, g, or t
  misc_feature (219)..(219): n is a, c, g, or t
  misc_feature (221)..(221): n is a, c, g, or t
  misc_feature (223)..(228): n is a, c, g, or t
  misc_feature (230)..(230): n is a, c, g, or t
  misc_feature (233)..(233): n is a, c, g, or t
  misc_feature (235)..(235): n is a, c, g, or t
  misc_feature (237)..(240): n is a, c, g, or t
  misc_feature (242)..(242): n is a, c, g, or t
  misc_feature (245)..(248): n is a, c, g, or t
  misc_feature (251)..(252): n is a, c, g, or t
  misc_feature (255)..(255): n is a, c, g, or t
  misc_feature (257)..(263): n is a, c, g, or t
  misc_feature (265)..(267): n is a, c, g, or t
  misc_feature (272)..(272): n is a, c, g, or t
  misc_feature (275)..(276): n is a, c, g, or t
  misc_feature (280)..(281): n is a, c, g, or t
  misc_feature (285)..(285): n is a, c, g, or t
  misc_feature (288)..(288): n is a, c, g, or t
  misc_feature (291)..(291): n is a, c, g, or t
  misc_feature (293)..(294): n is a, c, g, or t
  misc_feature (298)..(298): n is a, c, g, or t
  misc_feature (303)..(304): n is a, c, g, or t
  misc_feature (307)..(307): n is a, c, g, or t
  misc_feature (309)..(309): n is a, c, g, or t
  misc_feature (313)..(314): n is a, c, g, or t
  misc_feature (316)..(316): n is a, c, g, or t
  misc_feature (318)..(318): n is a, c, g, or t
  misc_feature (320)..(320): n is a, c, g, or t
  misc_feature (323)..(326): n is a, c, g, or t
  misc_feature (329)..(333): n is a, c, g, or t
  misc_feature (335)..(336): n is a, c, g, or t
  misc_feature (339)..(339): n is a, c, g, or t
  misc_feature (341)..(342): n is a, c, g, or t
  misc_feature (345)..(347): n is a, c, g, or t
  misc_feature (349)..(351): n is a, c, g, or t
  misc_feature (353)..(365): n is a, c, g, or t
  misc_feature (368)..(369): n is a, c, g, or t
  misc_feature (371)..(371): n is a, c, g, or t
  misc_feature (375)..(376): n is a, c, g, or t
  misc_feature (378)..(380): n is a, c, g, or t
  misc_feature (382)..(382): n is a, c, g, or t
  misc_feature (385)..(385): n is a, c, g, or t
  misc_feature (387)..(388): n is a, c, g, or t
  misc_feature (390)..(391): n is a, c, g, or t
  misc_feature (393)..(393): n is a, c, g, or t
  misc_feature (395)..(397): n is a, c, g, or t
  misc_feature (400)..(400): n is a, c, g, or t
  misc_feature (402)..(412): n is a, c, g, or t
  misc_feature (414)..(414): n is a, c, g, or t
  misc_feature (418)..(418): n is a, c, g, or t
  misc_feature (421)..(421): n is a, c, g, or t
  misc_feature (423)..(423): n is a, c, g, or t
  misc_feature (425)..(429): n is a, c, g, or t
  misc_feature (432)..(433): n is a, c, g, or t
  misc_feature (436)..(436): n is a, c, g, or t
  misc_feature (441)..(451): n is a, c, g, or t
  misc_feature (453)..(454): n is a, c, g, or t
  misc_feature (456)..(457): n is a, c, g, or t
  misc_feature (459)..(459): n is a, c, g, or t
  misc_feature (462)..(465): n is a, c, g, or t
  misc_feature (467)..(467): n is a, c, g, or t
  misc_feature (469)..(471): n is a, c, g, or t
  misc_feature (474)..(474): n is a, c, g, or t
  misc_feature (478)..(480): n is a, c, g, or t
  misc_feature (482)..(482): n is a, c, g, or t
  misc_feature (485)..(485): n is a, c, g, or t
  misc_feature (489)..(489): n is a, c, g, or t
  misc_feature (491)..(493): n is a, c, g, or t
  misc_feature (495)..(498): n is a, c, g, or t
  misc_feature (501)..(502): n is a, c, g, or t
  misc_feature (504)..(504): n is a, c, g, or t
  misc_feature (506)..(506): n is a, c, g, or t
  misc_feature (508)..(508): n is a, c, g, or t
  misc_feature (511)..(524): n is a, c, g, or t
  misc_feature (526)..(529): n is a, c, g, or t
  misc_feature (534)..(534): n is a, c, g, or t
  misc_feature (536)..(537): n is a, c, g, or t
  misc_feature (540)..(540): n is a, c, g, or t
  misc_feature (542)..(542): n is a, c, g, or t
  misc_feature (544)..(545): n is a, c, g, or t
  misc_feature (547)..(548): n is a, c, g, or t
  misc_feature (550)..(555): n is a, c, g, or t
  misc_feature (558)..(565): n is a, c, g, or t
  misc_feature (567)..(583): n is a, c, g, or t
  misc_feature (586)..(592): n is a, c, g, or t
  misc_feature (595)..(595): n is a, c, g, or t
  misc_feature (597)..(598): n is a, c, g, or t
  misc_feature (600)..(603): n is a, c, g, or t
  misc_feature (605)..(607): n is a, c, g, or t
  misc_feature (609)..(610): n is a, c, g, or t
  misc_feature (612)..(615): n is a, c, g, or t
  misc_feature (617)..(618): n is a, c, g, or t
  misc_feature (620)..(622): n is a, c, g, or t
  misc_feature (624)..(625): n is a, c, g, or t
  misc_feature (630)..(632): n is a, c, g, or t
  misc_feature (634)..(634): n is a, c, g, or t
  misc_feature (637)..(639): n is a, c, g, or t
  misc_feature (641)..(643): n is a, c, g, or t
  misc_feature (645)..(650): n is a, c, g, or t
  misc_feature (652)..(660): n is a, c, g, or t
  misc_feature (662)..(663): n is a, c, g, or t
  misc_feature (665)..(667): n is a, c, g, or t
  misc_feature (669)..(671): n is a, c, g, or t
  misc_feature (673)..(673): n is a, c, g, or t
  misc_feature (675)..(676): n is a, c, g, or t
  misc_feature (678)..(681): n is a, c, g, or t
  misc_feature (683)..(684): n is a, c, g, or t
  misc_feature (686)..(689): n is a, c, g, or t
  misc_feature (692)..(703): n is a, c, g, or t
  misc_feature (706)..(709): n is a, c, g, or t
  misc_feature (711)..(711): n is a, c, g, or t
  misc_feature (713)..(716): n is a, c, g, or t
  misc_feature (718)..(718): n is a, c, g, or t
  misc_feature (722)..(724): n is a, c, g, or t
  misc_feature (726)..(726): n is a, c, g, or t
  misc_feature (728)..(732): n is a, c, g, or t
  misc_feature (734)..(743): n is a, c, g, or t
  misc_feature (745)..(748): n is a, c, g, or t
  misc_feature (750)..(754): n is a, c, g, or t
  misc_feature (756)..(757): n is a, c, g, or t
  misc_feature (759)..(759): n is a, c, g, or t
  misc_feature (761)..(761): n is a, c, g, or t
  misc_feature (763)..(771): n is a, c, g, or t
  misc_feature (773)..(773): n is a, c, g, or t
  misc_feature (775)..(776): n is a, c, g, or t
  misc_feature (778)..(778): n is a, c, g, or t
  misc_feature (780)..(780): n is a, c, g, or t
  misc_feature (782)..(783): n is a, c, g, or t
  misc_feature (786)..(791): n is a, c, g, or t
  misc_feature (793)..(796): n is a, c, g, or t
  misc_feature (798)..(799): n is a, c, g, or t
  misc_feature (801)..(804): n is a, c, g, or t
  misc_feature (806)..(808): n is a, c, g, or t
  misc_feature (813)..(822): n is a, c, g, or t
  misc_feature (825)..(829): n is a, c, g, or t
  misc_feature (831)..(836): n is a, c, g, or t
  misc_feature (838)..(839): n is a, c, g, or t
  misc_feature (843)..(843): n is a, c, g, or t
  misc_feature (845)..(845): n is a, c, g, or t
  misc_feature (847)..(852): n is a, c, g, or t
  misc_feature (854)..(855): n is a, c, g, or t
  misc_feature (857)..(858): n is a, c, g, or t
  misc_feature (861)..(866): n is a, c, g, or t
  misc_feature (869)..(874): n is a, c, g, or t
  misc_feature (876)..(878): n is a, c, g, or t
  misc_feature (880)..(885): n is a, c, g, or t
  misc_feature (887)..(889): n is a, c, g, or t
  misc_feature (891)..(896): n is a, c, g, or t
  misc_feature (898)..(899): n is a, c, g, or t
  misc_feature (901)..(901): n is a, c, g, or t
  misc_feature (904)..(910): n is a, c, g, or t
  misc_feature (914)..(918): n is a, c, g, or t
  misc_feature (922)..(926): n is a, c, g, or t
  misc_feature (928)..(931): n is a, c, g, or t
  misc_feature (933)..(939): n is a, c, g, or t
  misc_feature (941)..(941): n is a, c, g, or t
  misc_feature (943)..(948): n is a, c, g, or t
  misc_feature (950)..(950): n is a, c, g, or t
  misc_feature (953)..(956): n is a, c, g, or t
  misc_feature (958)..(962): n is a, c, g, or t
  misc_feature (964)..(965): n is a, c, g, or t
  misc_feature (967)..(970): n is a, c, g, or t
  misc_feature (972)..(972): n is a, c, g, or t
  misc_feature (974)..(975): n is a, c, g, or t
  misc_feature (977)..(977): n is a, c, g, or t
  misc_feature (979)..(980): n is a, c, g, or t
  misc_feature (983)..(987): n is a, c, g, or t
  misc_feature (989)..(1002): n is a, c, g, or t
  misc_feature (1004)..(1010): n is a, c, g, or t
  misc_feature (1012)..(1012): n is a, c, g, or t
  misc_feature (1014)..(1017): n is a, c, g, or t
  misc_feature (1022)..(1031): n is a, c, g, or t
  misc_feature (1033)..(1033): n is a, c, g, or t
  misc_feature (1035)..(1037): n is a, c, g, or t
  misc_feature (1040)..(1040): n is a, c, g, or t
  misc_feature (1042)..(1042): n is a, c, g, or t
  misc_feature (1045)..(1048): n is a, c, g, or t
  misc_feature (1050)..(1051): n is a, c, g, or t
  misc_feature (1053)..(1053): n is a, c, g, or t
  misc_feature (1055)..(1056): n is a, c, g, or t
  misc_feature (1058)..(1058): n is a, c, g, or t
  misc_feature (1060)..(1068): n is a, c, g, or t
  misc_feature (1070)..(1070): n is a, c, g, or t
  misc_feature (1073)..(1077): n is a, c, g, or t
  misc_feature (1081)..(1081): n is a, c, g, or t
  misc_feature (1085)..(1090): n is a, c, g, or t
  misc_feature (1093)..(1101): n is a, c, g, or t
  misc_feature (1103)..(1103): n is a, c, g, or t
  misc_feature (1106)..(1111): n is a, c, g, or t
  misc_feature (1114)..(1114): n is a, c, g, or t
  misc_feature (1116)..(1116): n is a, c, g, or t
  misc_feature (1118)..(1119): n is a, c, g, or t
  misc_feature (1121)..(1122): n is a, c, g, or t
  misc_feature (1124)..(1125): n is a, c, g, or t
  misc_feature (1127)..(1128): n is a, c, g, or t
  misc_feature (1131)..(1132): n is a, c, g, or t
  misc_feature (1137)..(1137): n is a, c, g, or t
  misc_feature (1142)..(1142): n is a, c, g, or t
  misc_feature (1144)..(1145): n is a, c, g, or t
  misc_feature (1147)..(1151): n is a, c, g, or t
  misc_feature (1153)..(1153): n is a, c, g, or t
  misc_feature (1158)..(1159): n is a, c, g, or t
  misc_feature (1161)..(1162): n is a, c, g, or t
  misc_feature (1164)..(1167): n is a, c, g, or t
  misc_feature (1169)..(1171): n is a, c, g, or t
  misc_feature (1173)..(1174): n is a, c, g, or t
  misc_feature (1176)..(1177): n is a, c, g, or t
  misc_feature (1179)..(1181): n is a, c, g, or t
  misc_feature (1183)..(1183): n is a, c, g, or t
  misc_feature (1185)..(1185): n is a, c, g, or t
  misc_feature (1187)..(1188): n is a, c, g, or t
  misc_feature (1191)..(1191): n is a, c, g, or t
  misc_feature (1194)..(1195): n is a, c, g, or t
  misc_feature (1197)..(1199): n is a, c, g, or t
  misc_feature (1201)..(1203): n is a, c, g, or t
  misc_feature (1205)..(1205): n is a, c, g, or t
  misc_feature (1209)..(1211): n is a, c, g, or t
  misc_feature (1214)..(1214): n is a, c, g, or t
  misc_feature (1216)..(1216): n is a, c, g, or t
  misc_feature (1220)..(1220): n is a, c, g, or t
  misc_feature (1222)..(1228): n is a, c, g, or t
  misc_feature (1230)..(1235): n is a, c, g, or t
  misc_feature (1237)..(1237): n is a, c, g, or t
  misc_feature (1240)..(1242): n is a, c, g, or t
  misc_feature (1244)..(1245): n is a, c, g, or t
  misc_feature (1247)..(1252): n is a, c, g, or t
  misc_feature (1255)..(1258): n is a, c, g, or t
  misc_feature (1261)..(1263): n is a, c, g, or t
  misc_feature (1266)..(1271): n is a, c, g, or t
  misc_feature (1273)..(1277): n is a, c, g, or t
  misc_feature (1279)..(1279): n is a, c, g, or t
  misc_feature (1281)..(1284): n is a, c, g, or t
  misc_feature (1288)..(1288): n is a, c, g, or t
  misc_feature (1290)..(1295): n is a, c, g, or t
  misc_feature (1298)..(1298): n is a, c, g, or t
  misc_feature (1300)..(1301): n is a, c, g, or t
  misc_feature (1303)..(1304): n is a, c, g, or t
  misc_feature (1306)..(1308): n is a, c, g, or t
  misc_feature (1310)..(1311): n is a, c, g, or t
  misc_feature (1313)..(1314): n is a, c, g, or t
  misc_feature (1317)..(1322): n is a, c, g, or t
  misc_feature (1325)..(1328): n is a, c, g, or t
  misc_feature (1331)..(1334): n is a, c, g, or t
  misc_feature (1337)..(1337): n is a, c, g, or t
  misc_feature (1339)..(1339): n is a, c, g, or t
  misc_feature (1341)..(1344): n is a, c, g, or t
  misc_feature (1348)..(1348): n is a, c, g, or t
  misc_feature (1352)..(1354): n is a, c, g, or t
  misc_feature (1357)..(1361): n is a, c, g, or t
  misc_feature (1363)..(1363): n is a, c, g, or t
  misc_feature (1365)..(1366): n is a, c, g, or t
  misc_feature (1368)..(1369): n is a, c, g, or t
  misc_feature (1371)..(1371): n is a, c, g, or t
  misc_feature (1373)..(1373): n is a, c, g, or t
  misc_feature (1375)..(1376): n is a, c, g, or t
  misc_feature (1379)..(1385): n is a, c, g, or t
  misc_feature (1387)..(1387): n is a, c, g, or t
  misc_feature (1391)..(1392): n is a, c, g, or t
  misc_feature (1394)..(1394): n is a, c, g, or t
  misc_feature (1398)..(1398): n is a, c, g, or t
  misc_feature (1402)..(1403): n is a, c, g, or t
  misc_feature (1405)..(1407): n is a, c, g, or t
  misc_feature (1409)..(1412): n is a, c, g, or t
  misc_feature (1414)..(1415): n is a, c, g, or t
  misc_feature (1417)..(1420): n is a, c, g, or t
  misc_feature (1422)..(1426): n is a, c, g, or t
  misc_feature (1431)..(1436): n is a, c, g, or t
  misc_feature (1438)..(1438): n is a, c, g, or t
  misc_feature (1444)..(1445): n is a, c, g, or t
  misc_feature (1447)..(1448): n is a, c, g, or t
  misc_feature (1453)..(1453): n is a, c, g, or t
  misc_feature (1455)..(1460): n is a, c, g, or t
  misc_feature (1462)..(1465): n is a, c, g, or t
  misc_feature (1467)..(1467): n is a, c, g, or t
  misc_feature (1469)..(1470): n is a, c, g, or t
  misc_feature (1472)..(1472): n is a, c, g, or t
  misc_feature (1476)..(1477): n is a, c, g, or t
  misc_feature (1479)..(1479): n is a, c, g, or t
  misc_feature (1483)..(1484): n is a, c, g, or t
  misc_feature (1487)..(1487): n is a, c, g, or t
  misc_feature (1490)..(1491): n is a, c, g, or t
  misc_feature (1493)..(1493): n is a, c, g, or t
  misc_feature (1496)..(1496): n is a, c, g, or t
  misc_feature (1498)..(1499): n is a, c, g, or t
  misc_feature (1503)..(1503): n is a, c, g, or t
  misc_feature (1505)..(1514): n is a, c, g, or t
  misc_feature (1516)..(1517): n is a, c, g, or t
  misc_feature (1521)..(1526): n is a, c, g, or t
  misc_feature (1529)..(1529): n is a, c, g, or t
  misc_feature (1531)..(1531): n is a, c, g, or t
  misc_feature (1534)..(1536): n is a, c, g, or t
  misc_feature (1538)..(1543): n is a, c, g, or t
  misc_feature (1545)..(1547): n is a, c, g, or t
  misc_feature (1549)..(1551): n is a, c, g, or t
  misc_feature (1554)..(1554): n is a, c, g, or t
  misc_feature (1556)..(1557): n is a, c, g, or t
  misc_feature (1559)..(1560): n is a, c, g, or t
  misc_feature (1563)..(1564): n is a, c, g, or t
  misc_feature (1566)..(1566): n is a, c, g, or t
  misc_feature (1568)..(1571): n is a, c, g, or t
  misc_feature (1574)..(1576): n is a, c, g, or t
  misc_feature (1578)..(1580): n is a, c, g, or t
  misc_feature (1582)..(1583): n is a, c, g, or t
  misc_feature (1586)..(1586): n is a, c, g, or t
  misc_feature (1588)..(1590): n is a, c, g, or t
  misc_feature (1592)..(1593): n is a, c, g, or t
  misc_feature (1595)..(1596): n is a, c, g, or t
  misc_feature (1598)..(1598): n is a, c, g, or t
  misc_feature (1600)..(1605): n is a, c, g, or t
  misc_feature (1609)..(1610): n is a, c, g, or t
  misc_feature (1612)..(1615): n is a, c, g, or t
  misc_feature (1617)..(1618): n is a, c, g, or t
  misc_feature (1620)..(1620): n is a, c, g, or t
  misc_feature (1623)..(1627): n is a, c, g, or t
  misc_feature (1630)..(1630): n is a, c, g, or t
  misc_feature (1632)..(1634): n is a, c, g, or t
  misc_feature (1636)..(1638): n is a, c, g, or t
  misc_feature (1642)..(1642): n is a, c, g, or t
  misc_feature (1645)..(1645): n is a, c, g, or t
  misc_feature (1647)..(1650): n is a, c, g, or t
  misc_feature (1652)..(1653): n is a, c, g, or t
  misc_feature (1656)..(1656): n is a, c, g, or t
  misc_feature (1659)..(1673): n is a, c, g, or t
  misc_feature (1675)..(1684): n is a, c, g, or t
  misc_feature (1686)..(1691): n is a, c, g, or t
  misc_feature (1693)..(1693): n is a, c, g, or t
  misc_feature (1698)..(1698): n is a, c, g, or t
  misc_feature (1700)..(1702): n is a, c, g, or t
  misc_feature (1704)..(1705): n is a, c, g, or t
  misc_feature (1707)..(1709): n is a, c, g, or t
  misc_feature (1711)..(1711): n is a, c, g, or t
  misc_feature (1713)..(1714): n is a, c, g, or t
  misc_feature (1717)..(1723): n is a, c, g, or t
  misc_feature (1725)..(1728): n is a, c, g, or t
  misc_feature (1730)..(1731): n is a, c, g, or t
  misc_feature (1733)..(1733): n is a, c, g, or t
  misc_feature (1735)..(1737): n is a, c, g, or t
  misc_feature (1739)..(1742): n is a, c, g, or t
  misc_feature (1748)..(1748): n is a, c, g, or t
  misc_feature (1750)..(1758): n is a, c, g, or t
  misc_feature (1761)..(1761): n is a, c, g, or t
  misc_feature (1763)..(1763): n is a, c, g, or t
  misc_feature (1765)..(1766): n is a, c, g, or t
  misc_feature (1769)..(1771): n is a, c, g, or t
  misc_feature (1775)..(1776): n is a, c, g, or t
  misc_feature (1782)..(1792): n is a, c, g, or t
  misc_feature (1794)..(1806): n is a, c, g, or t
  misc_feature (1810)..(1816): n is a, c, g, or t
  misc_feature (1819)..(1819): n is a, c, g, or t
  misc_feature (1821)..(1824): n is a, c, g, or t
  misc_feature (1826)..(1828): n is a, c, g, or t
  misc_feature (1830)..(1837): n is a, c, g, or t
  misc_feature (1839)..(1842): n is a, c, g, or t
  misc_feature (1845)..(1851): n is a, c, g, or t
  misc_feature (1853)..(1853): n is a, c, g, or t
  misc_feature (1855)..(1855): n is a, c, g, or t
  misc_feature (1857)..(1864): n is a, c, g, or t
  misc_feature (1866)..(1866): n is a, c, g, or t
  misc_feature (1869)..(1869): n is a, c, g, or t
  misc_feature (1871)..(1873): n is a, c, g, or t
  misc_feature (1875)..(1875): n is a, c, g, or t
  misc_feature (1877)..(1878): n is a, c, g, or t
  misc_feature (1987)..(1987): n is a, c, g, or t
  misc_feature (1996)..(1996): n is a, c, g, or t
  misc_feature (3541)..(3542): n is a, c, g, or t
  misc_feature (3545)..(3545): n is a, c, g, or t
  misc_feature (3549)..(3550): n is a, c, g, or t
  misc_feature (3552)..(3552): n is a, c, g, or t
  misc_feature (3554)..(3564): n is a, c, g, or t
  misc_feature (3566)..(3570): n is a, c, g, or t
  misc_feature (3573)..(3576): n is a, c, g, or t
  misc_feature (3579)..(3583): n is a, c, g, or t
  misc_feature (3585)..(3587): n is a, c, g, or t
  misc_feature (3589)..(3591): n is a, c, g, or t
  misc_feature (3595)..(3596): n is a, c, g, or t
  misc_feature (3598)..(3598): n is a, c, g, or t
  misc_feature (3600)..(3600): n is a, c, g, or t
  misc_feature (3602)..(3602): n is a, c, g, or t
  misc_feature (3604)..(3607): n is a, c, g, or t
  misc_feature (3609)..(3611): n is a, c, g, or t
  misc_feature (3614)..(3614): n is a, c, g, or t
  misc_feature (3616)..(3617): n is a, c, g, or t
  misc_feature (3620)..(3620): n is a, c, g, or t
  misc_feature (3622)..(3622): n is a, c, g, or t
  misc_feature (3624)..(3625): n is a, c, g, or t
  misc_feature (3627)..(3627): n is a, c, g, or t
  misc_feature (3631)..(3632): n is a, c, g, or t
  misc_feature (3636)..(3636): n is a, c, g, or t
  misc_feature (3639)..(3639): n is a, c, g, or t
  misc_feature (3641)..(3642): n is a, c, g, or t
  misc_feature (3645)..(3649): n is a, c, g, or t
  misc_feature (3651)..(3657): n is a, c, g, or t
  misc_feature (3659)..(3663): n is a, c, g, or t
  misc_feature (3666)..(3668): n is a, c, g, or t
  misc_feature (3670)..(3675): n is a, c, g, or t
  misc_feature (3677)..(3683): n is a, c, g, or t
  misc_feature (3686)..(3690): n is a, c, g, or t
  misc_feature (3692)..(3696): n is a, c, g, or t
  misc_feature (3699)..(3702): n is a, c, g, or t
  misc_feature (3705)..(3707): n is a, c, g, or t
  misc_feature (3709)..(3710): n is a, c, g, or t
  misc_feature (3712)..(3728): n is a, c, g, or t
  misc_feature (3730)..(3732): n is a, c, g, or t
  misc_feature (3734)..(3735): n is a, c, g, or t
  misc_feature (3737)..(3737): n is a, c, g, or t
  misc_feature (3739)..(3740): n is a, c, g, or t
  misc_feature (3742)..(3743): n is a, c, g, or t
  misc_feature (3746)..(3747): n is a, c, g, or t
  misc_feature (3749)..(3752): n is a, c, g, or t
  misc_feature (3754)..(3754): n is a, c, g, or t
  misc_feature (3756)..(3756): n is a, c, g, or t
  misc_feature (3760)..(3761): n is a, c, g, or t
  misc_feature (3763)..(3764): n is a, c, g, or t
  misc_feature (3766)..(3771): n is a, c, g, or t
  misc_feature (3774)..(3774): n is a, c, g, or t
  misc_feature (3776)..(3780): n is a, c, g, or t
  misc_feature (3782)..(3784): n is a, c, g, or t
  misc_feature (3786)..(3787): n is a, c, g, or t
  misc_feature (3789)..(3790): n is a, c, g, or t
  misc_feature (3792)..(3805): n is a, c, g, or t
  misc_feature (3807)..(3813): n is a, c, g, or t
  misc_feature (3815)..(3817): n is a, c, g, or t
  misc_feature (3819)..(3821): n is a, c, g, or t
  misc_feature (3825)..(3825): n is a, c, g, or t
  misc_feature (3827)..(3827): n is a, c, g, or t
  misc_feature (3829)..(3829): n is a, c, g, or t
  misc_feature (3831)..(3836): n is a, c, g, or t
  misc_feature (3838)..(3843): n is a, c, g, or t
  misc_feature (3845)..(3845): n is a, c, g, or t
  misc_feature (3847)..(3851): n is a, c, g, or t
  misc_feature (3853)..(3853): n is a, c, g, or t
  misc_feature (3856)..(3858): n is a, c, g, or t
  misc_feature (3861)..(3863): n is a, c, g, or t
  misc_feature (3871)..(3874): n is a, c, g, or t
  misc_feature (3876)..(3878): n is a, c, g, or t
  misc_feature (3882)..(3882): n is a, c, g, or t
  misc_feature (3884)..(3886): n is a, c, g, or t
  misc_feature (3888)..(3891): n is a, c, g, or t
  misc_feature (3893)..(3893): n is a, c, g, or t
  misc_feature (3895)..(3898): n is a, c, g, or t
  misc_feature (3900)..(3901): n is a, c, g, or t
  misc_feature (3903)..(3908): n is a, c, g, or t
  misc_feature (3910)..(3911): n is a, c, g, or t
  misc_feature (3914)..(3921): n is a, c, g, or t
  misc_feature (3923)..(3926): n is a, c, g, or t
  misc_feature (3928)..(3930): n is a, c, g, or t
  misc_feature (3932)..(3932): n is a, c, g, or t
  misc_feature (3935)..(3935): n is a, c, g, or t
  misc_feature (3937)..(3937): n is a, c, g, or t
  misc_feature (3940)..(3941): n is a, c, g, or t
  misc_feature (3943)..(3944): n is a, c, g, or t
  misc_feature (3947)..(3947): n is a, c, g, or t
  misc_feature (3950)..(3950): n is a, c, g, or t
  misc_feature (3953)..(3954): n is a, c, g, or t
  misc_feature (3956)..(3962): n is a, c, g, or t
  misc_feature (3966)..(3966): n is a, c, g, or t
  misc_feature (3968)..(3969): n is a, c, g, or t
  misc_feature (3972)..(3975): n is a, c, g, or t
  misc_feature (3977)..(3977): n is a, c, g, or t
  misc_feature (3979)..(3979): n is a, c, g, or t
  misc_feature (3981)..(3983): n is a, c, g, or t
  misc_feature (3986)..(3988): n is a, c, g, or t
  misc_feature (3990)..(3991): n is a, c, g, or t
  misc_feature (3993)..(3994): n is a, c, g, or t
  misc_feature (3996)..(4000): n is a, c, g, or t
ngntngagnngtnnggnnnnnnnnncncnnancnnnnnnngncncctnncngatnntncncncnnccancnncnttncnancngcnccgnntntcnncnnncggnnncgntccnantcacgnnnnnnagntatnannnnnnnntagnnnntnngannagnnnnntnnnnntgnnntatnngnnngacnnncangctnnnngnnnntnnnncnagcttgngnannnnnngnatngngnnnncntcnnnngannggngnnnnnnncnnngaagnagnnatcnnaganagngangnngcanagggnnaanangaanncnangnagnnnncannnnngnnganannctnnnannngnnnnnnnnnnnnnagnngnggtnncnnncnttngnntnngntnnnttncnnnnnnnnnnncncgtnttncncnnnnntcnnacnccttnnnnnnnnnnncnncnncntgnnnntntnnnctntgtnnntnacntttncnnntnnnnacnnangntnttnnnnnnnnnnnnnngnnnntgagnannggnangnngnngnnnnnnatnnnnnnnngnnnnnnnnnnnnnnnnnaannnnnnntancnngnnnnannnannannnncnnannntnnagacnnngnatnnngnnncnnnnnncnnnnnnnnnanncnnntnnngncnnannnnanngnnnnctnnnnnnnnnnnnggnnnncncnnnntncgannngnannnnnannnnnnnnnntnnnntnnnnngnnanantnnnnnnnnntngnngntnannaannnnnntnnnngnnannnnannnacgtnnnnnnnnnnaannnnncnnnnnncnncacnancnnnnnngnnannacnnnnnncgnnnnnntnnnannnnnnannngnnnnnncnngngtnnnnnnnggannnnntgannnnnannnngnnnnnnngntnnnnnntnagnnnntnnnnncnntnnnnananntngnnagnnnnnannnnnnnnnnnnnnannnnnnntngnnnnaaacnnnnnnnnnngnannnaancngannnngnngnannanannnnnnnnngnggnnnnngacngtgnnnnnnggnnnnnnnnntngannnnnngcnangnnanngnncnncanncagcngcgtngnncnnnnncnacccnngnngnnnngnnncnncnncnnntncntnnaancanncnnncnnncntcannncananccantnnnnnnncnnnnnnanccnnngnncnnnnnngtnnnngtnnncgnnnnnngnnnnntntnnnngganannnnnnagnannanngnnnanntnnaannnnnntgnnnnaannnnaanantnnnncgcnaacnnnacnnnnntncnncnnanancnnacnnnnnnncnaccnncnctancatnntnnnannnncnnannnncnnnnncaggnnnnnngnagaggnngnnggagntnnnnnnannnngngnnanaggnnancggnnagngannangtnannaggnannnnnnnnnncnncaannnnnncancnggnnntnnnnnntnnngnnngtngnngnntcnntngnnnngtnnnannntnncgngnnngnnannancnnnnnnagtnngnnnntnnanaannnnntcngnnngnnnaaanatntnnnngnnttnaannnnnnnnnnnnnnngnnnnnnnnnntnnnnnngntgctngnnntnncnnngntnnccnnnnnnntnnnngnntncnnngnnnnggtagngnnnnnnnnncancngnngannnactnnttcatnnnnnnnnnnncnnnnnnnnnnnnnagannnnnnnggntnnnnannnannnnnnnngnnnngannnnnnntnantnnnnnnnnantancnnngncnnaccgcccactagcatctaaatcgcgtcgatgatatagtttagatgagcgcgtagtgtcatggctgcaggataggacatgtcgcgggggacaccgatgcggtcgcgaagntagaccagncattttgcaacatccttcccatcctggcttgtttcagcggtggaagcaccggcagatccatcgagcagcagggaaacggtggtacgcagcaacttatccaccttatccttatagttcaggttcggcactgcagtagggtccgccaggggagctccaaactgcttggctcctcgctcacccatgcctcggcaacaaaactttacaattgcgtcgtagtttgaaacgagcttgtaagccgcctcgtggcgagcagcttcatccccaggattcattgaatcaggtagaggttccgcatcactgggagacagattcagcggaagcctccaggtagagagcccgtcaatatttagctgtgcttgcttggctgcttcacttgagtctccatatcccggcccgtactggggaggtatgtccatcacgtgagtgtagtaatccgattttgtagccatgtaacaaggcctctcttcgaaagctgcaaaccacctttcgacgtttgcccatcgctcagtggaccggagctggaggcctttccagtacaggcacgacgcgttcatcctttcaacatgtgaaacatattgcaagtcgacgatagaaggagtgtcaccgccaaggaaccagggccccggtaattctcccaacgcttcgttcaccttgtcaaacgtttcctcgaattgttttctggctccaccgccaaacggtcccggtcccgaagggcgaaacacaagtccacaccagtcagaaaacagctgcctttcgaggcgaagaagcgtgttggcgcggtcgaagtgttcctctggaatcatcggaatctcaggaaacgtctgctcaagtatctgcattatgacgagagattcggtgatcatctttccgtccagctccaggacagggagcaacccagaaggcaccttcttgaggaaccaagcaggcttgtccccataactgcgcatgtttatccgctcgattcgataaggaatcttcttctcctcgagcatcatccatactttctgacaataaggacaccaagctgcgtgatctctgtagaacgtcactttgacatcatcctcagacgcaccaaagagtcgcaatttggcagtcacgtggggagcaccttcacctttagcacgcagtttctcctcttcggcaatcttctttccggtctcggtactcactgcgatccctttcagctcgtccctggagaaagtgcagagagctcagcacggacgcgtgatgctacaaaaacgcgggatgcattatctaaggatgaattaccagctgagaaccttctccgggaggacggcagtcgtcgcggctgctcgtaagggaaaactcatatttcgagatgaccgggagctcttcgtcactcgtgtggcgtttgcgctgtaaccctttgtccaggtcaagggctgtgcgcatatgctgggcatggacatggacagtcacgctcgcctcgatttcacgctcgcctcgatttcaagtggcatgtattgtgagtgcagcatcaggagggaaagcagataagttttgcgcacgtgtcgaattttggtnntanaaanntnannnnnnnnnnncnnnnngannnncgnnnnnannntnnntgcnncntncntnnnntnnntcnannagnantnntngttnnctgngtngnnggnnnnnannnnnnngnnnnngannngnnnnnngnnnnnnnctnnnnncnnnnngtnnnncannngnngnnnnnnnnnnnnnnnnnannncnncncnncnnccnncnnnncntntatnntnnannnnnncancnnnnnannngnngnngnnnnnnnnnnnnnngnnnnnnngnnnannnaatnancncnnnnnncnnnnnngngnnnnncnacnnncgnnncgccgtcnnnngnnntgangnnntnnnngnannnngnncnnnnnncnngannnnnnnngnnnncnnngntgntngcnncnnccnccnccnngnnnnnnncctncnncgnnnngncntnnnagnnngnngnnannnnn

SEQ ID NO: 991 - DNA, 4000 bp, Escherichia coli
  misc_feature (491)..(491): n is a, c, g, or t
  misc_feature (2048)..(2048): n is a, c, g, or t
  misc_feature (2161)..(2161): n is a, c, g, or t
  misc_feature (2175)..(2175): n is a, c, g, or t
  misc_feature (2183)..(2183): n is a, c, g, or t
  misc_feature (2191)..(2192): n is a, c, g, or t
  misc_feature (2195)..(2197): n is a, c, g, or t
  misc_feature (2201)..(2204): n is a, c, g, or t
  misc_feature (2207)..(2208): n is a, c, g, or t
  misc_feature (2210)..(2214): n is a, c, g, or t
  misc_feature (2224)..(2224): n is a, c, g, or t
  misc_feature (2228)..(2229): n is a, c, g, or t
  misc_feature (2232)..(2235): n is a, c, g, or t
  misc_feature (2238)..(2239): n is a, c, g, or t
  misc_feature (2246)..(2247): n is a, c, g, or t
  misc_feature (2254)..(2255): n is a, c, g, or t
  misc_feature (2257)..(2258): n is a, c, g, or t
  misc_feature (2260)..(2261): n is a, c, g, or t
  misc_feature (2266)..(2266): n is a, c, g, or t
  misc_feature (2271)..(2272): n is a, c, g, or t
  misc_feature (2277)..(2277): n is a, c, g, or t
  misc_feature (2279)..(2281): n is a, c, g, or t
  misc_feature (2288)..(2288): n is a, c, g, or t
  misc_feature (2290)..(2292): n is a, c, g, or t
  misc_feature (2299)..(2299): n is a, c, g, or t
  misc_feature (2312)..(2312): n is a, c, g, or t
  misc_feature (2315)..(2316): n is a, c, g, or t
  misc_feature (2322)..(2322): n is a, c, g, or t
  misc_feature (2325)..(2325): n is a, c, g, or t
  misc_feature (2332)..(2338): n is a, c, g, or t
  misc_feature (2343)..(2344): n is a, c, g, or t
  misc_feature (2349)..(2349): n is a, c, g, or t
  misc_feature (2352)..(2352): n is a, c, g, or t
  misc_feature (2359)..(2359): n is a, c, g, or t
  misc_feature (2365)..(2365): n is a, c, g, or t
  misc_feature (2377)..(2379): n is a, c, g, or t
  misc_feature (2390)..(2392): n is a, c, g, or t
  misc_feature (2394)..(2394): n is a, c, g, or t
  misc_feature (2399)..(2399): n is a, c, g, or t
  misc_feature (2401)..(2401): n is a, c, g, or t
  misc_feature (2404)..(2404): n is a, c, g, or t
  misc_feature (2407)..(2407): n is a, c, g, or t
  misc_feature (2416)..(2417): n is a, c, g, or t
  misc_feature (2422)..(2422): n is a, c, g, or t
  misc_feature (2427)..(2427): n is a, c, g, or t
  misc_feature (2431)..(2431): n is a, c, g, or t
  misc_feature (2434)..(2434): n is a, c, g, or t
  misc_feature (2436)..(2437): n is a, c, g, or t
  misc_feature (2442)..(2442): n is a, c, g, or t
  misc_feature (2458)..(2460): n is a, c, g, or t
  misc_feature (2466)..(2466): n is a, c, g, or t
  misc_feature (2468)..(2470): n is a, c, g, or t
  misc_feature (2472)..(2472): n is a, c, g, or t
  misc_feature (2475)..(2475): n is a, c, g, or t
  misc_feature (2477)..(2480): n is a, c, g, or t
  misc_feature (2485)..(2489): n is a, c, g, or t
  misc_feature (2496)..(2497): n is a, c, g, or t
  misc_feature (2518)..(2521): n is a, c, g, or t
  misc_feature (2527)..(2529): n is a, c, g, or t
  misc_feature (2531)..(2534): n is a, c, g, or t
  misc_feature (2537)..(2541): n is a, c, g, or t
  misc_feature (2543)..(2544): n is a, c, g, or t
  misc_feature (2553)..(2553): n is a, c, g, or t
  misc_feature (2556)..(2568): n is a, c, g, or t
  misc_feature (2572)..(2572): n is a, c, g, or t
  misc_feature (2575)..(2575): n is a, c, g, or t
  misc_feature (2581)..(2581): n is a, c, g, or t
  misc_feature (2586)..(2587): n is a, c, g, or t
  misc_feature (2594)..(2596): n is a, c, g, or t
  misc_feature (2602)..(2609): n is a, c, g, or t
  misc_feature (2612)..(2612): n is a, c, g, or t
  misc_feature (2616)..(2618): n is a, c, g, or t
  misc_feature (2621)..(2624): n is a, c, g, or t
  misc_feature (2626)..(2627): n is a, c, g, or t
  misc_feature (2630)..(2630): n is a, c, g, or t
  misc_feature (2637)..(2640): n is a, c, g, or t
  misc_feature (2644)..(2644): n is a, c, g, or t
  misc_feature (2648)..(2648): n is a, c, g, or t
  misc_feature (2651)..(2652): n is a, c, g, or t
  misc_feature (2655)..(2655): n is a, c, g, or t
  misc_feature (2658)..(2658): n is a, c, g, or t
  misc_feature (2663)..(2664): n is a, c, g, or t
  misc_feature (2667)..(2670): n is a, c, g, or t
  misc_feature (2676)..(2676): n is a, c, g, or t
  misc_feature (2681)..(2681): n is a, c, g, or t
  misc_feature (2685)..(2689): n is a, c, g, or t
  misc_feature (2691)..(2691): n is a, c, g, or t
  misc_feature (2693)..(2694): n is a, c, g, or t
  misc_feature (2697)..(2698): n is a, c, g, or t
  misc_feature (2700)..(2700): n is a, c, g, or t
  misc_feature (2702)..(2702): n is a, c, g, or t
  misc_feature (2704)..(2704): n is a, c, g, or t
  misc_feature (2709)..(2709): n is a, c, g, or t
  misc_feature (2712)..(2718): n is a, c, g, or t
  misc_feature (2722)..(2722): n is a, c, g, or t
  misc_feature (2725)..(2725): n is a, c, g, or t
  misc_feature (2730)..(2730): n is a, c, g, or t
  misc_feature (2733)..(2734): n is a, c, g, or t
  misc_feature (2740)..(2742): n is a, c, g, or t
  misc_feature (2745)..(2748): n is a, c, g, or t
  misc_feature (2754)..(2755): n is a, c, g, or t
  misc_feature (2760)..(2762): n is a, c, g, or t
  misc_feature (2766)..(2767): n is a, c, g, or t
  misc_feature (2774)..(2774): n is a, c, g, or t
  misc_feature (2777)..(2778): n is a, c, g, or t
  misc_feature (2781)..(2784): n is a, c, g, or t
  misc_feature (2789)..(2791): n is a, c, g, or t
  misc_feature (2796)..(2799): n is a, c, g, or t
  misc_feature (2802)..(2802): n is a, c, g, or t
  misc_feature (2805)..(2807): n is a, c, g, or t
  misc_feature (2809)..(2809): n is a, c, g, or t
  misc_feature (2821)..(2821): n is a, c, g, or t
  misc_feature (2823)..(2823): n is a, c, g, or t
  misc_feature (2826)..(2826): n is a, c, g, or t
  misc_feature (2831)..(2833): n is a, c, g, or t
  misc_feature (2838)..(2842): n is a, c, g, or t
  misc_feature (2846)..(2847): n is a, c, g, or t
  misc_feature (2852)..(2854): n is a, c, g, or t
  misc_feature (2861)..(2861): n is a, c, g, or t
  misc_feature (2864)..(2864): n is a, c, g, or t
  misc_feature (2868)..(2871): n is a, c, g, or t
  misc_feature (2874)..(2874): n is a, c, g, or t
  misc_feature (2877)..(2877): n is a, c, g, or t
  misc_feature (2879)..(2879): n is a, c, g, or t
  misc_feature (2881)..(2884): n is a, c, g, or t
  misc_feature (2887)..(2887): n is a, c, g, or t
  misc_feature (2891)..(2891): n is a, c, g, or t
  misc_feature (2895)..(2896): n is a, c, g, or t
  misc_feature (2903)..(2904): n is a, c, g, or t
  misc_feature (2906)..(2908): n is a, c, g, or t
  misc_feature (2912)..(2912): n is a, c, g, or t
  misc_feature (2917)..(2918): n is a, c, g, or t
  misc_feature (2923)..(2930): n is a, c, g, or t
  misc_feature (2937)..(2937): n is a, c, g, or t
  misc_feature (2942)..(2943): n is a, c, g, or t
  misc_feature (2948)..(2959): n is a, c, g, or t
  misc_feature (2965)..(2965): n is a, c, g, or t
  misc_feature (2968)..(2968): n is a, c, g, or t
  misc_feature (2972)..(2975): n is a, c, g, or t
  misc_feature (2979)..(2980): n is a, c, g, or t
  misc_feature (2982)..(2982): n is a, c, g, or t
  misc_feature (2985)..(2985): n is a, c, g, or t
  misc_feature (2988)..(2998): n is a, c, g, or t
  misc_feature (3000)..(3002): n is a, c, g, or t
  misc_feature (3005)..(3005): n is a, c, g, or t
  misc_feature (3009)..(3009): n is a, c, g, or t
  misc_feature (3011)..(3011): n is a, c, g, or t
  misc_feature (3013)..(3014): n is a, c, g, or t
  misc_feature (3018)..(3018): n is a, c, g, or t
  misc_feature (3021)..(3021): n is a, c, g, or t
  misc_feature (3024)..(3024): n is a, c, g, or t
  misc_feature (3026)..(3026): n is a, c, g, or t
  misc_feature (3028)..(3029): n is a, c, g, or t
  misc_feature (3031)..(3031): n is a, c, g, or t
  misc_feature (3035)..(3035): n is a, c, g, or t
  misc_feature (3039)..(3039): n is a, c, g, or t
  misc_feature (3042)..(3042): n is a, c, g, or t
  misc_feature (3045)..(3045): n is a, c, g, or t
  misc_feature (3047)..(3047): n is a, c, g, or t
  misc_feature (3052)..(3052): n is a, c, g, or t
  misc_feature (3054)..(3055): n is a, c, g, or t
  misc_feature (3058)..(3060): n is a, c, g, or t
  misc_feature (3063)..(3063): n is a, c, g, or t
  misc_feature (3080)..(3080): n is a, c, g, or t
  misc_feature (3085)..(3085): n is a, c, g, or t
  misc_feature (3087)..(3088): n is a, c, g, or t
  misc_feature (3092)..(3094): n is a, c, g, or t
  misc_feature (3099)..(3100): n is a, c, g, or t
  misc_feature (3103)..(3104): n is a, c, g, or t
  misc_feature (3116)..(3116): n is a, c, g, or t
  misc_feature (3119)..(3124): n is a, c, g, or t
  misc_feature (3128)..(3128): n is a, c, g, or t
  misc_feature (3131)..(3132): n is a, c, g, or t
  misc_feature (3139)..(3142): n is a, c, g, or t
  misc_feature (3145)..(3146): n is a, c, g, or t
  misc_feature (3149)..(3149): n is a, c, g, or t
  misc_feature (3152)..(3153): n is a, c, g, or t
  misc_feature (3157)..(3157): n is a, c, g, or t
  misc_feature (3159)..(3160): n is a, c, g, or t
  misc_feature (3162)..(3163): n is a, c, g, or t
  misc_feature (3167)..(3167): n is a, c, g, or t
  misc_feature (3170)..(3172): n is a, c, g, or t
  misc_feature (3176)..(3176): n is a, c, g, or t
  misc_feature (3182)..(3185): n is a, c, g, or t
  misc_feature (3189)..(3189): n is a, c, g, or t
  misc_feature (3191)..(3193): n is a, c, g, or t
  misc_feature (3197)..(3197): n is a, c, g, or t
  misc_feature (3202)..(3202): n is a, c, g, or t
  misc_feature (3204)..(3204): n is a, c, g, or t
  misc_feature (3208)..(3208): n is a, c, g, or t
  misc_feature (3211)..(3212): n is a, c, g, or t
  misc_feature (3216)..(3220): n is a, c, g, or t
  misc_feature (3224)..(3224): n is a, c, g, or t
  misc_feature (3227)..(3227): n is a, c, g, or t
  misc_feature (3230)..(3230): n is a, c, g, or t
  misc_feature (3235)..(3235): n is a, c, g, or t
  misc_feature (3239)..(3239): n is a, c, g, or t
  misc_feature (3241)..(3243): n is a, c, g, or t
  misc_feature (3245)..(3245): n is a, c, g, or t
  misc_feature (3249)..(3250): n is a, c, g, or t
  misc_feature (3256)..(3256): n is a, c, g, or t
  misc_feature (3260)..(3260): n is a, c, g, or t
  misc_feature (3270)..(3271): n is a, c, g, or t
  misc_feature (3274)..(3276): n is a, c, g, or t
  misc_feature (3280)..(3280): n is a, c, g, or t
  misc_feature (3283)..(3284): n is a, c, g, or t
  misc_feature (3288)..(3288): n is a, c, g, or t
  misc_feature (3301)..(3301): n is a, c, g, or t
  misc_feature (3307)..(3308): n is a, c, g, or t
  misc_feature (3311)..(3311): n is a, c, g, or t
  misc_feature (3314)..(3315): n is a, c, g, or t
  misc_feature (3321)..(3321): n is a, c, g, or t
  misc_feature (3324)..(3324): n is a, c, g, or t
  misc_feature (3328)..(3328): n is a, c, g, or t
  misc_feature (3331)..(3331): n is a, c, g, or t
  misc_feature (3335)..(3335): n is a, c, g, or t
  misc_feature (3338)..(3341): n is a, c, g, or t
  misc_feature (3344)..(3345): n is a, c, g, or t
  misc_feature (3347)..(3348): n is a, c, g, or t
  misc_feature (3354)..(3354): n is a, c, g, or t
  misc_feature (3359)..(3359): n is a, c, g, or t
  misc_feature (3362)..(3363): n is a, c, g, or t
  misc_feature (3368)..(3371): n is a, c, g, or t
  misc_feature (3376)..(3377): n is a, c, g, or t
  misc_feature (3381)..(3381): n is a, c, g, or t
  misc_feature (3386)..(3388): n is a, c, g, or t
  misc_feature (3392)..(3392): n is a, c, g, or t
  misc_feature (3395)..(3396): n is a, c, g, or t
  misc_feature (3402)..(3402): n is a, c, g, or t
  misc_feature (3407)..(3408): n is a, c, g, or t
  misc_feature (3412)..(3413): n is a, c, g, or t
  misc_feature (3418)..(3418): n is a, c, g, or t
  misc_feature (3422)..(3422): n is a, c, g, or t
  misc_feature (3427)..(3430): n is a, c, g, or t
  misc_feature (3434)..(3434): n is a, c, g, or t
  misc_feature (3436)..(3441): n is a, c, g, or t
  misc_feature (3444)..(3444): n is a, c, g, or t
  misc_feature (3448)..(3450): n is a, c, g, or t
  misc_feature (3454)..(3456): n is a, c, g, or t
  misc_feature (3458)..(3458): n is a, c, g, or t
  misc_feature (3462)..(3462): n is a, c, g, or t
  misc_feature (3465)..(3466): n is a, c, g, or t
  misc_feature (3470)..(3470): n is a, c, g, or t
  misc_feature (3472)..(3472): n is a, c, g, or t
  misc_feature (3474)..(3474): n is a, c, g, or t
  misc_feature (3476)..(3476): n is a, c, g, or t
  misc_feature (3480)..(3480): n is a, c, g, or t
  misc_feature (3484)..(3485): n is a, c, g, or t
  misc_feature (3488)..(3489): n is a, c, g, or t
  misc_feature (3494)..(3494): n is a, c, g, or t
  misc_feature (3498)..(3498): n is a, c, g, or t
  misc_feature (3502)..(3503): n is a, c, g, or t
  misc_feature (3506)..(3507): n is a, c, g, or t
  misc_feature (3510)..(3511): n is a, c, g, or t
  misc_feature (3518)..(3519): n is a, c, g, or t
  misc_feature (3523)..(3523): n is a, c, g, or t
  misc_feature (3528)..(3528): n is a, c, g, or t
  misc_feature (3533)..(3533): n is a, c, g, or t
  misc_feature (3536)..(3536): n is a, c, g, or t
  misc_feature (3538)..(3538): n is a, c, g, or t
  misc_feature (3540)..(3540): n is a, c, g, or t
  misc_feature (3543)..(3544): n is a, c, g, or t
  misc_feature (3547)..(3547): n is a, c, g, or t
  misc_feature (3549)..(3549): n is a, c, g, or t
  misc_feature (3553)..(3554): n is a, c, g, or t
  misc_feature (3557)..(3557): n is a, c, g, or t
  misc_feature (3559)..(3559): n is a, c, g, or t
  misc_feature (3565)..(3565): n is a, c, g, or t
  misc_feature (3567)..(3568): n is a, c, g, or t
  misc_feature (3572)..(3572): n is a, c, g, or t
  misc_feature (3574)..(3576): n is a, c, g, or t
  misc_feature (3583)..(3583): n is a, c, g, or t
  misc_feature (3585)..(3585): n is a, c, g, or t
  misc_feature (3588)..(3589): n is a, c, g, or t
  misc_feature (3593)..(3593): n is a, c, g, or t
  misc_feature (3598)..(3598): n is a, c, g, or t
  misc_feature (3605)..(3608): n is a, c, g, or t
  misc_feature (3610)..(3613): n is a, c, g, or t
  misc_feature (3618)..(3618): n is a, c, g, or t
  misc_feature (3621)..(3621): n is a, c, g, or t
  misc_feature (3627)..(3627): n is a, c, g, or t
  misc_feature (3630)..(3630): n is a, c, g, or t
  misc_feature (3635)..(3637): n is a, c, g, or t
  misc_feature (3642)..(3645): n is a, c, g, or t
  misc_feature (3649)..(3652): n is a, c, g, or t
  misc_feature (3656)..(3656): n is a, c, g, or t
  misc_feature (3659)..(3659): n is a, c, g, or t
  misc_feature (3669)..(3669): n is a, c, g, or t
  misc_feature (3671)..(3671): n is a, c, g, or t
  misc_feature (3674)..(3679): n is a, c, g, or t
  misc_feature (3683)..(3683): n is a, c, g, or t
  misc_feature (3692)..(3692): n is a, c, g, or t
  misc_feature (3696)..(3696): n is a, c, g, or t
  misc_feature (3700)..(3700): n is a, c, g, or t
  misc_feature (3703)..(3708): n is a, c, g, or t
  misc_feature (3711)..(3713): n is a, c, g, or t
  misc_feature (3716)..(3717): n is a, c, g, or t
  misc_feature (3719)..(3721): n is a, c, g, or t
  misc_feature (3727)..(3729): n is a, c, g, or t
  misc_feature (3732)..(3734): n is a, c, g, or t
  misc_feature (3738)..(3738): n is a, c, g, or t
  misc_feature (3741)..(3741): n is a, c, g, or t
  misc_feature (3749)..(3754): n is a, c, g, or t
  misc_feature (3757)..(3757): n is a, c, g, or t
  misc_feature (3762)..(3763): n is a, c, g, or t
  misc_feature (3766)..(3768): n is a, c, g, or t
  misc_feature (3775)..(3778): n is a, c, g, or t
  misc_feature (3785)..(3787): n is a, c, g, or t
  misc_feature (3790)..(3790): n is a, c, g, or t
  misc_feature (3793)..(3794): n is a, c, g, or t
  misc_feature (3801)..(3803): n is a, c, g, or t
  misc_feature (3807)..(3807): n is a, c, g, or t
  misc_feature (3812)..(3816): n is a, c, g, or t
  misc_feature (3819)..(3819): n is a, c, g, or t
  misc_feature (3822)..(3825): n is a, c, g, or t
  misc_feature (3827)..(3827): n is a, c, g, or t
  misc_feature (3833)..(3834): n is a, c, g, or t
  misc_feature (3838)..(3839): n is a, c, g, or t
  misc_feature (3843)..(3846): n is a, c, g, or t
  misc_feature (3849)..(3849): n is a, c, g, or t
  misc_feature (3859)..(3861): n is a, c, g, or t
  misc_feature (3867)..(3867): n is a, c, g, or t
  misc_feature (3872)..(3873): n is a, c, g, or t
  misc_feature (3875)..(3875): n is a, c, g, or t
  misc_feature (3879)..(3881): n is a, c, g, or t
  misc_feature (3884)..(3888): n is a, c, g, or t
  misc_feature (3891)..(3893): n is a, c, g, or t
  misc_feature (3896)..(3896): n is a, c, g, or t
  misc_feature (3903)..(3905): n is a, c, g, or t
  misc_feature (3907)..(3907): n is a, c, g, or t
  misc_feature (3912)..(3913): n is a, c, g, or t
  misc_feature (3916)..(3917): n is a, c, g, or t
  misc_feature (3926)..(3928): n is a, c, g, or t
  misc_feature (3932)..(3932): n is a, c, g, or t
  misc_feature (3934)..(3935): n is a, c, g, or t
  misc_feature (3938)..(3939): n is a, c, g, or t
  misc_feature (3942)..(3942): n is a, c, g, or t
  misc_feature (3948)..(3948): n is a, c, g, or t
  misc_feature (3953)..(3953): n is a, c, g, or t
  misc_feature (3956)..(3956): n is a, c, g, or t
  misc_feature (3959)..(3959): n is a, c, g, or t
  misc_feature (3963)..(3969): n is a, c, g, or t
  misc_feature (3977)..(3977): n is a, c, g, or t
  misc_feature (3980)..(3980): n is a, c, g, or t
  misc_feature (3987)..(3990): n is a, c, g, or t
  misc_feature (3993)..(3994): n is a, c, g, or t
  misc_feature (3999)..(4000): n is a, c, g, or t
tgaggttattcattcttacagcttatcgacaaaacgaaaccgaccattgaagaaactttcagtgcatttctccaacagtcagccctattcagtttgtttatctcatcaggaacgagaaacggtctacattattcaatgctatacccgctcccttggcaacactgtgcaatgggtcttcagccacatggaacggaatgttaatcttatcggtcaaacgcttgtcaattccacgtaacaaagcaccgccaccactcaaatagatgccattctttactatatcggcatacaattcaggcggtgtattctccaaagcagaaagaactgcattctctatttttgccacagtcttgtccaaacaatgcgctatttcctgatagcagactggtacctccattggcaacgccgtgatacggtttggcccgtgaacgatataatcctccggagcctcgtctcctaaatcggtcaaagccgaaccgacgtgcaccttaatncgttccgccatacgctcgctgacgcgaacattgtgttggcggctcatatattcctgaatatcagcagtaaggtcgtcgccagcaacacgaatagagttattgcaaacgataccacctaacgaaataacagctatttctgtactaccgccaccaatatcaactatcatatttccttcaggtgcctctacgtcaagccccataccaagagcagctgccattggctcgaagataagataaacatcgcgcccatcggcatgttcggcagagtcgcggactgcacgcagttctacttcggtagacccagaaggtacaccaatcaccatacgcaaagacggagagaacaagcgattaccactatgcaccatcttaataagtcccctcatcatttgttcgcatgccgtaaagtcggcaatcacaccatctcgaagtgggcgaatggtacgaatattggggtgttccttctcatacatcatcttggcgtcgttgccaacggctatcatcttgtccgtgcggcggtcgagtgctactactgaaggttcatcaacaactatcttatcatcactgataatgatagtatttgctgttcccaggtccattgctatttcctggataaatgaaaaaaatcccattctaaaatatttgatatgtggtgaaaacggggacaatccccatcgtcattttattattttctttcttatatgcttgccatctacaaacgcttacggtctgcaaacactgtttttacttacttcgcaaaccaattatgtattgccgtatcgtaccgactggtaaccgcaaacgcacgctctgcaaacattttccggtcttcgagtcctgtctttgcaccctgcttgttcagcagttgcaacaacacagggtattctgccttgcttggaataatgacaacatcattgaaattctttgcacctgcacgtatcaaagaaatgccgccaatatcgattttttcgataacatcagcttcgcttgcaccgcttgctacggtttgttcaaatggatacaaatcaacaacaaccaaatcaattgccggaatttcgtattcagccatttctttccgatcgttctcaagtgcacgacgtgccaaaatcccaccgaatatcttggggtgcaatgtttttacacgaccacccaagatagaaggataagtagttatatcttcaactttctgacattcatagcctaaagactctataaactgctgcgtaccaccagtactaaggaatttcacgccctcatcgttcagtttctttaaaatatcttccaaaccatctttgtggaatacggagattaaagcagtcttaatttcttttgtatcaaccatagttgcctactgtttcaatttgttttgcaaagatacaaaatagtgcaataagcaaacaagatttttagataaaaaaactttaattcagctacattattaatcaacatcaacattaaaggtgtccatttctgagtttacaatattgcgaattatttataaactgaatgtaaagatactaattcgcaaagacaaaatagcatttcggagaacctatttgnaattcttggagcagtagaaaaatactgcgaacaagcatttcgattcagctttctgaataaaagagtgtcttttattcgttgcatagcttcgcctgcataccttattatatatngaaaaataagacancaaaagtntaaaaaannttnnnaaannnnccnntnnnnnaaccaattanttannaannnnttnnaaaaccnnttatttnntnncnnaaaanaaccnnttttntnnntaaaaancnnnggttttncctcgccaaacanccnntttcgnaangccaaannnnnnncatcnnttttnaanaaaattntatttncaaattcaaggnnnttttttattcnnngntttcngnaanaanaagaaaatnnttccnccaanaaanttntnnaaaantaaaactttggaagannnaaattngnnncnttnannnnttttnnnnnaatttcnnaactgcaaacttcttgttccnnnnaaattnnnannnnaannnnnannttccaaagnaannnnnnnnnnnnnaaanaantttccnccaannttttaannncctttnnnnnnnnaantttnnnaannnnannttnaattggnnnnccanaaanggnnganaanttccnnggnnnnaaaccnccaanccannnnntntnnggnngngngnggttnttnnnnnnnaaanaanaattncanngggaannnccnnnngggaannttttnnnaaannttggccnaannttnnnnaattnnnaaaannnnccnaannngnggttttaagagngnggnaaggnnnggggnnnnnctcnngggcnnnaaatttncanaaannnncanaananannnnaantttngggnntttcccnnannnttanaaggnnttaannnnnnnnaaagggnttggnnaatannnnnnnnnnnnaatttnttnaatnnnnttcnnanaanccnnnnnnnnnnnannnggnaatntntnncgtnttnttncncnntntttnggtnttnacncnccaanannttnnnccnaagggaaaaaggttttnaaggntnnggcnnnggaannccnnccaaaagaggcnccnnnnnnttanaannaaggaannnnggnnttnggnnccananngnncacnccnnnttcncccaannnnaaantnnncccnttggnanaaanttnntttnnnnnaaanaanaanaaagngggngnnntncctnnaaaggnaaanaaaaccaaanngcnnnaacnccnnttcncctttatatatanaaggtnnaanggnnaaattnccnttcnccnccgnggnnnnggnnanntttggnaaggnttnngggannnnccaannaaanaattnnngggnaanncctttnaaaannccannttaanaaanaaggnnnnaaancnnnnnnttncccnnnaaannntntttnccnntttntntntnttanaaannaannttccncccncccnnccnnccnnttatatnngganaaaanaaagnganananaannttncncccnnccncnccttananntttncnnnttaaaantntgnnaaanaattntttttcnnnncnnnnccttnttnccaaanttngggtnnnccttnnnnaaannnnccanaanaaaagggaananacnnnnnnccanaaccaaaanaaanaagnggnnnnnnccnnnggnntnnnccaaannnccnnnaaanaancccggaannnnnnttnaaagnnccnnnaaacccnnnnaaagggnnnaanggnnggttttnnnctcnccttnnnnnaantannnnanaaaaannatannggcnnnnaanccaaaaccannnccaaanttttnnanaaannnggnnnnnccnnnggnaaaaagnnnanaaggnnttnnaaaaccaannnaaanannggnnatnttgggnaaggnaanggnaagnnnnnnnggccaaanccnttttttnnnnccnnccttnn

SEQ ID NO: 992 - DNA, 4000 bp, Escherichia coli
  misc_feature (395)..(395): n is a, c, g, or t
  misc_feature (1881)..(1881): n is a, c, g, or t
  misc_feature (1986)..(1986): n is a, c, g, or t
  misc_feature (3318)..(3318): n is a, c, g, or t
  misc_feature (3531)..(3531): n is a, c, g, or t
agacacatttgacatcgcgcgagcaaagagttcggatttcgttgaacgtattattgacatgggcagccgaatacctctcgccccattttacgacaacaacctgaatcatgacccatcctttgcgtgccgagcggggttttccatgaaactcactatccccctagctccgaactgttcttatgcagcgtttgccatttagacaagggggtggtcaaatatgcagaaggaatcggcagaatttctacatttcaaatcacctgccaaaattactttttaacgggtatatatgcaccaatgaagccttttctaaggaaatcttagcgaagaccaattatcaaaatttgggcagtcatggcgtcttgcaggcgtcgtttccatatttttctacacatgantttctcacacacatatgaactttggcatcacgtagaaatttattttcgtcgataatttccacatctatcgatggaatactcaccagttctgtttcgtcgtcacagattgtcacggctccgtctgttttacatatagattttccggttgcgcgatgttccattctataatttgtgacaagatgctgtttcaaacgtggcggaatttgttttagcaattgattttcgcatgaacttaactcggcacgatacgcctcgcctgaacaaccaattattgcgatcgtcagaaaaccagcgaccagtctgcaaagacagacttgcaccttattcacgttaggttccccacagatagccgattttcgcacagcacgcctaaacccctatttcatcgccataaaagaattgaaatcagacttttattaatgccgagttaattttcgtagcgcggatctgagaggtcatccaggccggtaataaattatcacttggaataagttaatttgtcttttacgaaccataaaagatcccaaatacgggtccccaccaatccggaaacacgcaaacaattaacgtggattacccataaatattacaatccctgattgtattcggataaattattgataagttagtcgataagtatctgtatcttttggttattttttagaacaatagtatcgccccgctttatctacaacgcgttctggcgtcttatactgcaataagcgggtggagtttggctgactgagattccagcatcttccgccaatgttgaaaaggtgtgaaccaaaatggcgatagtagacagtcaaaatgatgtttcttcagagcaaataagtattttgatcgctgatgatcacgagcttattctggatattgctcggttgtatttggaccaacaaagcgacatgtcggtgtctactgccatgacattaaacgacgcgattgacacctatcagaaagcaggtccattcgacgtcgtgctacttgattacaatatgcccgggatgaatggactggagggtttacgccaaatgatggcactggcacccggaatcccggttgcaataattacaggaaaccctacgcgccctttaatgaatgatgtcttggaggcgggtgctgcaggaatagtttcgaagtcaagtcctgtgaaatcgctggccaattccatcagatttatacattcgggcgaaacttacatgccgttgcatctgacgcgggaagatcccaaaaaacaaagaggcgacaccggaccgttgagttcacgcgaaatgactgtgttgagttaccttggagaaggaaagaaaaacaaacaaatcgcggtatctctcgggctgtctgaaggtactgtaaaaatgcatgtcatgtcgatttgcaagaaactcgatgcaacgaatcgcacccacgccgtgatcaatgcacgcaacactgggctactttaaagatagatttcaaagtctgtggggacggaccttaaagtgatctngtttgacggcatactctaccctttggcatagagttatggactcaattatcttttggctgtgacaaatagtacctttaaccgtgcatctaacgcgctatattaatngtagtgaccgttaagggatttggtatgttagatagacttaaagcagctgtggaaaacgcactaaaggcgcttgatgaaattacgcgccaacctgaaatgacggaagagctcaagccaattccggtgcgcgttgataaaaaacagcctttcgaccggaaacgttgagaacccgttaaatatctttttccaaaattccaagtccgcgtaaatatacgccaatacctgtttccaataattcttctggtgaatatgggctcgctgttcccggggaatttcttgcgaaaagctctactacgccgtgggacattgctagaatatgcgcactgaacatagatgctgggggacgtttgtctttgggaatatgtttgcccaaatcttccgcagcctgttccaagatgccgcgcgcatttgatgaggctgcagccagctcaggtgttcgatttaccgaaataccgctctcaaacatcgaaatgtaataccccgggtagcgccgcgcaaatgcaagataagcccgccctgtggcttcaaatgcggccagagcagaaggttggcctttgtcatatgcgaattgcatgaggtcggcaaaaatcttgtacccctccaatgccacttctgcgatcaaatcgtcacgaccttcaaaatggcgataaaccgccgcgggtgtcactccggcctgttttgctgcttcggacagactaaatcccgttggcccgcgggcttcgatcagctttatcgctgactcaacgagcgcctgacgcaagttgccatgatgatacccttgcttaaccattccagatgtccggacctcccaagaggtttcgatcaaccgcatccacaatatcatgatctttgaaatcatattcaaattgggaaagaatatggcgaattacagccaaacgtgcccgacgcttgtcgtccgaacgtaccacgcaccacgggcctttatcatggtgtgtccgtttgaaattttcttggatggcagcactgtagtcaccccaaagcgacaaacctttgatatcgatagaagacaacttccattgttttatcggatcacgttcgcgcttgagaaaccggcgtaattgttccgcacgccccacgttaagccagattttgatgagacagatcccttcatcggcgagcattttttcgaattcggtcacctgtacaaagaatttttgcacttgctcttcgtcacagaaccggaacacacgctcaaccactgcgcggttgtaccagctgcggtcaaaaatcgttatggtgcccgcagagggaaaatgttggacatatcgttgaaaataccattcaccacgctctttttccgtcggctttganaaggccacaacccgcgtgacccgcggattaagattttgggtggtggctttgatactaccgccttttcctgccgcatcccgaccttcaaataaaatagccaccctttgacctgtgccttgcacccaagattggaatttcgcaatctcaatttgaagcgcatccatttcttcaacataatttttttgcggcaatatacggcgatatggataactntcgtcgaggatgtcttttttatccccttcaaggataagtgcctttaaatctgcgggcgcttcttccatcaaaaaacggctgattgcgccgtcaaagggcaacgatgacatgttatctatcattggtgcactatgcctcctttatcactttaccgcaatccggcccgctcagccgcgcggtcaatcgcatcaatcacgtctttctttgcgacatgatggggcatatgtccgatgccttcaagaagtgtcagatttgatgccggagcctgtttcgccaaagctctggcatgaagatcggggctgaccagagtgtcagcagttccgtgcagtatttcaatcggcagggaaagcgtactgtatctgggagcttgattgatgatctggggtttcaaaatccgtctctggcgtgcgttggccagaattgtcttacgccgcaggaccagttcgacgccaaactcttcacgataccc

SEQ ID NO: 993 - DNA, 4000 bp, Escherichia coli
  misc_feature (1)..(5): n is a, c, g, or t
  misc_feature (8)..(28): n is a, c, g, or t
  misc_feature (30)..(40): n is a, c, g, or t
  misc_feature (42)..(49): n is a, c, g, or t
  misc_feature (51)..(58): n is a, c, g, or t
  misc_feature (60)..(85): n is a, c, g, or t
  misc_feature (87)..(90): n is a, c, g, or t
  misc_feature (93)..(102): n is a, c, g, or t
  misc_feature (104)..(104): n is a, c, g, or t
  misc_feature (107)..(119): n is a, c, g, or t
  misc_feature (124)..(124): n is a, c, g, or t
  misc_feature (126)..(126): n is a, c, g, or t
  misc_feature (128)..(128): n is a, c, g, or t
  misc_feature (138)..(140): n is a, c, g, or t
  misc_feature (142)..(148): n is a, c, g, or t
  misc_feature (150)..(153): n is a, c, g, or t
  misc_feature (155)..(160): n is a, c, g, or t
  misc_feature (164)..(166): n is a, c, g, or t
  misc_feature (169)..(176): n is a, c, g, or t
  misc_feature (179)..(179): n is a, c, g, or t
  misc_feature (181)..(181): n is a, c, g, or t
  misc_feature (186)..(186): n is a, c, g, or t
  misc_feature (189)..(190): n is a, c, g, or t
  misc_feature (192)..(192): n is a, c, g, or t
  misc_feature (194)..(194): n is a, c, g, or t
  misc_feature (197)..(197): n is a, c, g, or t
  misc_feature (201)..(201): n is a, c, g, or t
  misc_feature (204)..(204): n is a, c, g, or t
  misc_feature (206)..(206): n is a, c, g, or t
  misc_feature (208)..(208): n is a, c, g, or t
  misc_feature (211)..(211): n is a, c, g, or t
  misc_feature (214)..(217): n is a, c, g, or t
  misc_feature (221)..(221): n is a, c, g, or t
  misc_feature (225)..(225): n is a, c, g, or t
  misc_feature (228)..(228): n is a, c, g, or t
  misc_feature (233)..(233): n is a, c, g, or t
  misc_feature (235)..(238): n is a, c, g, or t
  misc_feature (240)..(240): n is a, c, g, or t
  misc_feature (242)..(243): n is a, c, g, or t
  misc_feature (245)..(246): n is a, c, g, or t
  misc_feature (248)..(249): n is a, c, g, or t
  misc_feature (252)..(255): n is a, c, g, or t
  misc_feature (259)..(263): n is a, c, g, or t
  misc_feature (269)..(269): n is a, c, g, or t
  misc_feature (273)..(273): n is a, c, g, or t
  misc_feature (279)..(280): n is a, c, g, or t
  misc_feature (286)..(287): n is a, c, g, or t
  misc_feature (289)..(289): n is a, c, g, or t
  misc_feature (294)..(294): n is a, c, g, or t
  misc_feature (297)..(297): n is a, c, g, or t
  misc_feature (300)..(300): n is a, c, g, or t
  misc_feature (302)..(303): n is a, c, g, or t
  misc_feature (308)..(310): n is a, c, g, or t
  misc_feature (312)..(312): n is a, c, g, or t
  misc_feature (321)..(321): n is a, c, g, or t
  misc_feature (325)..(325): n is a, c, g, or t
  misc_feature (330)..(330): n is a, c, g, or t
  misc_feature (333)..(334): n is a, c, g, or t
  misc_feature (336)..(336): n is a, c, g, or t
  misc_feature (340)..(342): n is a, c, g, or t
  misc_feature (345)..(346): n is a, c, g, or t
  misc_feature (349)..(349): n is a, c, g, or t
  misc_feature (352)..(352): n is a, c, g, or t
  misc_feature (354)..(354): n is a, c, g, or t
  misc_feature (356)..(357): n is a, c, g, or t
  misc_feature (362)..(364): n is a, c, g, or t
  misc_feature (367)..(372): n is a, c, g, or t
  misc_feature (376)..(376): n is a, c, g, or t
  misc_feature (378)..(378): n is a, c, g, or t
  misc_feature (381)..(381): n is a, c, g, or t
  misc_feature (385)..(385): n is a, c, g, or t
  misc_feature (389)..(390): n is a, c, g, or t
  misc_feature (396)..(397): n is a, c, g, or t
  misc_feature (400)..(400): n is a, c, g, or t
  misc_feature (402)..(402): n is a, c, g, or t
  misc_feature (404)..(406): n is a, c, g, or t
  misc_feature (409)..(409): n is a, c, g, or t
  misc_feature (411)..(412): n is a, c, g, or t
  misc_feature (414)..(414): n is a, c, g, or t
  misc_feature (416)..(417): n is a, c, g, or t
  misc_feature (422)..(422): n is a, c, g, or t
  misc_feature (427)..(427): n is a, c, g, or t
  misc_feature (430)..(430): n is a, c, g, or t
  misc_feature (433)..(434): n is a, c, g, or t
  misc_feature (438)..(438): n is a, c, g, or t
  misc_feature (443)..(443): n is a, c, g, or t
  misc_feature (448)..(448): n is a, c, g, or t
  misc_feature (452)..(452): n is a, c, g, or t
  misc_feature (454)..(454): n is a, c, g, or t
  misc_feature (457)..(459): n is a, c, g, or t
  misc_feature (462)..(462): n is a, c, g, or t
  misc_feature (465)..(466): n is a, c, g, or t
  misc_feature (468)..(469): n is a, c, g, or t
  misc_feature (471)..(472): n is a, c, g, or t
  misc_feature (475)..(476): n is a, c, g, or t
  misc_feature (479)..(480): n is a, c, g, or t
  misc_feature (482)..(483): n is a, c, g, or t
  misc_feature (485)..(485): n is a, c, g, or t
  misc_feature (491)..(493): n is a, c, g, or t
  misc_feature (499)..(499): n is a, c, g, or t
  misc_feature (501)..(504): n is a, c, g, or t
  misc_feature (508)..(509): n is a, c, g, or t
  misc_feature (511)..(512): n is a, c, g, or t
  misc_feature (514)..(514): n is a, c, g, or t
  misc_feature (516)..(516): n is a, c, g, or t
  misc_feature (519)..(521): n is a, c, g, or t
  misc_feature (523)..(523): n is a, c, g, or t
  misc_feature (526)..(526): n is a, c, g, or t
  misc_feature (528)..(528): n is a, c, g, or t
  misc_feature (531)..(531): n is a, c, g, or t
  misc_feature (536)..(537): n is a, c, g, or t
  misc_feature (539)..(540): n is a, c, g, or t
  misc_feature (542)..(542): n is a, c, g, or t
  misc_feature (545)..(545): n is a, c, g, or t
  misc_feature (547)..(547): n is a, c, g, or t
  misc_feature (550)..(551): n is a, c, g, or t
  misc_feature (553)..(554): n is a, c, g, or t
  misc_feature (556)..(556): n is a, c, g, or t
  misc_feature (559)..(559): n is a, c, g, or t
  misc_feature (565)..(567): n is a, c, g, or t
  misc_feature (569)..(569): n is a, c, g, or t
  misc_feature (572)..(574): n is a, c, g, or t
  misc_feature (578)..(578): n is a, c, g, or t
  misc_feature (586)..(586): n is a, c, g, or t
  misc_feature (589)..(589): n is a, c, g, or t
  misc_feature (595)..(595): n is a, c, g, or t
  misc_feature (598)..(599): n is a, c, g, or t
  misc_feature (602)..(602): n is a, c, g, or t
  misc_feature (606)..(606): n is a, c, g, or t
  misc_feature (608)..(608): n is a, c, g, or t
  misc_feature (610)..(611): n is a, c, g, or t
  misc_feature (615)..(615): n is a, c, g, or t
  misc_feature (617)..(617): n is a, c, g, or t
  misc_feature (619)..(619): n is a, c, g, or t
  misc_feature (621)..(621): n is a, c, g, or t
  misc_feature (625)..(625): n is a, c, g, or t
  misc_feature (635)..(635): n is a, c, g, or t
  misc_feature (638)..(638): n is a, c, g, or t
  misc_feature (641)..(641): n is a, c, g, or t
  misc_feature (644)..(644): n is a, c, g, or t
  misc_feature (647)..(648): n is a, c, g, or t
  misc_feature (650)..(650): n is a, c, g, or t
  misc_feature (653)..(656): n is a, c, g, or t
  misc_feature (658)..(658): n is a, c, g, or t
  misc_feature (668)..(668): n is a, c, g, or t
  misc_feature (671)..(672): n is a, c, g, or t
  misc_feature (676)..(676): n is a, c, g, or t
  misc_feature (678)..(678): n is a, c, g, or t
  misc_feature (688)..(689): n is a, c, g, or t
  misc_feature (692)..(692): n is a, c, g, or t
  misc_feature (696)..(697): n is a, c, g, or t
  misc_feature (700)..(701): n is a, c, g, or t
  misc_feature (704)..(705): n is a, c, g, or t
  misc_feature (707)..(707): n is a, c, g, or t
  misc_feature (712)..(713): n is a, c, g, or t
  misc_feature (716)..(716): n is a, c, g, or t
  misc_feature (718)..(720): n is a, c, g, or t
  misc_feature (723)..(725): n is a, c, g, or t
  misc_feature (728)..(729): n is a, c, g, or t
  misc_feature (732)..(732): n is a, c, g, or t
  misc_feature (735)..(736): n is a, c, g, or t
  misc_feature (738)..(738): n is a, c, g, or t
  misc_feature (741)..(741): n is a, c, g, or t
  misc_feature (745)..(747): n is a, c, g, or t
  misc_feature (751)..(751): n is a, c, g, or t
  misc_feature (756)..(757): n is a, c, g, or t
  misc_feature (759)..(759): n is a, c, g, or t
  misc_feature (761)..(764): n is a, c, g, or t
  misc_feature (766)..(766): n is a, c, g, or t
  misc_feature (769)..(769): n is a, c, g, or t
  misc_feature (772)..(774): n is a, c, g, or t
  misc_feature (777)..(778): n is a, c, g, or t
  misc_feature (780)..(780): n is a, c, g, or t
  misc_feature (785)..(785): n is a, c, g, or t
  misc_feature (787)..(788): n is a, c, g, or t
  misc_feature (790)..(790): n is a, c, g, or t
  misc_feature (794)..(794): n is a, c, g, or t
  misc_feature (801)..(801): n is a, c, g, or t
  misc_feature (803)..(804): n is a, c, g, or t
  misc_feature (807)..(807): n is a, c, g, or t
  misc_feature (809)..(810): n is a, c, g, or t
  misc_feature (816)..(817): n is a, c, g, or t
  misc_feature (819)..(820): n is a, c, g, or t
  misc_feature (822)..(823): n is a, c, g, or t
  misc_feature (826)..(826): n is a, c, g, or t
  misc_feature (835)..(835): n is a, c, g, or t
  misc_feature (837)..(837): n is a, c, g, or t
  misc_feature (840)..(842): n is a, c, g, or t
  misc_feature (845)..(845): n is a, c, g, or t
  misc_feature (847)..(848): n is a, c, g, or t
  misc_feature (851)..(851): n is a, c, g, or t
  misc_feature (863)..(864): n is a, c, g, or t
  misc_feature (866)..(866): n is a, c, g, or t
  misc_feature (868)..(870): n is a, c, g, or t
  misc_feature (873)..(874): n is a, c, g, or t
  misc_feature (877)..(879): n is a, c, g, or t
  misc_feature (882)..(882): n is a, c, g, or t
  misc_feature (884)..(885): n is a, c, g, or t
  misc_feature (887)..(887): n is a, c, g, or t
  misc_feature (892)..(892): n is a, c, g, or t
  misc_feature (894)..(895): n is a, c, g, or t
  misc_feature (898)..(898): n is a, c, g, or t
  misc_feature (903)..(903): n is a, c, g, or t
  misc_feature (905)..(908): n is a, c, g, or t
  misc_feature (911)..(912): n is a, c, g, or t
  misc_feature (921)..(921): n is a, c, g, or t
  misc_feature (923)..(923): n is a, c, g, or t
  misc_feature (926)..(927): n is a, c, g, or t
  misc_feature (930)..(931): n is a, c, g, or t
  misc_feature (934)..(934): n is a, c, g, or t
  misc_feature (936)..(936): n is a, c, g, or t
  misc_feature (944)..(944): n is a, c, g, or t
  misc_feature (947)..(948): n is a, c, g, or t
  misc_feature (951)..(952): n is a, c, g, or t
  misc_feature (954)..(957): n is a, c, g, or t
  misc_feature (961)..(961): n is a, c, g, or t
  misc_feature (964)..(966): n is a, c, g, or t
  misc_feature (970)..(970): n is a, c, g, or t
  misc_feature (974)..(976): n is a, c, g, or t
  misc_feature (978)..(978): n is a, c, g, or t
  misc_feature (981)..(982): n is a, c, g, or t
  misc_feature (986)..(986): n is a, c, g, or t
  misc_feature (989)..(989): n is a, c, g, or t
  misc_feature (1159)..(1159): n is a, c, g, or t
  misc_feature (1444)..(1444): n is a, c, g, or t
  misc_feature (1989)..(1989): n is a, c, g, or t
  misc_feature (1991)..(1991): n is a, c, g, or t
  misc_feature (1994)..(1994): n is a, c, g, or t
  misc_feature (3643)..(3648): n is a, c, g, or t
  misc_feature (3650)..(3650): n is a, c, g, or t
  misc_feature (3652)..(3653): n is a, c, g, or t
  misc_feature (3655)..(3655): n is a, c, g, or t
  misc_feature (3657)..(3658): n is a, c, g, or t
  misc_feature (3660)..(3660): n is a, c, g, or t
  misc_feature (3663)..(3666): n is a, c, g, or t
  misc_feature (3669)..(3669): n is a, c, g, or t
  misc_feature (3671)..(3671): n is a, c, g, or t
  misc_feature (3676)..(3677): n is a, c, g, or t
  misc_feature (3679)..(3684): n is a, c, g, or t
  misc_feature (3686)..(3687): n is a, c, g, or t
  misc_feature (3689)..(3691): n is a, c, g, or t
  misc_feature (3695)..(3700): n is a, c, g, or t
  misc_feature (3702)..(3707): n is a, c, g, or t
  misc_feature (3709)..(3711): n is a, c, g, or t
  misc_feature (3715)..(3724): n is a, c, g, or t
  misc_feature (3726)..(3726): n is a, c, g, or t
  misc_feature (3728)..(3728): n is a, c, g, or t
  misc_feature (3731)..(3731): n is a, c, g, or t
  misc_feature (3734)..(3737): n is a, c, g, or t
  misc_feature (3739)..(3740): n is a, c, g, or t
  misc_feature (3742)..(3742): n is a, c, g, or t
  misc_feature (3745)..(3750): n is a, c, g, or t
  misc_feature (3752)..(3756): n is a, c, g, or t
  misc_feature (3760)..(3761): n is a, c, g, or t
  misc_feature (3764)..(3764): n is a, c, g, or t
  misc_feature (3767)..(3767): n is a, c, g, or t
  misc_feature (3769)..(3771): n is a, c, g, or t
  misc_feature (3773)..(3774): n is a, c, g, or t
  misc_feature (3777)..(3779): n is a, c, g, or t
  misc_feature (3784)..(3785): n is a, c, g, or t
  misc_feature (3787)..(3791): n is a, c, g, or t
  misc_feature (3793)..(3793): n is a, c, g, or t
  misc_feature (3795)..(3795): n is a, c, g, or t
  misc_feature (3797)..(3799): n is a, c, g, or t
  misc_feature (3802)..(3802): n is a, c, g, or t
  misc_feature (3804)..(3810): n is a, c, g, or t
  misc_feature (3812)..(3813): n is a, c, g, or t
  misc_feature (3816)..(3817): n is a, c, g, or t
  misc_feature (3820)..(3820): n is a, c, g, or t
  misc_feature (3826)..(3827): n is a, c, g, or t
  misc_feature (3830)..(3843): n is a, c, g, or t
  misc_feature (3845)..(3847): n is a, c, g, or t
  misc_feature (3849)..(3851): n is a, c, g, or t
  misc_feature (3853)..(3853): n is a, c, g, or t
  misc_feature (3858)..(3859): n is a, c, g, or t
  misc_feature (3861)..(3861): n is a, c, g, or t
  misc_feature (3863)..(3863): n is a, c, g, or t
  misc_feature (3866)..(3868): n is a, c, g, or t
  misc_feature (3871)..(3872): n is a, c, g, or t
  misc_feature (3874)..(3874): n is a, c, g, or t
  misc_feature (3876)..(3878): n is a, c, g, or t
  misc_feature (3880)..(3889): n is a, c, g, or t
  misc_feature (3891)..(3894): n is a, c, g, or t
  misc_feature (3896)..(3905): n is a, c, g, or t
  misc_feature (3907)..(3912): n is a, c, g, or t
  misc_feature (3914)..(3914): n is a, c, g, or t
  misc_feature (3916)..(3916): n is a, c, g, or t
  misc_feature (3919)..(3919): n is a, c, g, or t
  misc_feature (3922)..(3924): n is a, c, g, or t
  misc_feature (3926)..(3935): n is a, c, g, or t
  misc_feature (3937)..(3938): n is a, c, g, or t
  misc_feature (3940)..(3957): n is a, c, g, or t
  misc_feature (3959)..(3959): n is a, c, g, or t
  misc_feature (3961)..(3962): n is a, c, g, or t
  misc_feature (3964)..(3969): n is a, c, g, or t
  misc_feature (3971)..(3971): n is a, c, g, or t
  misc_feature (3973)..(3973): n is a, c, g, or t
  misc_feature (3975)..(3975): n is a, c, g, or t
  misc_feature (3977)..(3977): n is a, c, g, or t
  misc_feature (3979)..(3979): n is a, c, g, or t
nnnnnaannnnnnnnnnnnnnnnnnnnnannnnnnnnnnngnnnnnnnngnnnnnnnnannnnnnnnnnnnnnnnnnnnnnnnnncnnnntannnnnnnnnnanaannnnnnnnnnnnngacgnangncctgcaaaannnannnnnnngnnnntnnnnnncgcnnnatnnnnnnnnaananaatgnganntncngtngcanatncngntgnagnnnnaaanatancgnggctntnnnnangnnanncnnagnnnnagtnnnnntaattnccgncgcagnngtgggnntnggtgnggntananntctcnnntntgcgcgcgnaggngcgtnggnntncgtnnnttnngtntcngnannagggnnnaannnnnntaananaantaanaagnncggcgnngangncnnntgngnncncnntgatntctcncgngannatgncgcanaaaanatcntngannnaangannanngnnttnngcnngnncnatatcnnntttaanannnngggnntnntngngcnnngnagngnggngacanncnntntananganntnnanagnaatatnnngntgnnngtgngcggtgtnttnctgtgntcnnganatgncntnncccntntnanaaanacaaaaggcncantantcnatnncncgnnnncngtggcgctgnaanntgtngnggacagagcnnctnatanngcnnccnnangcgcnnttnannncannncannggnaanngnganggannntatnaaggnngnannnngngtnaannnaanntnccccngnncnacgnacacacngnngcncnnagaaanncnnanncanaaaggagantntgnnnagntnnganaactctacattnncngnnngcnnctnnnaangnntngggancnngangaganannnnaanntgttctatntnttnngcnnaanantttctgcncanncanntnnnnaagnatnnncggnggcnnnanganntaanttntaaaggagtaaacgatgagagtgaaagataagataactattttaactggcgcaggttccggaattggcagggcaacggccattctttttgccggagagggtgccattgtttatgcatccgatattgatgaagcagggcttaaggaaacgctttctcttgtcaaagaaggnaaagaaaatgttcacatcacaaaagtggatgttacaaaatacgatgatgtaaggcaacatgtcgatgaagtcgccaaaaaacacggccggattgactgcctgatagtgaatgccggagtggtaagggtagggcaggttgaggatttcccggaagaggattacgatgtgctgctgaatgtaaatctcaaaggcttattttttacctgcaaggccgcaatcccctattttaaaaagcagaaaagcggtaatattataacgctcgcctcggtggccgcgcatatcggncagaacaaccatgccaactactgttcgacaaagcacggtgtcctgggttttaccaaagcgctggcgctcgatatggcgccttataacgttcgtgtaaacagcgttagccccggtgcaaccgatacgccaatgcttcgaactgatgttgggaaagaggccgtgcagaggggcgtttccttcgaacagatcaggaaggaatttgaggaacagggcgtgcttaccagatgggccgacccgatggagatagcaaccggcatattgttcctggcaacaagcgacgcatcctacatgacaggagccgacctgagaatagacggtggctggactacgagataaaatgttactacatatatgataagtcgtggaagttctgcattgatgcaagatggaggttataaacattaaaaaaaatattattctgttaaataaagtaatcacattcggcgagatcatgctcaggttgtcatcgcccggttatcaaagaataacccaggcaaactcttttgatattaattttggcggcggcgaagccaatgtggcagtancnctngcaaactttggcattgatgccgcgtttgttactcgattaccatcgaatgacattggtaaagcagctctgcaaaatctttgtaagcacaatgtatgtgttgatcatattgtgtggggtggtgaaaggttaggtatatattttctggaaaaaggcgccgttcaacgtcccagcaaagtcatctacgaccgggcacactcggctatttcagagatacaaccgggaatgatcgattggaatactatttttaaagatgcaacctggtttcattggacaggcattacaccggccatctcacaaacagcagcaacagtttgtttagaagctattaaagctgccaacacaaaagggattactgtttctactgatttgaactaccgcaaatacctgtggcaatatggcaagcaagcgggtgatgtcatgcccgaactggttgccggatgcgatattattttaggcaatgaagaagacgctgaaaaagtatttggcataaagcctgctggactgaatgtaaccaacgaacatgttgaagcgcgacaataccggtcggtttgcgaacaactgatgaagaaatttcctaaagcaaaaaaagtgattatcacgttacgtggctctgtcagtgcatcacacaacaactggtcaggtgtgttatggaacggaaaaaaattgtatgaagccagaacatacgaaatcacacacattgttgatcgtgttggcagcggagattcattcatgggcggattgatttatggattactcaccttttccgatgatgatcagaaagcacttgaatttgccgtagcggcatcggcattaaagcatacaatcgaaggtgacttcaatttagttactacagatgaagtattgaaactaatgagcggcgacggatcaggcagagtagaaagataatttaaaatttagaaaaatattttgatattaagaatggtaatggctaaaacaaaaacagaaatattatcgttatttgaaaaatgtggaatgatacctgtcttttatcatccggattatggtgtctgtaagaacgtagttgacgcgtgctacgcaggaggtctaaggatatttgaatatgctaaccgtggcgaaaaagcggctgaagtttttcaaaaacttaaaacgtatgttaaaaccacttatcccgatttaaaattaggtatcggcagtattatcaatggcaaacaagctgaacaatttatcgcacttgatgccgatttcattgtagcgcccatactcgatgaatcaacggcaatagtttgtcggaaagcaaatatcttctgggtgccgggatgcggaacattaactgagattgccaaagctgaaaacctgggcgcagagatcattaaaatatttcctggctcggtactgggaccagagtttatcaaagcagttaaaggacctatgccctggctgaagcttatgcctaccggtggtgttgaacccactaaagagaacttacgtgcatggcttaaagcaggtgctgtttgcgtaggtatgggatcgcaattgatatcaaaaaaaattattgatacaaaaaattacctggcattaactgaacagataaaacaaacatatttgatcattgatgcaatcaaacaagagatgcattcttagaaattaaaatggacacatttcccaannnnnnantnncncnnantcnnnnttngnttttnntnnnnnntnnannnttcnnnnnnannnnnntnnntaannnnnnnnnnananacnaannnnanntnatnnnnnngnnnnntatnnatnaanannnannaannnatttnntnnnnngnangnnnggnannnnnnntnnttnnttntttctnnctnnnnnnnnnnnnnntnnntnnntngtttnntntntgnnnggnngngnnngnnnnnnnnnntnnnntnnnnnnnnnntnnnnnnangnaancannnannnnnnnnnntnngnnnnnnnnnnnnnnnnnncntnnannnnnntntncntncnttctttttgtttccctatatt

SEQ ID NO: 994 - DNA, 4000 bp, Escherichia coli
  misc_feature (3518)..(3518): n is a, c, g, or t
  misc_feature (3533)..(3533): n is a, c, g, or t
ttttcttctatcaatgatgataaagtcattgcctaggccatccattttataagcttgtatttcgatcatctattttattgttgtatcttacaaatattctcaattattgacttttaaaatagtaaaatatacttttaagaaaattttccacaaaaataagcaggttttgtggtgtccttctaatgaaggagatcaacactagtcagcgatattcgcccactagtgcgattgctgctggagaaaaaaaatgtttgaaaatttaacaagtaaaattgagtctgccttttctttttttaataaaagcactcaattagatgaaaaacaggttgatgaaggattgcgaaagatccgccaggctcttcttgagtccgacgttgctctttctgttgctaaagaatttattgcaaatgttaaaccaaaagcaatcggccaagaagttttaaaatctataactccagggcagttacttgttaaaattgtatacgatgaacttgttaaaattttaggtagcgaaaaatcagaaattaatcttaatacagttccgccagcaaaaatattagttgttggtttgcaaggctcaggaaaaacaacaacttcagcaaagattgcaaaatttattgaaaagaattttaataaaaaagtaatgttatcgagcttagacgtttaccgtccagcagctcaaaaacaattagagttattaggtagtcaaaataatattcaaacaattccaattatagaaggacaacttccaatagaaattactcaaaggactttagcggctgcttccttatctggctctgatgtaattatttttgatactgcgggacgaacacaaattgatagcgtgatgatgagtgaattaaataatcttaaaaagataattaatccaatcgaaacttttttagttgctgactctttaacaggacaagacgccgtaaatatcgctagtgaatttaaaaaaacagtcgatttaacaggaataatattaacaagaatagatggagatggaaaaggtggtgcagcccttagcatgaagtccgttgccaattgtccaattaaatttttaggggttggtgaaaaaattgatgattttgaaatattccatccagaaagaattgcaaatagaattttaggaatgggagatgttgtttcccttgttgaaaaagtatctgaaaatttaaaaaaagaagaagttgaagagctagaagagaattttaaaaaaggacaatttacttttaatgattatttaaaacagattagacaaatgaaaaaaattggtggcatgggaaaagttttaggaatgattcctggaatttcaaaaattaaaaaacaaatagatgaggctgatattgatgagagtcttcttggaaaacaagaagcggttattttatcgatgactcctaaagaaagagataatccaaaaattattgatggatcgagaaaaaaaagaatagcgaatggttcaggaaccgacatcgctttagtaaacaagcttctaaaacaacataaaatgatgacaggaatgatgaaaagaatgtctcaaggtggcggaagaaattttggaggtttagatggaatacctcccgaattatttaacaatctaaaatagaaaggcaaataaatgttaaaaataagactatcaagagggggaacaaaaaaaagacccttctatcaaatcgtagttgcagattctagaaatccaagagatggaaaatttattgaaaaacttggatacttcaatccgttattaccaaaaagcaaaccagaaagattaagcttagagtcagaaagaataactcattggattaaaatgggagctcagcctactctaagagttgcaaaatttttaggtgctgcaaatcttgccccagttcctgaaaaaagaaataatccaattaaagctttacctaaaaagaaagctcaagaaagattaaaagctgcccaagcaccaaaagaagcaccagcagcagctccggcagcagaagcagccccagcagcagaagcagcggctccagcagctgaaccagctcctgtagaagctccaaaggttgaagaaaaagcaccagaagcggaggcaccaaaaacaaattaactattatgtggtctgcaaaaatattcactttatatccagaattttttccagggattttagatatcgggctttataaaagagctagagaaaataaaatctggtcactcgatgtcattaacatcagggactctgctttagataagcatggaagtgtggatgatactccttttggaggaggaagcggaatggttatgcgtgccgatgtaatagatagttgtttggataaaaatattaaaaactctaaaaatgaacttatttatctaagtcctagaggtgaattgttaacgcaaaaaattgcaaaacaattatcacaaaaaaatggagtagatcttatctgtggacactttgaaggaattgatcaaagagttatagaagaaagaaagattagagaaataagtattggtgattttattttatccggcggtgaaacagcagcgtttgtttttttagattccatacttagattgttgccaggcgttcttggcaattcttcttcattaaatgaagagagttttgaaaataatttattagaatatcctcaatatacaaaaccccaagagtggaaaggaagaactgttccggaagtacttttgtctgggaatcacgctaaaattaaggactggcgcttagcacaatccgaggatataacacgacgccagagacaagacttatgggaaaaatatcacaaataactaaattttaatgcaaatttctacaatgagaatagacgaattagataaacttcatattaagaaaattggtgaaaaaaaattaccagaattttctcctggagatactttaaaagtaaacgttcgaattatcgaaggaaaaagacaaagaatacaagcttacgaaggagtttgtattgctaaaaaaaatagaggaattaattctacttttacagttagaaaaatttcttttggtgaaggtgttgaaagattatttccagttcacagtccaaacgtagagtctgttgaagtaattagaagcggaaaagtaagaagagcaaaactttattatttaagagaaagaactggtaaatcagctagaattacagaaaaaattagaaaaaaaattggcgtagatattattcaacctttaccaaaaaaagaggcagtccaaaatattgaagcacaagcagctgtagttgctgaacaggctccaaaaaatacggaaaaagcttcagcgccaaagacagaagctcagaataaaaagaagtaatactagtttttatttaatggcaaagacaatttacgacaaaatatgggaaagtcatttagttgatgagcaaaatgacggaacatcactattgtacattgataggcatttagttcacgaagtaacgagtccacaggcatttgagggattacgtttatctaatagaaaagtaaaattacctggttcaacattagcagttgtagatcanaacgttccaacaacngatagatcaaaaggaatagcagataaagaatctgcaattcaagttgagactctttctaaaaattgtaaagattttggtatagaattttttggtttaacagataaaagacaaggcattgttcatgttattggtcctgaacaaggattcactcagcctggaatgacaattgtttgtggagatagtcatacttcaacgcatggcgcatttggtgcattagcttttggaatcggaacttcagaagtagagcatgttcttgcaacgcaaactttaattcaaagcagagccaaaaattttaaaattagtgttgatggaaaattgccattgggtgttactgctaaagatgtaatcctatctattattggaaaaattggaacagcaggtggaaccggttacgttattgaatactgtggagaagtttttagaaacttttctatggaagaaagaatgacggtttgtaatatgagtat

SEQ ID NO: 995 - DNA, 4000 bp, Escherichia coli
  misc_feature (126)..(126): n is a, c, g, or t
  misc_feature (155)..(155): n is a, c, g, or t
  misc_feature (168)..(168): n is a, c, g, or t
  misc_feature (354)..(354): n is a, c, g, or t
  misc_feature (441)..(441): n is a, c, g, or t
  misc_feature (502)..(502): n is a, c, g, or t
  misc_feature (511)..(511): n is a, c, g, or t
  misc_feature (560)..(560): n is a, c, g, or t
  misc_feature (595)..(595): n is a, c, g, or t
  misc_feature (632)..(632): n is a, c, g, or t
  misc_feature (725)..(725): n is a, c, g, or t
  misc_feature (791)..(791): n is a, c, g, or t
  misc_feature (890)..(890): n is a, c, g, or t
  misc_feature (986)..(986): n is a, c, g, or t
  misc_feature (992)..(992): n is a, c, g, or t
  misc_feature (1163)..(1163): n is a, c, g, or t
  misc_feature (1360)..(1360): n is a, c, g, or t
  misc_feature (1368)..(1369): n is a, c, g, or t
  misc_feature (1437)..(1437): n is a, c, g, or t
  misc_feature (1992)..(1992): n is a, c, g, or t
  misc_feature (2015)..(2015): n is a, c, g, or t
  misc_feature (2073)..(2073): n is a, c, g, or t
  misc_feature (2152)..(2153): n is a, c, g, or t
  misc_feature (2161)..(2161): n is a, c, g, or t
  misc_feature (2441)..(2441): n is a, c, g, or t
  misc_feature (2623)..(2623): n is a, c, g, or t
  misc_feature (2625)..(2625): n is a, c, g, or t
  misc_feature (2627)..(2627): n is a, c, g, or t
  misc_feature (2725)..(2725): n is a, c, g, or t
  misc_feature (2751)..(2751): n is a, c, g, or t
  misc_feature (3532)..(3532): n is a, c, g, or t
cggctcatcaatctaaagtcggcatgattaaacacgcttttaacgcccattttagattgcagcttatagaacgccacagccgaaaggcgcttaaaaacagggtcggccttgcgcgacaccttcacnccataaacaatatcgcttccttcacgatnatgttgcagcatncgcggtatggcttgcaggtcgtcttgcaggtcggcatcgatggttatcaccacatcagcccaatgtctagcagtgagcattccggccataatggcattttgatggcctacgtttcgggctagattgatgcctcgcacgtaattgttttggcgctgatgttggcaaataagctgccaagtggcatcnctgctaccatcgtttacaaacactatcatgcttttggccgacacctcgccactcttaacaagcgtgtcaagtaagtcggttagtcgngctaccgacgagttaagcactgcctcttcgttataacaaggcgaaacaatagccagtcgcntcatctttnttttccctttttacgtttcacaaagtcggtgtaggtaataaattcggcntcgcgccgtttcatcatctttaccaaacggtctantcggttaaccatatccatgccgctatggttgcgaatnatgaagggcatacgatattcgggatggtcgttaaggtcgtagaactcccacggatgaaaataggttaccaaataaccatcgtgtcgcaacacncgcctaaccatggcgtgataaagccattgaggcagattgtgcagcgacagccaaaacaaagggaancgcaaaaggggcgtaaccgatgcggggatttgcatcactgagcctttcataaaccatcggcggggcgtggtgaggtgcatataacgaccaggaatgaangcgggattgagcgacgaattatacaaatagccagcctcggccagtgcgtcgtcgctcacggggaacattcggggctgccgatagccatgcatgggnacgccngccacacgttcgagaatgttttttgagcgccacacgtcttcgggaacaggcttccaatggtccacaccatggcaagccacctcgtgtccctcgtccatgatgcggcgaataaggcgcggtgcctgctcggcaaagttacccgtgcagaaaaaagtggcacacacgccattncgtttcaggcaatcaagaatgcgcgttgtaccctctaccgacacgcgcataccctcttccaagctgatgtttacgccatgttcgcgtggcacatcaaactcttcggtgtcgaaacttagcaatatcagctctttgtcttttgtttgcatgctgcaaagttacgaaaataattggcaacaatgatgttttttcactgntcatcatnngcatttaacgcacgaaagaaaaacgcattatcaacttcgtgctcctacttttaaggctatatgcttcnctagggtgctaaccttttgtaactttgctctacctgatgccctttttgcgctgaataaagcttagctgcaaacagatgataagcgggcgaaagggaagaataaattaaagggggagatggtttgaacaacatcaaacacatctcccccttttgatttaatattcgtcttcgttgaagaggaaatcctcttttgtgggataatcgggccaaatatcttcgatactctcgtagacatcgccttcgtcttcaatctcttgcaagttctctaacacctccaaaggtgcgcccgaacgcatagcatagtctatgagttcttccttggttgctggccaaggtgcatcttctagtttagatgccaattccaatgtccaatacatatcttatcgtttttcttgttaatgttctcggtttaggctgcaaaaataacacttttattgttatttgcaagtgttttgccaagttttttcaagtaaatgtgcattaaaacagataaaacgagctaaaacaaagagataatcggataatctattgagatattgtaagataacgggcganaccgcatctgtatgcgagagggncacaacgcttcgctcggcgcgtctacaaatggtgcgacacacgtgcgcccaggctganaggggagttcctccaggtagtataaattgggtttgcggtggcaattggctctgcatttggtcgatggcttgctctaaannggcgatgntctcggccgatagtaagggcaaacggtggcaagacggctgtaacgacgcctgcgaactggtggcaagatggcaaccgatgttgaaaagctgctgctgaatggcttctatctgcggtgcatgtgcaccatcaggacaaagggctagcaaatatcccaaagatgaattaagctcatccactgtgccgtaggcctcaatgcgaacatgcgacttatctatacgcgttccgcctactaggcttgtaaaaccctcgtcgcctgttttggtgtatattttcatctntagtagctgaatgaggttaaaaattaatgacgtaatgttgtttagggcgggcactatcgaagaacgccacaccacaataatataggtcgaacgttacgccaacacgcttgtcctgctgcaaacgatgccacaattggcgagcatgggccgacttactcacttcgttgacaagcagaatggtntncncgttgaatttgggcaacaactgctcgaatatttcttcggcatgctctacgtcctgaagatgtaaaacaacaggctgttcgaagggtgtaagcgatggnatattgcagggctgcaaatgggtaanttgggtgcgtttgcatgctgtttgcacataaggtgcaagccaatgaggcgacgactggcaacaaatccaacgttcggcttgggcaaaattggccaacctaaagaaaaattcgcccaacttgcgctctctttttgagatgttgggcagctgctgacacaggtcggcataggcgtaataggggtaatgctcgttcactacatatcgtacgaacgaataagccgacggcgattgtatgccaaatccacggcaacaagtgagtcgggtgagccaaatccatagtcgttcgagatgatacattttcgtgatatatatttataattgatgaagtatgcaaagttaatcatttaaaacggaaacaatagcgatggcaaaaactaaaaccattaaaaagtaaggataataaaaaaatatgctgaaaagaaaacaacatagcgttattttcactatttttgcaaaacaaagttatagaaaggccactactgaccgatgaagagctggcacaacaatgtggacaacgataatcaatcagggtaatagcatttcaatataactcaacaactaaatacatcatctataaccgcgcataaaatcgaatcaattaaataacagataaacaacaatactcacaaaatttcatcgtatggataaaacaaaaatcgtagtcaccgcaattattggcctggtggttgttattggtgcatggtttattgcatcgggttttaaaaactttagagaaggacaacccgtaatcagtgtaacgggtatggccgaaaaagaaatnacaagcgacctcatcgtttggaaaattacggttaacgcagagggttcaactcgtagttcggcctttaccgagtttgagaaatcagctcgcgtgatgagcaagtacctacaaacgcatggcattcctgaaaaggaaattacattgagcagcgtggatatcagcaaacgcacaaaagacttttgggacgaagacagccgaaaatacgtaacgcttgaagatgggttctcggtttcgcagactttcacggttagctcgaacgatctcaaacgcgtggaaggggtttaccaacgtatctctgaactgtacaacagtggtatggatttcagtagcgagaaaccactgtactactacacgaaactgaacgacctgaagatggaaatgcttaaccaagcatcggccaacgcatacgaacgtgctcaaaccattgctaaaggtagcgattcgaaagtgggttcggttgtatcttca

SEQ ID NO: 996 - DNA, 4000 bp, Escherichia coli
  misc_feature (1)..(4): n is a, c, g, or t
  misc_feature (6)..(8): n is a, c, g, or t
  misc_feature (12)..(14): n is a, c, g, or t
  misc_feature (16)..(18): n is a, c, g, or t
  misc_feature (21)..(21): n is a, c, g, or t
  misc_feature (23)..(23): n is a, c, g, or t
  misc_feature (25)..(31): n is a, c, g, or t
  misc_feature (34)..(35): n is a, c, g, or t
  misc_feature (38)..(42): n is a, c, g, or t
  misc_feature (44)..(46): n is a, c, g, or t
  misc_feature (48)..(52): n is a, c, g, or t
  misc_feature (54)..(61): n is a, c, g, or t
  misc_feature (63)..(64): n is a, c, g, or t
  misc_feature (66)..(66): n is a, c, g, or t
  misc_feature (68)..(69): n is a, c, g, or t
  misc_feature (71)..(71): n is a, c, g, or t
  misc_feature (73)..(74): n is a, c, g, or t
  misc_feature (76)..(78): n is a, c, g, or t
  misc_feature (81)..(82): n is a, c, g, or t
  misc_feature (84)..(98): n is a, c, g, or t
  misc_feature (102)..(102): n is a, c, g, or t
  misc_feature (105)..(105): n is a, c, g, or t
  misc_feature (107)..(108): n is a, c, g, or t
  misc_feature (110)..(110): n is a, c, g, or t
  misc_feature (112)..(113): n is a, c, g, or t
  misc_feature (116)..(119): n is a, c, g, or t
  misc_feature (121)..(121): n is a, c, g, or t
  misc_feature (123)..(123): n is a, c, g, or t
  misc_feature (125)..(127): n is a, c, g, or t
  misc_feature (129)..(131): n is a, c, g, or t
  misc_feature (133)..(133): n is a, c, g, or t
  misc_feature (135)..(136): n is a, c, g, or t
  misc_feature (138)..(138): n is a, c, g, or t
  misc_feature (140)..(144): n is a, c, g, or t
  misc_feature (148)..(148): n is a, c, g, or t
  misc_feature (152)..(153): n is a, c, g, or t
  misc_feature (158)..(162): n is a, c, g, or t
  misc_feature (164)..(164): n is a, c, g, or t
  misc_feature (167)..(173): n is a, c, g, or t
  misc_feature (175)..(183): n is a, c, g, or t
  misc_feature (185)..(188): n is a, c, g, or t
  misc_feature (190)..(193): n is a, c, g, or t
  misc_feature (195)..(208): n is a, c, g, or t
  misc_feature (210)..(212): n is a, c, g, or t
  misc_feature (214)..(218): n is a, c, g, or t
  misc_feature (221)..(222): n is a, c, g, or t
  misc_feature (225)..(228): n is a, c, g, or t
  misc_feature (230)..(232): n is a, c, g, or t
  misc_feature (236)..(240): n is a, c, g, or t
  misc_feature (242)..(244): n is a, c, g, or t
  misc_feature (246)..(256): n is a, c, g, or t
  misc_feature (258)..(260): n is a, c, g, or t
  misc_feature (262)..(262): n is a, c, g, or t
  misc_feature (264)..(270): n is a, c, g, or t
  misc_feature (274)..(281): n is a, c, g, or t
  misc_feature (283)..(288): n is a, c, g, or t
  misc_feature (290)..(291): n is a, c, g, or t
  misc_feature (293)..(296): n is a, c, g, or t
  misc_feature (298)..(304): n is a, c, g, or t
  misc_feature (306)..(308): n is a, c, g, or t
  misc_feature (311)..(312): n is a, c, g, or t
  misc_feature (315)..(318): n is a, c, g, or t
  misc_feature (320)..(324): n is a, c, g, or t
  misc_feature (326)..(329): n is a, c, g, or t
  misc_feature (331)..(333): n is a, c, g, or t
  misc_feature (338)..(341): n is a, c, g, or t
  misc_feature (343)..(349): n is a, c, g, or t
  misc_feature (351)..(354): n is a, c, g, or t
  misc_feature (357)..(357): n is a, c, g, or t
  misc_feature (359)..(359): n is a, c, g, or t
  misc_feature (363)..(364): n is a, c, g, or t
  misc_feature (366)..(366): n is a, c, g, or t
  misc_feature (369)..(376): n is a, c, g, or t
  misc_feature (378)..(386): n is a, c, g, or t
  misc_feature (389)..(390): n is a, c, g, or t
  misc_feature (393)..(393): n is a, c, g, or t
  misc_feature (395)..(396): n is a, c, g, or t
  misc_feature (399)..(400): n is a, c, g, or t
  misc_feature (404)..(404): n is a, c, g, or t
  misc_feature (406)..(407): n is a, c, g, or t
  misc_feature (409)..(412): n is a, c, g, or t
  misc_feature (415)..(417): n is a, c, g, or t
  misc_feature (420)..(428): n is a, c, g, or t
  misc_feature (430)..(434): n is a, c, g, or t
  misc_feature (436)..(440): n is a, c, g, or t
  misc_feature (442)..(445): n is a, c, g, or t
  misc_feature (447)..(450): n is a, c, g, or t
  misc_feature (454)..(466): n is a, c, g, or t
  misc_feature (469)..(470): n is a, c, g, or t
  misc_feature (472)..(475): n is a, c, g, or t
  misc_feature (479)..(480): n is a, c, g, or t
  misc_feature (482)..(484): n is a, c, g, or t
  misc_feature (486)..(487): n is a, c, g, or t
  misc_feature (489)..(489): n is a, c, g, or t
  misc_feature (492)..(494): n is a, c, g, or t
  misc_feature (498)..(500): n is a, c, g, or t
  misc_feature (503)..(505): n is a, c, g, or t
  misc_feature (508)..(515): n is a, c, g, or t
  misc_feature (518)..(520): n is a, c, g, or t
  misc_feature (522)..(526): n is a, c, g, or t
  misc_feature (528)..(532): n is a, c, g, or t
  misc_feature (534)..(536): n is a, c, g, or t
  misc_feature (539)..(542): n is a, c, g, or t
  misc_feature (547)..(563): n is a, c, g, or t
  misc_feature (565)..(568): n is a, c, g, or t
  misc_feature (571)..(573): n is a, c, g, or t
  misc_feature (576)..(581): n is a, c, g, or t
  misc_feature (583)..(583): n is a, c, g, or t
  misc_feature (586)..(589): n is a, c, g, or t
  misc_feature (591)..(596): n is a, c, g, or t
  misc_feature (598)..(600): n is a, c, g, or t
  misc_feature (602)..(607): n is a, c, g, or t
  misc_feature (609)..(611): n is a, c, g, or t
  misc_feature (613)..(624): n is a, c, g, or t
  misc_feature (626)..(630): n is a, c, g, or t
  misc_feature (633)..(641): n is a, c, g, or t
  misc_feature (643)..(648): n is a, c, g, or t
  misc_feature (650)..(650): n is a, c, g, or t
  misc_feature (653)..(660): n is a, c, g, or t
  misc_feature (662)..(669): n is a, c, g, or t
  misc_feature (673)..(676): n is a, c, g, or t
  misc_feature (678)..(679): n is a, c, g, or t
  misc_feature (683)..(684): n is a, c, g, or t
  misc_feature (686)..(686): n is a, c, g, or t
  misc_feature (688)..(694): n is a, c, g, or t
  misc_feature (696)..(696): n is a, c, g, or t
  misc_feature (698)..(698): n is a, c, g, or t
  misc_feature (701)..(705): n is a, c, g, or t
  misc_feature (709)..(714): n is a, c, g, or t
  misc_feature (718)..(723): n is a, c, g, or t
  misc_feature (725)..(725): n is a, c, g, or t
  misc_feature (727)..(727): n is a, c, g, or t
  misc_feature (729)..(730): n is a, c, g, or t
  misc_feature (732)..(738): n is a, c, g, or t
  misc_feature (740)..(740): n is a, c, g, or t
  misc_feature (742)..(742): n is a, c, g, or t
  misc_feature (744)..(748): n is a, c, g, or t
  misc_feature (750)..(750): n is a, c, g, or t
  misc_feature (753)..(753): n is a, c, g, or t
  misc_feature (755)..(756): n is a, c, g, or t
  misc_feature (759)..(760): n is a, c, g, or t
  misc_feature (762)..(764): n is a, c, g, or t
  misc_feature (767)..(767): n is a, c, g, or t
  misc_feature (770)..(770): n is a, c, g, or t
  misc_feature (773)..(773): n is a, c, g, or t
  misc_feature (775)..(782): n is a, c, g, or t
  misc_feature (784)..(786): n is a, c, g, or t
  misc_feature (791)..(791): n is a, c, g, or t
  misc_feature (793)..(796): n is a, c, g, or t
  misc_feature (798)..(798): n is a, c, g, or t
  misc_feature (801)..(805): n is a, c, g, or t
  misc_feature (807)..(809): n is a, c, g, or t
  misc_feature (811)..(812): n is a, c, g, or t
  misc_feature (814)..(814): n is a, c, g, or t
  misc_feature (817)..(822): n is a, c, g, or t
  misc_feature (827)..(830): n is a, c, g, or t
  misc_feature (837)..(837): n is a, c, g, or t
  misc_feature (842)..(842): n is a, c, g, or t
  misc_feature (852)..(853): n is a, c, g, or t
  misc_feature (855)..(856): n is a, c, g, or t
  misc_feature (859)..(859): n is a, c, g, or t
  misc_feature (861)..(861): n is a, c, g, or t
  misc_feature (863)..(864): n is a, c, g, or t
  misc_feature (866)..(869): n is a, c, g, or t
  misc_feature (872)..(872): n is a, c, g, or t
  misc_feature (876)..(877): n is a, c, g, or t
  misc_feature (886)..(887): n is a, c, g, or t
  misc_feature (894)..(894): n is a, c, g, or t
  misc_feature (896)..(896): n is a, c, g, or t
  misc_feature (898)..(900): n is a, c, g, or t
  misc_feature (902)..(904): n is a, c, g, or t
  misc_feature (907)..(913): n is a, c, g, or t
  misc_feature (917)..(921): n is a, c, g, or t
  misc_feature (923)..(923): n is a, c, g, or t
  misc_feature (925)..(925): n is a, c, g, or t
  misc_feature (927)..(930): n is a, c, g, or t
  misc_feature (935)..(942): n is a, c, g, or t
  misc_feature (944)..(947): n is a, c, g, or t
  misc_feature (950)..(951): n is a, c, g, or t
  misc_feature (956)..(958): n is a, c, g, or t
  misc_feature (960)..(963): n is a, c, g, or t
  misc_feature (965)..(970): n is a, c, g, or t
  misc_feature (972)..(973): n is a, c, g, or t
  misc_feature (975)..(986): n is a, c, g, or t
  misc_feature (988)..(997): n is a, c, g, or t
  misc_feature (999)..(1002): n is a, c, g, or t
  misc_feature (1005)..(1013): n is a, c, g, or t
  misc_feature (1015)..(1018): n is a, c, g, or t
  misc_feature (1020)..(1022): n is a, c, g, or t
  misc_feature (1024)..(1031): n is a, c, g, or t
  misc_feature (1033)..(1037): n is a, c, g, or t
  misc_feature (1039)..(1058): n is a, c, g, or t
  misc_feature (1062)..(1066): n is a, c, g, or t
  misc_feature (1073)..(1075): n is a, c, g, or t
  misc_feature (1078)..(1081): n is a, c, g, or t
  misc_feature (1083)..(1084): n is a, c, g, or t
  misc_feature (1087)..(1090): n is a, c, g, or t
  misc_feature (1098)..(1101): n is a, c, g, or t
  misc_feature (1105)..(1111): n is a, c, g, or t
  misc_feature (1113)..(1118): n is a, c, g, or t
  misc_feature (1120)..(1120): n is a, c, g, or t
  misc_feature (1123)..(1125): n is a, c, g, or t
  misc_feature (1128)..(1130): n is a, c, g, or t
  misc_feature (1133)..(1135): n is a, c, g, or t
  misc_feature (1137)..(1140): n is a, c, g, or t
  misc_feature (1144)..(1145): n is a, c, g, or t
  misc_feature (1148)..(1150): n is a, c, g, or t
  misc_feature (1155)..(1164): n is a, c, g, or t
  misc_feature (1166)..(1172): n is a, c, g, or t
  misc_feature (1174)..(1176): n is a, c, g, or t
  misc_feature (1178)..(1181): n is a, c, g, or t
  misc_feature (1183)..(1183): n is a, c, g, or t
  misc_feature (1186)..(1186): n is a, c, g, or t
  misc_feature (1188)..(1193): n is a, c, g, or t
  misc_feature (1196)..(1204): n is a, c, g, or t
  misc_feature (1207)..(1207): n is a, c, g, or t
  misc_feature (1210)..(1214): n is a, c, g, or t
  misc_feature (1216)..(1216): n is a, c, g, or t
  misc_feature (1222)..(1224): n is a, c, g, or t
  misc_feature (1226)..(1227): n is a, c, g, or t
  misc_feature (1230)..(1231): n is a, c, g, or t
  misc_feature (1233)..(1247): n is a, c, g, or t
  misc_feature (1249)..(1249): n is a, c, g, or t
  misc_feature (1252)..(1256): n is a, c, g, or t
  misc_feature (1262)..(1267): n is a, c, g, or t
  misc_feature (1269)..(1269): n is a, c, g, or t
  misc_feature (1271)..(1272): n is a, c, g, or t
  misc_feature (1275)..(1275): n is a, c, g, or t
  misc_feature (1277)..(1277): n is a, c, g, or t
  misc_feature (1279)..(1292): n is a, c, g, or t
  misc_feature (1294)..(1295): n is a, c, g, or t
  misc_feature (1298)..(1301): n is a, c, g, or t
  misc_feature (1303)..(1312): n is a, c, g, or t
  misc_feature (1314)..(1321): n is a, c, g, or t
  misc_feature (1323)..(1325): n is a, c, g, or t
  misc_feature (1327)..(1336): n is a, c, g, or t
  misc_feature (1338)..(1342): n is a, c, g, or t
  misc_feature (1346)..(1347): n is a, c, g, or t
  misc_feature (1349)..(1351): n is a, c, g, or t
  misc_feature (1353)..(1354): n is a, c, g, or t
  misc_feature (1356)..(1356): n is a, c, g, or t
  misc_feature (1358)..(1361): n is a, c, g, or t
  misc_feature (1368)..(1369): n is a, c, g, or t
  misc_feature (1372)..(1374): n is a, c, g, or t
  misc_feature (1377)..(1380): n is a, c, g, or t
  misc_feature (1382)..(1383): n is a, c, g, or t
  misc_feature (1388)..(1388): n is a, c, g, or t
  misc_feature (1390)..(1390): n is a, c, g, or t
  misc_feature (1392)..(1392): n is a, c, g, or t
  misc_feature (1396)..(1396): n is a, c, g, or t
  misc_feature (1398)..(1399): n is a, c, g, or t
  misc_feature (1402)..(1403): n is a, c, g, or t
  misc_feature (1406)..(1406): n is a, c, g, or t
  misc_feature (1409)..(1413): n is a, c, g, or t
  misc_feature (1416)..(1418): n is a, c, g, or t
  misc_feature (1422)..(1428): n is a, c, g, or t
  misc_feature (1431)..(1440): n is a, c, g, or t
  misc_feature (1442)..(1442): n is a, c, g, or t
  misc_feature (1446)..(1446): n is a, c, g, or t
  misc_feature (1448)..(1453): n is a, c, g, or t
  misc_feature (1455)..(1455): n is a, c, g, or t
  misc_feature (1459)..(1461): n is a, c, g, or t
  misc_feature (1463)..(1463): n is a, c, g, or t
  misc_feature (1465)..(1472): n is a, c, g, or t
  misc_feature (1474)..(1474): n is a, c, g, or t
  misc_feature (1477)..(1480): n is a, c, g, or t
  misc_feature (1482)..(1483): n is a, c, g, or t
  misc_feature (1485)..(1490): n is a, c, g, or t
  misc_feature (1496)..(1496): n is a, c, g, or t
  misc_feature (1498)..(1498): n is a, c, g, or t
  misc_feature (1504)..(1504): n is a, c, g, or t
  misc_feature (1506)..(1508): n is a, c, g, or t
  misc_feature (1510)..(1510): n is a, c, g, or t
  misc_feature (1512)..(1516): n is a, c, g, or t
  misc_feature (1521)..(1522): n is a, c, g, or t
  misc_feature (1524)..(1527): n is a, c, g, or t
  misc_feature (1531)..(1532): n is a, c, g, or t
  misc_feature (1535)..(1539): n is a, c, g, or t
  misc_feature (1542)..(1542): n is a, c, g, or t
  misc_feature (1544)..(1544): n is a, c, g, or t
  misc_feature (1548)..(1549): n is a, c, g, or t
  misc_feature (1552)..(1555): n is a, c, g, or t
  misc_feature (1557)..(1558): n is a, c, g, or t
  misc_feature (1562)..(1564): n is a, c, g, or t
  misc_feature (1566)..(1570): n is a, c, g, or t
  misc_feature (1573)..(1583): n is a, c, g, or t
  misc_feature (1587)..(1588): n is a, c, g, or t
  misc_feature (1591)..(1591): n is a, c, g, or t
  misc_feature (1594)..(1594): n is a, c, g, or t
  misc_feature (1596)..(1597): n is a, c, g, or t
  misc_feature (1602)..(1602): n is a, c, g, or t
  misc_feature (1604)..(1605): n is a, c, g, or t
  misc_feature (1607)..(1608): n is a, c, g, or t
  misc_feature (1610)..(1610): n is a, c, g, or t
  misc_feature (1613)..(1616): n is a, c, g, or t
  misc_feature (1618)..(1618): n is a, c, g, or t
  misc_feature (1620)..(1626): n is a, c, g, or t
  misc_feature (1628)..(1628): n is a, c, g, or t
  misc_feature (1631)..(1634): n is a, c, g, or t
  misc_feature (1636)..(1636): n is a, c, g, or t
  misc_feature (1640)..(1645): n is a, c, g, or t
  misc_feature (1647)..(1649): n is a, c, g, or t
  misc_feature (1651)..(1654): n is a, c, g, or t
  misc_feature (1656)..(1659): n is a, c, g, or t
  misc_feature (1661)..(1664): n is a, c, g, or t
  misc_feature (1666)..(1669): n is a, c, g, or t
  misc_feature (1672)..(1673): n is a, c, g, or t
  misc_feature (1677)..(1680): n is a, c, g, or t
  misc_feature (1682)..(1684): n is a, c, g, or t
  misc_feature (1686)..(1691): n is a, c, g, or t
  misc_feature (1696)..(1702): n is a, c, g, or t
  misc_feature (1704)..(1707): n is a, c, g, or t
  misc_feature (1709)..(1710): n is a, c, g, or t
  misc_feature (1712)..(1712): n is a, c, g, or t
  misc_feature (1717)..(1724): n is a, c, g, or t
  misc_feature (1726)..(1726): n is a, c, g, or t
  misc_feature (1728)..(1728): n is a, c, g, or t
  misc_feature (1730)..(1736): n is a, c, g, or t
  misc_feature (1739)..(1740): n is a, c, g, or t
  misc_feature (1742)..(1747): n is a, c, g, or t
  misc_feature (1750)..(1753): n is a, c, g, or t
  misc_feature (1755)..(1757): n is a, c, g, or t
  misc_feature (1760)..(1767): n is a, c, g, or t
  misc_feature (1769)..(1769): n is a, c, g, or t
  misc_feature (1771)..(1771): n is a, c, g, or t
  misc_feature (1775)..(1781): n is a, c, g, or t
  misc_feature (1783)..(1783): n is a, c, g, or t
  misc_feature (1786)..(1786): n is a, c, g, or t
  misc_feature (1792)..(1797): n is a, c, g, or t
  misc_feature (1802)..(1807): n is a, c, g, or t
  misc_feature (1812)..(1817): n is a, c, g, or t
  misc_feature (1822)..(1828): n is a, c, g, or t
  misc_feature (1833)..(1834): n is a, c, g, or t
nnnntnnnaaannntnnnaananannnnnnnaannttnnnnnannntnnnnnannnnnnnntnnancnnantnnannnaanntnnnnnnnnnnnnnnnaaanatntnnanannttnnnnantntnnncnnntntnntntnnnnntttntttnnttttnnnnnanttnnnnnnnannnnnnnnnannnnannnnannnnnnnnnnnnnntnnnannnnnttnnaannnntnnnaaannnnnannnannnnnnnnnnnannntntnnnnnnntttnnnnnnnntnnnnnntnntnnnnannnnnnnannnaannttnnnnannnnnannnnannntaaannnnannnnnnncnnnntanancctnnantannnnnnnntnnnnnnnnnttnnaantnnttnnaaananntnnnnaannnttnnnnnnnnntnnnnntnnnnncnnnntnnnncaannnnnnnnnnnnnttnntnnnntttnntnnnanntnttnnnaaannnttnnnaannnnnnnnaannntnnnnnannnnntnnnaannnnttttnnnnnnnnnnnnnnnnntnnnnttnnnaannnnnnanaannnntnnnnnnannntnnnnnnannnannnnnnnnnnnntnnnnnttnnnnnnnnntnnnnnntnttnnnnnnnntnnnnnnnntttnnnnannttanntnannnnnnntnanttnnnnnaaannnnnnaaannnnnnananannannnnnnnanantnnnnnanaanannaannannnaanaanaanannnnnnnnannngaaantnnnngnaannnnnannnannanaannnnnnaaaannnnaaaaaanaaaanaaaaaaaaanntnnaananannannnnaanaaannaaaaaaaannaaaaaantntnnntnnnttnnnnnnnattnnnnntnantnnnncttannnnnnnntnnnnaannttttnnnannnnannnnnngnnannnnnnnnnnnntnnnnnnnnnntnnnnttnnnnnnnnntnnnntnnnannnnnnnnannnnncnnnnnnnnnnnnnnnnnnnntttnnnnnttttttnnnatnnnnannaannnnaaaaaaannnnaaannnnnnnannnnnnanttnnnttnnnttnnntnnnntttnnttnnnttttnnnnnnnnnntnnnnnnnannnannnnanatnannnnnnttnnnnnnnnnttnaannnnntnaaaaannntnnaannannnnnnnnnnnnnnnanaannnnnaaaaannnnnnananntantnannnnnnnnnnnnnnannttnnnnannnnnnnnnntnnnnnnnnannnannnnnnnnnnannnnnaaannannnannanannnnaaaaaannttnnnaannnntnnaaatnananaaantnnaannaanttnnnnnaannnaaannnnnnnaannnnnnnnnntngaanannnnnnanaaannnanannnnnnnnanaannnntnntnnnnnnttttananaataanannnantnnnnnaaaannannnnaaannaannnnnaananaatnnaannnnannaaannngnnnnnaannnnnnnnnnnaaannttnttnanntttantnnanntnaannnnanannnnnnntnaannnnanttannnnnnannnannnnannnnannnnannnnaanntaannnnannntnnnnnnaaaannnnnnnannnntnnanaaaannnnnnnncntntnnnnnnnttnncnnnnnnttnnnntnnnaannnnnnnnananaaannnnnnnanaanaaaaannnnnnaaaannnnnnaaaannnnnnaaaannnnnnnaaaanngatcaaaaacgatcaaaaacgatcaaaaacgatcaaaaacgatcaaaatataagtttcttaaaaattaataatttttttagaaaatattaaaatcatttttttaataaaaaaggtctaaaatcatcaaaaatttagcaaaaacaatcaaaaaagtggaaaattgatcaaaaaaacattaaaaatggttttttttaaaaaattaaattaaggcaatttatggcctaaataggtttctaacattctaaaccaatctatttcgcttaaatcaatacttaaagaattttttgcagcattaattctttcagtttttacggttccaattacaggatgaatttttgatggatgttttaatatccatgacaataataattgatcttttgaagcattgtattttttcataagctcttctaataaaaaatgaatttttttattattttcatccttatccttaaatatcgtccctaaagggctccagctcataggaattatatcattaacaaacatatagtctaatgatgaatcaaacaaaggtttattatgggataaagaaaactctatctgattagcactaaccttagatttagtagaaattaaatcagtttgaatatccgtaaaatttgaaactccaaatgaatttatttttccttgagacaataaagtttcaatagctttagaaatttcgtcagggtgcattagaggactaggcctatgtaacaaaaatatatctaaataatctgcatttaaatctttgattgatttttcggcactaaatattatataatccgagtcatactgatagtgtttgactttatttaatcgagtttctccgacatattgaataccacattttgaaattaactgaacttcttctcgtttaatactcgaatttttaaaagctttaccaaactccatttcagttgtataatctccatatatatcggcatgatcaaacgaagtaatccctttttctaaattaaaatgaattaatctttccatttcattttgagaaagcgaacttccccatttgccccagttcatacaaccttgtataattcttgaaaaattagatttcatttgaaattattttttattaaaatactaattaaaactgacttacatttgtgaaaatttaaaaaaattgattgccaattacactaaagaatttcgctataatttaaaattatcatttcctgtaatgcttggaatgttagggcatacatttgtggcgtttgccgataatgtaatggttggtcaactaggtacagcagaactggctgcagtttctttgggtaatagttttgtgtttatagcaatgtctttaggaattggattttcaactgctattactccgcttgttgctgaagctgatgcatccaataacatttcagaaggcaagaatgcattcaaacacggtttacttctttgtactattttaagcgttttactttttttaattattatattacttaaacctgtaatgtattatatggatcaacccaaagaggttgtagaattggctattccttatttaaactttgtttctctttcactaattcctctgatagtatttcaggcattaaaacaattttctgacggactttctaataccaaatacccaatgtatgccacaatattggctaacgtaataaacataacattaaattactttctaatatttggaacatttggttttcctaagttaggaataactggagcggctataggaactcttatatcaagaattattatggtttattttttatggatgattttcaagcacaaagaaaaatttaaaccttatataactggatttaattttagaaaagttgaaaaaaaaatcactaataaactatttaatttaggatttccatctgctcttcaaatgttttttgaagttgggatttttactgctgctatttggttaagtggagttttaggaaaaaatccacaagcagcaaatcaaatagccctaaacttatcgagtatgacttttatgataggaataggtctttcggttgccgctatggtaagagttggtaatcaaaaaggattaaatgattttgtttcgcttagaagaattgcgttttctattttctttttaacttttttaattgaaattatttttgcatcatttttcttggtgttcagagactggcttccaacat

SEQ ID NO: 997 - DNA, 4000 bp, Escherichia coli
  misc_feature (127)..(127): n is a, c, g, or t
  misc_feature (1369)..(1369): n is a, c, g, or t
  misc_feature (1990)..(1990): n is a, c, g, or t
  misc_feature (2422)..(2422): n is a, c, g, or t
  misc_feature (2431)..(2431): n is a, c, g, or t
  misc_feature (2653)..(2653): n is a, c, g, or t
  misc_feature (2847)..(2847): n is a, c, g, or t
  misc_feature (3138)..(3138): n is a, c, g, or t
  misc_feature (3308)..(3308): n is a, c, g, or t
  misc_feature (3334)..(3334): n is a, c, g, or t
  misc_feature (3349)..(3349): n is a, c, g, or t
  misc_feature (3359)..(3359): n is a, c, g, or t
  misc_feature (3814)..(3814): n is a, c, g, or t
  misc_feature (3991)..(3991): n is a, c, g, or t
gagcagattgattctctccacgccgcggcgcttgcggatgaagtcggcggcgctgccgacgtccttcacggcggtggacgtggtggtgagcggagcattgcgctcggccggctggtccatctccggnggacgcgtggagcgcccgtagccgcgcaggtcgacgaggtagacgtcgtagccctgccgcgcgatgtattccatccacgacacgccgttcagcggcaggtcgaaggccgtttccgccggatacgtcgagccgtgcacgaacagcacgatgcgctcgccggggaaccgcgactccgaggccgggcgcttgttgcgcacgtagagctcgatgccggggtcggccgagggaaccatgaactcctcggtgaccagggcttgctcgtgcagcacggtggcgcagccgcccagccacaacggcagggcgaggaacagcaatggcgcaagtctcgacatgaatgttgctccccggctagcgatcctcggcgtcgcgcatgtcctggtccagcagcgcatcacggcctttcgaggtgatggtgaaggcgccagcattcggcctggcgaggccgaaggcgccaagcttggcggcgatattcattggaacgctcggcgggtcgcgcttcgcgtccgcggcgtccctcagcttccgcagccagtcgaaatcctccgccgtcaggtccgaatccatgcctataataatctcccggatgcacatccaaaccgtcaaggcggcgtaccgccgctacgcgcgcgtctacgacgcgctgttcgggcccgtccttcagcccggtcgcaaggcggtcgtcaaggcgctcggctgccggccgggcgagcgcgtgctcgaggtcggcgtgggcaccgggctgtcgctgccgctttatccgccgcatacgcgcgtcaccggcatcgacgtgtcgacagagatgctcgacaaggcgcgcgcccgggtggaaaaccgcaggctggcgaacgtcgaggcgctgctcgagatgaacgccgaggagatgacgttccccgacgcgagcttcgacaaggtggtggcgatgtacgtggtctcggtcgtggagcgcccggcgcgcctgctcgaggagctgcaccgcgtctgccggccgcagggcgagatcttcatcgtcaatcacctgcgttccgacaacccgcttctcggcgccgtggaaaagagcctggcgcggttctcggacaagctcggattccgtcccgacttcgcgctgcgcgacctggtggatggctcggagcaggtgacggaagtggcgcgcatcaacctcctgtggaaagtgctgcgcctgcgcaacggcatcgcgcatccgcggtttgctacttcgtgcgcaccgcacccatcaggtgatcnggcagccaggtagcgatcgtcgggaacacgcagaggatcacgatcgcgaggaacatgcacagcacgtagggaatcgttccccagatcactttcatgagcggcacgtcgggagcgatggccttgacgatgtagatgttgaggccgaccggcggatggatcaggccgatctccatgttgatggtcatgatgacgccgaaccacaccgggtcgaagcccgccgcccggatgatcggcagcaggatcgggctggtcatcaggatgatcgccgccggcgggatgaagaagccgcacaccagcaggaacaggttgatcagcgccatcagcacccagcggttgacgtgcatgtcggcgatcgcctgcgcgagcgtctgcgtgaggtagagcgaagtcagcatgtagccgaacagcaccgccgcgccgatgatcgtcaggatcatcaccgactcgcgcgtcgtgtcgcgcaggatctgccaccagtcgcgcggctgccacatgcggtagatgagcaccgccagaaccacgcacagcgccgccccgacgccggcggcttccgacggcgtcgccacgcctccatacagcacgtacatgacgccgacgatgatggcgaggaacggcgctacnttcggcaccgactggaatttctccttccaggaatagcggaactccggcgcatgggcgcggaagccccggcgccagatggcgaacagcgtccagagcatgaacaggcccgtcagcatgagcccgggaaccacgccggcgaggaacaggcggccgatcgaggtctcggtggcgatgccgtagaggatgaaggtgatcgagggcgggatcaggatgccgagcgtgccgccggcgcagatcgagccggtggcgatctcgtccggatagccgcgccggcgcatctccgggatgcccatcttgccgatggcggcgcagcacgccggggacgagccggtgagcgccgcgaacagggcgcaggcgcccaggttggagatcaccagcccgcccggcagccggtacagccagcggtcgagcgcctcgtacaggtcgcgcccngcgggcgangagccgatcgccgcacccatcatgacgaacatcgggatcgagaccagggtgaaatcgttcaggccggcatagaaggtctccgccaccacctgcagcgagccgaatccctggaagatcagcaggaacacgatcgacagcgcgccgagcccgaacgccaccggggcgccgcaaagcagcacgatcagcgtcgcggtgaggacgatggcgccttgagtggcaggnctcatggctcgatgccgaacggcggctcgcgcccgctcacgaggcaataaagatcggcgaagtactgcaggcagaggatcgcgaggccgatcggcatcgagctgtagggaatccacagccgcgcgcgccacatcgtgtcggagacccagcggctgtcccaggcctcgagccagaaacgcgcggtcagcgctgcnaggaccaggcagaacgcgagcgacatgacgatcgaggccagggcgagccaccagcggccgcgcggcccgagatagtgcgggagaacgtccacgttcacgtgcccgcgggtcagcagcacataggggctgccgacgaacgtggcggccaccaggctccaggtgacgaagtcggtctgccagatggtgttctggttgagcgcgtagcgcacgaacaccatctcgcagaccaccagcacgccgagcccgatcagcgccgcggcgacgatgccgcagagctgcgagacgcggcgnatgccgcgaacgaagaagtccaagctacttgacgctcagcgcttcttcgatcagcttcttgccgttggggacttccttgtcgaactcggcatacgagctctcgcgcgccaccttgatccacgcgtcgtactcggccggcgtgagagtgatgacctcgaccttgtggtccntgaacaccttcaccatctcgtcgtcnagacctttggcgttngcggcgaagnactgctgcgacttcctgccggcctgcagcagggcgtcctgctgcttcctgtccaggcgcaggaaggttttcttggacatcagcaccggctcgtacatgaaccagagcgcgttgtcgcccggcgcggtcaggcacttcacctgctcgtagatgcggaacgagacgaagctgccggagctggtgtcggtggcgtcggcgacgccggtctgcaatgcgttgtagacctcgttcgacgggatcgacacgatcgaggcgccggccgattgccacatcgaggcgaaagtcggcccggcggagcgcaccttcaggcccttgatgtcctcgggcctgcggatgcagcctttcttcgaggcgatcgcgccggcgagccaggcgtcggcgagcacgacgacgcccgccttgtcgatgtgcgccttgatctccttcatgaagggcgaattgttgagccgctgcgcncgctcgtggctgcgcaccaggccgggcatcagcgtggcgccgaaggcgcgcaccttgccgctcgcgtaatcgagcgggaacgacgagatgtcgagctgcccgttgaccagggcgttccactgctcgttgggcttgaacagggacgccccggggtagacctggatctcgagatcgacnttggccgcc

SEQ ID NO: 998 - DNA, 4000 bp, Escherichia coli
  misc_feature (37)..(37): n is a, c, g, or t
  misc_feature (104)..(104): n is a, c, g, or t
  misc_feature (229)..(229): n is a, c, g, or t
  misc_feature (241)..(241): n is a, c, g, or t
  misc_feature (737)..(737): n is a, c, g, or t
  misc_feature (740)..(740): n is a, c, g, or t
  misc_feature (743)..(743): n is a, c, g, or t
  misc_feature (776)..(776): n is a, c, g, or t
  misc_feature (803)..(803): n is a, c, g, or t
  misc_feature (854)..(854): n is a, c, g, or t
  misc_feature (857)..(857): n is a, c, g, or t
  misc_feature (860)..(860): n is a, c, g, or t
  misc_feature (862)..(862): n is a, c, g, or t
  misc_feature (1664)..(1664): n is a, c, g, or t
  misc_feature (1990)..(1990): n is a, c, g, or t
  misc_feature (2228)..(2229): n is a, c, g, or t
  misc_feature (2303)..(2304): n is a, c, g, or t
  misc_feature (2306)..(2307): n is a, c, g, or t
  misc_feature (2315)..(2315): n is a, c, g, or t
  misc_feature (2317)..(2318): n is a, c, g, or t
  misc_feature (2322)..(2322): n is a, c, g, or t
  misc_feature (2330)..(2330): n is a, c, g, or t
  misc_feature (2333)..(2333): n is a, c, g, or t
  misc_feature (2341)..(2342): n is a, c, g, or t
  misc_feature (2348)..(2348): n is a, c, g, or t
  misc_feature (2351)..(2352): n is a, c, g, or t
  misc_feature (2355)..(2355): n is a, c, g, or t
  misc_feature (2357)..(2358): n is a, c, g, or t
  misc_feature (2360)..(2363): n is a, c, g, or t
  misc_feature (2365)..(2366): n is a, c, g, or t
  misc_feature (2368)..(2370): n is a, c, g, or t
  misc_feature (2372)..(2383): n is a, c, g, or t
  misc_feature (2387)..(2392): n is a, c, g, or t
  misc_feature (2399)..(2399): n is a, c, g, or t
  misc_feature (2401)..(2402): n is a, c, g, or t
  misc_feature (2404)..(2407): n is a, c, g, or t
  misc_feature (2411)..(2413): n is a, c, g, or t
  misc_feature (2416)..(2422): n is a, c, g, or t
  misc_feature (2424)..(2424): n is a, c, g, or t
  misc_feature (2427)..(2427): n is a, c, g, or t
  misc_feature (2429)..(2429): n is a, c, g, or t
  misc_feature (2432)..(2435): n is a, c, g, or t
  misc_feature (2438)..(2439): n is a, c, g, or t
  misc_feature (2441)..(2444): n is a, c, g, or t
  misc_feature (2447)..(2451): n is a, c, g, or t
  misc_feature (2453)..(2453): n is a, c, g, or t
  misc_feature (2455)..(2455): n is a, c, g, or t
  misc_feature (2457)..(2461): n is a, c, g, or t
  misc_feature (2463)..(2463): n is a, c, g, or t
  misc_feature (2465)..(2466): n is a, c, g, or t
  misc_feature (2468)..(2472): n is a, c, g, or t
  misc_feature (2474)..(2493): n is a, c, g, or t
  misc_feature (2495)..(2495): n is a, c, g, or t
  misc_feature (2497)..(2497): n is a, c, g, or t
  misc_feature (2501)..(2502): n is a, c, g, or t
  misc_feature (2504)..(2510): n is a, c, g, or t
  misc_feature (2512)..(2519): n is a, c, g, or t
  misc_feature (2522)..(2523): n is a, c, g, or t
  misc_feature (2525)..(2525): n is a, c, g, or t
  misc_feature (2527)..(2529): n is a, c, g, or t
  misc_feature (2535)..(2536): n is a, c, g, or t
  misc_feature (2538)..(2541): n is a, c, g, or t
  misc_feature (2543)..(2543): n is a, c, g, or t
  misc_feature (2546)..(2550): n is a, c, g, or t
  misc_feature (2552)..(2558): n is a, c, g, or t
  misc_feature (2560)..(2575): n is a, c, g, or t
  misc_feature (2577)..(2577): n is a, c, g, or t
  misc_feature (2580)..(2586): n is a, c, g, or t
  misc_feature (2589)..(2589): n is a, c, g, or t
  misc_feature (2591)..(2592): n is a, c, g, or t
  misc_feature (2596)..(2602): n is a, c, g, or t
  misc_feature (2604)..(2605): n is a, c, g, or t
  misc_feature (2607)..(2610): n is a, c, g, or t
  misc_feature (2612)..(2613): n is a, c, g, or t
  misc_feature (2615)..(2616): n is a, c, g, or t
  misc_feature (2618)..(2618): n is a, c, g, or t
  misc_feature (2620)..(2621): n is a, c, g, or t
  misc_feature (2624)..(2626): n is a, c, g, or t
  misc_feature (2628)..(2631): n is a, c, g, or t
  misc_feature (2633)..(2637): n is a, c, g, or t
  misc_feature (2639)..(2640): n is a, c, g, or t
  misc_feature (2642)..(2642): n is a, c, g, or t
  misc_feature (2644)..(2649): n is a, c, g, or t
  misc_feature (2651)..(2654): n is a, c, g, or t
  misc_feature (2657)..(2657): n is a, c, g, or t
  misc_feature (2661)..(2667): n is a, c, g, or t
  misc_feature (2669)..(2670): n is a, c, g, or t
  misc_feature (2672)..(2672): n is a, c, g, or t
  misc_feature (2674)..(2677): n is a, c, g, or t
  misc_feature (2679)..(2683): n is a, c, g, or t
  misc_feature (2685)..(2687): n is a, c, g, or t
  misc_feature (2689)..(2692): n is a, c, g, or t
  misc_feature (2695)..(2699): n is a, c, g, or t
  misc_feature (2701)..(2701): n is a, c, g, or t
  misc_feature (2703)..(2704): n is a, c, g, or t
  misc_feature (2706)..(2716): n is a, c, g, or t
  misc_feature (2718)..(2719): n is a, c, g, or t
  misc_feature (2722)..(2722): n is a, c, g, or t
  misc_feature (2724)..(2729): n is a, c, g, or t
  misc_feature (2731)..(2731): n is a, c, g, or t
  misc_feature (2734)..(2753): n is a, c, g, or t
  misc_feature (2756)..(2759): n is a, c, g, or t
  misc_feature (2761)..(2761): n is a, c, g, or t
  misc_feature (2763)..(2765): n is a, c, g, or t
  misc_feature (2769)..(2769): n is a, c, g, or t
  misc_feature (2771)..(2773): n is a, c, g, or t
  misc_feature (2775)..(2778): n is a, c, g, or t
  misc_feature (2780)..(2780): n is a, c, g, or t
  misc_feature (2782)..(2784): n is a, c, g, or t
  misc_feature (2787)..(2787): n is a, c, g, or t
  misc_feature (2790)..(2791): n is a, c, g, or t
  misc_feature (2794)..(2794): n is a, c, g, or t
  misc_feature (2798)..(2798): n is a, c, g, or t
  misc_feature (2800)..(2803): n is a, c, g, or t
  misc_feature (2805)..(2806): n is a, c, g, or t
  misc_feature (2808)..(2816): n is a, c, g, or t
  misc_feature (2818)..(2819): n is a, c, g, or t
  misc_feature (2821)..(2822): n is a, c, g, or t
  misc_feature (2826)..(2826): n is a, c, g, or t
  misc_feature (2831)..(2831): n is a, c, g, or t
  misc_feature (2833)..(2836): n is a, c, g, or t
  misc_feature (2838)..(2843): n is a, c, g, or t
  misc_feature (2845)..(2846): n is a, c, g, or t
  misc_feature (2848)..(2855): n is a, c, g, or t
  misc_feature (2857)..(2857): n is a, c, g, or t
  misc_feature (2859)..(2864): n is a, c, g, or t
  misc_feature (2868)..(2870): n is a, c, g, or t
  misc_feature (2872)..(2872): n is a, c, g, or t
  misc_feature (2877)..(2877): n is a, c, g, or t
  misc_feature (2880)..(2880): n is a, c, g, or t
  misc_feature (2884)..(2887): n is a, c, g, or t
  misc_feature (2889)..(2890): n is a, c, g, or t
  misc_feature (2892)..(2894): n is a, c, g, or t
  misc_feature (2896)..(2897): n is a, c, g, or t
  misc_feature (2900)..(2901): n is a, c, g, or t
  misc_feature (2903)..(2905): n is a, c, g, or t
  misc_feature (2909)..(2914): n is a, c, g, or t
  misc_feature (2917)..(2919): n is a, c, g, or t
  misc_feature (2921)..(2924): n is a, c, g, or t
  misc_feature (2927)..(2928): n is a, c, g, or t
  misc_feature (2930)..(2930): n is a, c, g, or t
  misc_feature (2932)..(2934): n is a, c, g, or t
  misc_feature (2937)..(2942): n is a, c, g, or t
  misc_feature (2944)..(2945): n is a, c, g, or t
  misc_feature (2947)..(2949): n is a, c, g, or t
  misc_feature (2951)..(2956): n is a, c, g, or t
  misc_feature (2958)..(2958): n is a, c, g, or t
  misc_feature (2960)..(2961): n is a, c, g, or t
  misc_feature (2965)..(2965): n is a, c, g, or t
  misc_feature (2967)..(2988): n is a, c, g, or t
  misc_feature (2990)..(2990): n is a, c, g, or t
  misc_feature (2992)..(2995): n is a, c, g, or t
  misc_feature (2997)..(2997): n is a, c, g, or t
  misc_feature (2999)..(3005): n is a, c, g, or t
  misc_feature (3007)..(3008): n is a, c, g, or t
  misc_feature (3011)..(3011): n is a, c, g, or t
  misc_feature (3013)..(3015): n is a, c, g, or t
  misc_feature (3017)..(3017): n is a, c, g, or t
  misc_feature (3019)..(3021): n is a, c, g, or t
  misc_feature (3024)..(3032): n is a, c, g, or t
  misc_feature (3034)..(3041): n is a, c, g, or t
  misc_feature (3043)..(3045): n is a, c, g, or t
  misc_feature (3049)..(3049): n is a, c, g, or t
  misc_feature (3051)..(3053): n is a, c, g, or t
  misc_feature (3055)..(3068): n is a, c, g, or t
  misc_feature (3070)..(3070): n is a, c, g, or t
  misc_feature (3072)..(3072): n is a, c, g, or t
  misc_feature (3076)..(3082): n is a, c, g, or t
  misc_feature (3085)..(3091): n is a, c, g, or t
  misc_feature (3093)..(3096): n is a, c, g, or t
  misc_feature (3099)..(3099): n is a, c, g, or t
  misc_feature (3101)..(3103): n is a, c, g, or t
  misc_feature (3107)..(3108): n is a, c, g, or t
  misc_feature (3111)..(3115): n is a, c, g, or t
  misc_feature (3119)..(3120): n is a, c, g, or t
  misc_feature (3122)..(3122): n is a, c, g, or t
  misc_feature (3124)..(3124): n is a, c, g, or t
  misc_feature (3126)..(3127): n is a, c, g, or t
  misc_feature (3129)..(3131): n is a, c, g, or t
  misc_feature (3133)..(3134): n is a, c, g, or t
  misc_feature (3136)..(3143): n is a, c, g, or t
  misc_feature (3145)..(3145): n is a, c, g, or t
  misc_feature (3147)..(3149): n is a, c, g, or t
  misc_feature (3151)..(3152): n is a, c, g, or t
  misc_feature (3155)..(3156): n is a, c, g, or t
  misc_feature (3158)..(3159): n is a, c, g, or t
  misc_feature (3162)..(3162): n is a, c, g, or t
  misc_feature (3164)..(3165): n is a, c, g, or t
  misc_feature (3167)..(3172): n is a, c, g, or t
  misc_feature (3177)..(3177): n is a, c, g, or t
  misc_feature (3179)..(3183): n is a, c, g, or t
  misc_feature (3186)..(3186): n is a, c, g, or t
  misc_feature (3188)..(3188): n is a, c, g, or t
  misc_feature (3190)..(3190): n is a, c, g, or t
  misc_feature (3192)..(3196): n is a, c, g, or t
  misc_feature (3200)..(3208): n is a, c, g, or t
  misc_feature (3210)..(3213): n is a, c, g, or t
  misc_feature (3215)..(3215): n is a, c, g, or t
  misc_feature (3217)..(3217): n is a, c, g, or t
  misc_feature (3220)..(3220): n is a, c, g, or t
  misc_feature (3222)..(3223): n is a, c, g, or t
  misc_feature (3225)..(3231): n is a, c, g, or t
  misc_feature (3236)..(3240): n is a, c, g, or t
  misc_feature (3242)..(3247): n is a, c, g, or t
  misc_feature (3249)..(3256): n is a, c, g, or t
  misc_feature (3258)..(3267): n is a, c, g, or t
  misc_feature (3269)..(3270): n is a, c, g, or t
  misc_feature (3273)..(3273): n is a, c, g, or t
  misc_feature (3275)..(3276): n is a, c, g, or t
  misc_feature (3278)..(3278): n is a, c, g, or t
  misc_feature (3281)..(3282): n is a, c, g, or t
  misc_feature (3284)..(3288): n is a, c, g, or t
  misc_feature (3290)..(3294): n is a, c, g, or t
  misc_feature (3296)..(3297): n is a, c, g, or t
  misc_feature (3299)..(3300): n is a, c, g, or t
  misc_feature (3302)..(3302): n is a, c, g, or t
  misc_feature (3304)..(3312): n is a, c, g, or t
  misc_feature (3315)..(3319): n is a, c, g, or t
  misc_feature (3324)..(3325): n is a, c, g, or t
  misc_feature (3328)..(3328): n is a, c, g, or t
  misc_feature (3331)..(3338): n is a, c, g, or t
  misc_feature (3341)..(3341): n is a, c, g, or t
  misc_feature (3344)..(3347): n is a, c, g, or t
  misc_feature (3349)..(3351): n is a, c, g, or t
  misc_feature (3355)..(3359): n is a, c, g, or t
  misc_feature (3361)..(3362): n is a, c, g, or t
  misc_feature (3364)..(3364): n is a, c, g, or t
  misc_feature (3366)..(3366): n is a, c, g, or t
  misc_feature (3368)..(3372): n is a, c, g, or t
  misc_feature (3375)..(3378): n is a, c, g, or t
  misc_feature (3380)..(3381): n is a, c, g, or t
  misc_feature (3385)..(3385): n is a, c, g, or t
  misc_feature (3390)..(3391): n is a, c, g, or t
  misc_feature (3397)..(3399): n is a, c, g, or t
  misc_feature (3402)..(3404): n is a, c, g, or t
  misc_feature (3406)..(3406): n is a, c, g, or t
  misc_feature (3413)..(3423): n is a, c, g, or t
  misc_feature (3425)..(3425): n is a, c, g, or t
  misc_feature (3427)..(3427): n is a, c, g, or t
  misc_feature (3429)..(3429): n is a, c, g, or t
  misc_feature (3432)..(3432): n is a, c, g, or t
  misc_feature (3434)..(3439): n is a, c, g, or t
  misc_feature (3441)..(3445): n is a, c, g, or t
  misc_feature (3451)..(3457): n is a, c, g, or t
  misc_feature (3459)..(3459): n is a, c, g, or t
  misc_feature (3461)..(3464): n is a, c, g, or t
  misc_feature (3468)..(3477): n is a, c, g, or t
  misc_feature (3480)..(3480): n is a, c, g, or t
  misc_feature (3482)..(3486): n is a, c, g, or t
  misc_feature (3488)..(3497): n is a, c, g, or t
  misc_feature (3500)..(3501): n is a, c, g, or t
  misc_feature (3504)..(3504): n is a, c, g, or t
  misc_feature (3507)..(3510): n is a, c, g, or t
  misc_feature (3512)..(3513): n is a, c, g, or t
  misc_feature (3515)..(3520): n is a, c, g, or t
  misc_feature (3522)..(3522): n is a, c, g, or t
  misc_feature (3524)..(3524): n is a, c, g, or t
  misc_feature (3527)..(3528): n is a, c, g, or t
  misc_feature (3530)..(3534): n is a, c, g, or t
  misc_feature (3536)..(3538): n is a, c, g, or t
  misc_feature (3540)..(3542): n is a, c, g, or t
  misc_feature (3546)..(3571): n is a, c, g, or t
  misc_feature (3574)..(3574): n is a, c, g, or t
  misc_feature (3576)..(3577): n is a, c, g, or t
  misc_feature (3580)..(3580): n is a, c, g, or t
  misc_feature (3582)..(3582): n is a, c, g, or t
  misc_feature (3584)..(3584): n is a, c, g, or t
  misc_feature (3586)..(3587): n is a, c, g, or t
  misc_feature (3589)..(3590): n is a, c, g, or t
  misc_feature (3592)..(3595): n is a, c, g, or t
  misc_feature (3597)..(3597): n is a, c, g, or t
  misc_feature (3599)..(3599): n is a, c, g, or t
  misc_feature (3601)..(3601): n is a, c, g, or t
  misc_feature (3603)..(3605): n is a, c, g, or t
  misc_feature (3609)..(3610): n is a, c, g, or t
  misc_feature (3613)..(3616): n is a, c, g, or t
  misc_feature (3618)..(3621): n is a, c, g, or t
  misc_feature (3624)..(3625): n is a, c, g, or t
  misc_feature (3627)..(3630): n is a, c, g, or t
  misc_feature (3632)..(3661): n is a, c, g, or t
  misc_feature (3664)..(3671): n is a, c, g, or t
  misc_feature (3675)..(3676): n is a, c, g, or t
  misc_feature (3678)..(3679): n is a, c, g, or t
  misc_feature (3682)..(3684): n is a, c, g, or t
  misc_feature (3686)..(3686): n is a, c, g, or t
  misc_feature (3690)..(3690): n is a, c, g, or t
  misc_feature (3693)..(3693): n is a, c, g, or t
  misc_feature (3695)..(3696): n is a, c, g, or t
  misc_feature (3698)..(3698): n is a, c, g, or t
  misc_feature (3701)..(3704): n is a, c, g, or t
  misc_feature (3706)..(3711): n is a, c, g, or t
  misc_feature (3713)..(3714): n is a, c, g, or t
  misc_feature (3719)..(3719): n is a, c, g, or t
  misc_feature (3721)..(3726): n is a, c, g, or t
  misc_feature (3728)..(3728): n is a, c, g, or t
  misc_feature (3730)..(3731): n is a, c, g, or t
  misc_feature (3733)..(3735): n is a, c, g, or t
  misc_feature (3737)..(3738): n is a, c, g, or t
  misc_feature (3740)..(3740): n is a, c, g, or t
  misc_feature (3743)..(3745): n is a, c, g, or t
  misc_feature (3747)..(3747): n is a, c, g, or t
  misc_feature (3750)..(3750): n is a, c, g, or t
  misc_feature (3753)..(3753): n is a, c, g, or t
  misc_feature (3756)..(3762): n is a, c, g, or t
  misc_feature (3764)..(3765): n is a, c, g, or t
  misc_feature (3768)..(3769): n is a, c, g, or t
  misc_feature (3771)..(3771): n is a, c, g, or t
  misc_feature (3773)..(3773): n is a, c, g, or t
  misc_feature (3776)..(3778): n is a, c, g, or t
  misc_feature (3780)..(3781): n is a, c, g, or t
  misc_feature (3786)..(3789): n is a, c, g, or t
  misc_feature (3792)..(3792): n is a, c, g, or t
  misc_feature (3794)..(3796): n is a, c, g, or t
  misc_feature (3798)..(3798): n is a, c, g, or t
  misc_feature (3800)..(3802): n is a, c, g, or t
  misc_feature (3804)..(3808): n is a, c, g, or t
  misc_feature (3811)..(3812): n is a, c, g, or t
  misc_feature (3815)..(3815): n is a, c, g, or t
  misc_feature (3817)..(3817): n is a, c, g, or t
  misc_feature (3820)..(3824): n is a, c, g, or t
  misc_feature (3827)..(3827): n is a, c, g, or t
  misc_feature (3829)..(3830): n is a, c, g, or t
  misc_feature (3832)..(3839): n is a, c, g, or t
  misc_feature (3842)..(3849): n is a, c, g, or t
  misc_feature (3851)..(3851): n is a, c, g, or t
  misc_feature (3853)..(3853): n is a, c, g, or t
  misc_feature (3856)..(3859): n is a, c, g, or t
  misc_feature (3862)..(3862): n is a, c, g, or t
  misc_feature (3864)..(3865): n is a, c, g, or t
  misc_feature (3867)..(3873): n is a, c, g, or t
  misc_feature (3880)..(3880): n is a, c, g, or t
  misc_feature (3882)..(3882): n is a, c, g, or t
  misc_feature (3884)..(3891): n is a, c, g, or t
  misc_feature (3894)..(3899): n is a, c, g, or t
  misc_feature (3903)..(3906): n is a, c, g, or t
  misc_feature (3908)..(3908): n is a, c, g, or t
  misc_feature (3910)..(3915): n is a, c, g, or t
  misc_feature (3918)..(3922): n is a, c, g, or t
  misc_feature (3924)..(3931): n is a, c, g, or t
  misc_feature (3933)..(3934): n is a, c, g, or t
  misc_feature (3937)..(3937): n is a, c, g, or t
  misc_feature (3940)..(3952): n is a, c, g, or t
  misc_feature (3956)..(3965): n is a, c, g, or t
  misc_feature (3967)..(3970): n is a, c, g, or t
  misc_feature (3973)..(3976): n is a, c, g, or t
  misc_feature (3979)..(3982): n is a, c, g, or t
  misc_feature (3985)..(3985): n is a, c, g, or t
  misc_feature (3987)..(3989): n is a, c, g, or t
  misc_feature (3993)..(3994): n is a, c, g, or t
  misc_feature (3996)..(3997): n is a, c, g, or t
  misc_feature (4000)..(4000): n is a, c, g, or t
agaatatacatgaccagcaacactttgcccattgtcntaaaaagatttccttttcctgccaccttctcttttcccatatatcctccatccatcttcgtaccttncgcctgcatccgtaacttattttttatatcatgttccggatacagtttcgctttgtactatatatgaaaaaaagatttatattatgtataaaaatgtctcctgccgcttaactttccaatcacgnataaaaataccnaaaatgtcggaatatttttccatcctgatttatcttctctgtttcctgaaagccaagtttatgaagcagtcccaacgatgcttcattccccggctccaccagacagtcaattcttcgaaaatcaagattgctttttgcccacgccatgattgcctgacagacctcatatgcataaccctgcctctggtattccggtgcaatgacataacccatctcaataatttcttcttctcccagcatgcgatagtcgattccggctcttccaatcagccggtgggtacctttttcctttgccagccacatgccatatccatagtagccatacatattttcaatatatgctctctggtactcctcctcttcctgcctttcgtaaaggggctcgatataatcggtgattcccttcttattatataaatcaaataaatcgtccatgtcatctaacgtaatctctctcagataacaccgctttgtctctaatatccgccacggcagntgntgnttccgctgaaatgtccgaagtaaaaattctgtntccacttcttccagtccaagaagcagnatatccacattgcttaaaggcatctgttttgaaaaatccggtacttcatanccnatnanggtaagctggtctgagtcagaatctgcatcctttttcgcccatgccacttcttccggttctgttgcaagcagcatacattcctccggctttacatgatgtccgctcaggaaaaatgtgatatctttttccaaatcagcatctgtaaaaagaagttccacttttttctgctctgacagttctttttgcaggcggcttaatgcatgtttctcttcttcagaaagtttttcttctaatgtttcttttcgtatgatacagttccagtttacagtattccagtgacacatatttccttctctctttctttacaaaaaagcctttttccgctatagtagaactacattctgttatgcaggatgaattcaatgaacagaaatgaggtatcttacaatggctcagaatcctattattacatttgaaatggaaaacggagatattatgaaagcggaattatatccgcaggttgctcctaacacagtaaataactttatcagccttgtcaacaagggattttatgatggacttatcttccatcgtgtcatcaacggttttatgattcagggtggtgacccggaaggaaccggaatgggcggtccaggatatggtatcaagggtgaatttgcacagaacggctttgccaatgacttaaagcattctgcaggcgttctttccatggctcgttccatgatgccaaactctgccggctcccagttctttatcatgcataaggatgctccacacttagatggtgcttacgctgctttcggtaaaatcatcgaaggcatggatgtggtaaataaaatngcagaagttgcaaccgactacagcgaccgtccaatggaagaccagcgaatgaaaaccgttaccgtagaaacctttggtgttgattacgacgaaccggaaaccgtataatgccatcgcaacagccgtatcagtgtatacactggcgcggctgttgtttttttgcaaagcttctctttttattctttcagtttccggtaaagcttctgtacaaactgcacatcctctctggtaagtttcttatggctatacgctgccacttcaagaatctgaagataacgctccttttcttccatgctccagcccccataatttaaaagctgttcccngaatgtccggtcggattgtacttttgcatttacaatgcccttccgccgtaaaatgcgataaatctggttcgaattccaacggatgatacgcttgtaactatgtgttcccttcttccgttttccttctatctctcttaagtaataccagatacctgctgcaagaagcagaatgatgattaccacaacaatcaaaatgacctttaaacggcttcccttttgattctgttttcctgccttnntgccatcctgcatggaattttctgtattccggttttccgtgccctgattttccgtatccgggttttctgtatcnngnntttctgtntnntgantttctgtnttntgattttnngtattntgnnttncnntnnnngnnannncnnnnnnnnnnnnatcnnnnnnactgtcntnntnnnnactnnnctnnnnnnnanttngntcnnnngtnntnnnntcnnnnntncngnnnnnantnntnnnnntnnnnnnnnnnnnnnnnnnnngntnaatnncnnnnnnntnnnnnnnngtnntntnnnccggcnncnnnncnacnnnnncnnnnnnnannnnnnnnnnnnnnnntnccnnnnnnncangnncctnnnnnnnannannnncnncnntntnnttnnnannnntnnnnntnntnannnnnnannnnctnacannnnnnncnntnannnncnnnnncnnnannnncannnnncncnnannnnnnnnnnncnnacngnnnnnntnctnnnnnnnnnnnnnnnnnnnntcnnnnanannntgtncnnntnnnncntnnnccnatnncanattntnnnnanncnnnnnnnnntnncnnttcnccagntnnnntnnnnnnanntnnnnnnnntnannnnnnttannntnataantancatnnnnannannncnnttnncnnnaaannnnnnatnnncnnnntcnnantnnnctnnnnnntnntnnncnnnnnncngnnttcncnnnnnnnnnnnnnnnnnnnnnntntnnnntncnnnnnnntnnttntnnntntnnntannnnnnnnntnnnnnnnngnnnattngnnntnnnnnnnnnnnnnntnanaccnnnnnnnatnnnnnnncnnnntantnnnattnnctnnnnnttcnntnantnncnnntnncnnnnnnnntnannncnntcnncnnaancnncnnnnnncaaancnnnnntanananannnnncatnnnnnnnnntnnnntncngtntnntnnnnnnncgtcnnnnncnnnnnngnnnnnnnnannnnnnnnnncnntangnncnccnncnnnnngnnnnncnncnngntnnnnnnnnnccnnnnnatagnntgncannnnnnnntanggnnnntnnncatnnnnntnntncncnnnnnaannnntnncccngtaannggtatnnnagnnntnggtatannnnnnnnnnntntntnccngnnnnnncnnnnnctgttnnnnnnngntnnnntccnnnnnnnnnntgncnnnnncnnnnnnnnnnganncanaannnntnnannnnnnantnttnnannnnncnnntnnntaannnnnnnnnnnnnnnnnnnnnnnnnntancnnatnancngnnanntnnnnancngncnnntccnnaannnncnnnnccnnannnntnnnnnnnnnnnnnnnnnnnnnnnnnnnnnnatnnnnnnnnaaannannttnnncnaaangantnncngcnnnnannnnnncnnctgtnannnnnncntnngnnncnntntcnnntncanttnttnnnnnnncnnttnntntngcnnncnnttctnnnnctntnnntncnnncnnnnnaannacnancgnnnnnacnannannnnnnnnacnnnnnnnngncntannnnttncnncnnnnnnnattccancngnnnnnnnnccnnnnnnccannnntncnnnnnncannnnntnnnnnnnnanncantgnnnnnnnnnnnnntgcnnnnnnnnnngnnnnatnnnncannnnaanannnagcnntnnaan

SEQ ID NO: 999 - DNA, 4000 bp, Escherichia coli
  misc_feature (1)..(1): n is a, c, g, or t
  misc_feature (3)..(3): n is a, c, g, or t
  misc_feature (5)..(5): n is a, c, g, or t
  misc_feature (7)..(7): n is a, c, g, or t
  misc_feature (9)..(12): n is a, c, g, or t
  misc_feature (15)..(18): n is a, c, g, or t
  misc_feature (21)..(23): n is a, c, g, or t
  misc_feature (25)..(26): n is a, c, g, or t
  misc_feature (29)..(33): n is a, c, g, or t
  misc_feature (38)..(38): n is a, c, g, or t
  misc_feature (41)..(51): n is a, c, g, or t
  misc_feature (53)..(54): n is a, c, g, or t
  misc_feature (56)..(58): n is a, c, g, or t
  misc_feature (60)..(60): n is a, c, g, or t
  misc_feature (62)..(62): n is a, c, g, or t
  misc_feature (64)..(67): n is a, c, g, or t
  misc_feature (69)..(76): n is a, c, g, or t
  misc_feature (82)..(84): n is a, c, g, or t
  misc_feature (86)..(86): n is a, c, g, or t
  misc_feature (88)..(89): n is a, c, g, or t
  misc_feature (91)..(95): n is a, c, g, or t
  misc_feature (98)..(98): n is a, c, g, or t
  misc_feature (100)..(101): n is a, c, g, or t
  misc_feature (104)..(108): n is a, c, g, or t
  misc_feature (110)..(111): n is a, c, g, or t
  misc_feature (113)..(113): n is a, c, g, or t
  misc_feature (115)..(119): n is a, c, g, or t
  misc_feature (121)..(121): n is a, c, g, or t
  misc_feature (123)..(127): n is a, c, g, or t
  misc_feature (129)..(129): n is a, c, g, or t
  misc_feature (133)..(133): n is a, c, g, or t
  misc_feature (136)..(137): n is a, c, g, or t
  misc_feature (139)..(141): n is a, c, g, or t
  misc_feature (143)..(149): n is a, c, g, or t
  misc_feature (151)..(153): n is a, c, g, or t
  misc_feature (155)..(161): n is a, c, g, or t
  misc_feature (164)..(164): n is a, c, g, or t
  misc_feature (166)..(166): n is a, c, g, or t
  misc_feature (168)..(168): n is a, c, g, or t
  misc_feature (170)..(171): n is a, c, g, or t
  misc_feature (173)..(174): n is a, c, g, or t
  misc_feature (176)..(176): n is a, c, g, or t
  misc_feature (178)..(179): n is a, c, g, or t
  misc_feature (183)..(193): n is a, c, g, or t
  misc_feature (197)..(197): n is a, c, g, or t
  misc_feature (199)..(202): n is a, c, g, or t
  misc_feature (204)..(207): n is a, c, g, or t
  misc_feature (209)..(209): n is a, c, g, or t
  misc_feature (211)..(212): n is a, c, g, or t
  misc_feature (214)..(215): n is a, c, g, or t
  misc_feature (217)..(217): n is a, c, g, or t
  misc_feature (219)..(219): n is a, c, g, or t
  misc_feature (222)..(222): n is a, c, g, or t
  misc_feature (224)..(225): n is a, c, g, or t
  misc_feature (228)..(229): n is a, c, g, or t
  misc_feature (231)..(238): n is a, c, g, or t
  misc_feature (241)..(243): n is a, c, g, or t
  misc_feature (245)..(245): n is a, c, g, or t
  misc_feature (247)..(248): n is a, c, g, or t
  misc_feature (250)..(256): n is a, c, g, or t
  misc_feature (261)..(261): n is a, c, g, or t
  misc_feature (265)..(265): n is a, c, g, or t
  misc_feature (267)..(268): n is a, c, g, or t
  misc_feature (270)..(270): n is a, c, g, or t
  misc_feature (272)..(276): n is a, c, g, or t
  misc_feature (278)..(279): n is a, c, g, or t
  misc_feature (281)..(282): n is a, c, g, or t
  misc_feature (284)..(286): n is a, c, g, or t
  misc_feature (289)..(289): n is a, c, g, or t
  misc_feature (291)..(293): n is a, c, g, or t
  misc_feature (298)..(305): n is a, c, g, or t
  misc_feature (307)..(313): n is a, c, g, or t
  misc_feature (315)..(321): n is a, c, g, or t
  misc_feature (324)..(324): n is a, c, g, or t
  misc_feature (326)..(326): n is a, c, g, or t
  misc_feature (329)..(329): n is a, c, g, or t
  misc_feature (331)..(332): n is a, c, g, or t
  misc_feature (334)..(339): n is a, c, g, or t
  misc_feature (341)..(342): n is a, c, g, or t
  misc_feature (344)..(345): n is a, c, g, or t
  misc_feature (347)..(347): n is a, c, g, or t
  misc_feature (349)..(351): n is a, c, g, or t
  misc_feature (353)..(356): n is a, c, g, or t
  misc_feature (358)..(361): n is a, c, g, or t
  misc_feature (363)..(375): n is a, c, g, or t
  misc_feature (377)..(381): n is a, c, g, or t
  misc_feature (383)..(384): n is a, c, g, or t
  misc_feature (386)..(390): n is a, c, g, or t
  misc_feature (392)..(392): n is a, c, g, or t
  misc_feature (394)..(396): n is a, c, g, or t
  misc_feature (400)..(400): n is a, c, g, or t
  misc_feature (404)..(404): n is a, c, g, or t
  misc_feature (406)..(406): n is a, c, g, or t
  misc_feature (408)..(408): n is a, c, g, or t
  misc_feature (410)..(410): n is a, c, g, or t
  misc_feature (413)..(418): n is a, c, g, or t
  misc_feature (420)..(420): n is a, c, g, or t
  misc_feature (422)..(427): n is a, c, g, or t
  misc_feature (430)..(432): n is a, c, g, or t
  misc_feature (434)..(438): n is a, c, g, or t
  misc_feature (440)..(444): n is a, c, g, or t
  misc_feature (446)..(450): n is a, c, g, or t
  misc_feature (452)..(463): n is a, c, g, or t
  misc_feature (466)..(466): n is a, c, g, or t
  misc_feature (469)..(471): n is a, c, g, or t
  misc_feature (474)..(476): n is a, c, g, or t
  misc_feature (478)..(478): n is a, c, g, or t
  misc_feature (480)..(480): n is a, c, g, or t
  misc_feature (482)..(482): n is a, c, g, or t
  misc_feature (484)..(486): n is a, c, g, or t
  misc_feature (490)..(490): n is a, c, g, or t
  misc_feature (492)..(502): n is a, c, g, or t
  misc_feature (505)..(506): n is a, c, g, or t
  misc_feature (508)..(509): n is a, c, g, or t
  misc_feature (512)..(513): n is a, c, g, or t
  misc_feature (515)..(516): n is a, c, g, or t
  misc_feature (518)..(518): n is a, c, g, or t
  misc_feature (520)..(521): n is a, c, g, or t
  misc_feature (523)..(531): n is a, c, g, or t
  misc_feature (533)..(534): n is a, c, g, or t
  misc_feature (538)..(550): n is a, c, g, or t
  misc_feature (552)..(552): n is a, c, g, or t
  misc_feature (556)..(560): n is a, c, g, or t
  misc_feature (562)..(566): n is a, c, g, or t
  misc_feature (568)..(570): n is a, c, g, or t
  misc_feature (1019)..(1019): n is a, c, g, or t
  misc_feature (1021)..(1023): n is a, c, g, or t
  misc_feature (1025)..(1027): n is a, c, g, or t
  misc_feature (1029)..(1031): n is a, c, g, or t
  misc_feature (1033)..(1033): n is a, c, g, or t
  misc_feature (1035)..(1037): n is a, c, g, or t
  misc_feature (1039)..(1042): n is a, c, g, or t
  misc_feature (1044)..(1044): n is a, c, g, or t
  misc_feature (1046)..(1046): n is a, c, g, or t
  misc_feature (1048)..(1051): n is a, c, g, or t
  misc_feature (1053)..(1053): n is a, c, g, or t
  misc_feature (1055)..(1057): n is a, c, g, or t
  misc_feature (1059)..(1063): n is a, c, g, or t
  misc_feature (1065)..(1065): n is a, c, g, or t
  misc_feature (1067)..(1070): n is a, c, g, or t
  misc_feature (1072)..(1072): n is a, c, g, or t
  misc_feature (1074)..(1074): n is a, c, g, or t
  misc_feature (1076)..(1076): n is a, c, g, or t
  misc_feature (1079)..(1083): n is a, c, g, or t
  misc_feature (1085)..(1085): n is a, c, g, or t
  misc_feature (1087)..(1087): n is a, c, g, or t
  misc_feature (1090)..(1094): n is a, c, g, or t
  misc_feature (1097)..(1098): n is a, c, g, or t
  misc_feature (1101)..(1101): n is a, c, g, or t
  misc_feature (1107)..(1107): n is a, c, g, or t
  misc_feature (1110)..(1113): n is a, c, g, or t
  misc_feature (1115)..(1115): n is a, c, g, or t
  misc_feature (1118)..(1121): n is a, c, g, or t
  misc_feature (1123)..(1124): n is a, c, g, or t
  misc_feature (1126)..(1127): n is a, c, g, or t
  misc_feature (1129)..(1129): n is a, c, g, or t
  misc_feature (1131)..(1136): n is a, c, g, or t
  misc_feature (1140)..(1145): n is a, c, g, or t
  misc_feature (1147)..(1147): n is a, c, g, or t
  misc_feature (1149)..(1153): n is a, c, g, or t
  misc_feature (1155)..(1155): n is a, c, g, or t
  misc_feature (1157)..(1161): n is a, c, g, or t
  misc_feature (1163)..(1163): n is a, c, g, or t
  misc_feature (1165)..(1167): n is a, c, g, or t
  misc_feature (1169)..(1176): n is a, c, g, or t
  misc_feature (1179)..(1188): n is a, c, g, or t
  misc_feature (1190)..(1190): n is a, c, g, or t
  misc_feature (1192)..(1193): n is a, c, g, or t
  misc_feature (1198)..(1199): n is a, c, g, or t
  misc_feature (1201)..(1203): n is a, c, g, or t
  misc_feature (1224)..(1224): n is a, c, g, or t
  misc_feature (1243)..(1243): n is a, c, g, or t
  misc_feature (1271)..(1271): n is a, c, g, or t
  misc_feature (1481)..(1481): n is a, c, g, or t
  misc_feature (1503)..(1503): n is a, c, g, or t
  misc_feature (1550)..(1550): n is a, c, g, or t
  misc_feature (1640)..(1640): n is a, c, g, or t
  misc_feature (1769)..(1769): n is a, c, g, or t
  misc_feature (1813)..(1813): n is a, c, g, or t
  misc_feature (1817)..(1817): n is a, c, g, or t
  misc_feature (1827)..(1827): n is a, c, g, or t
  misc_feature (1829)..(1829): n is a, c, g, or t
  misc_feature (1835)..(1835): n is a, c, g, or t
  misc_feature (1938)..(1938): n is a, c, g, or t
  misc_feature (1964)..(1964): n is a, c, g, or t
  misc_feature (1969)..(1969): n is a, c, g, or t
  misc_feature (1976)..(1976): n is a, c, g, or t
  misc_feature (1978)..(1981): n is a, c, g, or t
nangntnannnnctnnnnaannncnnatnnnnnaacancannnnnnnnnnngnnannntnantnnnntnnnnnnnnaaacannnancnntnnnnncantnncgnnnnnanngncnnnnnancnnnnngnattntcnntnnntnnnnnnncnnnannnnnnntcngntntnnannanannccgnnnnnnnnnnntttncnnnntnnnnananntnngncnaantnnatnntnnnnnnnnaannnananncnnnnnnnttttngtgncnnangnnnnnanncnnannnaanannnattgnnnnnnnncnnnnnnntnnnnnnnacnantantnnannnnnngnnannanannnannnntnnnncnnnnnnnnnnnnnannnnnanntnnnnnancnnnattntcantnantntannnnnnanannnnnnctnnnannnnnannnnnannnnnannnnnnnnnnnnatnaannnaannnananangnnnaatncnnnnnnnnnnnaannannganntnnanannannnnnnnnngnntaannnnnnnnnnnnnantaannnnnannnnntnnncacgaactgattataaaaaccactaatgaacatcttgttattaaacaaattgttaatacggtcatttcgtgaagaaagtgtttttacaacaacattctcacttaatctattggatagattaaaactgttagaataatatttaatataatgtttaattaacataaataaaattaataaaagaataatccatcgggtaccaaaacatacaattgaaaagcataaaaaaacgaataatattagtatgcttaataactctaaagccttattatgtttattactgaagttaacatatttatttaaaaaaaggcgtactgaggtaatataaaaagaccagcacataattcctattagagttggacctaacatatctgatgaaaaatgtacagtacatgtataaagtagatacgaaacactcaaaattactactagttgtaataaaggtatttgtntnnncnnnannngnannnannnntntntnnnngnannntnnnnntnannnntnanangcnnnnnancnatnnnnngtnnaantcgaanaannnngnatnnnncnntnntntnnnnnntaannnnnngnannnnntnannnnnangnnnannnnnnnntannnnnnnnnnantnngcacnngnnncatgcaacttattgttagcanctagtgcataaatagttangcctgtcgtaactgtaggtacagctaangaactagctaatttagctccttttgttagagcaattttcccaaacagcctactaaaaggatttcctccaactttgataagaaattcgttgatagtaataaaccagatgttagcaaaactacaataaatataactaaaacaaccagattcagagtaatgattgtaagttaacgttagtagaaatacaaatcgagcataacgactaaaaagnccaattaagcgcatatcggtancatagtgtatttcaacagttgctaattggctagcaaccatcttgganacctccgatttgggtttataattaataaacctaagtataatttttataatatatacaagatataaaacaaaaattatgtagaaagagggntccaaaacataaaatgccaatataatagcagtaaatagaatgaaaatatacttttcatctattttttttaaacctaatgactctaacgaaggtgttaaagacattattaaagttaagatagcgccaaanagtaaaagtaataaatagactttatcacttaataaaccaaaacntgtnaggtttaggnangtaaanattattaaacacaccaattggaacaatggcgttttgatataacagtacaaccagtagatcttaaatatctctggttgataaccctcataatcttggtttagcnttttgaaatcgggaaaaccaagatcntaatnttttatnannnntttaacaaatgtcatcgatgcctaaatgagctaataaattattacaagtaagatgcattggatctaaaaagatctcaggataaattcccataactagagtaagtataactagtggaagtaatgtcgcaaactcacgtttatctacatcagaaaacacattcatatattgaactttaatatttccaaaagcaactcggttaaataaccataaggaataaccaccccctaaaatcattccagtagcagaaagaacacatactgttgtatttgtttggaaagcacctgcaagaattagaaactctccaacaaaactgctcgttccaggtaaagcaatattagccatactaaaaaacataaaaatggcaatataaattggcatagtatgagctaaaccactataatacttaactaaacgagtatggtgacggtcatatataacaccaacacataagaataaagcaccagatacgagtccatgacttaactgttgaagaatacttccttctagtccttgtaaattataaacaaacataccaattagtactaagttcatatgtgcaacagaggcataagcaattatacgtttaagatctgtttgacgtatagcggttaaacttgtatatataacagcaatacaagcaaaagcataaatcaatggagtgaaataaatagaagcataaggaaataatggtaatgaaaaacgtaaaaaaccataagatcctaacttcaataaaattcctgctaaaataacagaaccggcagtcggagcctccacatgagcttcaggtaaccaaatgtgaacaggcaacattggaactttaacagcaaatgaagcgaaaaaagctaaccataataatttttgaacttctggatcaaaagtagttgtcaataaaatttgataatcagttgtacctgcctgataataaatatacagaatagcaagaagcattagtaccgatcccaataatgtatataagaagaacatataagcagcacgtatacgtcgctcacgtgaaccccacacaccaatgataataaacataggtattaaaacactttcaaagaaaacataaaataaaataatgtctaaaacacagaatacagcgataacaagagcttccatagctaaaaaggcaataaaatattctttttcattaaacttaatagcatcccaactagctaataaacaaattggtatcaataaagtagttaacaaaataaaaaataaggaaataccatctactcctaaataaaaaataatattagaagattcaatccaattatacgcctcaacaaactgaaaacgtgaactagagttatcaaaggacatccacatcattaatgaaagtaagaactctgctaatgaaaaagataaaaccacgactttgatagtctctttatattggcttggaataaataaaaccaaaaacgaaccaatcaaaggaattaaaattaaatttgataataacataatttatgatttagatgacgcttcttgttttgtaaaaaagctacccgaagcaaccgcagcgatcaataagatgaaaaataatcgaccatcaacaaatgatgagattacgtcccataagcctagaatggcaattaaaaaagttacacctaataacattacaaatgcgtagtggtatagaaaacctgtttgtaaaccagctaaagtatctccacgttttgtaaccatacgtgaaatacctaaaggtcctaagaattcaaacaccccacggtcaattaatttatatgacgtatgataaccaaagtgtaacatattttgtgtaatatactcattataaaccttatcaaaaaaccatttacggtttaaaaaagtatacaatttacgcccgaatgggtgaactttaatctcatataaccaacgagtgtggtttttatataagaaaaatgcagatattgctccagttaaactaaaaacaacaggaacaagctttatatgatgaggaataaactcagcttctaacaaagtcaaatgacttggatgagtaaataggg

SEQ ID NO: 1000 - DNA, 4000 bp, Escherichia coli
  misc_feature (2393)..(2394): n is a, c, g, or t
  misc_feature (2396)..(2398): n is a, c, g, or t
  misc_feature (2401)..(2401): n is a, c, g, or t
  misc_feature (2408)..(2408): n is a, c, g, or t
  misc_feature (2452)..(2454): n is a, c, g, or t
  misc_feature (2457)..(2459): n is a, c, g, or t
  misc_feature (2461)..(2461): n is a, c, g, or t
  misc_feature (2465)..(2467): n is a, c, g, or t
  misc_feature (2470)..(2472): n is a, c, g, or t
  misc_feature (2475)..(2475): n is a, c, g, or t
  misc_feature (2481)..(2485): n is a, c, g, or t
  misc_feature (2489)..(2489): n is a, c, g, or t
  misc_feature (2491)..(2493): n is a, c, g, or t
  misc_feature (2495)..(2495): n is a, c, g, or t
  misc_feature (2497)..(2499): n is a, c, g, or t
  misc_feature (2513)..(2513): n is a, c, g, or t
  misc_feature (2515)..(2521): n is a, c, g, or t
  misc_feature (2523)..(2523): n is a, c, g, or t
  misc_feature (2525)..(2525): n is a, c, g, or t
  misc_feature (2527)..(2529): n is a, c, g, or t
  misc_feature (2532)..(2536): n is a, c, g, or t
  misc_feature (2538)..(2538): n is a, c, g, or t
  misc_feature (2545)..(2545): n is a, c, g, or t
  misc_feature (2548)..(2548): n is a, c, g, or t
  misc_feature (2554)..(2554): n is a, c, g, or t
  misc_feature (2557)..(2558): n is a, c, g, or t
  misc_feature (2560)..(2560): n is a, c, g, or t
  misc_feature (2564)..(2564): n is a, c, g, or t
  misc_feature (2566)..(2567): n is a, c, g, or t
  misc_feature (2572)..(2572): n is a, c, g, or t
  misc_feature (2575)..(2575): n is a, c, g, or t
  misc_feature (2586)..(2589): n is a, c, g, or t
  misc_feature (2595)..(2595): n is a, c, g, or t
  misc_feature (2597)..(2598): n is a, c, g, or t
  misc_feature (2600)..(2601): n is a, c, g, or t
  misc_feature (2603)..(2604): n is a, c, g, or t
  misc_feature (2606)..(2607): n is a, c, g, or t
  misc_feature (2613)..(2613): n is a, c, g, or t
  misc_feature (2615)..(2620): n is a, c, g, or t
  misc_feature (2622)..(2628): n is a, c, g, or t
  misc_feature (2631)..(2632): n is a, c, g, or t
  misc_feature (2634)..(2634): n is a, c, g, or t
  misc_feature (2637)..(2639): n is a, c, g, or t
  misc_feature (2641)..(2641): n is a, c, g, or t
  misc_feature (2645)..(2645): n is a, c, g, or t
  misc_feature (2647)..(2648): n is a, c, g, or t
  misc_feature (2650)..(2650): n is a, c, g, or t
  misc_feature (2656)..(2660): n is a, c, g, or t
  misc_feature (2665)..(2665): n is a, c, g, or t
  misc_feature (2667)..(2667): n is a, c, g, or t
  misc_feature (2682)..(2682): n is a, c, g, or t
  misc_feature (2684)..(2690): n is a, c, g, or t
  misc_feature (2692)..(2700): n is a, c, g, or t
  misc_feature (2702)..(2706): n is a, c, g, or t
  misc_feature (2708)..(2710): n is a, c, g, or t
  misc_feature (2712)..(2713): n is a, c, g, or t
  misc_feature (2715)..(2718): n is a, c, g, or t
  misc_feature (2720)..(2720): n is a, c, g, or t
  misc_feature (2722)..(2727): n is a, c, g, or t
  misc_feature (2729)..(2734): n is a, c, g, or t
  misc_feature (2737)..(2737): n is a, c, g, or t
  misc_feature (2739)..(2740): n is a, c, g, or t
  misc_feature (2742)..(2743): n is a, c, g, or t
  misc_feature (2746)..(2748): n is a, c, g, or t
  misc_feature (2750)..(2751): n is a, c, g, or t
  misc_feature (2753)..(2754): n is a, c, g, or t
  misc_feature (2756)..(2758): n is a, c, g, or t
  misc_feature (2761)..(2761): n is a, c, g, or t
  misc_feature (2763)..(2765): n is a, c, g, or t
  misc_feature (2768)..(2769): n is a, c, g, or t
  misc_feature (2771)..(2772): n is a, c, g, or t
  misc_feature (2774)..(2776): n is a, c, g, or t
  misc_feature (2779)..(2779): n is a, c, g, or t
  misc_feature (2782)..(2782): n is a, c, g, or t
  misc_feature (2785)..(2785): n is a, c, g, or t
  misc_feature (2788)..(2788): n is a, c, g, or t
  misc_feature (2791)..(2791): n is a, c, g, or t
  misc_feature (2794)..(2794): n is a, c, g, or t
  misc_feature (2797)..(2797): n is a, c, g, or t
  misc_feature (2802)..(2802): n is a, c, g, or t
  misc_feature (2805)..(2805): n is a, c, g, or t
  misc_feature (2807)..(2817): n is a, c, g, or t
  misc_feature (2819)..(2824): n is a, c, g, or t
  misc_feature (2826)..(2827): n is a, c, g, or t
  misc_feature (2829)..(2830): n is a, c, g, or t
  misc_feature (2832)..(2832): n is a, c, g, or t
  misc_feature (2834)..(2838): n is a, c, g, or t
  misc_feature (2841)..(2841): n is a, c, g, or t
  misc_feature (2843)..(2843): n is a, c, g, or t
  misc_feature (2845)..(2845): n is a, c, g, or t
  misc_feature (2847)..(2852): n is a, c, g, or t
  misc_feature (2854)..(2856): n is a, c, g, or t
  misc_feature (2859)..(2874): n is a, c, g, or t
  misc_feature (2876)..(2881): n is a, c, g, or t
  misc_feature (2883)..(2888): n is a, c, g, or t
  misc_feature (2891)..(2904): n is a, c, g, or t
  misc_feature (2906)..(2910): n is a, c, g, or t
  misc_feature (2912)..(2918): n is a, c, g, or t
  misc_feature (2920)..(2924): n is a, c, g, or t
  misc_feature (2926)..(2929): n is a, c, g, or t
  misc_feature (2931)..(2931): n is a, c, g, or t
  misc_feature (2933)..(2936): n is a, c, g, or t
  misc_feature (2939)..(2946): n is a, c, g, or t
  misc_feature (2948)..(2953): n is a, c, g, or t
  misc_feature (2955)..(2958): n is a, c, g, or t
  misc_feature (2960)..(2963): n is a, c, g, or t
  misc_feature (2966)..(2966): n is a, c, g, or t
  misc_feature (2968)..(2973): n is a, c, g, or t
  misc_feature (2975)..(2975): n is a, c, g, or t
  misc_feature (2978)..(2989): n is a, c, g, or t
  misc_feature (2991)..(3005): n is a, c, g, or t
  misc_feature (3007)..(3007): n is a, c, g, or t
  misc_feature (3009)..(3016): n is a, c, g, or t
  misc_feature (3018)..(3019): n is a, c, g, or t
  misc_feature (3021)..(3021): n is a, c, g, or t
  misc_feature (3024)..(3025): n is a, c, g, or t
  misc_feature (3027)..(3027): n is a, c, g, or t
  misc_feature (3029)..(3030): n is a, c, g, or t
  misc_feature (3032)..(3033): n is a, c, g, or t
  misc_feature (3035)..(3040): n is a, c, g, or t
  misc_feature (3042)..(3046): n is a, c, g, or t
  misc_feature (3048)..(3051): n is a, c, g, or t
  misc_feature (3054)..(3054): n is a, c, g, or t
  misc_feature (3057)..(3061): n is a, c, g, or t
  misc_feature (3063)..(3071): n is a, c, g, or t
  misc_feature (3075)..(3076): n is a, c, g, or t
  misc_feature (3078)..(3087): n is a, c, g, or t
  misc_feature (3089)..(3089): n is a, c, g, or t
  misc_feature (3091)..(3093): n is a, c, g, or t
  misc_feature (3095)..(3096): n is a, c, g, or t
  misc_feature (3098)..(3099): n is a, c, g, or t
  misc_feature (3101)..(3103): n is a, c, g, or t
  misc_feature (3106)..(3108): n is a, c, g, or t
  misc_feature (3112)..(3133): n is a, c, g, or t
  misc_feature (3135)..(3136): n is a, c, g, or t
  misc_feature (3139)..(3139): n is a, c, g, or t
  misc_feature (3142)..(3145): n is a, c, g, or t
  misc_feature (3147)..(3147): n is a, c, g, or t
  misc_feature (3150)..(3154): n is a, c, g, or t
  misc_feature (3156)..(3156): n is a, c, g, or t
  misc_feature (3158)..(3170): n is a, c, g, or t
  misc_feature (3173)..(3176): n is a, c, g, or t
  misc_feature (3179)..(3188): n is a, c, g, or t
  misc_feature (3190)..(3193): n is a, c, g, or t
  misc_feature (3195)..(3196): n is a, c, g, or t
  misc_feature (3198)..(3198): n is a, c, g, or t
  misc_feature (3201)..(3201): n is a, c, g, or t
  misc_feature (3203)..(3205): n is a, c, g, or t
  misc_feature (3207)..(3210): n is a, c, g, or t
  misc_feature (3212)..(3214): n is a, c, g, or t
  misc_feature (3216)..(3217): n is a, c, g, or t
  misc_feature (3219)..(3222): n is a, c, g, or t
  misc_feature (3224)..(3232): n is a, c, g, or t
  misc_feature (3234)..(3235): n is a, c, g, or t
  misc_feature (3237)..(3239): n is a, c, g, or t
  misc_feature (3241)..(3250): n is a, c, g, or t
  misc_feature (3252)..(3254): n is a, c, g, or t
  misc_feature (3256)..(3257): n is a, c, g, or t
  misc_feature (3259)..(3271): n is a, c, g, or t
  misc_feature (3275)..(3275): n is a, c, g, or t
  misc_feature (3277)..(3277): n is a, c, g, or t
  misc_feature (3279)..(3280): n is a, c, g, or t
  misc_feature (3282)..(3284): n is a, c, g, or t
  misc_feature (3286)..(3287): n is a, c, g, or t
  misc_feature (3290)..(3292): n is a, c, g, or t
  misc_feature (3294)..(3296): n is a, c, g, or t
  misc_feature (3298)..(3304): n is a, c, g, or t
  misc_feature (3306)..(3317): n is a, c, g, or t
  misc_feature (3319)..(3319): n is a, c, g, or t
  misc_feature (3321)..(3324): n is a, c, g, or t
  misc_feature (3327)..(3328): n is a, c, g, or t
  misc_feature (3330)..(3331): n is a, c, g, or t
  misc_feature (3333)..(3336): n is a, c, g, or t
  misc_feature (3338)..(3338): n is a, c, g, or t
  misc_feature (3340)..(3340): n is a, c, g, or t
  misc_feature (3342)..(3349): n is a, c, g, or t
  misc_feature (3351)..(3355): n is a, c, g, or t
  misc_feature (3357)..(3361): n is a, c, g, or t
  misc_feature (3364)..(3365): n is a, c, g, or t
  misc_feature (3367)..(3368): n is a, c, g, or t
  misc_feature (3370)..(3371): n is a, c, g, or t
  misc_feature (3373)..(3374): n is a, c, g, or t
  misc_feature (3377)..(3378): n is a, c, g, or t
  misc_feature (3380)..(3384): n is a, c, g, or t
  misc_feature (3386)..(3390): n is a, c, g, or t
  misc_feature (3392)..(3403): n is a, c, g, or t
  misc_feature (3405)..(3408): n is a, c, g, or t
  misc_feature (3410)..(3417): n is a, c, g, or t
  misc_feature (3419)..(3420): n is a, c, g, or t
  misc_feature (3425)..(3425): n is a, c, g, or t
  misc_feature (3427)..(3435): n is a, c, g, or t
  misc_feature (3437)..(3443): n is a, c, g, or t
  misc_feature (3445)..(3445): n is a, c, g, or t
  misc_feature (3447)..(3451): n is a, c, g, or t
  misc_feature (3453)..(3468): n is a, c, g, or t
  misc_feature (3470)..(3473): n is a, c, g, or t
  misc_feature (3475)..(3476): n is a, c, g, or t
  misc_feature (3479)..(3480): n is a, c, g, or t
  misc_feature (3484)..(3484): n is a, c, g, or t
  misc_feature (3486)..(3487): n is a, c, g, or t
  misc_feature (3490)..(3499): n is a, c, g, or t
  misc_feature (3501)..(3506): n is a, c, g, or t
  misc_feature (3508)..(3514): n is a, c, g, or t
  misc_feature (3516)..(3516): n is a, c, g, or t
  misc_feature (3518)..(3525): n is a, c, g, or t
  misc_feature (3527)..(3533): n is a, c, g, or t
  misc_feature (3535)..(3535): n is a, c, g, or t
  misc_feature (3537)..(3542): n is a, c, g, or t
  misc_feature (3544)..(3544): n is a, c, g, or t
  misc_feature (3546)..(3546): n is a, c, g, or t
  misc_feature (3548)..(3560): n is a, c, g, or t
  misc_feature (3562)..(3568): n is a, c, g, or t
  misc_feature (3570)..(3576): n is a, c, g, or t
  misc_feature (3578)..(3585): n is a, c, g, or t
  misc_feature (3587)..(3593): n is a, c, g, or t
  misc_feature (3595)..(3596): n is a, c, g, or t
  misc_feature (3598)..(3601): n is a, c, g, or t
  misc_feature (3603)..(3612): n is a, c, g, or t
  misc_feature (3614)..(3622): n is a, c, g, or t
  misc_feature (3624)..(3624): n is a, c, g, or t
  misc_feature (3626)..(3626): n is a, c, g, or t
  misc_feature (3629)..(3632): n is a, c, g, or t
  misc_feature (3635)..(3635): n is a, c, g, or t
  misc_feature (3640)..(3641): n is a, c, g, or t
  misc_feature (3645)..(3656): n is a, c, g, or t
  misc_feature (3658)..(3659): n is a, c, g, or t
  misc_feature (3661)..(3662): n is a, c, g, or t
  misc_feature (3666)..(3672): n is a, c, g, or t
  misc_feature (3676)..(3679): n is a, c, g, or t
  misc_feature (3681)..(3685): n is a, c, g, or t
  misc_feature (3687)..(3689): n is a, c, g, or t
  misc_feature (3691)..(3698): n is a, c, g, or t
  misc_feature (3700)..(3700): n is a, c, g, or t
  misc_feature (3702)..(3707): n is a, c, g, or t
  misc_feature (3710)..(3715): n is a, c, g, or t
  misc_feature (3717)..(3717): n is a, c, g, or t
  misc_feature (3720)..(3721): n is a, c, g, or t
  misc_feature (3723)..(3726): n is a, c, g, or t
  misc_feature (3728)..(3728): n is a, c, g, or t
  misc_feature (3730)..(3731): n is a, c, g, or t
  misc_feature (3733)..(3733): n is a, c, g, or t
  misc_feature (3736)..(3752): n is a, c, g, or t
  misc_feature (3756)..(3759): n is a, c, g, or t
  misc_feature (3761)..(3764): n is a, c, g, or t
  misc_feature (3766)..(3771): n is a, c, g, or t
  misc_feature (3773)..(3781): n is a, c, g, or t
  misc_feature (3783)..(3783): n is a, c, g, or t
  misc_feature (3785)..(3787): n is a, c, g, or t
  misc_feature (3789)..(3796): n is a, c, g, or t
  misc_feature (3798)..(3798): n is a, c, g, or t
  misc_feature (3800)..(3801): n is a, c, g, or t
  misc_feature (3803)..(3805): n is a, c, g, or t
  misc_feature (3809)..(3809): n is a, c, g, or t
  misc_feature (3812)..(3812): n is a, c, g, or t
  misc_feature (3814)..(3817): n is a, c, g, or t
  misc_feature (3822)..(3822): n is a, c, g, or t
  misc_feature (3824)..(3824): n is a, c, g, or t
  misc_feature (3827)..(3827): n is a, c, g, or t
  misc_feature (3830)..(3831): n is a, c, g, or t
  misc_feature (3833)..(3833): n is a, c, g, or t
  misc_feature (3835)..(3838): n is a, c, g, or t
  misc_feature (3840)..(3843): n is a, c, g, or t
  misc_feature (3849)..(3850): n is a, c, g, or t
  misc_feature (3855)..(3856): n is a, c, g, or t
  misc_feature (3858)..(3858): n is a, c, g, or t
  misc_feature (3860)..(3860): n is a, c, g, or t
  misc_feature (3862)..(3868): n is a, c, g, or t
  misc_feature (3870)..(3873): n is a, c, g, or t
  misc_feature (3875)..(3877): n is a, c, g, or t
  misc_feature (3879)..(3879): n is a, c, g, or t
  misc_feature (3881)..(3884): n is a, c, g, or t
  misc_feature (3886)..(3887): n is a, c, g, or t
  misc_feature (3889)..(3889): n is a, c, g, or t
  misc_feature (3891)..(3891): n is a, c, g, or t
  misc_feature (3893)..(3895): n is a, c, g, or t
  misc_feature (3898)..(3899): n is a, c, g, or t
  misc_feature (3902)..(3903): n is a, c, g, or t
  misc_feature (3905)..(3906): n is a, c, g, or t
  misc_feature (3909)..(3909): n is a, c, g, or t
  misc_feature (3912)..(3912): n is a, c, g, or t
  misc_feature (3914)..(3914): n is a, c, g, or t
  misc_feature (3917)..(3917): n is a, c, g, or t
  misc_feature (3919)..(3921): n is a, c, g, or t
  misc_feature (3924)..(3925): n is a, c, g, or t
  misc_feature (3930)..(3934): n is a, c, g, or t
  misc_feature (3937)..(3937): n is a, c, g, or t
  misc_feature (3940)..(3944): n is a, c, g, or t
  misc_feature (3947)..(3948): n is a, c, g, or t
  misc_feature (3951)..(3952): n is a, c, g, or t
  misc_feature (3954)..(3960): n is a, c, g, or t
  misc_feature (3962)..(3968): n is a, c, g, or t
  misc_feature (3970)..(3970): n is a, c, g, or t
  misc_feature (3972)..(3972): n is a, c, g, or t
  misc_feature (3974)..(3974): n is a, c, g, or t
  misc_feature (3976)..(3976): n is a, c, g, or t
  misc_feature (3978)..(3979): n is a, c, g, or t
  misc_feature (3981)..(3986): n is a, c, g, or t
  misc_feature (3989)..(3992): n is a, c, g, or t
  misc_feature (3994)..(3995): n is a, c, g, or t
  misc_feature (3997)..(3997): n is a, c, g, or t
  misc_feature (3999)..(4000): n is a, c, g, or t
cgcgcgcgaaacggcgtcacgagcggtgacgtcacgcgcgcattcgacgcgtggacgacgcgcgcagacgacgcgcgcgcgtggacgaccgggacagcggtcggcgtgtgtatgtgtacgcgagttcgcatcatggcgcgcgcgagaggtccacgcggcgcggtatgcggaggggcgtggtatgatgtgggctggagacttgaagagcctggagcgctccggcgtgcgcgcgaggtgaaatgacgagcctgaagtgcgcgaatatcgcgtgaaggatacaaggtaaagttacaaaaatctatgattagtacgattccggggtcgctgagccgttcgggtgcgcgttgacgtcgcgcggtttgtggagcgcgcgtcggcgcgcgatttcagccgataaagcatccagctcgctttcgacgcggtctttgacttggtcgtgctggccagcgacgatggcgagaatgtcttcgatcatatcttcgttgcccatgatgttgatgtggtcgccttcggctctaccttggaaggaagcgacggattgaggggcgacgtgcgcgtattctcgagtgacgactgggacgcccgctgggttcaattttttgctcgtgcgccaaacgcttcggcagacgtacccgagtgaagctaaagtgatggtaccatcgccatggacttgccgcacgccattttgaattccacgcgcgtgatattgcacatccaactgaaatggacgcaacgtgtcggtggcgtgatgttcgtacacgtacgcccgctcggatgctttacctgtgccgtacaagcagaacaccttcatgtttggcgcatacggcaacggccgcgtcaatgcattcccgaaatctgttgcacgtttattcgcgagcgacgggtcattacgcaacagctgcgcttgcgtcttgggatgcgtcacgtgcgagaattccgcaacgttgtgcggattcttctcctgcatcgtcgcgaataaaaaatcaagcgcactgtcgatagtgtgattgacaccttcttgtcgaggcgcgcctgcggcgcgtatttgcaaaaagtaattcaatcgctcgtcatccggggcatcatcgggcgagccgagttcgttgtcgccccacaccgccgcgccgccgcgcgggagcatggcccataccgatccccacgagcgaaaggtttcgcacgcttctttgagctgactagcgataacgcgtccaacggcgacatcaagcaaacctccaagcaacccttcgagttcgccgagcatcgtcgtatcgcgcatttcgcccgaaagcaaactcggaagcgccttggcgacgccaagcatcggcccggcgatgtccacatacgactcgacgtgcttctctacccatcgtcgaccgccgccgccaccaccttttgacacgggagtttcgacccaatcgaaaaagtacctcgccacggtatcgccgtacgaatgcgccaatatcacgctcttctcaccgtgcacctcggtaaacgtctcgatgacgctcttcagtcgcgtcatgtacccatcgcgcttttccagctgcaacggactcaaacgccaatcgtacgacgcagagtgaatattattggcatcgtacccgagctcgccgagctcttcgatgtgtcgcgcccagacaaaatagccgggcgcgaaccaatccaccgcttctaaaccgcgtaccgcgcggagttttataccctccggatccaatccagtatttggatcaaggcgcatgtgctccatccaacaccgcatattcgcaaagaacgcgcgcgccatcgcgggcgtcccccacatgcgctgtcgaaagaactgcttcccgcacgctcgccccgaccacaactcgagcccggtgctcacgaaccccggcacgatcaccaccggatgctttggcgccatgcctcgcgcctttgcgcgcgcaccaggtccattgacattcgtgttctgaaacccaccgtattcgagcgcgggcaacctcgcgagcaccgtcgtgttcaaccactccccgcccggcgacgcgcgcaccacggcgtcgaaccgcagcacattcctcaaatacgtcgccgcgcacgccaccgcgagcacgagcaccgcacgcgcgaacgacaccgtcgtcgtcgcctctcgcacgaccgcgccgcgatcgcacgcgcgcgcgagaaaccgcgcgcgaacgcgcgtgagccaccatcgcgcggcatcggtgcgcgcaaccgttcgtctccctcgtcgccctgtgccgacgcgcgacggcgttttcgacgcggcgcgaggcgcgcgaggcgcgcgagacgcgcgagaggcgtcgtccgcgtcgtccgcggcgtccgcggcgtccgcggcgcgcgcgcgacgcgtgcgcatcgcggtcgcgacgacgaatggcgannannnctngaggacnatttttcaccaatcacgaccaggcacacgaggggggactcgacnnnccnnncnctcnnncgnnnggncggcgnnnnnttcntnnncncnnncgcgcgcgcgcgtncnnnnnnngntngnnnggnnnnncnaaccggnagncgcgcnccnngnccgncnncgccnccncgatcgttcgnnnngttcgncnngnngnncnncggcgngnnnnnngnnnnnnngtnngnggnnngngggngnncngggggnnnnnggcgngncggcggcgcgacgangnnnnnnngnnnnnnnnngnnnnngnnngnngnnnngnannnnnngnnnnnnggngnngnngcnnngnngnngnnnggngnnnggnngnngnnnggnggnggnggnggnggnggnggggnggngnnnnnnnnnnngnnnnnngnngnngngnnnnnggntncngnnnnnnannnggnnnnnnnnnnnnnnnntnnnnnnannnnnnaannnnnnnnnnnnnngnnnnngnnnnnnnannnnntnnnnantnnnnatnnnnnnnngnnnnnngnnnngnnnnttngnnnnnnanggnnnnnnnnnnnngnnnnnnnnnnnnnnntnannnnnnnngnngncgnngntnngnngnnnnnngnnnnngnnnnctnggnnnnngnnnnnnnnnttgnntnnnnnnnnnnanannnannanngnnngannntggnnnnnnnnnnnnnnnnnnnnnngnnggnggnnnngnggnnnnngngnnnnnnnnnnnnnatnnnnaannnnnnnnnnannnnannanccnannngnnnncnnngnngnnnngnnnnnnnnnanngnnnannnnnnnnnnannntnnannnnnnnnnnnnntggnancnngnnngnncgnnngnnngnnnnnnngnnnnnnnnnnnngncnnnnggnngnngnnnngntnannnnnnnntnnnnngnnnnncgnngnngnntnncgnntnnnnncnnnnnannnnnnnnnnnngnnnntnnnnnnnncnncgaancnnnnnnnnncnnnnnnncngnnnnngnnnnnnnnnnnnnnnngnnnntnnccnngttncnnggnnnnnnnnnngnnnnnncnnnnnnncntnnnnnnnngnnnnnnntngnnnnnngnantnnnnnnnnnnnnngnnnnnnngnnnnnnngnnnnnnnncnnnnnnncnncnnnncnnnnnnnnnngnnnnnnnnntngnaannnnaanaaaannagannnnnnnnnnnnanngnnaaannnnnnnaaannnngnnnnngnnngnnnnnnnncnannnnnnaannnnnnanggnnannnngngnntncgnnnnnnnnnnnnnnnnngccnnnnannnncnnnnnncnnnnnnnnncnannncnnnnnnnntncnncnnncccnccncnnnncgacntngtnatnncntnnnnannnntgaagnntggcnnangngnnnnnnngnnnntnnntnannnntnnanancnnnaannccnncnnccnccngngtncnnntgnnggcannnnnggnggnnnnnggnnggnnannnnnnnannnnnnnanangntnanngnnnnnnaannnncnnangnn

SEQ ID NO: 1001 - DNA, 4000 bp, Escherichia coli
  misc_feature (8)..(9): n is a, c, g, or t
  misc_feature (12)..(13): n is a, c, g, or t
  misc_feature (18)..(19): n is a, c, g, or t
  misc_feature (21)..(27): n is a, c, g, or t
  misc_feature (29)..(31): n is a, c, g, or t
  misc_feature (33)..(34): n is a, c, g, or t
  misc_feature (37)..(37): n is a, c, g, or t
  misc_feature (40)..(44): n is a, c, g, or t
  misc_feature (47)..(49): n is a, c, g, or t
  misc_feature (53)..(54): n is a, c, g, or t
  misc_feature (60)..(62): n is a, c, g, or t
  misc_feature (65)..(66): n is a, c, g, or t
  misc_feature (70)..(70): n is a, c, g, or t
  misc_feature (72)..(72): n is a, c, g, or t
  misc_feature (77)..(77): n is a, c, g, or t
  misc_feature (79)..(79): n is a, c, g, or t
  misc_feature (81)..(83): n is a, c, g, or t
  misc_feature (86)..(86): n is a, c, g, or t
  misc_feature (90)..(91): n is a, c, g, or t
  misc_feature (93)..(94): n is a, c, g, or t
  misc_feature (99)..(99): n is a, c, g, or t
  misc_feature (102)..(106): n is a, c, g, or t
  misc_feature (108)..(108): n is a, c, g, or t
  misc_feature (112)..(113): n is a, c, g, or t
  misc_feature (117)..(118): n is a, c, g, or t
  misc_feature (120)..(122): n is a, c, g, or t
  misc_feature (129)..(132): n is a, c, g, or t
  misc_feature (134)..(135): n is a, c, g, or t
  misc_feature (137)..(138): n is a, c, g, or t
  misc_feature (141)..(141): n is a, c, g, or t
  misc_feature (144)..(144): n is a, c, g, or t
  misc_feature (147)..(148): n is a, c, g, or t
  misc_feature (150)..(150): n is a, c, g, or t
  misc_feature (152)..(154): n is a, c, g, or t
  misc_feature (157)..(157): n is a, c, g, or t
  misc_feature (160)..(162): n is a, c, g, or t
  misc_feature (164)..(164): n is a, c, g, or t
  misc_feature (166)..(167): n is a, c, g, or t
  misc_feature (169)..(171): n is a, c, g, or t
  misc_feature (174)..(177): n is a, c, g, or t
  misc_feature (180)..(187): n is a, c, g, or t
  misc_feature (190)..(191): n is a, c, g, or t
  misc_feature (193)..(193): n is a, c, g, or t
  misc_feature (195)..(195): n is a, c, g, or t
  misc_feature (199)..(201): n is a, c, g, or t
  misc_feature (203)..(204): n is a, c, g, or t
  misc_feature (208)..(208): n is a, c, g, or t
  misc_feature (211)..(211): n is a, c, g, or t
  misc_feature (213)..(213): n is a, c, g, or t
  misc_feature (216)..(216): n is a, c, g, or t
  misc_feature (219)..(219): n is a, c, g, or t
  misc_feature (222)..(222): n is a, c, g, or t
  misc_feature (225)..(226): n is a, c, g, or t
  misc_feature (228)..(233): n is a, c, g, or t
  misc_feature (236)..(237): n is a, c, g, or t
  misc_feature (239)..(239): n is a, c, g, or t
  misc_feature (242)..(242): n is a, c, g, or t
  misc_feature (244)..(244): n is a, c, g, or t
  misc_feature (246)..(247): n is a, c, g, or t
  misc_feature (249)..(249): n is a, c, g, or t
  misc_feature (252)..(253): n is a, c, g, or t
  misc_feature (255)..(255): n is a, c, g, or t
  misc_feature (257)..(258): n is a, c, g, or t
  misc_feature (261)..(261): n is a, c, g, or t
  misc_feature (263)..(266): n is a, c, g, or t
  misc_feature (271)..(271): n is a, c, g, or t
  misc_feature (273)..(274): n is a, c, g, or t
  misc_feature (277)..(279): n is a, c, g, or t
  misc_feature (281)..(281): n is a, c, g, or t
  misc_feature (283)..(283): n is a, c, g, or t
  misc_feature (286)..(288): n is a, c, g, or t
  misc_feature (290)..(293): n is a, c, g, or t
  misc_feature (296)..(297): n is a, c, g, or t
  misc_feature (303)..(303): n is a, c, g, or t
  misc_feature (306)..(312): n is a, c, g, or t
  misc_feature (315)..(315): n is a, c, g, or t
  misc_feature (320)..(320): n is a, c, g, or t
  misc_feature (322)..(323): n is a, c, g, or t
  misc_feature (325)..(325): n is a, c, g, or t
  misc_feature (327)..(327): n is a, c, g, or t
  misc_feature (332)..(335): n is a, c, g, or t
  misc_feature (337)..(342): n is a, c, g, or t
  misc_feature (344)..(345): n is a, c, g, or t
  misc_feature (348)..(348): n is a, c, g, or t
  misc_feature (350)..(350): n is a, c, g, or t
  misc_feature (352)..(355): n is a, c, g, or t
  misc_feature (357)..(358): n is a, c, g, or t
  misc_feature (360)..(362): n is a, c, g, or t
  misc_feature (365)..(365): n is a, c, g, or t
  misc_feature (367)..(367): n is a, c, g, or t
  misc_feature (369)..(374): n is a, c, g, or t
  misc_feature (376)..(378): n is a, c, g, or t
  misc_feature (380)..(381): n is a, c, g, or t
  misc_feature (385)..(385): n is a, c, g, or t
  misc_feature (388)..(388): n is a, c, g, or t
  misc_feature (390)..(397): n is a, c, g, or t
  misc_feature (400)..(403): n is a, c, g, or t
  misc_feature (406)..(408): n is a, c, g, or t
  misc_feature (410)..(415): n is a, c, g, or t
  misc_feature (418)..(422): n is a, c, g, or t
  misc_feature (424)..(424): n is a, c, g, or t
  misc_feature (426)..(427): n is a, c, g, or t
  misc_feature (429)..(430): n is a, c, g, or t
  misc_feature (432)..(435): n is a, c, g, or t
  misc_feature (438)..(438): n is a, c, g, or t
  misc_feature (442)..(445): n is a, c, g, or t
  misc_feature (447)..(448): n is a, c, g, or t
  misc_feature (450)..(450): n is a, c, g, or t
  misc_feature (452)..(462): n is a, c, g, or t
  misc_feature (464)..(465): n is a, c, g, or t
  misc_feature (467)..(479): n is a, c, g, or t
  misc_feature (482)..(485): n is a, c, g, or t
  misc_feature (487)..(487): n is a, c, g, or t
  misc_feature (490)..(490): n is a, c, g, or t
  misc_feature (492)..(494): n is a, c, g, or t
  misc_feature (496)..(499): n is a, c, g, or t
  misc_feature (502)..(512): n is a, c, g, or t
  misc_feature (518)..(518): n is a, c, g, or t
  misc_feature (522)..(524): n is a, c, g, or t
  misc_feature (526)..(531): n is a, c, g, or t
  misc_feature (533)..(536): n is a, c, g, or t
  misc_feature (539)..(539): n is a, c, g, or t
  misc_feature (541)..(541): n is a, c, g, or t
  misc_feature (545)..(547): n is a, c, g, or t
  misc_feature (549)..(550): n is a, c, g, or t
  misc_feature (552)..(552): n is a, c, g, or t
  misc_feature (554)..(556): n is a, c, g, or t
  misc_feature (561)..(561): n is a, c, g, or t
  misc_feature (566)..(567): n is a, c, g, or t
  misc_feature (573)..(575): n is a, c, g, or t
  misc_feature (577)..(579): n is a, c, g, or t
  misc_feature (582)..(583): n is a, c, g, or t
  misc_feature (585)..(585): n is a, c, g, or t
  misc_feature (587)..(592): n is a, c, g, or t
  misc_feature (594)..(600): n is a, c, g, or t
  misc_feature (604)..(605): n is a, c, g, or t
  misc_feature (608)..(609): n is a, c, g, or t
  misc_feature (612)..(615): n is a, c, g, or t
  misc_feature (619)..(619): n is a, c, g, or t
  misc_feature (621)..(632): n is a, c, g, or t
  misc_feature (635)..(636): n is a, c, g, or t
  misc_feature (638)..(639): n is a, c, g, or t
  misc_feature (641)..(641): n is a, c, g, or t
  misc_feature (643)..(645): n is a, c, g, or t
  misc_feature (647)..(651): n is a, c, g, or t
  misc_feature (655)..(658): n is a, c, g, or t
  misc_feature (660)..(666): n is a, c, g, or t
  misc_feature (668)..(668): n is a, c, g, or t
  misc_feature (671)..(673): n is a, c, g, or t
  misc_feature (675)..(678): n is a, c, g, or t
  misc_feature (680)..(680): n is a, c, g, or t
  misc_feature (685)..(688): n is a, c, g, or t
  misc_feature (690)..(692): n is a, c, g, or t
  misc_feature (694)..(697): n is a, c, g, or t
  misc_feature (699)..(700): n is a, c, g, or t
  misc_feature (702)..(702): n is a, c, g, or t
  misc_feature (704)..(704): n is a, c, g, or t
  misc_feature (706)..(706): n is a, c, g, or t
  misc_feature (709)..(709): n is a, c, g, or t
  misc_feature (711)..(712): n is a, c, g, or t
  misc_feature (714)..(727): n is a, c, g, or t
  misc_feature (729)..(729): n is a, c, g, or t
  misc_feature (731)..(736): n is a, c, g, or t
  misc_feature (738)..(742): n is a, c, g, or t
  misc_feature (744)..(744): n is a, c, g, or t
  misc_feature (746)..(746): n is a, c, g, or t
  misc_feature (749)..(758): n is a, c, g, or t
  misc_feature (760)..(775): n is a, c, g, or t
  misc_feature (778)..(781): n is a, c, g, or t
  misc_feature (784)..(784): n is a, c, g, or t
  misc_feature (786)..(786): n is a, c, g, or t
  misc_feature (789)..(789): n is a, c, g, or t
  misc_feature (791)..(794): n is a, c, g, or t
  misc_feature (796)..(796): n is a, c, g, or t
  misc_feature (798)..(798): n is a, c, g, or t
  misc_feature (803)..(803): n is a, c, g, or t
  misc_feature (806)..(809): n is a, c, g, or t
  misc_feature (811)..(812): n is a, c, g, or t
  misc_feature (814)..(814): n is a, c, g, or t
  misc_feature (816)..(817): n is a, c, g, or t
  misc_feature (819)..(819): n is a, c, g, or t
  misc_feature (822)..(825): n is a, c, g, or t
  misc_feature (827)..(829): n is a, c, g, or t
  misc_feature (832)..(832): n is a, c, g, or t
  misc_feature (835)..(835): n is a, c, g, or t
  misc_feature (837)..(839): n is a, c, g, or t
  misc_feature (841)..(842): n is a, c, g, or t
  misc_feature (844)..(847): n is a, c, g, or t
  misc_feature (851)..(851): n is a, c, g, or t
  misc_feature (854)..(855): n is a, c, g, or t
  misc_feature (858)..(858): n is a, c, g, or t
  misc_feature (860)..(860): n is a, c, g, or t
  misc_feature (862)..(863): n is a, c, g, or t
  misc_feature (865)..(865): n is a, c, g, or t
  misc_feature (868)..(876): n is a, c, g, or t
  misc_feature (881)..(882): n is a, c, g, or t
  misc_feature (886)..(888): n is a, c, g, or t
  misc_feature (890)..(898): n is a, c, g, or t
  misc_feature (900)..(900): n is a, c, g, or t
  misc_feature (902)..(902): n is a, c, g, or t
  misc_feature (905)..(906): n is a, c, g, or t
  misc_feature (911)..(915): n is a, c, g, or t
  misc_feature (917)..(919): n is a, c, g, or t
  misc_feature (921)..(923): n is a, c, g, or t
  misc_feature (925)..(926): n is a, c, g, or t
  misc_feature (930)..(931): n is a, c, g, or t
  misc_feature (933)..(937): n is a, c, g, or t
  misc_feature (939)..(944): n is a, c, g, or t
  misc_feature (946)..(946): n is a, c, g, or t
  misc_feature (949)..(950): n is a, c, g, or t
  misc_feature (955)..(955): n is a, c, g, or t
  misc_feature (962)..(963): n is a, c, g, or t
  misc_feature (971)..(971): n is a, c, g, or t
  misc_feature (1144)..(1144): n is a, c, g, or t
  misc_feature (1167)..(1167): n is a, c, g, or t
  misc_feature (1229)..(1229): n is a, c, g, or t
  misc_feature (1238)..(1238): n is a, c, g, or t
  misc_feature (1331)..(1331): n is a, c, g, or t
  misc_feature (1382)..(1382): n is a, c, g, or t
  misc_feature (1391)..(1391): n is a, c, g, or t
  misc_feature (1441)..(1441): n is a, c, g, or t
  misc_feature (1555)..(1555): n is a, c, g, or t
  misc_feature (1589)..(1589): n is a, c, g, or t
  misc_feature (1592)..(1592): n is a, c, g, or t
  misc_feature (1603)..(1603): n is a, c, g, or t
  misc_feature (1677)..(1677): n is a, c, g, or t
  misc_feature (1686)..(1686): n is a, c, g, or t
  misc_feature (1754)..(1754): n is a, c, g, or t
  misc_feature (1763)..(1763): n is a, c, g, or t
  misc_feature (1805)..(1805): n is a, c, g, or t
  misc_feature (1831)..(1831): n is a, c, g, or t
  misc_feature (1840)..(1840): n is a, c, g, or t
  misc_feature (2547)..(2547): n is a, c, g, or t
  misc_feature (2574)..(2574): n is a, c, g, or t
  misc_feature (2583)..(2583): n is a, c, g, or t
  misc_feature (2598)..(2598): n is a, c, g, or t
  misc_feature (2639)..(2639): n is a, c, g, or t
  misc_feature (2676)..(2676): n is a, c, g, or t
  misc_feature (2682)..(2682): n is a, c, g, or t
  misc_feature (2685)..(2685): n is a, c, g, or t
  misc_feature (2732)..(2733): n is a, c, g, or t
  misc_feature (2737)..(2737): n is a, c, g, or t
  misc_feature (2814)..(2814): n is a, c, g, or t
  misc_feature (2824)..(2824): n is a, c, g, or t
  misc_feature (2835)..(2835): n is a, c, g, or t
  misc_feature (2838)..(2838): n is a, c, g, or t
  misc_feature (2847)..(2847): n is a, c, g, or t
  misc_feature (2876)..(2876): n is a, c, g, or t
  misc_feature (2898)..(2898): n is a, c, g, or t
  misc_feature (2907)..(2907): n is a, c, g, or t
  misc_feature (2910)..(2910): n is a, c, g, or t
  misc_feature (2928)..(2928): n is a, c, g, or t
  misc_feature (2931)..(2934): n is a, c, g, or t
  misc_feature (2938)..(2940): n is a, c, g, or t
  misc_feature (2942)..(2942): n is a, c, g, or t
  misc_feature (2944)..(2947): n is a, c, g, or t
  misc_feature (2949)..(2952): n is a, c, g, or t
  misc_feature (2954)..(2956): n is a, c, g, or t
  misc_feature (2958)..(2960): n is a, c, g, or t
  misc_feature (2962)..(2964): n is a, c, g, or t
  misc_feature (2967)..(2971): n is a, c, g, or t
  misc_feature (2973)..(2975): n is a, c, g, or t
  misc_feature (2978)..(2978): n is a, c, g, or t
  misc_feature (2980)..(2987): n is a, c, g, or t
  misc_feature (2990)..(2992): n is a, c, g, or t
  misc_feature (2997)..(2998): n is a, c, g, or t
  misc_feature (3000)..(3002): n is a, c, g, or t
  misc_feature (3004)..(3004): n is a, c, g, or t
  misc_feature (3006)..(3012): n is a, c, g, or t
  misc_feature (3014)..(3019): n is a, c, g, or t
  misc_feature (3021)..(3026): n is a, c, g, or t
  misc_feature (3028)..(3032): n is a, c, g, or t
  misc_feature (3035)..(3038): n is a, c, g, or t
  misc_feature (3041)..(3041): n is a, c, g, or t
  misc_feature (3043)..(3045): n is a, c, g, or t
  misc_feature (3048)..(3058): n is a, c, g, or t
  misc_feature (3060)..(3060): n is a, c, g, or t
  misc_feature (3062)..(3064): n is a, c, g, or t
  misc_feature (3066)..(3066): n is a, c, g, or t
  misc_feature (3068)..(3071): n is a, c, g, or t
  misc_feature (3074)..(3075): n is a, c, g, or t
  misc_feature (3077)..(3077): n is a, c, g, or t
  misc_feature (3079)..(3081): n is a, c, g, or t
  misc_feature (3084)..(3085): n is a, c, g, or t
  misc_feature (3088)..(3089): n is a, c, g, or t
  misc_feature (3092)..(3101): n is a, c, g, or t
  misc_feature (3106)..(3106): n is a, c, g, or t
  misc_feature (3109)..(3109): n is a, c, g, or t
  misc_feature (3111)..(3117): n is a, c, g, or t
  misc_feature (3119)..(3120): n is a, c, g, or t
  misc_feature (3122)..(3124): n is a, c, g, or t
  misc_feature (3126)..(3126): n is a, c, g, or t
  misc_feature (3128)..(3140): n is a, c, g, or t
  misc_feature (3144)..(3144): n is a, c, g, or t
  misc_feature (3146)..(3146): n is a, c, g, or t
  misc_feature (3148)..(3151): n is a, c, g, or t
  misc_feature (3153)..(3156): n is a, c, g, or t
  misc_feature (3158)..(3162): n is a, c, g, or t
  misc_feature (3165)..(3171): n is a, c, g, or t
  misc_feature (3173)..(3189): n is a, c, g, or t
  misc_feature (3191)..(3191): n is a, c, g, or t
  misc_feature (3193)..(3203): n is a, c, g, or t
  misc_feature (3206)..(3208): n is a, c, g, or t
  misc_feature (3210)..(3210): n is a, c, g, or t
  misc_feature (3212)..(3212): n is a, c, g, or t
  misc_feature (3214)..(3216): n is a, c, g, or t
  misc_feature (3220)..(3220): n is a, c, g, or t
  misc_feature (3222)..(3231): n is a, c, g, or t
  misc_feature (3234)..(3243): n is a, c, g, or t
  misc_feature (3245)..(3253): n is a, c, g, or t
  misc_feature (3255)..(3257): n is a, c, g, or t
  misc_feature (3259)..(3263): n is a, c, g, or t
  misc_feature (3265)..(3270): n is a, c, g, or t
  misc_feature (3272)..(3272): n is a, c, g, or t
  misc_feature (3275)..(3283): n is a, c, g, or t
  misc_feature (3287)..(3288): n is a, c, g, or t
  misc_feature (3290)..(3301): n is a, c, g, or t
  misc_feature (3304)..(3306): n is a, c, g, or t
  misc_feature (3308)..(3312): n is a, c, g, or t
  misc_feature (3315)..(3320): n is a, c, g, or t
  misc_feature (3324)..(3324): n is a, c, g, or t
  misc_feature (3326)..(3328): n is a, c, g, or t
  misc_feature (3330)..(3330): n is a, c, g, or t
  misc_feature (3333)..(3335): n is a, c, g, or t
  misc_feature (3337)..(3338): n is a, c, g, or t
  misc_feature (3340)..(3346): n is a, c, g, or t
  misc_feature (3349)..(3350): n is a, c, g, or t
  misc_feature (3352)..(3356): n is a, c, g, or t
  misc_feature (3358)..(3360): n is a, c, g, or t
  misc_feature (3362)..(3364): n is a, c, g, or t
  misc_feature (3366)..(3371): n is a, c, g, or t
  misc_feature (3373)..(3375): n is a, c, g, or t
  misc_feature (3378)..(3381): n is a, c, g, or t
  misc_feature (3383)..(3384): n is a, c, g, or t
  misc_feature (3386)..(3389): n is a, c, g, or t
  misc_feature (3391)..(3392): n is a, c, g, or t
  misc_feature (3394)..(3395): n is a, c, g, or t
  misc_feature (3397)..(3399): n is a, c, g, or t
  misc_feature (3401)..(3401): n is a, c, g, or t
  misc_feature (3404)..(3407): n is a, c, g, or t
  misc_feature (3413)..(3414): n is a, c, g, or t
  misc_feature (3417)..(3417): n is a, c, g, or t
  misc_feature (3419)..(3419): n is a, c, g, or t
  misc_feature (3421)..(3429): n is a, c, g, or t
  misc_feature (3431)..(3438): n is a, c, g, or t
  misc_feature (3440)..(3440): n is a, c, g, or t
  misc_feature (3443)..(3443): n is a, c, g, or t
  misc_feature (3445)..(3446): n is a, c, g, or t
  misc_feature (3448)..(3448): n is a, c, g, or t
  misc_feature (3450)..(3454): n is a, c, g, or t
  misc_feature (3456)..(3460): n is a, c, g, or t
  misc_feature (3462)..(3462): n is a, c, g, or t
  misc_feature (3464)..(3464): n is a, c, g, or t
  misc_feature (3468)..(3473): n is a, c, g, or t
  misc_feature (3476)..(3476): n is a, c, g, or t
  misc_feature (3478)..(3479): n is a, c, g, or t
  misc_feature (3481)..(3492): n is a, c, g, or t
  misc_feature (3495)..(3495): n is a, c, g, or t
  misc_feature (3497)..(3501): n is a, c, g, or t
  misc_feature (3503)..(3506): n is a, c, g, or t
  misc_feature (3508)..(3509): n is a, c, g, or t
  misc_feature (3511)..(3513): n is a, c, g, or t
  misc_feature (3515)..(3519): n is a, c, g, or t
  misc_feature (3521)..(3524): n is a, c, g, or t
  misc_feature (3526)..(3526): n is a, c, g, or t
  misc_feature (3528)..(3533): n is a, c, g, or t
  misc_feature (3535)..(3543): n is a, c, g, or t
  misc_feature (3547)..(3552): n is a, c, g, or t
  misc_feature (3554)..(3555): n is a, c, g, or t
  misc_feature (3557)..(3564): n is a, c, g, or t
  misc_feature (3567)..(3569): n is a, c, g, or t
  misc_feature (3571)..(3578): n is a, c, g, or t
  misc_feature (3581)..(3581): n is a, c, g, or t
  misc_feature (3585)..(3588): n is a, c, g, or t
  misc_feature (3590)..(3590): n is a, c, g, or t
  misc_feature (3593)..(3593): n is a, c, g, or t
  misc_feature (3596)..(3602): n is a, c, g, or t
  misc_feature (3604)..(3607): n is a, c, g, or t
  misc_feature (3609)..(3613): n is a, c, g, or t
  misc_feature (3616)..(3620): n is a, c, g, or t
  misc_feature (3624)..(3628): n is a, c, g, or t
  misc_feature (3630)..(3631): n is a, c, g, or t
  misc_feature (3633)..(3633): n is a, c, g, or t
  misc_feature (3635)..(3635): n is a, c, g, or t
  misc_feature (3637)..(3642): n is a, c, g, or t
  misc_feature (3644)..(3647): n is a, c, g, or t
  misc_feature (3649)..(3655): n is a, c, g, or t
  misc_feature (3660)..(3660): n is a, c, g, or t
  misc_feature (3662)..(3663): n is a, c, g, or t
  misc_feature (3665)..(3667): n is a, c, g, or t
  misc_feature (3670)..(3670): n is a, c, g, or t
  misc_feature (3672)..(3673): n is a, c, g, or t
  misc_feature (3675)..(3676): n is a, c, g, or t
  misc_feature (3678)..(3679): n is a, c, g, or t
  misc_feature (3681)..(3681): n is a, c, g, or t
  misc_feature (3683)..(3683): n is a, c, g, or t
  misc_feature (3686)..(3686): n is a, c, g, or t
  misc_feature (3689)..(3692): n is a, c, g, or t
  misc_feature (3694)..(3695): n is a, c, g, or t
  misc_feature (3697)..(3697): n is a, c, g, or t
  misc_feature (3701)..(3704): n is a, c, g, or t
  misc_feature (3706)..(3706): n is a, c, g, or t
  misc_feature (3708)..(3713): n is a, c, g, or t
  misc_feature (3715)..(3724): n is a, c, g, or t
  misc_feature (3726)..(3730): n is a, c, g, or t
  misc_feature (3732)..(3732): n is a, c, g, or t
  misc_feature (3734)..(3734): n is a, c, g, or t
  misc_feature (3736)..(3740): n is a, c, g, or t
  misc_feature (3742)..(3744): n is a, c, g, or t
  misc_feature (3746)..(3746): n is a, c, g, or t
  misc_feature (3748)..(3748): n is a, c, g, or t
  misc_feature (3750)..(3754): n is a, c, g, or t
  misc_feature (3757)..(3765): n is a, c, g, or t
  misc_feature (3767)..(3784): n is a, c, g, or t
  misc_feature (3786)..(3788): n is a, c, g, or t
  misc_feature (3790)..(3792): n is a, c, g, or t
  misc_feature (3794)..(3799): n is a, c, g, or t
  misc_feature (3803)..(3804): n is a, c, g, or t
  misc_feature (3806)..(3809): n is a, c, g, or t
  misc_feature (3812)..(3815): n is a, c, g, or t
  misc_feature (3817)..(3819): n is a, c, g, or t
  misc_feature (3822)..(3822): n is a, c, g, or t
  misc_feature (3824)..(3824): n is a, c, g, or t
  misc_feature (3826)..(3828): n is a, c, g, or t
  misc_feature (3830)..(3832): n is a, c, g, or t
  misc_feature (3834)..(3835): n is a, c, g, or t
  misc_feature (3837)..(3840): n is a, c, g, or t
  misc_feature (3842)..(3843): n is a, c, g, or t
  misc_feature (3845)..(3855): n is a, c, g, or t
  misc_feature (3858)..(3860): n is a, c, g, or t
  misc_feature (3862)..(3878): n is a, c, g, or t
  misc_feature (3880)..(3880): n is a, c, g, or t
  misc_feature (3882)..(3882): n is a, c, g, or t
  misc_feature (3884)..(3889): n is a, c, g, or t
  misc_feature (3891)..(3891): n is a, c, g, or t
  misc_feature (3893)..(3901): n is a, c, g, or t
  misc_feature (3903)..(3905): n is a, c, g, or t
  misc_feature (3907)..(3907): n is a, c, g, or t
  misc_feature (3909)..(3914): n is a, c, g, or t
  misc_feature (3917)..(3925): n is a, c, g, or t
  misc_feature (3927)..(3930): n is a, c, g, or t
  misc_feature (3932)..(3932): n is a, c, g, or t
  misc_feature (3934)..(3938): n is a, c, g, or t
  misc_feature (3942)..(3945): n is a, c, g, or t
  misc_feature (3947)..(3949): n is a, c, g, or t
  misc_feature (3953)..(3958): n is a, c, g, or t
  misc_feature (3960)..(3963): n is a, c, g, or t
  misc_feature (3965)..(3966): n is a, c, g, or t
  misc_feature (3969)..(3971): n is a, c, g, or t
  misc_feature (3973)..(3973): n is a, c, g, or t
  misc_feature (3977)..(3979): n is a, c, g, or t
  misc_feature (3981)..(3984): n is a, c, g, or t
  misc_feature (3986)..(3987): n is a, c, g, or t
  misc_feature (3989)..(3989): n is a, c, g, or t
  misc_feature (3991)..(3991): n is a, c, g, or t
  misc_feature (3993)..(3993): n is a, c, g, or t
  misc_feature (3995)..(3997): n is a, c, g, or t
  misc_feature (3999)..(3999): n is a, c, g, or t
tgggctcnnagnntcacnntnnnnnnncnnnannaanaannnnntcnnnaagnnaatgannntcnnaaantnatgantntnnnctnagcnntnntcatnacnnnnntntttnncctnntnnncgccctnnnnanntnnttntcngcnnancnnnctntcnnntntnnannnatnnnnctnnnnnnnnttnnantngttnnngnntttnccntntanttnatntannannnnnnttnncnatncnanngnccnnananngancnnnntcaangnncannntncnggnnntnnnnacnngttatnctnnnnnnnatntttcntnngntncttgnnnncnnnnnnannagntncnnnncnncnnnccntnannnnnnannngnnccantgncnnnnnnnnttnnnngannngnnnnnntannnnntngnntnnannnnaanaaannnntnnanannnnnnnnnnnanngnnnnnnnnnnnnnttnnnnanaanannnannnnctnnnnnnnnnnntcaatntttnnntnnnnnnannnnaananttcnnncnntnannnttccnccccnnattttnnnannnganntngnnnnnnannnnnnntttnntgnnctnnnntttntnnnnnnnnnnnnaanngnncntnnngnnnnntccnnnnannnnnnncnggnnntnnnnanaattnnnnannnannnnannancnanttntnncnnnnnnnnnnnnnnanannnnnntnnnnngngngcnnnnnnnnnntnnnnnnnnnnnnnnnnatnnnnaangncanannnnantnccttnctnnnntnntntnncnctnnnntnnnatnaanannngnncnnnnaacncanntcnancnngnttnnnnnnnnnaaaannaaannnannnnnnnnngngnttnnttttnnnnntnnntnnntnnaaanntnnnnntnnnnnntnccnnatagntttctcnnatcttttntgataaaataggctcaatctatttctaggaggataaaatatgatttctactattggtattgttagtttatctagtggcattatcggagaggactttgtcaaacacgaagtggacttgggtgtccaacgtctcaaggacctgggactcaatcctatctttttgccccattcgcnaaaaggattagactttatcaagnaccatcctgaagctcgtgcagaggatttgattcatgccttttctgatgatagcatcgacatnatcctatgngccatcggtggagacgatacctatcgcttactaccttatctttttgaaaatgaccaactccaaaaggttatcaaacaaaaaatttttcttggnttctcggatacaaccatgaaccatctcatgttgcataaactaggaatcaanactttttanggtcaatccttcttagcagacatttgtgaattagacaaagaaatgctagnctatagccttcactactttaaagaattgattgagacgggaagaatctcagaaatccgccctagtgacgtttggtatgatgaaaggactgacttcagtcccaaggctctgggganacctcgtgtcagtcatgcaaataccggttttganttnttgcaaggaantgcccagttcgagggaaaaatcctcggtggttgcctcgaatccctctacgatatctttgacaactctcgatacncagatagcncggagctctgccaaaaatacaaacttttccctgacttgtcagactgggaaggaaagatcctcttgctngaaacaagngaagaaaagcctgagccggaagacttcaaaaagatgttgcgnactttaaaggacactggcatattcgnggtcatcantggactcttggtcggaaaacctatggatgaaactttctatgacgactataaagaggcactattggatatcattgatagcaatatcccgattgtctataatttgaatgtcggccacgcaactccaagagcaattgtccccttcggagttcacgcctatgtagatgcaaaggagcaaatcattcgctttgactataacaaaaaataaatagtttctctatttttgtgcttttgtattcgttttcgttacaatttgtatctgaatttattgcatttcgctaatttctatgatatccttttgaaggaggtgtatatgacaaaacaaaaaattaatcgaatcgtaggttctattggtgcctttattggaattatagtatttattgcctacatacctcaaattatcgctaatttacagggaaataaagctcaaccatttcaacctttatcagctgctatatcttgcttaatctgggttatttatggatggacaaaggaacctaagaaggattggatactaatcattccaaattcagctggtgttattttaggtggaatcacttttttgacttcactctaacaaatctaatagtatatataaaaagctgggaaaaatttctcagcttttttctatattctcagatatgctagttacctgtacacactaattcctgcttttccattcacaatcattctcgtggtcatcaactagncctgcagcctgtagaaaagacaagacngcgactggncctgtgaacttgaancctcgttttttgagatctttggctaatttctcagacaaagntgttttagctggggcttggcggtaatcgggaacatcnttaacnatngttttcccctcaacaaaagaccaaagataggcatcaaaagagccatnntctncctgtagtcgtagaaaggcttgggcgttagcgcgtgtagcaaaaatcttggctctatttcggatgatggctggattntccagcaagncttccaattcngtntcggtcatntctgcgaccgcttgaatttgatagccatnaaatgcttctcggaaagcttgncgtttgttnagnaccgtttcccaagacagnccnnnntgannngntnnnntnnnnannnannnannnaannnnngnnnatnannnnnnnnttnnncccanncnnnancnnnnnnngnnnnnnannnnnnannnnncannnngancnnngannnnnnnnnnntnannntntnnnnctnntngnnnaannttnnaannnnnnnnnngaaanggntnnnnnnngnntnnntngnnnnnnnnnnnnntttntngnnnntnnnnannnnngtnnnnnnntnnnnnnnnnnnnnnnnngngnnnnnnnnnnnttnnnantntnnntttncnnnnnnnnnntgnnnnnnnnnntnnnnnnnnngnnnannnnntnnnnnnantannnnnnnnnccanntnnnnnnnnnnnngtnnngnnnnnttnnnnnnaatntnnngnaannnanncnnnnnnntanngnnnnngnnntnnntnnnnnnannnaannnngnntnnnnannannannntnaannnnaagagnngananannnnnnnnncnnnnnnnngnaancnnantnnnnnannnnntnanatgnnnnnntgnannannnnnnnnnnnnagntnnnnntnnnnanncnnnannnnntnnnnanannnnnnannnnnnnnnttgnnnnnncnnannnnnnnntannnannnnnnnnatncagnnnntnacngtnnnnnnngnnnncnnnnncannnnntttnnnnntnntntngnnnnnnannnntnnnnnnnattcnannannnttntnntnnanntntnatnttnnnntnntntacnnnnantnnnnnnannnnnnnnnntnnnnngnancnnnnntnnnanancnnnnntgnnnnnnnnntnnnnnnnnnnnnnnnnnngnnnannntnnnnnngatnntnnnnttnnnngnnntgntnannnannngnnannnngnntnnnnnnnnnnnggnnngnnnnnnnnnnnnnnnnntntncnnnnnntnannnnnnnnntnnntntnnnnnnttnnnnnnnnnannnntncnnnnnaaannnnannntgtnnnnnntnnnntnnatnnntnattnnntnnnntnntntncnannnana

SEQ ID NO: 1002 - DNA, 4000 bp, Escherichia coli
  misc_feature (101)..(101): n is a, c, g, or t
  misc_feature (481)..(481): n is a, c, g, or t
  misc_feature (492)..(492): n is a, c, g, or t
  misc_feature (524)..(524): n is a, c, g, or t
  misc_feature (569)..(569): n is a, c, g, or t
  misc_feature (690)..(690): n is a, c, g, or t
  misc_feature (1086)..(1086): n is a, c, g, or t
  misc_feature (2145)..(2145): n is a, c, g, or t
  misc_feature (2354)..(2354): n is a, c, g, or t
  misc_feature (2414)..(2414): n is a, c, g, or t
  misc_feature (2416)..(2416): n is a, c, g, or t
  misc_feature (2441)..(2441): n is a, c, g, or t
  misc_feature (2445)..(2445): n is a, c, g, or t
  misc_feature (2470)..(2470): n is a, c, g, or t
  misc_feature (2498)..(2498): n is a, c, g, or t
  misc_feature (2506)..(2506): n is a, c, g, or t
  misc_feature (2509)..(2510): n is a, c, g, or t
  misc_feature (2513)..(2513): n is a, c, g, or t
  misc_feature (2529)..(2529): n is a, c, g, or t
  misc_feature (2532)..(2532): n is a, c, g, or t
  misc_feature (2536)..(2536): n is a, c, g, or t
  misc_feature (2547)..(2547): n is a, c, g, or t
  misc_feature (2549)..(2549): n is a, c, g, or t
  misc_feature (2553)..(2553): n is a, c, g, or t
  misc_feature (2569)..(2569): n is a, c, g, or t
  misc_feature (2653)..(2653): n is a, c, g, or t
  misc_feature (2655)..(2655): n is a, c, g, or t
  misc_feature (2658)..(2658): n is a, c, g, or t
  misc_feature (2662)..(2662): n is a, c, g, or t
  misc_feature (2664)..(2664): n is a, c, g, or t
  misc_feature (2669)..(2670): n is a, c, g, or t
  misc_feature (2676)..(2676): n is a, c, g, or t
  misc_feature (2679)..(2680): n is a, c, g, or t
  misc_feature (2708)..(2708): n is a, c, g, or t
  misc_feature (2712)..(2712): n is a, c, g, or t
  misc_feature (2743)..(2743): n is a, c, g, or t
  misc_feature (2793)..(2793): n is a, c, g, or t
  misc_feature (2814)..(2814): n is a, c, g, or t
  misc_feature (2841)..(2841): n is a, c, g, or t
  misc_feature (2975)..(2975): n is a, c, g, or t
  misc_feature (3025)..(3025): n is a, c, g, or t
  misc_feature (3044)..(3044): n is a, c, g, or t
  misc_feature (3060)..(3060): n is a, c, g, or t
  misc_feature (3105)..(3105): n is a, c, g, or t
  misc_feature (3121)..(3121): n is a, c, g, or t
  misc_feature (3186)..(3186): n is a, c, g, or t
  misc_feature (3193)..(3193): n is a, c, g, or t
  misc_feature (3213)..(3213): n is a, c, g, or t
  misc_feature (3258)..(3258): n is a, c, g, or t
  misc_feature (3275)..(3275): n is a, c, g, or t
  misc_feature (3310)..(3310): n is a, c, g, or t
  misc_feature (3312)..(3312): n is a, c, g, or t
  misc_feature (3351)..(3351): n is a, c, g, or t
  misc_feature (3555)..(3555): n is a, c, g, or t
  misc_feature (3598)..(3598): n is a, c, g, or t
  misc_feature (3631)..(3631): n is a, c, g, or t
  misc_feature (3700)..(3700): n is a, c, g, or t
  misc_feature (3931)..(3931): n is a, c, g, or t
  misc_feature (3942)..(3942): n is a, c, g, or t
  misc_feature (3949)..(3949): n is a, c, g, or t
acattaagcgtctaaagggcgtgggagactatactgctgctgccatcggaagcttcgcttttggtcttcaagtggctgcagttgacggcaacttctatcgngtgctggcgcgttactttggtattgacacgccaatgaacactcccgagggagttaaactctttgccgctttggcccaagagcaccttcctgagggtgcagcggctgactataaccaagctgttatggacttcggtgcaacgctatgtaccccaaaagctccgcaatgtacaaggtgtccattggctgaaacgtgtgttgcgaggcgcgaaaacaaggttgatcaactgcccgttaaactaaaaacactaaaggtgctgacgcgaaacctctccttatattatataaggtggaatgggaaaacagccattcataaacgtggaagcggtgatatatggcaaggattatggacagttcccgagtccgaacatctcactccacnactccgaaaanctgccgttctactgcaaaaaggggtgaaacangtgctcactcaccgcattctacttgccgacttctatctcctctcnccaaaagaaaagcctgctttgcccgaagattttatctggatagatgaaaaagacatcgaaaactatggcataccaaggctgatggagaagctgataagccttgctcaaccccttcaaaganaaggaatcagaccatgaaagcctacaaagaaaacagaaaagcgctactctacatcgtgtaaagtaacgccttccttatcgtcaactaaattaattcgtttcagaaattcagtatccttaacttgtcagttagccttctccgctcttagacaagcaaggatatgtttcctacttaaactcattccgaatcttctctgctatttccttaaattcttcttcgcttagtttcacatgatgtttgaagtctacatcggcctcactattcatgggaagaagatgtatatgcgcatgatttacctccaaaccaagcactacttcagccacctttttacatggaaaggcagccttgattgccttggctacgcgcttagcgaacacctgaaactcagccaattcntcatcatccatgtcgaagatatagtctacttcgcgacgtggaacaaccaaagtgtgtccctttgtgactggatcaatgtcgagaaacgcataaaatttgtcgctctctgcacacttatagctgggtatttcgcctgcagcaatctttgaaaatatcgtactcattgcggtaatctttatgttattgcaaagcttaagcctcgatactaatcttatctatgcgtagtttgatgacgccacgcggtatctttacctctacaacatcaccgactttatgattcaacaagccttgagcaataggcgtcttgatgctgattttgccctgctttagattggcttcactttcacttacaatagtatataccatcttagacttattagacatgttcgtcatctctacctttgacataatctgaacggcatccgcgcttaaacgagacacgtcaactatctttgcttcggcaatgtcaagcttcatcttattgattttactttcaagatgagcttgggcttctttggccgcatcatactctgaattctcacttaaatcgcctttatctcgggcctcagcaattgcggctgatgccttaggacgctctattgattcgagccgtttgagctctgctacaagtttgtcgtagccttcttgtgacatgtaagccataatctttcttgtttgtttaatataaattgaacgctgtaagagtaaacaataagataagaattccgacatattgtctctgtcggaattccaaatcctctttctactctttgtgttttatctgctgcaaagatagagattaaatctgaataaaacaagtttttaaatatcttttgcgtaaaacggcaagttcaaatgggtttgtttgcgtacacaaagttgacataaatcaattaaaactattataaattacttttatagataatagacttgacaagattagtaaaatggagtaactttgcaatgtgtttttcatagtattagatttaaggttaataaagattgggactcagcggagccccttttttgtttttagccagtttgtaacgccgaaaaacngcaaacccaagaactttcaaaagtcgttttaagcggaaatcatttgtattgtgaagagaaataaagctaaatcacaaacaatagtcctcaaatcgtttcatcaactgcaaccattgccccacagcctcatcctccctcattccctacccccacacaacttagctctcctctcctatggaggaggtgggaaaggtgcaatcaaaagcgangtaaaatgaggcagattagtgcacgaaatgacgcagattagcgcatgaagtgacgcaaangncagcgtgaaatgacgcagattgcgncagncaatgctacaaagcataaaataaangccgttttcagtccttacaacttgctgnaaacggcnttnnaanttctattttattgatntanaaantgcttttatcntncacnccttctttatataaanacacaaaaaacgcccgcattttgtgcgggcgaatgattgaaagcaagtttcaatatattatggctaagtttgtagtttgcttgngntcncacntngattnnattttnatnntcctttaatcttgtgcaatcaacgatancatntcaggtaagacagggcgcgaaaggcatgtcnttggcacaccattccgcccatttgaagtctatctcttaacgattttattntctattttgatgccggctgcncgtgtttgtgaggcacgactgaagacnatatcattagattttgcataactataacgggcaagtttgaagtcgataaactcgttgttattcactcctatcatagtaccttcaaagcggtttgcatcaagatagctctgcatgttacttgttttatcgagcanagtgatgcgatatttcttcttagaaccatcataagtgacatagatatcgnttgtagtcttgtcgatttnccatgtaaaatagagngtttgtgattgcgtattaccatttgaagtggctgtatctatctcncgaccacggcctttcngtcccgttgcatcatattgatcgaactctaattgtgcgttaaattgtgcgatggcgcgttgtccnttgtcgncattatactcatatctcatngcgccttcccagtgtcctcgcagggtgttggctaagtttttgagntattgtgcatcgctgtntgcattgccatctgaattattcgaccaccagtctngnttgtcttcatagtatgttgagcctgaactacagcttganaatgctatggaaacagatgctatcaacagcaaaaataagattttagtgagctttttcatatcctaattctattttaataaacaaatgatttatcttttattcagcgaagaatcgttgtggacggctttctgatttgactgcactgcgactcttggcatagccataatagccatcagaataatagttgttgtaattataatcgtnccagtttggcgaataagtatggtaaagtgtgatggtcaaatcnttgccagtgttcgttcgaatatatcccgacagncggtcatcgctaagactataattatagattactatgtcagtattctcttctatgaagtgaatatagatnttagaattccttacttgccacgtgatgtgactcgcttgatagtcataaggagcattactgtagtagtcaacccaatagccatcgcccgagttataaccgctattgaactgcactttgctttccgatgctttatattcacggtcattatatcgcgaagatacatagacattgccctgccatgtgccgtttaaggtggcagcaacttcggcatcttcgtcacaagaaaccaangcaacagaaancattgtnataagaaccatggagaatattgtcgtaaatcgtttcataataacatgagtt

SEQ ID NO: 1003 - DNA, 4000 bp, Escherichia coli
  misc_feature (1639)..(1639): n is a, c, g, or t
  misc_feature (1715)..(1715): n is a, c, g, or t
  misc_feature (1953)..(1953): n is a, c, g, or t
  misc_feature (1955)..(1955): n is a, c, g, or t
  misc_feature (1960)..(1960): n is a, c, g, or t
  misc_feature (1966)..(1966): n is a, c, g, or t
  misc_feature (1984)..(1984): n is a, c, g, or t
  misc_feature (1990)..(1990): n is a, c, g, or t
  misc_feature (1992)..(1994): n is a, c, g, or t
  misc_feature (1997)..(1997): n is a, c, g, or t
ggccctgcgcaggtcgagcggacggcctgcgatgcagaccacgataagcggcgttcccgtcgcctttatgcgccgcagcagctcttcctgttctccgagcagcgcgagcgtcgctcggtcgaaaccttcgccgcactccatgtcgcgcacctcgtcgtgcgcggctttggccgcgcccgtttgcaggaattccgtgtcgaagtcgcgggcgctcgatccgccgatgaccacgaccgccgcatctgtgccgcgggccgcggagacggccgccgcgatttccgaccgatcgccgccgcgcaccgtacagccgcggctgtagacgacgcggtcgcgccccagcagtttttccagcccgtcccggacggtgttcgccgctgtctgctgggccgtataatcccctaactggttgtagatgttgtcggcgttgggaccgatgacggctacccgccgcaggcgccggggatcgagcggcagggtgccgctgcggttttcgagcagcgtcaccgactgccgagccgcttcgagcgccagctccgagtgggcggcgcatccgacctccgcggcggcagcttcgtcgatataggggttctcgaacagtcccatttcgaacttcagggccagcacgcgctccacggcccggtcgatctccgcttcggcgacgtcgcccgcttccgcggcctcgcggagtgaggcgaaggcgccgcccttcaggtctgcgtccacgcccgcccgcaatgcctgcacggcggcttcccggacgcttccggccacgccgtgcgtctcgtgcagcccttcgatgctcagcaggtcggagaccacgaagccgtcgaagccccattcgccgcgcaggatgtcggtcagcatgcggcggttggccgtgcagggaatgccgtctaccgagttgtaggccgtcatcaccgagcgcgctccggcctttacggctgcttcgaacggcggcaggtaggtctcgcgcagttcgcgttcgcccagcaggttgcttccgccgttctggccgccctccgatgcgccgtaggcgatgaagtgcttgagtgtcgagagggcgtgccgcgactgtgagaggtcgccggaacccgtgccgcggacataggcttcaccgatgcgcgccgtcaggtaacagtcctcgccgtagctctcttcggtgcgcgaccagcgcgggtcgcggacgatgtccagcacgggaccgtaacagatatgtccgccctgcaggcggatttcggcggcgatgaccttgcccatgcgttcgatcagctccgggttccatgtcgaagcctgtcccggcgccgtggggaatgtcgtggccccgatggccatgtggccgtggggggcttcctcagcgaggaagaggggaatgcccagccgcgagtgctgcacggcgtagcgctgcattcggttggccagccgcgccgccagctgcggggtcagccccgtccgcaggtctttctgcgtccacggatcggcgcggaacgtaccccacaacatgccgatatgtccgttttgcaccgcttcgcggaaagcgtcggtcagacggaccgagtcgccgtgccgttcgtacatctcccagccgtaaggcgacgtcagctgtccgatcttctcgtcgagcgtcatctcggccgtcagnagttcggcccgtttctgcggcggaaggcttgtgtcgcgccagtcggcgctgcatgccgcggcggccgcgcacgccntcagcagtaaaagtcgtttcataggggttgctgttttgtccagtctgcgggttcgggacccatttcgaagcggagttccccgcctgcggcgatctccgcgtaatcgatgtaatatttccggtacgcttcgccgttgagcgtaatgcgctgtatgtagatgttctccggcgagttgtccgcagccgtgatgcggaattccccgccgcggacccgcagcgtcgcgccgtctacggcgggngngccgnagaagnagcggccgccggccggcnccgccngnnncangcccagcgccgagagtacgtaccatgccgacatctgcccgacgtcctcgttgccgcagagtccttccggacggtcgtggtagagttcgccgaggatgcggcgcaccttctcggcgcatttccacggttgcccgatcatcgtgtaaatataggttatgtggtggctcggctcgttgccgtgggcgtactggccgatcagccccgatatgtcgggcgaagcgtgcgcgcccatgtcgccttcggcgaggaacagcgagtcgagcttcccgacgaagcgttcccggccgccgaagcactccatgagtccttcgatgtcgtgcggcacgagccatgtgtactgccatgcgttgccttcggtgtagtcctgctccatgtggcgcgagtggaacggatcgaaaggcgtgcgccatgcgcccgacgccgatctgccgcggataaacccggtcgaggggtcgaaataatggcggtaggccttgctgcgggcgaggaaatagtcgtaatcctcccgtttgccttcgcgctgcgcggcctgcgccagtgcccagtccgcgatggcgtattcgagacagtatccgaccgattcgttgaactcatagggaatatatccgtacctcttgtagaggtccagcctccggtcgtcgcgcatggccgaactcttcatcgcttcgtaggctttcgcccggtcgaagccgccgaatcctttcagcagggcgtcggccaccacggggatggccggattgccgaccatgcagtcggtttcgcagcccatcaggtgccagacgggaagtttgccctgctgttcgtggatgcgcagcatcgtattgatcaggtcgccgaccttttcgggatggatgagcgtcagcaggggatgcgccgcgcggtaggtgtcccaaagcgagaaggtggtgtaattggtgaaggtcgtgtcgcggcggaccgctccgtcggcgccgcggtagtcgccgttcacgtcgcagaagagcgacggcgcgatcatggtgtggtaaagcgctgtgtagaagatccgtcgcaccgccggatcggctgtttcgatgcggattttcgacaactcgccgttccatgccctgcgggtggcttcgcgcacggcttcgaaatcccagccggggcactccgcctgcatgttccgccgggcattttccgcggaaacggccgaaagcccgaccttgacggtgatgcgttcgttctcctccgtccgaaaaccgaagcgtccgtagagtttccgcccgcgggccgagcggccgtcggcggagagcgtatccgcgccggtgaagacgatccgttcgaagggcttcgagaattcggcgtggaagtagacgcgctggtcgtcggcccagcccgtcgaatatcgccagccctcgaccgtacggtcgctgcatgcggtgatgccgcagtcggtggagcggtcccagccctgcccgttttcgaggtcgaggacgatacccgcgtcgtccgatgcggggaaggcgtagcggctcattccgacgcgcggcgaggcggtcagctcgacgccgatgccgtagcgcagcaggcgagtggcatagtagcccggcgcgcaccgttcgtcggcgcggctgaaacgggaccacatgcccgacgacggatcgccggccgtgccgcgtcccggcgtgactttgccgacgaccggcatcagcgagatgtcgttcaggtcgccgatgcccgtgccgctcaggtgcgtgtgaccgaacccgatgacggtcgtgtcggcgtaattgtagccggagcaccagtcccatgtctgcgggatgctcgtcggaccgagctgtacgaatccgaacgggacgttggcgcccatgaagacgtgtccgtggtcgcccgtgccgatgtagggatcgacgtattgcgtgtaatcctccggcacggcggaactgcatgcgccgcagagcagcgcggcgattgccgggagaaagatgatgcgtttcataattcgtgtcgttatacagcggatgcggcggacgcagccgc

SEQ ID NO: 1004 - DNA, 4000 bp, Escherichia coli
  misc_feature (128)..(128): n is a, c, g, or t
  misc_feature (155)..(155): n is a, c, g, or t
  misc_feature (1408)..(1408): n is a, c, g, or t
  misc_feature (1992)..(1992): n is a, c, g, or t
  misc_feature (2037)..(2037): n is a, c, g, or t
  misc_feature (2044)..(2044): n is a, c, g, or t
  misc_feature (2046)..(2047): n is a, c, g, or t
  misc_feature (2050)..(2052): n is a, c, g, or t
  misc_feature (2055)..(2055): n is a, c, g, or t
  misc_feature (2061)..(2061): n is a, c, g, or t
  misc_feature (2128)..(2128): n is a, c, g, or t
  misc_feature (3125)..(3125): n is a, c, g, or t
  misc_feature (3473)..(3473): n is a, c, g, or t
  misc_feature (3617)..(3617): n is a, c, g, or t
atttaccaccagaagtccccagtaataataatggtaagcccatgcctaaactgagcacataaagtgttaaaccaccgacgaggtagtcaccactttgcgccacataaagtaaagcagcagacaatggngctgttgtacacggtgaagcaatcaanccagacaatacacccatcataaatacgccaacatagttgccgcctttttgctggttactaacctgagtgagcttattcatcatgccgctaggtaatttgatttcgtaccagccaaacatcgacattgccaataatacaaataagatactaaagctaattagtacagtaggatgctgtaaatacccttgtacttgcccacctaatgatgcaaccactaagcccagcgctgcgtaagtaacggccataccttgtacatatacaaacgacagcgagaacgcttttttagtcgacaaattctgctgacccgcaataaggctcgacaaaatcggaaacattggaaatacgcaaggcgtaaaagccagaccaatacccactaaaaagaagattactaggttagttagtaaaccttgcgatgccagcttatcggtatatgactgctcacctgctggttttgatgcttcttgagagggcgctgatgatgcttcatttgtatcagctgcttgtgttaatgccgctaatgcgttccccgcatctgcagtctgtgatacttgctcacctgcaatcacagataaaggaatggttctaacttctggcggataacataaccctgcttcggcgcagccttgaaaacgcactttaacaactgcaccttctgtgacgttgctgagcttagaaaccacacttaacgaatcaaagaatacctcagtcttaccaaaaaattcatcttcaataatcacgcccttgccaagatcaggaacttcaatatcagcgcctttggcaataatttcgactttctttttgtaaaggtaataatcaggcgcaatatcccagccaataaataaggttttgccttgctggtcaaaatcgaaaacaaacgcctgatcaaccgggagaaatgtttgctccgcaggttgtagtagatttccaagtaaattgttattacttgcacttgctggcataagccacaatgcacaaagtaataaaaggaacgatcgcattaattaagtacctcatccatccaattaaaataggctaaattgcccgtagccacatcaacgacctgaatttcaggcacctcataactatgcaatttcttgatagtttggatcacctcattcattttttctgacttagttttgatcagtaacttactctcaatagcttgagttacctcgccttcccacatgtaaatagattcaatagtaggcaaaatgttcacacaagcagctagcttttctttaactagatgttgngccaactgacgggcttcagcctcatttgcacaagtcgtaaaaataagtcgaaaatgcgtagtcataaggaacctttatttgattacgtgagtcgcaccatagtagccgatagtaactataatgtgtagcgagcaaggtgatcctaggttccgtcttgaaaaatgacctgctcaccccaatttatatttcactgactcgaaagagaatgacattttttagagagcgttatgtttagatttttgtttttgttatttattttagtgccgattgtggagatcgcgttactcatccaagtgagtgaagtgatcggcggctttgccaccatagcgcttgtaattgtgaccgcgattgtcggtgcgaaattagtgaagcagcaaggtatgggcgcgattcaaaacgtgcaattacaaatggcacaagggcaaatgcctgcaaaagaattatttactggattatgtgtgattatcgccggtgttttattaatgacaccaggcatcatgactgacttttttggctttttactacttacgccagcaatccgcaacaaactggctgcaggccttgctagtcaagcgactgtgcgnatgagttcgcaggcaaatcaaggctctgcacacttccaataccanagtaaancnnccnnncangaaganccaaaccatcaacctacaactattgatggtgaatttgagcgaaaagattaaaattttttaatttttntacttggatttttttaagccacccccattaatgaatgcaatgaaacgcaacgggtggcttagcactcccctgcaataacacaagattttttctgtactgttcagaaactgttaggagaactaaataaatgaacattcgtcctttacatgatcgcgtcatcgttaagcgtctagaagaagaaactaagtctgctggcggtattgtattaactggctctgcagctgaaaaatcaactcgcggagaagttatcgctgttggtaatggccgtgttttagacaacggtgaagtaagagcattagaagttaaagccggtgacactgtgctgttcggctcttatgttgaaaaagctgaaaagatcgaaggtcaagagtacctgatcatgcgtgaagataacattctaggcattgtaggctaatcctacttttcgtttagcaacccgtttacagaatttaagaggaatttaatcatggcagcaaaagaagtactttttgcaggtgacgcacgtggcaaaatgctaactggcgtaaacattttagcaaacgcagtaaaagtaactttaggtcctaaaggccgtaacgttgtattagacaaatcattcggcgctccagtgatcactaaagatggtgtatctgttgcaaaagaaatcgagcttgaagacaagttcgaaaacatgggcgcacaaatggttaaagaagtagcgtctaaagcgaatgacgctgcaggtgacggtacaacaactgcaacagtattagcgcaagctatcgtaaacgaaggcttaaaagcagttgcagcgggtatgaacccaatggaccttaagcgcggtatcgacaaagcagttactgcggcagttgaagagcttaaagcactttctgttccatgtgcagacactaaagcaattgcacaagtaggtactatttctgctaactctgataaagaaatcggtgacatcattgcagaagcaatggaaaaagtaggccgtgattcaggcgttatcacngttgaagaaggtcagtcgttagaaaacgaactagacgtagttgaaggtatgcagtttgaccgcggttacctttctccttatttcatcaacaacgctgaaaaaggcgctgtagagctagacaacccattcattctacttgtagacaaaaaagtatctaacatccgtgagctactacctacattagaagcagtagctaaagctagcaagccactacttatcattgctgaagaccttgaaggtgaagcacttgcaacacttgttgtaaacaacatgcgcggtatcgttaaagtatctgcggttaaagcacctggttttggcgaccgtcgtaaagcaatgctacaagacatngcagtgttaacaggtggtactgttatttctgaagaaatcggtttagagctagagaaagcgacaatcgaagacctaggtacagcgaagcgcgttgtgatcactaaagatgatacaacaatcatcgacggtgcaggcgaagaaganggcatcaatggtcgtgttgcacaaatcaaagcacaaatcgaagaagcgacgtctgactacgataaagagaaactacaagagcgtatggctaaactagctggcggtgttgcagtaatcaaagttggcgcagcaactgaaatcgaaatgaaagagaaaaaagaccgcgttgaagatgctctacacgcaactcgcgcagcggttgaagaaggtgttgtaccaggtggtggtgttgcactagttcgcgtagcaagcaaacttgttgaacttgctggcgacaacgaagaccaaagccacggtatcaaagttgcactacgtgcgatggaagcaccacttcgtcaaatcgtaactaacgcaggtgacgaagcatctgttgttgttaactc

SEQ ID NO: 1005 - DNA, 4000 bp, Escherichia coli
  misc_feature (315)..(315): n is a, c, g, or t
  misc_feature (692)..(692): n is a, c, g, or t
  misc_feature (983)..(983): n is a, c, g, or t
  misc_feature (1002)..(1002): n is a, c, g, or t
  misc_feature (1430)..(1430): n is a, c, g, or t
  misc_feature (1541)..(1541): n is a, c, g, or t
  misc_feature (1550)..(1551): n is a, c, g, or t
  misc_feature (1553)..(1553): n is a, c, g, or t
  misc_feature (1601)..(1601): n is a, c, g, or t
  misc_feature (1640)..(1640): n is a, c, g, or t
  misc_feature (2207)..(2207): n is a, c, g, or t
  misc_feature (2387)..(2387): n is a, c, g, or t
  misc_feature (2412)..(2412): n is a, c, g, or t
  misc_feature (2456)..(2456): n is a, c, g, or t
  misc_feature (2462)..(2462): n is a, c, g, or t
  misc_feature (2468)..(2468): n is a, c, g, or t
  misc_feature (2901)..(2901): n is a, c, g, or t
  misc_feature (2980)..(2980): n is a, c, g, or t
  misc_feature (3042)..(3042): n is a, c, g, or t
  misc_feature (3091)..(3091): n is a, c, g, or t
  misc_feature (3104)..(3104): n is a, c, g, or t
  misc_feature (3135)..(3135): n is a, c, g, or t
  misc_feature (3137)..(3137): n is a, c, g, or t
  misc_feature (3262)..(3262): n is a, c, g, or t
  misc_feature (3264)..(3264): n is a, c, g, or t
  misc_feature (3267)..(3267): n is a, c, g, or t
  misc_feature (3286)..(3286): n is a, c, g, or t
  misc_feature (3288)..(3288): n is a, c, g, or t
  misc_feature (3303)..(3303): n is a, c, g, or t
  misc_feature (3315)..(3315): n is a, c, g, or t
  misc_feature (3330)..(3330): n is a, c, g, or t
  misc_feature (3333)..(3333): n is a, c, g, or t
  misc_feature (3336)..(3336): n is a, c, g, or t
  misc_feature (3342)..(3342): n is a, c, g, or t
  misc_feature (3348)..(3348): n is a, c, g, or t
  misc_feature (3389)..(3389): n is a, c, g, or t
  misc_feature (3393)..(3394): n is a, c, g, or t
  misc_feature (3396)..(3397): n is a, c, g, or t
  misc_feature (3399)..(3399): n is a, c, g, or t
  misc_feature (3403)..(3403): n is a, c, g, or t
  misc_feature (3407)..(3407): n is a, c, g, or t
  misc_feature (3409)..(3412): n is a, c, g, or t
  misc_feature (3414)..(3415): n is a, c, g, or t
  misc_feature (3419)..(3420): n is a, c, g, or t
  misc_feature (3424)..(3424): n is a, c, g, or t
  misc_feature (3426)..(3427): n is a, c, g, or t
  misc_feature (3429)..(3429): n is a, c, g, or t
  misc_feature (3462)..(3462): n is a, c, g, or t
  misc_feature (3501)..(3501): n is a, c, g, or t
  misc_feature (3507)..(3507): n is a, c, g, or t
  misc_feature (3534)..(3534): n is a, c, g, or t
  misc_feature (3603)..(3603): n is a, c, g, or t
  misc_feature (3636)..(3638): n is a, c, g, or t
  misc_feature (3643)..(3645): n is a, c, g, or t
  misc_feature (3647)..(3647): n is a, c, g, or t
  misc_feature (3655)..(3655): n is a, c, g, or t
  misc_feature (3657)..(3657): n is a, c, g, or t
  misc_feature (3661)..(3662): n is a, c, g, or t
  misc_feature (3664)..(3664): n is a, c, g, or t
  misc_feature (3670)..(3670): n is a, c, g, or t
  misc_feature (3674)..(3674): n is a, c, g, or t
  misc_feature (3676)..(3681): n is a, c, g, or t
  misc_feature (3685)..(3685): n is a, c, g, or t
  misc_feature (3688)..(3690): n is a, c, g, or t
  misc_feature (3697)..(3699): n is a, c, g, or t
  misc_feature (3703)..(3703): n is a, c, g, or t
  misc_feature (3705)..(3706): n is a, c, g, or t
  misc_feature (3717)..(3717): n is a, c, g, or t
  misc_feature (3720)..(3721): n is a, c, g, or t
  misc_feature (3726)..(3726): n is a, c, g, or t
  misc_feature (3735)..(3735): n is a, c, g, or t
  misc_feature (3741)..(3741): n is a, c, g, or t
  misc_feature (3743)..(3743): n is a, c, g, or t
  misc_feature (3754)..(3754): n is a, c, g, or t
  misc_feature (3792)..(3792): n is a, c, g, or t
  misc_feature (3795)..(3795): n is a, c, g, or t
  misc_feature (3808)..(3808): n is a, c, g, or t
  misc_feature (3811)..(3812): n is a, c, g, or t
  misc_feature (3814)..(3816): n is a, c, g, or t
  misc_feature (3820)..(3821): n is a, c, g, or t
  misc_feature (3826)..(3827): n is a, c, g, or t
  misc_feature (3837)..(3837): n is a, c, g, or t
  misc_feature (3876)..(3876): n is a, c, g, or t
  misc_feature (3878)..(3878): n is a, c, g, or t
  misc_feature (3906)..(3906): n is a, c, g, or t
  misc_feature (3915)..(3915): n is a, c, g, or t
  misc_feature (3918)..(3921): n is a, c, g, or t
  misc_feature (3926)..(3926): n is a, c, g, or t
  misc_feature (3931)..(3933): n is a, c, g, or t
  misc_feature (3940)..(3941): n is a, c, g, or t
  misc_feature (3945)..(3945): n is a, c, g, or t
  misc_feature (3949)..(3949): n is a, c, g, or t
  misc_feature (3951)..(3951): n is a, c, g, or t
  misc_feature (3953)..(3954): n is a, c, g, or t
  misc_feature (3960)..(3963): n is a, c, g, or t
  misc_feature (3965)..(3966): n is a, c, g, or t
  misc_feature (3972)..(3972): n is a, c, g, or t
  misc_feature (3975)..(3978): n is a, c, g, or t
  misc_feature (3987)..(3987): n is a, c, g, or t
  misc_feature (3989)..(3989): n is a, c, g, or t
  misc_feature (3999)..(3999): n is a, c, g, or t
ctactcgttactatgatagcaaggcagaagcaataaaagatcctattgctcagcaagattataaagactctgttaagtatttaggcatctactcttaccagaaatgcttagaaactcaaatcggattaggtcttgaccttaaaggaggtatgaacgtaattcttgagatttcagtaccagatgttcttgaaacacttgcagaccacaaaacagatgctttctttgtgaaggctatggaggaagcaaagaaagaagaagaaacaagccaaggcgattttatttcgttgtttgttaaatcttttaagaagtatgcancaggtcatcgtttagctgaaatctttgcaactcaacagttgcaaggcaagatttcgcctaatagtagcgactctgaggtagagaaagtgttgagagaagaagttaaaaatgctattgataactctttcaacgtagttcgtacacgtatcgacaagtttggtgttgtacagccaaacattcaaaagttagaaggacaagaaggccgaatcatggtcgaaatgcctggtattcgtgagccagagcgtgttcgtaagcttctacaaggaagtgcaaaccttgagttttgggaaacattcaattccgatgagatagttccttatcttgtacagttagaccaacgcttggcaaatggtgaaacaacagccgacacaacagcngttgccgacaccgcaaaggtagctaaagcagcagaacctaagttagagttgaacgctaacaaaaaaggcaatgcaaagctaaatgtaacagacgaggctaagatagcagaagcaaagcgtgctcatccattgctttcaatgcttcaaacaacaggaaacggtgcgcttgcccttgtaggttttgcaagcgttcgtgatacagccgaaatcaacaaagccatctattcagcaacagcaaaacaagtattgccttcagatttgaagctaatgtggagtgctaagccagaaganggaatcaaagcaaagaacntttacggcttatatgcaattaaagtgaccacagcaaacggtagagcgccacttgaaggtgatgttattaccgacgcaaaagaccaatttaacagcgtaacaggtgctcctgaggtaggaatgacaatgaataccgaaggttcaagacgttgggcagctcttacaaaggccaacacaggcaaggcaattgccattgttttggacggagttgtttactctgcgcctcgtgttaatggcgaaatcgatggcggtcaatcatcaatttcaggtagtttcactatcgaagacaccaaagacttggctaatacacttaaatcaggacgtatgccagcacctgctcgcattgttcaagaagaagtagtaggaccaactcttggagcacaatcaattcaacaaggtatcgtttcattcggtattgccttcgtaatncttatgatctacatggtgatgatgtatggtttcacaccaggtatgatggccaaccttgcattgttggttaacttattcttcacacttggtattttaacatcgttccaagcngctctaacnntntcgggaattgccggtatggtgctctcacttggtaccgctgtagacgcnaacgtgttgatatacgaacgtacaaaagaagagttagcnctcggaaaagatacccgtcaggccatgtcagaaggttatcgcaacgcattctcagcgatcttcgactccaacttcacatcaatcatcacaggtatcattctttatgtgttcggaacaggacctattagaggattcgctaccacattgattattggtattatctgttcattcttcaccgcagtttacttaacacgtcttgtattcgagaacagaatgaacaaaggaaagtggttaaatcttactttcacaacaggtatttcaagaaacctaatgaccaacactcacatcggtttcatgaacttctataagaaaacattcagcttcgtaggagtaattatccttgtagctattgtaagttttgcagttagaggtttaagtagaagtatcgacttcacaggtggacgcaactatgttatcaccttcgaacgcccagttgagccagaacaaatacgtggaatcattgcaaatgcattcccaggcacaaccacaagtgcacttgcgttgggtaccgaccacaaaactataagaatttcaaccaactataagatcgaatctaacagtccaacngtagacgacgaggcagaaacaatcttatacaacgcattaaagaaaggtggatttgtatctcaaccaaacgttgaatcattcaagaatccagatattagagaaggcggttcaatcatcagcagtaccaaagtaggaccttcagtggctaaagatatcacccacggagccatcctaagtgtngttcttgcattgttcgcaatcttcntctacattctcattcgtttccgcaacatggcgttctcaattggntcaacnattgcncttgcggtagacaccatcatcgtattaggcgtatatagcctatgttggggttggatgccattctcactcgaaatcgaccaaaccttcatcggagcgatcctaaccgttattggttactcaatcaacgacaaggtggtagtcttcgaccgtattcgtgagaacatgcaactacaccaaaagcaagatttcaagacattgttcaacgacagtatcaaccaaaccctaaccagaaccatcaacacatcaacttcaaccttaattgtgttgttgtgtatcttcttcttaggtggcgaaagcattcgcagtttctcattcgcaatgagtctcggtgttatcgttggtaccctatcatcaatcttcgttgcagcacctattgccttcctaacacttggtaagcaaaaaggaaaaagacgtgcatcagaagaagtagttnaagcataatatacagaaagagatggaagttacacctatttatatataggggtagcttccattttttatctttttatcancaaactacacccctattaccatctaactactatcattttatacattaataaggcagcttttncaaagctaaccctgcaaaaaataaacgattcaatacaatagcccttgtngaaagggtcaacncaagcaaagtgatgctgtagagagtcgtaananatattttattactaacaatttaattcattaaccgattatgaataaaattactttattggcttgcgccttgatgtcgtgtacgctcgcaaatgcacagcgcacacccacccatccattggatattnangangcaaattacgaccaattancntactatttcgaccgntggactccaggnacacagcctcaaggngtntcnagaatngacgangagttctttatctcacgtgtaaagcctcgtaaaagaatcanaganntnnantatnaggntnnnncnnatgnngatncnnancgtaaaatgtgtctttgggtacccctcgacgancccacttctaagtggaaagccctcccacgttattgcttngagggngataactttagtctttggtcttacatngacattcatggtaactggacagcaccatggatgcgtgtttcagcaggcttgtcagacgtagcccataanaatggtgttaaggtaggatgtgtgatgagtatnnnctggnnngnaagaatantncttnntngttggnattnannnnnncacncannngtacttnnnaagntnncagaaaaaganagnnaaggnaactttaanaactcnanaaagcttgtanagttgatgaagtattatggaattgatggtcttggagtnaantcagagttcactnctnnannngganncatgnntactcttatngctttctttgaagattgtcacaaaaaagcaaaagaaatngnttgggaattccaattacattggtacganggaaccaangannnnggtgntattnnnttcgatnnaggncttngntnncacaannnnannatgttnggnnnnaaagatcangnagttaccgana

SEQ ID NO: 1006 - DNA, 4000 bp, Escherichia coli
  misc_feature (126)..(126): n is a, c, g, or t
  misc_feature (1986)..(1986): n is a, c, g, or t
  misc_feature (1988)..(1988): n is a, c, g, or t
  misc_feature (2017)..(2017): n is a, c, g, or t
  misc_feature (2042)..(2042): n is a, c, g, or t
  misc_feature (2277)..(2277): n is a, c, g, or t
  misc_feature (2319)..(2319): n is a, c, g, or t
  misc_feature (2379)..(2379): n is a, c, g, or t
  misc_feature (2418)..(2418): n is a, c, g, or t
  misc_feature (2477)..(2477): n is a, c, g, or t
  misc_feature (2616)..(2616): n is a, c, g, or t
  misc_feature (2826)..(2826): n is a, c, g, or t
  misc_feature (2946)..(2946): n is a, c, g, or t
  misc_feature (3151)..(3151): n is a, c, g, or t
  misc_feature (3854)..(3854): n is a, c, g, or t
aattcgcaaagattagtagaagttgcaaaaagatttggttgtaaagaaagtattctaatgcattctgatcaagaattaccggttgataagattaagaattcaaaaaatataggcattacttccggngcttcagctcctgaaatattggttgagaatttaattaaagaaattaaaagtgttactaatgttaaacttgaagaagtgattacatcggttgaaaatgtttcttttaaacttcctacaatacttattaaataatggctgtttataccaagttagaacatcaagaagtcagacagtttttagagcaatacaatattaataactttaaagattacaaaggaattactgagggcgtagaaaatactaactatcttattaaaacatcagaacaagattatatccttactatttatgaaaaaagagttgatgaaaatgatttgccattctttataaaattattgtcatatttatcagaaaataaatttccttgcccaaaacctattgcaaataagaataatgaaaaaattaacagaattaagaataaaaatgctgctttagtaacttttttaaatggacaatctaagaataagataactagtgaagagtgttttgaaatagggaaaataacagctcaattacatgagataacaaaaaaatttgatattaatagaaaaaataatttatctattgaaaattgggagagtatttttgaaaaaacaatcaaacaaaaaatagatttagacgaatctattattaaaaaaactaagaattatttaaattttttaaaggacaaatggccaaaaaatcttcctcaaggtattattcatgcagatttatttccggacaatatattttttacaaataataaagtttctggaattatagatttttatttcgcgtgtaatgatttctttgcttatgagatagcaatttgcataaactctctatgttttgataacaattctacattcaatatgacaaaggccaaaaatcttatagatggatacacatccataaggactttgagcgaagatgaaaaaaaatatttacctattttgtctatgggtgcggccatgagattttttttaacaaggttatatgatttttatcatacagataataaagcagatgttaaaattaaagatccttttgaataccttaaaaaaattgaatttcattcaactattaaaaattttaacgaatattttatttaatgaatgagattgtaatttatacagacggttcctgcctaggcaatccaggtaaagggggttgggctgctgtaattattaatgacagtatagaagaggtaatatttggatctgaaaaagaatctacaaataatagaatggaattaacagctgctataaatgctttattgaaaatcaaacaagataaaaaaataaagatctacactgactctaagtatgtcaaagatggtattgaaaaatggattaataattggaagttaaataattggaaaaatgccaataaaaaagatgtaaaaaataaagatctttggacaaaattagacagcataattagtaaaaaagaaattacttggaactgggtaaaagctcactcgatcaacgaatacaataacaaagtagacattattgcaaggaatgctgctaatgcaaacgattagcttttatataatttttaattttatttaaattgttaggcagcaccttataaaattctttttttttgagatttttactaatcccactaggaatcttgggattcctttttaatattttataaatagtttctctaaattttgcaggatgcgctgtttctaaacaaaataaattctctgattttttactattatcaagataatagttttctaaagccttcaatccaacagaagaatgtgggtctaatattttactattatatttataaactaacttaatagtttttttagtatcttttgcattcactgactttgaataaaaaatatttttaatatttttnanaatatttctatctatcttataaaaacccntgttattaagctgcttcattaattnagatatttttttagaattattattatagtaagaagaaattaatctttcaaaattactagccacttgaatatccatgcttggtgaaatactaaattttactttggatggtttgtaaattccatttttcaaaaatttatataaaagatcattttcatttgttgcgataattaatttagatataggcaagcccattttgtaagcaatgtatccagcataaatatctccaaaattcccngttggaactgagaagacgctttttttatttttgtcagataancgaaaatgagaataaaaataataaactatctgaacaactattcttgcccaattgattganttaactcctgacatgttaatagatcttctaaagtgacgntcattgaacattgattttactaatgtttgacaatcatcaaatgaccctttaaccgcaanattaaacacattttttgaatttactgtagtcattagctttctctgcgtaatagaaacttttcctcttggatgtaaaacaaaaattcttaaattttttttattttttacagcatcaatggctgcggccccagtatccccngatgttgctgtaactagattaattttatttttactttttgaaagaacagtttcgtacatattgcctatcacttgcattgcaatatctttaaaagctaaagttgggccgtgatataattctactaaattaaatttttttactcttgaaaattttattacattattactatcaaatttattgtaagaattttttataattttttttaactcnttttttgaaaaggtattacctgtataaatctttataatttcgtaagctaaatcattgtaatttaattttgataatcttttcaaagtaatcttagataaacgaggaatcttttttggaatntacagaccgccatcatgcgcaagtccatttaaaaaagtatcaataaaattataagtttttttattatctctagtactgatgtatttcattaagctttcttcctataatataaaaaaaaaattatagtaaacaatgctaacccataccatgttatagcatattgcaaatgattatttgataaacgaacttcataaccattaggaanaatatctttgtttgccgttgaagtttgaataattaataatggataaatattcttatttagagattttttcaaattatcaatctcaattgaatataaaaaatcttctttaatattattattgggagtaaataaacttttttcccttattttttttgtatagccctcaataatgtcatcgttaaacgatgtgttttttattaaattaatcttatcttttctaatccaacctttgtctactaagacaactaatgaactattgacttcataaggaactataactttgaaacctatctctcctttgtttaagtgatataaaaatatttttgattttaaatattttttcttaaataaaacttttgtatattctttatctatatctgcattaaaattaattgaatttttttttagattactttctaaatcagaaattaaattattttttgaatgtaatctaaaaacttgccatgttcctaaggagagaacaataaatataaaaaatataaaaaatatatctaaagatttaattttaaacaaaatactctattaacttccccaaatatatattgaagcaaataagaacagccaaactacatcaacaaaatgccaataccacgccgcagcctcaaatccgaaatgatgatcaggcttataatgcccagcttttgctctaaagtagcaaactgctaaaaagattgttccaacnagtacgtgaaagccatgaaaacctgtggccatataaaaagttgctccataaatgcctgtgctaattttaaaatcagcaacagcatattcgtaagcttgaaaacaggtaaaaataactccaagaattactgttaataacaatccatt

SEQ ID NO: 1007 - DNA, 4000 bp, Escherichia coli
  misc_feature (642)..(642): n is a, c, g, or t
  misc_feature (1127)..(1127): n is a, c, g, or t
  misc_feature (1313)..(1313): n is a, c, g, or t
  misc_feature (1366)..(1366): n is a, c, g, or t
  misc_feature (1475)..(1475): n is a, c, g, or t
  misc_feature (1612)..(1612): n is a, c, g, or t
  misc_feature (1985)..(1985): n is a, c, g, or t
  misc_feature (1987)..(1987): n is a, c, g, or t
  misc_feature (1990)..(1990): n is a, c, g, or t
  misc_feature (1998)..(1998): n is a, c, g, or t
  misc_feature (2014)..(2015): n is a, c, g, or t
  misc_feature (2030)..(2030): n is a, c, g, or t
  misc_feature (2643)..(2643): n is a, c, g, or t
  misc_feature (2939)..(2939): n is a, c, g, or t
  misc_feature (3689)..(3689): n is a, c, g, or t
  misc_feature (3805)..(3805): n is a, c, g, or t
  misc_feature (3981)..(3981): n is a, c, g, or t
tcgtcatcggcacccacgccctaattgaagacaacgtggaattcgcacggctcggtttcgtcgccattgacgagcagcatcgcttcggcgtgctgcagcgcaagcgcctcatggacaaagccgccgcacacggccacgccccacacgtcctcgtcctcaccgccacgcccatcccgcgcacgctttcgctcactctctatggcgacctcgacgtttccgtcctcgacgaactcccgcccggccgcactcccatcgtcacgcgcatgaccacggaacagcatctccccggcgtttgggaatttctccgccgcgaagtcgcggccggacaccagggctacgtcgtttatccggtcattgaggaatcgaagctcgaactgaaagcggccatggaagagtacgagcgattgtcgcgagaagtttttccaaagctaaagcttggcctgttgcacggccgcctctccagcgacgaaaaagaagaagtcatgcagcgtttccgcaaaaacgaagcgcaaattctcgtcgccaccaccgtcgtggaagtcggcgtcgacgtccccaacgccaccgtcatggtcatcgaacacgccgagcgcttcggcctcgcccagctccaccagcttcgcggccgcattggccgcggcncgcaaaaatcccactgcatcctcgtcgccccctttcgtatgactgacgaagcccgcgcgcgcctcgagaccatggtgcgcacctccaacggcttcgaaatcgccgaaaccgatctcctcctccgtggccccggcgaatttttcggcacccgccagtcaggcgacctcggcttccacatcgccaaccccttgcgcgaccgcgaactcctcgaactcgcccgccgcgaagccttcaccctagccgccgattccgcccagcacgaaaccatgcagcgcctcctgcaccaactcccccccgaatggcagcgccgctaccacctcgcccgcatcggctaacggcttagtgggtaggctgccgacaaatctttccagtgacatccatatggggagacattgtcgattttccaggtttgcaacgaatagccttcgaaattataaccaggtcgaggtgacgggcgggcttagagcgcgagtcggatcgtgaanatcttcgcctccaccttaccatcaaggttctgcgcaggctgaaaccaccaccttctggccgcttccattacagctcttacccgctcgccgcattcctcagtcactcccacgttttgaatgtccgtcgcgcgtccctctttgctcacgagaatgttcaaggcgaaggtgccatgacaattgcttggngtagcgggcaactgaatagggcaccagaggcactgcggttctccgatgtgtgnggagctcgccccatcactttctcccctcggcgcttcagtttccaggccgagaggaagaagcttcgcaacctgatctgtcaatggaagtatcgcccagaaagtcatagancgaggtttaggctgaccgatggcgtagaagtcgatccgcactgcgcgctgcatttttgagaatgagccaaatatacaagtttcggcgcctgcttgtcttgcgtacgccctgtccctcttaggatcccaaacgtgccntgcgcggctcccttggtccgcgtcccgattccgcttctcgaggagcgagctgatggtggagcgatcaataacctggagctcgggatggcgttgcgcaacagtcgtcgagatctggtcagccatccagctgccaaacggcgctcgcaaaccttttgggccgacaagatcaaaaacgaccgctttcccagggttcccttcctggataaagcgcgcgagatagtcccccaaatcctcaactctggactggagatcatcctgcggaggcgtcgctgctttgacgtcttgagccgtcccacggccccctaagaagattgcaaatcctatgcagaggtttgtaactaacactcctacaagcatcgttcgcaacatagcnanacnattgtaanacttgacctatcgtgnnacagcggatttcgtntcctcctcattgtcagtaattagcggttctggagcagcaccgcccgcgattctttgtttcttgactaaaaactaaaaaatgacaactaataactgcactcatgcgcgtcatcgccggaacctaccgaagccgcatcctgaagagcctcaaaggcctcgcactgcgccccaccagcgaccgcctgcgcgaaactctcttcaacgtgctggccccgaatataggcggctctcgattcgtcgatcttttcgctggaaccggcgccatcggcattgaggccctcagccgcggcgccgccgaagtcgtcttcatcgaaaatcacgcgcccgccgccacgctgatccgccgcaatctcgaatcattgggcatcaacaccggcgtgaccgtgcttgccgttgatgctcttcgcggcctcgcgatgctggcctcccgaaagcagcactccctcggactcgactacgtttttctcgaccccccctacgccgctgccgaagactactcccgcgtgctagaatttcttggttccacggatcttctcgcgccgagcggcatcgtagtcgccgagcatcgccgcaacttcgacttgcgcgaagaagccggcgtactgcggaggtancgcgttctcagacacggcgacgccgccctgagtttttaccgccgtcgcggcgcggctgccggtgaaaataactctgccgagtaaacccccgcccgcagagtttcatctatgatgaggtgcttgcgcatccttggtctagcgaagcctgagcgttttctttgtagtggcgggcgggtcttcagacccgtcgggttgagcgcgccaagcagggcgcgcgcatcttactaccgtcgagggggaaatttctttgagccaggtcggcagggcactcgatctcttaggacaggccgccaagnctgccgctcccgcacgtctgcgggcaggacacgagccgaatctcgaagtagcctggggaagttttcaccaggggatcggcagcagcctgatcgctatcttcagcagatcaaatgtccccaagcgttttctgcgcggaggattcttcagagattgctggattgaggggcgcattccccgccgtgccctggttgccgccgccttgtggcacgtcgttttcattgtcatgccgttcccgcagctccccgccgcaccgccccactatcccgcgttcgagaacaccgaactcacctggtcgggcccgatcgatgacttacctttggtggagatgaagactcccaaagccaaaccaagcccgcgcggcgagcctgctgctaaacctctccgtcccgagggcgccgacgccttccatccgcggcagcgcatcttcaccgatcccgtacacccgacgcatccgcgccagacgttgatcaattccgccgctcctccggagccgccgaagattcttccgaaccttcccaatctcgtgcaattccagcagatgcccggcccggcgcgtccgcgcctgcagatcagccaggaaacgctctccaagctgcgcccgcgtgagcttcgcaaggttaagttcacctccgcgccggctcctgaccttccaacgctggaccaaaaactctcggatatcgcaccggcaatgttgccaaacgctcccgcgcgtccaaagttggaattgaacgccggcgccgccccgcgantcgcgtcccgtgcgcaagcgggtgaagcagaacctgcgcccgaagttggctcttcccaatccagcgttgcgaatggaaatgccacaacattcatcgctctctccgcgacgcccggnccgcccgcacctgtagtgcaaccgccgcaagggaatctggccgcccgcgtctccatttcacccgaaggcaagcaacccggcgtacccggaggctcgccgaacgggatgcccggcgcaaacggaagcgcgggcggcggaccggatagcagtgggggaaccgcaacgggcaacggcgncgcgaaaaatgacatagac

SEQ ID NO: 1008 - DNA, 4000 bp, Escherichia coli
  misc_feature (834)..(834): n is a, c, g, or t
  misc_feature (1287)..(1287): n is a, c, g, or t
  misc_feature (1856)..(1856): n is a, c, g, or t
ctttttccaattggtccacgatcacggtgatattgccgccactcaccatcatgcggcgtgacaactcgcccatcgtcagaccttcgcggtgacgttcgagctgcgccatcaagtcaaagcgcgatagtgtgatgtcaaatttctcgcgtaatttttgtcgaatcgtttcttcgataagcgtggtgcatgagagcaaacgaagccataagcgcaacgaggcgtggtggtcttcgtgtgcacgtagctcttggtcttgggtttcggtcgccgcattcatcccgccaactccccaccgtcgatagcgatggcttgcccattgatggcaccgcttcctggcccgcatagccacaaaacagcttgggcgatttcttctggttgcaccaattgcttttgtggatttcgatcggctaaagcctggcgcgcttgtgtcggagtttttccagtcttggctacgatgttttcaacagccgattgcacaatgtctgtttcggtgtagcctggacaaatggcattcacggtaatgtttttacgcgcaagctcaagtgccaaagcacgcgtcagaccgatgacgccatgcttggcagcggtgtaggcggatacatacgcgtagccttgcaggcctgctgtgctagccacattaatgatgcggccaggcgcaccgctggaagccgcctgcaacatcgacggtaatgccgcatgcgtgcaaatgtaggtgccagtgaggttggttgtgatcatggattgccacatcgccaggtctgttttgtcgaaaggctgactgctggcttgtcctgcgttgttaaccaagatgtgtatgggacccagcgcttgttnggcagcttgcatcgcagtgtggaccgccgcgttgtcggtgatatcaacagcttcagtatgaacgcgtgtcaacgctcgcagttctgcagcaatattttctaagctatcacgtgatcggccgatcaaggtgaggtgcgcaccggcatgtgcaagtgcgcgcgcaatggccgcaccaatgccacgtgaggcgcccgtgaccacggcatggcgttgttggagcaagggagtgttattcggcatgactatttgctgattggcgtggcgagcgcggcttgtacggcagcacgctcaaaattagtttccagctgtcgtttgccagatatgtagggtttgggccacggcatggcttggtaaccaatacgcgctgcttccgtcaaggtccaagcggggttggccaaatggggacgcgccaccgcacacaggtcggcccgaccagcagcaatgatgctgttnacgtgatcggcttcgcttatggcacccaccgcaatcgtggcaatgccggcctcttgacggatgcggtctgaaaacggagtttgaaacatacgaccaaaaacgggtttttcccgcttgctcacttgtcctgaagaacagtcaatcacatcagcgccggcggctttgaaggctttggcaatcagcaccgcatcggcgggtgtgatgccaccttcaacccaatcatgcgcagagatacgcacggacatgggcagatgctgaggccatgcagcgcgtaccgctttgaacacggccagtgggtaacgcaagcggttttccaagatgccgccatacgcatcggtgcgctgattggtcaacggagaaataaagctcgataacaaatatccgtgtgcgcaatgtaattcaagccagtcaaaacccgcctccgcggcacgaagtgtggctgcaacaaagtcagcggtcacgcgggccatgtctgtttcggtcatggcccgtgaggtttgactttcaccgtcgatgtattgctggggggaggcgctgatcaaaggccagttgggctcggtgtcgtcagntgccaagggttggtcaatgccatcccaagcacgtcttgtggagcctttggcaccagcatggcctatctgcaccgccatgcgcgccccgctatgttgatgtgcccagtcgacgatttttttccatgcgagtttttgcacatcattccacaagcccggacagccgggggtaatgcgggcatccgcgctcacgcaagtcatttcagcgaacaccatgccagcaccacccatggcgcgcgcgccgaggtgaaccaagtggtagtcggtgggaatgccatcatgtgcggaatattgcgccataggagatacgactacacggtttttgagcgtgatggatcgcaaggtgtacggggtgaacatggggggcgtcgttgtcactgcggtcgatgcctcgctcatgaactgctgggcaaaccaattttcataaccgtccagccatgttttgtcccgcagacgcaggttttcgtggctgatgcgctggctgcgggtcaacatcgaatacatgaattgttcaggttcaagttggtcgcaatagcgctcaccacaaacttcaaaccactccatggcattccatgctgcgttttgaattttgagtgtttcgatgcgccggctttcttggtagtcggtgagtacatttgaaatgtgagcgggctcacagccatgaatttcgaattggtgcgtcagttcaattgcatcttccaaagcgagtttggtgcccgagccaatcgcaaagtgggccgtatgcacagcgtcacccatcagcaccacatagctaccgtgtttgttttttagccaccactgttcgcacacaacgcgctgaaagttcaaccaagcggagcctctcagatgacgcgagttggtcatgagtttggcgccttgcaagttgtctgcaaagagttgttcgcaaaacgtaatcgattgctcttggctggccttgtctaaaccgtgtgccagccacacagactcggggcactcggcaataaaagtggccgtgtcatcgtcaaatttgtaaatatgtgcctgaaaccaaccgtgtacagttttcttgaaatcaaatgtgaaggcgtcgtattgacggtgggtacctagccaaatatagcgattagggcgcgtggcaatatcgggtttgaatacatcttcgtattgcgtgcgaattttggagttgatgccatcgctcgcgataattaagtcagcatcaggaaaatctaagtctgaattcacatcgcaatcaaatttcaggacaacgcctagttcttcgcaacgtacttgcagaatattcagtaattttttacgacctatgcctacaaagccatgaccaccggatcttatagttcgacctttgaacaagagttcaatgtcatcccaatggttgaaggcttcttgaatttgatcggcggtagtgcgatcccattgccgcatgttgtccatcgtggcatcggaaaacacaacgccccagccaaacgtgtcgtagggtaagttgcgctccaccacagtgatttggtggtcgggccaccgagctttcatgagcaagccaaagtacaaaccagctggaccaccaccaatacaaacaatgttcatgctccgctccagatttgcttttatattgaatatttcaatattaaaataaatatcttcgaaaattcatgaactgtcaataggggttttaaatcttttttagaaaaagaactcagtaaggtttgactgatctgagtgcggcgtcagcagggtcaaactgtaaatattgtcttcagtatgtactctaatgaatgggctaatcgacttgggttcgaactagtgacctaaggtttgagagctaacccattcaccaaaacaccttggtctgagaactgttgcgccttagccttgccaatacctgcaacgcgagacatcaaatctttccaattcataaaaggcttgtcagcacgcgctgttaatactttgcgcgtcattgcaggtcccaaacctttgatgctgtcgagttctgcttcgttggcttggttgatctctaatgccaatacgcttaggcaggcgcacgccaatgctccaactaaccaatgcttaagcaagtaacgctgccatgtaatgcgtgacgccagtggccacatctgcaaacacatggttgcaacccgtgctgcgtaagaggttca

SEQ ID NO: 1009 - DNA, 4000 bp, Escherichia coli
  misc_feature (81)..(81): n is a, c, g, or t
  misc_feature (143)..(143): n is a, c, g, or t
  misc_feature (157)..(158): n is a, c, g, or t
  misc_feature (165)..(165): n is a, c, g, or t
  misc_feature (176)..(176): n is a, c, g, or t
  misc_feature (196)..(197): n is a, c, g, or t
  misc_feature (199)..(199): n is a, c, g, or t
  misc_feature (250)..(250): n is a, c, g, or t
  misc_feature (252)..(252): n is a, c, g, or t
  misc_feature (262)..(263): n is a, c, g, or t
  misc_feature (269)..(269): n is a, c, g, or t
  misc_feature (460)..(460): n is a, c, g, or t
  misc_feature (469)..(469): n is a, c, g, or t
  misc_feature (1011)..(1011): n is a, c, g, or t
  misc_feature (1985)..(1985): n is a, c, g, or t
  misc_feature (2004)..(2004): n is a, c, g, or t
  misc_feature (2012)..(2012): n is a, c, g, or t
  misc_feature (2016)..(2016): n is a, c, g, or t
  misc_feature (2018)..(2018): n is a, c, g, or t
  misc_feature (2036)..(2036): n is a, c, g, or t
  misc_feature (2059)..(2059): n is a, c, g, or t
  misc_feature (2129)..(2129): n is a, c, g, or t
  misc_feature (2237)..(2237): n is a, c, g, or t
  misc_feature (2938)..(2938): n is a, c, g, or t
  misc_feature (3011)..(3011): n is a, c, g, or t
  misc_feature (3075)..(3075): n is a, c, g, or t
  misc_feature (3206)..(3206): n is a, c, g, or t
  misc_feature (3404)..(3404): n is a, c, g, or t
  misc_feature (3413)..(3413): n is a, c, g, or t
  misc_feature (3764)..(3764): n is a, c, g, or t
  misc_feature (3899)..(3899): n is a, c, g, or t
  misc_feature (3931)..(3931): n is a, c, g, or t
  misc_feature (3933)..(3933): n is a, c, g, or t
  misc_feature (3935)..(3935): n is a, c, g, or t
  misc_feature (3999)..(3999): n is a, c, g, or t
gttgacgaaataggcctcaaactcggtgacactcagttggcgggtgtcggcgggcacgaaggcgaggtggaggttgaggtngtcggcgccttttcgctcgaggggacgggggcggaaggtgatttcgcgatcggcgggatcgncgttttcgtcggcnngggcgtnggtttcgtcgncttcgtcgccttcgtcttcnncntcgtgggcggcgagggcggctttgacgctggtgtgggtttcgccggcggcnanttgtgcgcgnnttttgngctcggcggcgtcataggggttgatttccttgctcttgcggccgggggcgggtttgcgctcgaggttgtaggcgtcggtgtctaccacaacgatttcgtggcggagggtgggcacttcaaatccgtcttcgtcggtgacgaggacgaggtctttaccttgaaatccggtgatgcggcctccgccgaccgcnttgagaaancgaactttgtctccgatgttcataaaatggggatgttttggggcaaaggtacaaaaaaatccgtgtgacacgtcgcacgggaacaaaaaatccccgtcgccacatgggcaacggggagttctatttaggatcgatcctaagatcgttctctgtcgctattattcagcgatgcagataacgacgcggttctgatcgttgacagcgaagggctgaacagtgtcaccctttgcgtctttgatgatgcggtttgcagcgatgttgcgcttaacgagctcagcgaagacagcgtttgcacgttgcttggagagacggctgttgatcactgcgttacccgttccgcggtcggcataaccggtgatggaaaccttggcgttggggttttgcttgaggtagttcaccacttcgttcaccttcacgatttcgctggggcgtacctttgcggaattgatgaggaagaatacgttgcgggtgaggctttgtacctgaacgggagcaggtgcgggagcaggagcgggagcgggtgcgggtgcgggctcaacaanttcctcttccttcacttcttctacgacaggagccacaacgggagccggagccaccacaacgggtgcagcttcgccgatgcgtccgagacggaacttcagacctgcataagcgtcgaagagccagtcggcgttgccaccgtccttggagttgaacttatcggaggtgacggtagcgagaccttcgaggttgaaggaaacgcgcttggcaagacggaagtcaaattgcacaccaccgcgaccgctgacaacgttcagcttgttcttctcccagaggagctgcatttctgcggggtgaccgagagtgtacttgtcgttgtatgcgtcctcattcttgaagccgtggatgtaacccacaccgaggataccgtaaacggtgaagaaacggttggggttgtagtggctgaagatggtgttgaggtcgagcatagcgtcgaggccgagttgaccgtagttccacttgtagtagtccatacgatcgtggttgtaatcccagccgttcttagcttcccagccgctggcgtggagacgcaagcctacgggacgcgagaaacgatagcccaccgagaaagcagcggcgggagaaatggtcttcgaccacttaaggtgctcaccgtaagtggtagccgcgccaccctgaagaccgatcgtccaataagggctgaaatcatacttggccgagctctgtgcgttggcaccgagagccactgctgcgagagcagctaccagaaaagttctgaatttcataactgtggttatattattgagttgaattatgcgatgcatagtgccgaaggtgcgaagtttcttcggttccgcgtccaaagtcctgcacttttctactattactcgttgcaaaggtaagccttttcagagagccacccaatgtttttaaggaaaaaaaggagctcagacacaatataaaagaagaagctttggataaatggcgcttttggcacgcgcattcggcacttttngggtcaaaatggctgatgnggtcgtgntatngncccaccatgaccttgtgnccgccttgaatttgcacgccggnggtgcctttcggggctttgcggccggtgagatcgaaattgtcggcggcttttgcggaaaaatcggctgtntttccggcaaatcccccttgtttttgcgtttcgtcgcccagtttcacggcttcgatgcccacgagggggttttgctcacgcgtttggtagacgcgcacccagtcgaancgcgtttcgtagcggaagttcatgtcgggacctgccgcccaactgccgtcgcccacgctctggttgaggatgagatagaagggttcggtgtaaggccactgcccgttggccaaggcatcggcgttggtgctcttcaccgcggtgccggccacttttccgtcgacgctccatgtgatttgggtcggtgtccactcgacggcgaaggtgtggtagcgcgaatagtcgatgtcgcccatcgcaaagtgcgacatcgggtcgtttttgtgcttgaggttgaacgtccaattggagtgcagggtgtgataggccttgttttcgttgttgatctgctcccaaatgtcgatttctccctcgtgcggccaaccttttttgcttttggcaggcatcatccagaaggcggggaagttgccgctgtggggggtggtgaaaatacgcgcctcggctcgaccgtagcggaaggagtagcggccttcacttcgcactccgccggtgatgaagtccttttgttcgccctttgccttgagggaatcgggcgtggccatggcgcggcacaccaattctccgttctgcacgaagaccgtgaggggcgaatcggagtggaagcgggcccaggtgggattgcggcggacggtgcgcgaccagattttggcgttgggctgcgaaccgtcgggggcatcgaactcgtcggcgaaggcgggcanatattttgcgttttggccgggcacatagtgggcgatgatgcgcacgtcgccctgcatgactgcggcgggaagngtgattcggccgtcggcggcgggggtgaactcggtttcggtccactgcggcgtgccgcccacgntggagggaccgtcgagttcgcggccgtggcgcacggcgaagcgctcgagttcataaccggcatcgggggtgacgacgcggagggcgagggcttcgtcggaagccacggtgaggggcagcgcgccgtcgggngcatagagattggcgttgcgcgtatcgagactcaggcgggactcggcgtaggctttgcccttgacttcgagccaggtgtcgacgatggcgccgcgattggtgaggatgccgtttttgcccttggcgctgttttccgatccgagtgagccggcgggatccacattgtcccagtcgactttgaaacgcaggcggtagcgnccgggcgcnaggttggcgggcaggcgaaacgcggggggattgagtgcgctgccgtaaccttggacgttgggcgcgatggtgcggccggtcatgtcctgaccttgatagtaggaataggcgaggaggtcgccgtcgctggtgaagttgccgtcactgtcgcggtctacgaagacgtatccgtgcatccacgtggcgccattgttgccgtaatcgaagcgcacctcgacgcgatcgccgggacgtgcggtgagggtttcggctgtgaggtcggtgtagggggcggggttggcaatggtgagccgacgggcgccggccgaggtggtaaaggtgacgccgcgcaaaggacggtcggcggaaacngcgggcgcattcttgtcgaagtgcaggggatagtcggattgcgccgcggctccgagcgggagcagcagggcgaaggcgaggaggtagggtttgatcatgcgatgaaagagatgataggagggagggaggttcggncggcggggacagaccgaacggagatgggccgncngngctacgcctcggggacgggcgaagggccgggcggaggaaaaacaaaaaggcatacgagataccnt

SEQ ID NO: 1010 - DNA, 4000 bp, Escherichia coli
  misc_feature (131)..(131): n is a, c, g, or t
  misc_feature (1046)..(1046): n is a, c, g, or t
  misc_feature (1822)..(1822): n is a, c, g, or t
  misc_feature (1987)..(1987): n is a, c, g, or t
  misc_feature (1992)..(1992): n is a, c, g, or t
  misc_feature (2010)..(2010): n is a, c, g, or t
  misc_feature (2665)..(2665): n is a, c, g, or t
  misc_feature (2674)..(2674): n is a, c, g, or t
  misc_feature (2758)..(2758): n is a, c, g, or t
  misc_feature (3088)..(3088): n is a, c, g, or t
  misc_feature (3301)..(3301): n is a, c, g, or t
  misc_feature (3367)..(3367): n is a, c, g, or t
  misc_feature (3376)..(3376): n is a, c, g, or t
  misc_feature (3394)..(3394): n is a, c, g, or t
  misc_feature (3412)..(3412): n is a, c, g, or t
  misc_feature (3445)..(3445): n is a, c, g, or t
  misc_feature (3451)..(3451): n is a, c, g, or t
  misc_feature (3457)..(3457): n is a, c, g, or t
  misc_feature (3478)..(3478): n is a, c, g, or t
  misc_feature (3484)..(3484): n is a, c, g, or t
  misc_feature (3487)..(3487): n is a, c, g, or t
  misc_feature (3493)..(3493): n is a, c, g, or t
  misc_feature (3499)..(3499): n is a, c, g, or t
  misc_feature (3503)..(3503): n is a, c, g, or t
  misc_feature (3505)..(3505): n is a, c, g, or t
  misc_feature (3526)..(3526): n is a, c, g, or t
  misc_feature (3529)..(3529): n is a, c, g, or t
  misc_feature (3538)..(3538): n is a, c, g, or t
  misc_feature (3541)..(3541): n is a, c, g, or t
  misc_feature (3544)..(3544): n is a, c, g, or t
  misc_feature (3550)..(3550): n is a, c, g, or t
  misc_feature (3553)..(3553): n is a, c, g, or t
  misc_feature (3556)..(3556): n is a, c, g, or t
  misc_feature (3559)..(3559): n is a, c, g, or t
  misc_feature (3576)..(3576): n is a, c, g, or t
  misc_feature (3580)..(3580): n is a, c, g, or t
  misc_feature (3595)..(3595): n is a, c, g, or t
  misc_feature (3598)..(3598): n is a, c, g, or t
  misc_feature (3601)..(3601): n is a, c, g, or t
  misc_feature (3607)..(3607): n is a, c, g, or t
  misc_feature (3610)..(3610): n is a, c, g, or t
  misc_feature (3616)..(3616): n is a, c, g, or t
  misc_feature (3618)..(3619): n is a, c, g, or t
  misc_feature (3628)..(3628): n is a, c, g, or t
  misc_feature (3637)..(3637): n is a, c, g, or t
  misc_feature (3643)..(3643): n is a, c, g, or t
  misc_feature (3646)..(3646): n is a, c, g, or t
  misc_feature (3652)..(3652): n is a, c, g, or t
  misc_feature (3655)..(3655): n is a, c, g, or t
  misc_feature (3679)..(3681): n is a, c, g, or t
  misc_feature (3694)..(3694): n is a, c, g, or t
  misc_feature (3696)..(3696): n is a, c, g, or t
  misc_feature (3709)..(3709): n is a, c, g, or t
  misc_feature (3718)..(3718): n is a, c, g, or t
  misc_feature (3726)..(3726): n is a, c, g, or t
  misc_feature (3808)..(3808): n is a, c, g, or t
taacgcccttctatcctgaaggtggtgggcaaattggggattcgggtaccttagttcagggcgatcacaccatacacctcactaccacgaaaaaagagaatggtgttattgtgcattttaccgacgatttncccgcggagttaggtggtcagtggaaggcgacagtgaatgttgccgatcgtaatgaaactgcgaaaaatcacagtgcgacccacttgatgcatgaagtgttacgcgaagttttgggcacgcacgtcgaacaaaaaggctcgctggtacgtccagattatttgcgttttgacttttctcatttccaaaaggtaagtgcggaggaattggccaccattgaaactaaggtaaacgagcgtattcaagccaattatacgctcgaagaataccgcaacattcctattgctgaggcgaaggatatgggagctatggcactcttcggcgagaagtatggcgataccgttcgcgctattaaatttggttcatctgtcgaactttgtggtggtattcacgtgcctgccacgggctctataggactctttaagtttatttctgaaggtgctgttgcagcgggtgttcgtcgtgttgaagcggtgaccggtagaggagctctagactatgtcaatgctgagctcgcaaaactgcgtgcggcggctgaggtgttgaagcatccgcaggatttggccagtgcattgcagcagttgaaggagaaggaggccgccgcgcagaaagaaattgacgcattgcgtaaagaaaaagcaatgggagcggtagcagaattagaaaacggtgcagaggcatttaatggagccagagctattgttgcacggaccacgcttgatgcaggcagtgtaaaagatttagttttcaaactcaaagcgacgccaggcactttagtcattttaggcaatgttgtcgagggcaaggttaccttgagcattggggttagtgacgaccttatcacggataaggggtggcatgcgggcaatgccgtacgcacattagcaagacacatcagtggtggtggaggcggtcancccggcttcgctacagcaggaggtaaaaatcctgatggcatagataaagtattagtagaatggaaaaacgaattctcatgatgaaaacagccttacgattattccttgtagttggcttatttcctgtagcgctgatggctcagaaaacagagcccatcgaatactacactgatagtgatattaacgacacaaagttttctttagcggctagttatgctccttctttttcgggacgccgcttggcattgtatactcccgtacaggacggaacggaattatttgccctcacgaatgaagatggtggtggtgtgctgggccaacgttatggattttctttgttttatgaactgcgcagcatgttccacattggtatcggttggtcgcaagagcacagtggttatttgaccaaaggatttgcggtgtttgatcaaaatgcgatcttccaagataccattgggacatacacggcaaaaacgtcgtacaatgcgataaacattcccattcaaatcgtcttccacacacaaatgacggatgtttgggcgttgcaggtcataccttcttatgaccttacgttttattcaggcatccaacgcgaatggatcggtgatgaggtgcccaattttccagcggatgccgctacaggagtattgggatcgttgtacgaacgcggtacagaagtgaaatacatgacgggcttcaatggatctattggctttgctatcgggaacgaatttaccatagcaaataacctcgccctcactgtgcgtggtgaattncgttacggcttgttgcctatcaataaggaggatataggtcttcgtgaagtgccctatggggtaggcgcagcggttgggttccgttattacttataagcagttccctgcagtaaaggcataaaaaaatccgggcgcatacgcgcccggatttttttgtgttcggtnatttngattattccgccgatgcngaatctgcggcctcgacagcagcttccgttgcttcttcttcactaggcgtttcgcggttttcattcaacatgttcaccatacgctcagtaatgtcaaactcatcgttcgcataaatgatttgaccgccttcttcgtagagaagaataaagtccaggttcaactcttctttgagcacttcaatggcgctgttcatgtcttcgcgcatcacgagcgtgaggtcattttggcgtttcatcatctggctttgtgcagcttgctctacttgaagatagttttgttgaacgcgacgtagatcggcttcatttgcttcgcgctgacgcgccgtcatttttggtgcctcttgctgataaagctcgagattagtctgcaattcttgttggcgacgttgcaattcaatgataattttttcttcttccgcttgcagttctccaaccaattcctggaagtagttgtactgactctgcaaagagtcaattcgtacataggctaaacgaatgcctttatctgtgttttcaactgctgccggttgctgacaacttgcgagcatgcttagaccgattgcggccaaaaagaactttttcattttaaaaatctaggttgttcaatacgtttttatctacgagcttcggtacagtcactttcaaattaggggtncgctgcatntcgcgctcaatggcgaatatagcttctttatttctagcccaagatcttctggcgatgccattattgacatcatagagcagcatnttttctaatttacgctcagcttcatcagaaccgtcaagcaacattccgaatccgccgttgatcacttcgccccatccgacgccgccgccgttgtggatgctaacccaagtcgcacctcggaagctgtcgccaatcacgttctggatggccatatctgcggtaaagctcgacccgtcgtagatgttcgaagtttcacggtacgggctgtcggttccactgacatcgtggtggtcacggcccagaacgactggcccaatctcgcctgcagcgatggctttattgaaagcgcgggcaatctcaatacgaccttcgctatcggcatagaggatncgcgcctgagaacccacgactaatttgttttccttcgcgcctttgatccaacgaatgttgtcgtccatttgctcgcgaatttctttcggtgccttggccatgagtccttccaagatttcttgtgcgatggcatcggtcttatctaaatcggccccatcgccactggcacatacccagcggaacggaccaaagccgtagtcgaaacacataggncccataatgtcctgcacgtacgaagggtagcggaataattcgccgtcttcatccatgatttctgcnccggcgcgngagctttccaataagaangcattgccgtaatcgaanaagtacatgccgttttctacgagcgcattgacngccttnacgtgncgcttcaaggtcgcttggatncgtacnttnaactcntcaggnttantngccatcatctcgttcgactcntcntagctcatnccntgngggtantanccnccngcccaagggttgtgcanggangtctggtcagaaccnagntcnacgtgnacnttgcgntnnaccatgcgntcccagagntccacnatntttccnatntaggcgatgcttcgtgcgcgtttnnntgcctggaattcnanggccatgtcgatngcctcatcngtgctggnggtaatctcgtccacccagccctgctcgtgacgtttgtaggctgcctttgggttgatttctgcggtgatgctcacgaccccngcaatgtttcctgcctttggctgcgctcctgacataccgcccaatcccgcagtgacaaatagttttccttccggtccgccgctagatttcatgcgtgcagcattcaatacggtgatggttgttccgtgtacgatcccttgtggcccgatgtacatgtaagaaccggccgtcatttgaccgtattgggtaacg

SEQ ID NO: 1011 - DNA, 4000 bp, Escherichia coli
  misc_feature (2587)..(2587): n is a, c, g, or t
  misc_feature (2601)..(2601): n is a, c, g, or t
  misc_feature (2610)..(2610): n is a, c, g, or t
  misc_feature (2612)..(2613): n is a, c, g, or t
  misc_feature (2615)..(2615): n is a, c, g, or t
  misc_feature (2621)..(2621): n is a, c, g, or t
  misc_feature (2624)..(2627): n is a, c, g, or t
  misc_feature (2629)..(2631): n is a, c, g, or t
  misc_feature (2634)..(2634): n is a, c, g, or t
  misc_feature (2640)..(2640): n is a, c, g, or t
  misc_feature (2643)..(2646): n is a, c, g, or t
  misc_feature (2648)..(2649): n is a, c, g, or t
  misc_feature (2653)..(2655): n is a, c, g, or t
  misc_feature (2660)..(2660): n is a, c, g, or t
  misc_feature (2664)..(2664): n is a, c, g, or t
  misc_feature (2666)..(2667): n is a, c, g, or t
  misc_feature (2673)..(2673): n is a, c, g, or t
  misc_feature (2679)..(2679): n is a, c, g, or t
  misc_feature (2682)..(2682): n is a, c, g, or t
  misc_feature (2685)..(2685): n is a, c, g, or t
  misc_feature (2689)..(2691): n is a, c, g, or t
  misc_feature (2694)..(2694): n is a, c, g, or t
  misc_feature (2697)..(2697): n is a, c, g, or t
  misc_feature (2706)..(2706): n is a, c, g, or t
  misc_feature (2708)..(2709): n is a, c, g, or t
  misc_feature (2712)..(2715): n is a, c, g, or t
  misc_feature (2724)..(2724): n is a, c, g, or t
  misc_feature (2727)..(2727): n is a, c, g, or t
  misc_feature (2732)..(2732): n is a, c, g, or t
  misc_feature (2736)..(2736): n is a, c, g, or t
  misc_feature (2762)..(2762): n is a, c, g, or t
  misc_feature (2766)..(2766): n is a, c, g, or t
  misc_feature (2769)..(2769): n is a, c, g, or t
  misc_feature (2778)..(2778): n is a, c, g, or t
  misc_feature (2781)..(2781): n is a, c, g, or t
  misc_feature (2783)..(2783): n is a, c, g, or t
  misc_feature (2793)..(2793): n is a, c, g, or t
  misc_feature (2799)..(2799): n is a, c, g, or t
  misc_feature (2801)..(2802): n is a, c, g, or t
  misc_feature (2815)..(2815): n is a, c, g, or t
  misc_feature (2819)..(2820): n is a, c, g, or t
  misc_feature (2823)..(2823): n is a, c, g, or t
  misc_feature (2826)..(2826): n is a, c, g, or t
  misc_feature (2828)..(2829): n is a, c, g, or t
  misc_feature (2831)..(2832): n is a, c, g, or t
  misc_feature (2834)..(2834): n is a, c, g, or t
  misc_feature (2838)..(2838): n is a, c, g, or t
  misc_feature (2840)..(2840): n is a, c, g, or t
  misc_feature (2844)..(2844): n is a, c, g, or t
  misc_feature (2850)..(2850): n is a, c, g, or t
  misc_feature (2852)..(2852): n is a, c, g, or t
  misc_feature (2859)..(2859): n is a, c, g, or t
  misc_feature (2862)..(2864): n is a, c, g, or t
  misc_feature (2883)..(2883): n is a, c, g, or t
  misc_feature (2892)..(2892): n is a, c, g, or t
  misc_feature (2895)..(2895): n is a, c, g, or t
  misc_feature (2898)..(2898): n is a, c, g, or t
  misc_feature (2902)..(2904): n is a, c, g, or t
  misc_feature (2913)..(2913): n is a, c, g, or t
  misc_feature (2919)..(2919): n is a, c, g, or t
  misc_feature (2921)..(2922): n is a, c, g, or t
  misc_feature (2925)..(2925): n is a, c, g, or t
  misc_feature (2928)..(2928): n is a, c, g, or t
  misc_feature (2934)..(2934): n is a, c, g, or t
  misc_feature (2936)..(2937): n is a, c, g, or t
  misc_feature (2943)..(2943): n is a, c, g, or t
  misc_feature (2949)..(2949): n is a, c, g, or t
  misc_feature (2958)..(2958): n is a, c, g, or t
  misc_feature (2963)..(2964): n is a, c, g, or t
  misc_feature (2966)..(2966): n is a, c, g, or t
  misc_feature (2970)..(2970): n is a, c, g, or t
  misc_feature (2973)..(2973): n is a, c, g, or t
  misc_feature (2975)..(2975): n is a, c, g, or t
  misc_feature (2979)..(2979): n is a, c, g, or t
  misc_feature (2982)..(2982): n is a, c, g, or t
  misc_feature (2991)..(2994): n is a, c, g, or t
  misc_feature (2997)..(3000): n is a, c, g, or t
  misc_feature (3003)..(3003): n is a, c, g, or t
  misc_feature (3006)..(3006): n is a, c, g, or t
  misc_feature (3008)..(3011): n is a, c, g, or t
  misc_feature (3015)..(3015): n is a, c, g, or t
  misc_feature (3021)..(3021): n is a, c, g, or t
  misc_feature (3024)..(3024): n is a, c, g, or t
  misc_feature (3026)..(3027): n is a, c, g, or t
  misc_feature (3039)..(3041): n is a, c, g, or t
  misc_feature (3043)..(3045): n is a, c, g, or t
  misc_feature (3048)..(3052): n is a, c, g, or t
  misc_feature (3054)..(3054): n is a, c, g, or t
  misc_feature (3063)..(3063): n is a, c, g, or t
  misc_feature (3066)..(3066): n is a, c, g, or t
  misc_feature (3069)..(3069): n is a, c, g, or t
  misc_feature (3075)..(3075): n is a, c, g, or t
  misc_feature (3083)..(3084): n is a, c, g, or t
  misc_feature (3086)..(3086): n is a, c, g, or t
  misc_feature (3088)..(3090): n is a, c, g, or t
  misc_feature (3093)..(3093): n is a, c, g, or t
  misc_feature (3099)..(3099): n is a, c, g, or t
  misc_feature (3102)..(3102): n is a, c, g, or t
  misc_feature (3108)..(3108): n is a, c, g, or t
  misc_feature (3117)..(3118): n is a, c, g, or t
  misc_feature (3121)..(3121): n is a, c, g, or t
  misc_feature (3123)..(3123): n is a, c, g, or t
  misc_feature (3131)..(3131): n is a, c, g, or t
  misc_feature (3133)..(3139): n is a, c, g, or t
  misc_feature (3141)..(3142): n is a, c, g, or t
  misc_feature (3144)..(3152): n is a, c, g, or t
  misc_feature (3154)..(3156): n is a, c, g, or t
  misc_feature (3158)..(3158): n is a, c, g, or t
  misc_feature (3160)..(3160): n is a, c, g, or t
  misc_feature (3162)..(3162): n is a, c, g, or t
  misc_feature (3164)..(3166): n is a, c, g, or t
  misc_feature (3170)..(3172): n is a, c, g, or t
  misc_feature (3174)..(3176): n is a, c, g, or t
  misc_feature (3178)..(3185): n is a, c, g, or t
  misc_feature (3187)..(3188): n is a, c, g, or t
  misc_feature (3190)..(3197): n is a, c, g, or t
  misc_feature (3199)..(3199): n is a, c, g, or t
  misc_feature (3202)..(3203): n is a, c, g, or t
  misc_feature (3206)..(3206): n is a, c, g, or t
  misc_feature (3208)..(3214): n is a, c, g, or t
  misc_feature (3216)..(3216): n is a, c, g, or t
  misc_feature (3220)..(3222): n is a, c, g, or t
  misc_feature (3225)..(3225): n is a, c, g, or t
  misc_feature (3228)..(3236): n is a, c, g, or t
  misc_feature (3238)..(3245): n is a, c, g, or t
  misc_feature (3247)..(3249): n is a, c, g, or t
  misc_feature (3251)..(3252): n is a, c, g, or t
  misc_feature (3254)..(3257): n is a, c, g, or t
  misc_feature (3259)..(3259): n is a, c, g, or t
  misc_feature (3262)..(3265): n is a, c, g, or t
  misc_feature (3267)..(3273): n is a, c, g, or t
  misc_feature (3275)..(3275): n is a, c, g, or t
  misc_feature (3277)..(3278): n is a, c, g, or t
  misc_feature (3280)..(3286): n is a, c, g, or t
  misc_feature (3289)..(3291): n is a, c, g, or t
  misc_feature (3293)..(3293): n is a, c, g, or t
  misc_feature (3295)..(3295): n is a, c, g, or t
  misc_feature (3298)..(3302): n is a, c, g, or t
  misc_feature (3304)..(3304): n is a, c, g, or t
  misc_feature (3306)..(3307): n is a, c, g, or t
  misc_feature (3309)..(3309): n is a, c, g, or t
  misc_feature (3311)..(3311): n is a, c, g, or t
  misc_feature (3313)..(3319): n is a, c, g, or t
  misc_feature (3321)..(3323): n is a, c, g, or t
  misc_feature (3325)..(3325): n is a, c, g, or t
  misc_feature (3327)..(3336): n is a, c, g, or t
  misc_feature (3339)..(3341): n is a, c, g, or t
  misc_feature (3344)..(3345): n is a, c, g, or t
  misc_feature (3347)..(3349): n is a, c, g, or t
  misc_feature (3351)..(3352): n is a, c, g, or t
  misc_feature (3355)..(3357): n is a, c, g, or t
  misc_feature (3359)..(3360): n is a, c, g, or t
  misc_feature (3362)..(3364): n is a, c, g, or t
  misc_feature (3366)..(3366): n is a, c, g, or t
  misc_feature (3368)..(3374): n is a, c, g, or t
  misc_feature (3376)..(3385): n is a, c, g, or t
  misc_feature (3387)..(3394): n is a, c, g, or t
  misc_feature (3396)..(3398): n is a, c, g, or t
  misc_feature (3402)..(3402): n is a, c, g, or t
  misc_feature (3405)..(3407): n is a, c, g, or t
  misc_feature (3410)..(3417): n is a, c, g, or t
  misc_feature (3419)..(3420): n is a, c, g, or t
  misc_feature (3422)..(3431): n is a, c, g, or t
  misc_feature (3433)..(3435): n is a, c, g, or t
  misc_feature (3437)..(3437): n is a, c, g, or t
  misc_feature (3439)..(3442): n is a, c, g, or t
  misc_feature (3444)..(3444): n is a, c, g, or t
  misc_feature (3446)..(3446): n is a, c, g, or t
  misc_feature (3448)..(3448): n is a, c, g, or t
  misc_feature (3450)..(3450): n is a, c, g, or t
  misc_feature (3452)..(3452): n is a, c, g, or t
  misc_feature (3454)..(3456): n is a, c, g, or t
  misc_feature (3458)..(3459): n is a, c, g, or t
  misc_feature (3461)..(3464): n is a, c, g, or t
  misc_feature (3466)..(3466): n is a, c, g, or t
  misc_feature (3468)..(3469): n is a, c, g, or t
  misc_feature (3472)..(3472): n is a, c, g, or t
  misc_feature (3474)..(3474): n is a, c, g, or t
  misc_feature (3477)..(3480): n is a, c, g, or t
  misc_feature (3482)..(3489): n is a, c, g, or t
  misc_feature (3491)..(3493): n is a, c, g, or t
  misc_feature (3495)..(3495): n is a, c, g, or t
  misc_feature (3497)..(3497): n is a, c, g, or t
  misc_feature (3499)..(3502): n is a, c, g, or t
  misc_feature (3504)..(3504): n is a, c, g, or t
  misc_feature (3506)..(3517): n is a, c, g, or t
  misc_feature (3519)..(3528): n is a, c, g, or t
  misc_feature (3530)..(3530): n is a, c, g, or t
  misc_feature (3532)..(3533): n is a, c, g, or t
  misc_feature (3535)..(3537): n is a, c, g, or t
  misc_feature (3540)..(3543): n is a, c, g, or t
  misc_feature (3545)..(3545): n is a, c, g, or t
  misc_feature (3547)..(3552): n is a, c, g, or t
  misc_feature (3555)..(3566): n is a, c, g, or t
  misc_feature (3569)..(3572): n is a, c, g, or t
tctcatctaaatcatcaaacatatccacctctttaaactgatgaatcttaactccaaacttagaagcaactaattttatctcatcatcccccccattatattgcaaatcaatccaatctactcctttaatcttaagaacggagatccaatcagctaattttaaattatctttagctgcagctcctttctgattagagcttgtccagcaaatccctatcttcaacccagcccctaatagagaaactttacttttccaatatttttctctattatcatccactttaaggtacttaatacactcaggaaaaagatcaatatttttcctgaaaatggaaggaagtgatcccagcgcgacttgataatctatttttctctttgattcaatccatgatacatcttttttacctctcactatcattgaagtagtctcaccccccattagtttttcattcagagatatcaccgttgcttcaggaaaagagcgctcaaacaacttttccaacttatattgaaccaaaatagtacagtgtctagctttttgaaccacctctgccacacatgatgcgaaagtaacggtgtctccaataccttgttcatgatacaaaagaatatgactttctgaaatatcatcctctccccaccacgccttccacttaaaacctgaatgccctccaatatcttctgttcttctatattcataatagggccatccaagatccaacctgcctaaagttaaataattatacgccaagtttttttttgccgtaacacactcttttgattcagaacaaaattgcaacgctctattatatgcctcaatcgattccaatattttccattgatcgtgcaaaaccgcccccaaatcgttataactatcataagattctccaaacaactttaggcatgttctcaatatcaactctgactgaggaaacatatcttgaatagaatagatataagcaagacgcaaataagcaacctcatacttatcatttaattctaatgattttttgaaataaaactcagcattactgtaatcttcctcctcgagatatataaacccaagattataatagatctgtgaattatcttcaattttcagcgcctgtaaaaaataatctttcgcattttctttatccccttgcttatataagctacctgcatacccattcaacgccgaaacattaagcgaattaatagacaaaactttattataaattactgtcgccttttgatattcacctactccaatccatgccgcacctaagcttacagataaagcctcatcattcggcaatattttcaaagcctcctctaaaaaatggatcgcgttctcatactctcctttctgctctaataaaacacccaacattgcagcagcatctactctataacgcccttgcgcctcattaaatacttttcttaatattttttcagcactaaaaagatcattttgctcaatcaaattatcagcttttaaaagttttcgtttaaacttattcattagactcaactcactgtattgtataaattattactcacgcataaataacataaaaaaggctcctataattggagccttttttatctatcttcctacttttacaaagtagatttactataacatactacctcaatagtgacagaacattttgtggtaattggttagcctgtgctaacattgccatacctgcctgttgaagaatttgtgaacgtgccagattcgttgtctcttctgcaaaatctgcatcttccactcgactcttcgctgctgttaggttctgtgatgtattttgcatattggaaactgttgaatctaatcgattctgataagcacccaacttagctcgttctgcattcacataacccaaagcgccatctgctgccttaatcatttcagttgcctttgcttgagtagcaacagaaccagaacccacagatgagagagtactggaattacttgccgctgtcattaaagtagtctcatttgatgcaaccgtataacttgaattactagaaaaatccaaataacctccaacacgactactatctgcagctgttgatactaatgtttggtctgcagttgctgtaccacctgacaatactccattaaactttgctgtcgctccatcagttcctgcagagtttttaaagtcagtaatcgcaatatcatcacccgacttactagtcattgtcaaacttttcttatcagtagataaaacagcagaaataccggtagatcccgagtgtgtattaatggccgataccaaggagcttaaatcatccttattatcaacaacggcactaactgaaacatccgtggtattattccccttcaaaccaaaagagatcgttccagaagcacttaaagtatgtaatgtggcttttgttgtcgctgtaacttgaacgcctgtatctgctgttttattattgattgccgttgcaatcgtctcagcagagttgtccgctgttaacgtgaccgaagccgatccctcagaaccaccaatcaccaatgtctgcgcctccactccattcgcggtaacagcagccgcattcacatcttgtgaaacagaagctgctgatcctnctgtagtggcggtnttactaccnanngnagttgnagnnnnannnccnatactnaannnnanngtannncctgnattngnnccaatntgaaanttnttngaannnaangtnccatccaanannttnnnnccattaaantcngttgngctngagatcctagtcaactcttcctgtanctgngtnacctctttntgnantgcaactcgntcactngnngtattagtatcantcgnngantgnanngnnanctcncnaacncgctgnanaatattngcnnnctcctgcatcgcaccctcngcagtctgnatnagngaannngcatcattngcattncnnatnccntgattnanncctctnatctgngcagtcatnccttnngnaatngcnantccngcngcatcatcnnnngcnnnnttnatncnnnnaccngatganagncnntccattgatgtnnntnnngannnnngngatttgtcnagnacncgaacngtgttcanngncnnnatntttgtnttnataaantgtggcatnntantnctcctaanannnnnnnanntnnnnnnnnnannntnancnannntgcnnnannntnnnnnnnncnncnnnnnnnnanggnnaangnnnnnnngncttnnnttnttnnnnnnnnntnnnnnnnnannntnntnnnnanaannnnannnnnnnananntnnnnnnncannncngnagnnnnnanannanancnnnnnnnannncnannnnnnnnnnaannnaannannnannttnnngnngnnntntnnnnnnncnnnnnnnnnngnnnnnnnngnnngttnagnnngtnnnnnnnnanncnnnnnnnnnncnnntntnnnntncnancncncnnnanngnnnntnannaananaannnntnnnnnnnngnnngntntnnnntntnnnnnnnnnnnnannnnnnnnnnangnngnnnatnnnnanannnnnnctnnnnnnnnnnnnctnnnncgcctccttgctcataatttagactggcttttaggttatcaacaatcgcgagtgccttggtgagcgactctgctttttcaactgttttttgctgatcaataaagtagagtgcttttttatagcgctcaatcgctccatttagaagcatgctgaccagtttgtgggggtcagctgtgctaatttgtgactcaacccccacctgctgatactgcccagctgcttttttgtatctactgttcatttaaaatactccaatttttattaagtttactattctgcagctgcccactctagtacttcctcttttgatgcggagcgaagattttttggaatggctatccaagattcatgtatgcctgccatcaggtcaatcacatcatccatgagtgctggctctacttgacgcattgactctaccaatctaccaa

SEQ ID NO: 1012 - DNA, 4000 bp, Escherichia coli
  misc_feature (83)..(83): n is a, c, g, or t
  misc_feature (413)..(413): n is a, c, g, or t
  misc_feature (446)..(446): n is a, c, g, or t
  misc_feature (455)..(455): n is a, c, g, or t
  misc_feature (724)..(724): n is a, c, g, or t
  misc_feature (1334)..(1334): n is a, c, g, or t
  misc_feature (1436)..(1436): n is a, c, g, or t
  misc_feature (1448)..(1448): n is a, c, g, or t
  misc_feature (1794)..(1794): n is a, c, g, or t
  misc_feature (1821)..(1821): n is a, c, g, or t
  misc_feature (1960)..(1960): n is a, c, g, or t
  misc_feature (1982)..(1982): n is a, c, g, or t
  misc_feature (1992)..(1992): n is a, c, g, or t
  misc_feature (2184)..(2184): n is a, c, g, or t
  misc_feature (2241)..(2241): n is a, c, g, or t
  misc_feature (2505)..(2505): n is a, c, g, or t
  misc_feature (2592)..(2592): n is a, c, g, or t
  misc_feature (2605)..(2605): n is a, c, g, or t
  misc_feature (2670)..(2670): n is a, c, g, or t
  misc_feature (2680)..(2681): n is a, c, g, or t
  misc_feature (2697)..(2697): n is a, c, g, or t
  misc_feature (2720)..(2722): n is a, c, g, or t
  misc_feature (2724)..(2724): n is a, c, g, or t
  misc_feature (2727)..(2727): n is a, c, g, or t
  misc_feature (2735)..(2735): n is a, c, g, or t
  misc_feature (2793)..(2793): n is a, c, g, or t
  misc_feature (3096)..(3096): n is a, c, g, or t
  misc_feature (3167)..(3167): n is a, c, g, or t
  misc_feature (3179)..(3179): n is a, c, g, or t
  misc_feature (3444)..(3444): n is a, c, g, or t
  misc_feature (3472)..(3472): n is a, c, g, or t
  misc_feature (3483)..(3484): n is a, c, g, or t
  misc_feature (3704)..(3704): n is a, c, g, or t
  misc_feature (3736)..(3736): n is a, c, g, or t
  misc_feature (3738)..(3740): n is a, c, g, or t
  misc_feature (3742)..(3748): n is a, c, g, or t
  misc_feature (3750)..(3750): n is a, c, g, or t
  misc_feature (3752)..(3758): n is a, c, g, or t
  misc_feature (3762)..(3762): n is a, c, g, or t
  misc_feature (3764)..(3768): n is a, c, g, or t
  misc_feature (3770)..(3777): n is a, c, g, or t
  misc_feature (3779)..(3779): n is a, c, g, or t
  misc_feature (3782)..(3784): n is a, c, g, or t
  misc_feature (3787)..(3788): n is a, c, g, or t
  misc_feature (3792)..(3792): n is a, c, g, or t
  misc_feature (3797)..(3800): n is a, c, g, or t
  misc_feature (3802)..(3803): n is a, c, g, or t
  misc_feature (3807)..(3811): n is a, c, g, or t
  misc_feature (3813)..(3814): n is a, c, g, or t
  misc_feature (3816)..(3816): n is a, c, g, or t
  misc_feature (3818)..(3824): n is a, c, g, or t
  misc_feature (3828)..(3831): n is a, c, g, or t
  misc_feature (3839)..(3839): n is a, c, g, or t
  misc_feature (3841)..(3847): n is a, c, g, or t
  misc_feature (3852)..(3854): n is a, c, g, or t
  misc_feature (3857)..(3862): n is a, c, g, or t
  misc_feature (3866)..(3866): n is a, c, g, or t
  misc_feature (3869)..(3870): n is a, c, g, or t
  misc_feature (3872)..(3875): n is a, c, g, or t
  misc_feature (3877)..(3877): n is a, c, g, or t
  misc_feature (3882)..(3883): n is a, c, g, or t
  misc_feature (3885)..(3889): n is a, c, g, or t
  misc_feature (3891)..(3900): n is a, c, g, or t
  misc_feature (3902)..(3902): n is a, c, g, or t
  misc_feature (3904)..(3909): n is a, c, g, or t
  misc_feature (3911)..(3912): n is a, c, g, or t
  misc_feature (3914)..(3924): n is a, c, g, or t
  misc_feature (3927)..(3936): n is a, c, g, or t
  misc_feature (3939)..(3939): n is a, c, g, or t
  misc_feature (3941)..(3944): n is a, c, g, or t
  misc_feature (3951)..(3952): n is a, c, g, or t
  misc_feature (3954)..(3955): n is a, c, g, or t
  misc_feature (3957)..(3957): n is a, c, g, or t
  misc_feature (3960)..(3965): n is a, c, g, or t
  misc_feature (3972)..(3977): n is a, c, g, or t
  misc_feature (3980)..(3982): n is a, c, g, or t
  misc_feature (3985)..(3987): n is a, c, g, or t
  misc_feature (3990)..(3990): n is a, c, g, or t
  misc_feature (3994)..(3995): n is a, c, g, or t
  misc_feature (3997)..(3998): n is a, c, g, or t
aataacggtaggtttaacaaaaaggcctgcatataacagtgtgcctacgattgcccaaggcaaaattcctataatagtgagtntaaccttttgtatcgcggttttctcgtttacagcagcgttcataactcccccaaaaaaatattcagacatggcatctaaatgaagccattctcatcaaaaacgaatttttattttattattttattgttgttctttgctttaaaaaaattccggaaggaactgttagtatttgtatactaacaatcccttcacggaatggtctagattaatattaacgtgctaactgaataagagttttcagtgttacgtcttcttcttgcactgagtcagggttagctttcatgttagaagaccaagttgttgagaactcagctttccaatcaatgatntgaccaacaactggcatcaatgcttggtaaccntcatcaccntaatcgatacgattttggaagatgaaagttttccagaatttaccgtttttatcgtatgcttcacccagataaggtcttgggtaatccatttccatataaacgattttcttgctgtaaggatgctcgtcaggaggagttccctcaataacgtacacttcacgtggttcccattgaacttgttcgttagggaagaagtgaggtggtgtatccatgtctacagctgggaattccttaatagtatttttaaaagcaaggtcaacagtaactantggagcatgagcaatagcccagatccaacgcttaccagttaacttaacttctttatacttagtaggaactgcatcccaaatatcccagtcatcgtacaactgaactgttccaccaattggatccatccatgcgttaccagaaagacgacgtgcacgacgtacagacttcaagtatgcataaacatcatcaggcttctgagatgttggatcattgtagcgaacagaaaagattccgatgcctttaatatcttgtgggtaaattgctacaagtacagttttttgtagaatgtcgcctttaccttcagatactgggccaccatctaaacggccttccatatagtaacgacgtgcccaccaacgctgaatacgctccatacctgatgtggcatctaggaatacccaggagatgtgacgtagatccattgttgcaccataagtaggtgaacgtaggttccagattagtttacaacctgcatccggatcatccatgcttactttttgtgggtcaaagaacataccagctgtccagttactaacaacaccacagttactaccgttagcaggtgctccgtatacaacattaggagctccatctatagtagcttgcatntatttagggtccatttcaatgaactctgaatgacgagtattaatcatcaatgctttgttacggatcatccactcaacgttttcagtaatcatacttccaacngtttttccttcnaaacaaagattagttactgcatctaagtttgaattctggataactgttccagcttccatagcatcaccagtacaaccgccttctgcttcaataggagaaggaccgccatcccagcgaccagctgcgggtggatcaccgtaaaataatgggtttggtttagttccatcagcagtttttgctacatagcctttaggcttactagcatcatccgcccaatctgctttagcaaaggcttgagagcctcctaaaagcagtcctagcgatactaccgaggtagtaattagcttcatatacataattataactccaagttttattttagtgctgtctgcacaactcatacatngtactcattgtgcagacatactcaaangtactactttcttagaactgtctagttattttaactacaatttggttatcgccgccaaaatagtccataaagccagcgctgttttctctcttacctagagcgaagtcaccgcctgcaactggtgtagcagtaccattancaccctgtccaccgatgtagcntgaaccattnagagctccacaactattggaaccgtcggttgtataaccattaaacgaacctttacaggttttcttcgtatcaccgtcattgaaccaaagatctgcttcaattttcagacgccaatcatcaccataaacaaactctactgcaggaatagcgaaaccgccacctttagtaaggtcagtaccagccacgaatgangggttaatggtatcacgatggaagttcatcaacgtaaagatagtcaagtaggcagtntgctctttcttttgtgaaccaaaagaagcaaattctactatttcgtctttatcgtcgtgagacaatatccaagtgtcaaataactgaacacttgacagtgaaggacggtgcgtacctagtgaatccatccacttaaattccttatcgatacggaacatcatattgatagtatctttttcgataacaccgttccaaccaggtagatctgaataaatagatccgtagttgtaaggcttgttaggaataaaagcaatctcagcactnaatgttgcatccataggcgaattgaatccggtcatagtaaaaccaaagatatcaatttcaggatacatccagtcacctaataggttnccttgtgtagccncttcgctgccgtaagtttcagttgcacccataatgccatagtaagcatagtagccaccattagcnccaactaggnnagaatcagcaacagcnttagcaacgtctggacgatttgnnncngtngcacctanagcatgtggattcacaacaggagctggattgaaggttttcatataagcgaatgaatancctatagaaccccactctccgttccaacgaataccataagtcatatcactccagtctcctgaagaatgacctgtattatatgaatctgtgaattgtgtgaagtcaacaccacgatatgggtgtggaatccaacgtccaccttcgatgttatagttactacccatgtcctctttgcggtcccaacctggacggatgtaccagttcaagctaccaccgagttcatagaaatccaacctaaagttgaataacattaaaggcttacgccactcttcattgttttcataaaataaacgaccacgatantcataaccgtgaacaacgtccatagcctggaagaaatcactttcaccccatactaattgttgacgtccaanacgaaccattantctgtcatcgaaaaggtttacgtcaaagtatatctcacgtaaccagtcgaaaacttcatcagtagtttcgtattgatccatatagtcgccatctctacctctactaacaccgtcagtaaagttaccgctttggataccaaatcctgtagcgatgctttcagatcgagcttctagatcatctaaataatctgtctgcgcttctttatcaaaacgtgtgatcactttccagttcaaaggaccagttttaatatcgaagtccaagttnagagttacctctgcttggttcatgcganacttatcatcnnctgtagtttcatcattatcttccagcatgacgcctacagtagttcttacgtagccgttccagttaaggttatagaaaggttcactatcacccccgtagccatacgcagagaaagcattactgctccctaagagaagacctccaaatcccagcagaaggccgccgacctttaatatgctggtggttttattactcaccatcttattctcccacttatattnctttatataattaaattgccgtgattatagancnnngnnnnnnncnannnnnnncccntnnnnnannnnnnnnanccnnnttnntttnaaaannnnannaaannnnnannantnnnnnnnaaannnntttttttnannnnnnnaaaannnttnnnnnnaaanttnntnnnntnaaaannannnnntnnnnnnnnnnangnnnnnnannannnnnnnnnnnaannnnnnnnnnttnannnnaaaaaanntnnanttnnnnnnaaaaaannnnnnaannnggnnnaantttnnannaa

SEQ ID NO: 1013 - DNA, 4000 bp, Escherichia coli
  misc_feature (144)..(144): n is a, c, g, or t
  misc_feature (1985)..(1985): n is a, c, g, or t
  misc_feature (1988)..(1988): n is a, c, g, or t
  misc_feature (1997)..(1997): n is a, c, g, or t
  misc_feature (3878)..(3878): n is a, c, g, or t
  misc_feature (3887)..(3887): n is a, c, g, or t
  misc_feature (3908)..(3908): n is a, c, g, or t
  misc_feature (3920)..(3920): n is a, c, g, or t
  misc_feature (4000)..(4000): n is a, c, g, or t
agaacacaagaaatccaaagacttataggaagatccttaagacaggcagttaatttaaagtacattaaaggaaaaactattaatattgactgtgatgtaattcaagcagatggtggaacaaggactgcctcgataacaggtggntgtgtcgcattatttctagctcttcaaaaccatcatgatgaccatagagcgatcaagtcacatgttgctgcagtttctcttggagttctggatggtcaggttgctcttgatttggactataaagaggatagcagtgctgaagttgatttaaatttagttatgactgacaactctgaaataattgaaattcaaggaactggtgaagaagctccatttaatagagagcagctagatgatatgcttaatattggaagcgctgctattgcagatattattcagaaacaaaaggcctgcttaaaataagtgaaaaattaccagaaaatatttttaaatcttgcattagatgcaaaagcattagaattcggtagtttcactctcaaatctggcagaacaagcccctacttttttaatgcagctaagatgctgtcaggtaatctctcagagttagctaattgctatgttcaagcaattaatgaaactgaaatggaatatgattgtatttatggccctgcatataaaggtatttttttagggtctatggttgctgtactattgagtcaaaatggtaataactaccctctttcatttgatagaaaagaggttaaagatcatggggaaggtgggaatattattggaaataatcctgttggtaatgtaatgataattgatgatgtgctttctgcaggaacggctgcaagacagtcgattgagcttattagcaaaactggtgctattccaaaaatatttattgtaggtcttgatagacaagaaaaaggttctgctgatatatctgcatccaaagaacttcaaaatgattttggtataactgttaaatctatagttaatcttgatacgcttatatcatttactgaaaacaattcagactataccgctcatctaggggagctgaaggcttatagagacaattggggagcataaaatgttttcaggtattgtttcagtcaaaagcaaagttgccaaaataaaaaaatatgaagactacctgtctttagaaataactaccccaaaaggttttgataagaatttgaagagaggtgcgagtatttctgtaaatggagtctgtcttacctcaaaagatagtggctctaaaacattaaaatttgatgtaatagaagaaactattagcaagaccaatttaaagaatattaataaaggggatatagtcaacctcgaaaggtctataaaagcttcaactgaaatcggaggtcatttgatgtcaggtcatattcacttcactgctaaagttatcaaaactgttaatagaaaaaatactaaagatatacaaatatcattaataaaaaaatatttagattacgttatggaaaagggctatataggtataaatggttgcagcttaacaattggcaaggtaaataaaacaaacttttatattcatttgatacctgaaactctagatataactaatttagacaaactttcagaaggcgatcaggttaatatcgaaatagatcaaaatacaatcacagtagtaaatactgttaagaaaaccctagctgctcagatatctagctaatacagccattcttatagcaacgccgtttgcaacctgatttcttattaccgaattatctgactgataaacgctttcagatatttcaatataattaaccgggcctgggtgcatgactatcacatcacctcttgcctgctgcactctttctgatgttaattcatatgcatgcttgtaatcatcaagatcaagatttagctcttcttcaaatctttcatgctgaattcttaatgtaataatcacatctgcatcttgaacagctaaatcaaggtctggttcatatcttccnagngcaggatcnaaatactttgaacacatgcttggatgcccgcagaatgttaatgagttaaaagaaaaattagagataccttctatgaaggacgatgtaacgcgtgagtgatcaagatcaccaacaataacgatatttaaatcatctatagagcctttactatcaataatagtcattaaatcaattaaggcttgagttggatgagatatcgacccttctccaccattgataaaaaccatttcaggcatatattcatctagctcacgaataactgaatcaggatgcctgagaacgcaaagatctacccccattaagcctagcgcatcaatagtttcgtatattgattcccctttttctattgatgagcttgaggcatcaaaaccaatcacactgcaccctaaatttttagcggcaatttcaaatgatgattttgtccttgtgctcggttcacaaaaaacatttgcaactgttttatctggaaaaagagtttctttcttaaaagaaccatcatcatttttaaagtttctggcaaattctataagatcaagtatttcttgtttagataaatcattaatagataggagacttttattcatctatatttactattgcatccatttctacatttactccaagcggaagtgctgaaacttctatagttgcccttgctggataaggagattcaaaatgactctccatggcttgattcacaatagaaaaatcattcatatctgtaatgtaaatagttaatttaacaatatcggacagaccagcatttgcggctttacatattgcagttagatttttaattacttgttcggcctgctcttctattgaagagttcttaagatcaccagagacaggacacaaggctacctgacccgaaacaaataaaaaactacctgatttaacagcctgagagtatggaccaatagcttttggagcgtcttcagtaaaaattatttctttagccataatgtcgttctcttttaagttagttgatgttgttaaaaagtgaattgtacataataaaaaatggtttcgttctattatttatcattaatgattcttgaacagctagctgtgaatttttttgatcttaccttggacataattcttttgagctcatcaaggctttcaatatttgcttccaatgtgaactcagaaaatttttgatcgactgccttggtatttacttgctcaatattaattcctgcctttgcaaatatagaaacaatatctgataaaacacctattttattttcagtagtaattttgagcattgctagatataaatgagattttttagaggcatcccaataagcagagaagtatcttggatctttattgatatatggagacacttgtttacacctttgatgatgaaccacaatacctctttctgtatctgagtgtgcaatgactggatcgccttggatgggatgacagcatttagcaaatactactgaaacaccttcaatatgattatcgataataggaacagtcctatcttctatgatttctttttcttttctaatctgcagtcctgaataaaatctttcagcaacaatatttccagttctctttcctgatcctaaatcgattagtagtttatttagagtagtgactccaattgaatcgagaactcttttcaaagtgctccccctataatcctcaagtgattttcctgatctttttaactctgattcaagcattaactttcctgctttcctagcagaagaatttttttgatttcttaatctagacctaataccacttcttgctttgctagttacaacaaagtttaaccatgcagggtctgcatctactggatagtcagatgttattatttctaccgtttggccactctcaagctcaacattaagaggtgcntctcttctnttgaccttacatcctacaatnctatttccaagncctgtatgaacctcataagcaaaatcaataggagttgcgccagttttaatggaatacacatgaccctttggtgaaaatan

SEQ ID NO: 1014 - DNA, 4000 bp, Escherichia coli
  misc_feature (16)..(16): n is a, c, g, or t
  misc_feature (29)..(29): n is a, c, g, or t
  misc_feature (31)..(31): n is a, c, g, or t
  misc_feature (33)..(33): n is a, c, g, or t
  misc_feature (53)..(53): n is a, c, g, or t
  misc_feature (57)..(57): n is a, c, g, or t
  misc_feature (100)..(100): n is a, c, g, or t
  misc_feature (105)..(105): n is a, c, g, or t
  misc_feature (216)..(216): n is a, c, g, or t
  misc_feature (222)..(222): n is a, c, g, or t
  misc_feature (225)..(225): n is a, c, g, or t
  misc_feature (228)..(228): n is a, c, g, or t
  misc_feature (267)..(267): n is a, c, g, or t
  misc_feature (346)..(346): n is a, c, g, or t
  misc_feature (378)..(378): n is a, c, g, or t
  misc_feature (780)..(780): n is a, c, g, or t
  misc_feature (789)..(789): n is a, c, g, or t
  misc_feature (825)..(825): n is a, c, g, or t
  misc_feature (1221)..(1221): n is a, c, g, or t
  misc_feature (1361)..(1361): n is a, c, g, or t
  misc_feature (1433)..(1433): n is a, c, g, or t
ctagatacttatttgnttaatgggctgantncnatgcatcaaattctttctgnaatncgtgttttagagctggggcagttaattgcaggaccctttgccnccaanaccttggctgattttggggcggagattatcaaggtggaatcccctcaagatggtgatcccttgaggaagtggcgcatgcttcatgagggcacttcggtatggtggcaggcncaatcncgnaanaaacaatccatctgcattgatttgcgagtgaaagagggncaagacatcgttcgtcgcttggccaaagaagccgatgtgctgattgagaactttcgaccgggcaccatggagaagtggnggatgggctgggatgagctgcatgcgctcaancctaagttgatcatgttgcgtgtctccgggtatggccaagatggaccacggcgggatgagcctggctttgcagcaattgcggaggcaactgcaggcctgcgctatctcacaggtcatccgggcgatgtaccagcgcgcgccggcttatcacttggcgatacgatcgctggtttacatggtgcccttggagtattgctagccctctatgagcgtgatgctaggggtggcaaaggccaaatgattgatgtggctttatacgaggctgtgtttaatttaaccgagagcctattacctgaataccatgtgtttggagcggtacgtcaaccggctggaggcgcattaccagggattgccccatccaatgcttacccttgcgcagatggacaatacatcttgattgcngccaatggngattctttatttaagcgcctcatgggattcattggncgatcagatttagccaatgatcctgacttagccagaaatgatgggcgagcaaaacgtgccgaagagattgatcagatcatcgggcagtggacacaaacccaatccattgatcaggtcttaaacgcattgcaagagatcgcagtaccggcagggcgtatttatacggcaaaggatattgcagaggatccacactatcgtgcccgtggtgtgattgaaacgattgaaagtgcagatggcctaaaagtggagatgcccggaatcattccgaagttatccaataatccaggcgccattcgtcatcgcgcgcccacattgggagagcatacgcagaagattcttcaatcgattggcttaagtgaagagcaaattaaagccctaaaagagactggcgtcctnaattaatggaagcagcgattcaaaccctgttgcattggtttggaatgcccacagtgggtctgcccgctgtatttatcgtagcaactgtatcagcaaccttaatcccgatgggttccgagcccgtgttatttgcttatgtnagtcttaatccgcaagactactggttagcaattgcagttgccacactaggtaatacgatcgggggaatgatnaattggtggctgggactcttggcacgcaatacctacgaatctctaaagggaaagacaaattctcgggcacaagtctggctggagaagcggggaccacccatgttgttattgtcttggttacccgcgataggcgaccctttgtgtctagttgccggttggctccgctttaattggctgaaatgcttgatttacatggcaattggaaaactactgcgctacatcaccctgacatggttgctgacagaaataccaaaagaattttgggaggagattggaagagccttgggttttctgtaaatctagaccgaacaatatttctgctgaatctcatcattattaagaagtgcttttgcagagtcttcaaaaacaattttgccttgatcaagaatatatgctctatctgatataccaagagccttttgaacattttgctccaccaataagatggtcattcctgcttgcttcattttagtaaacagtgtgaacatctcttctactaaaactggcatgattccctcagagggctcatctaaaagaattatcttaggcttcgctaccatcgctctcgcaatcgccaacatctgttgctcgccccctgacattgaggtaccgtcttgatgaagtcgctccgttaatcttggaaaggtttctgcaacttcatcaagcatcgactgaatattacccttggatttttgtgcgatcatgccaagctctaaattttctttaaccgttaagcctggaacgatacgcctatcttctggcacataagcaatacctagatgaaaacgctcataggcaggtagccctaaaaactcttttccattgatacttgcatgcccctttcgttttgataagagccccatcaaggttcgaagcgtggttgttttaccggccccattacgacccattaaggtaacaatctcccctgcgtttacggttaatgagatgccttggataacgtgactttggtcataccaggcttgtaggttctcaattcttagcatcgctacccttgacccaaataaacacgacgtacttcggcgttattttgaatttcatcagggctaccttctgcaagaaactcgccatgatgcaagacaataatacgattgcatagccccataatgagcttcattttgtgctcaacaagtatgaccgttcgctctgtagctaatgttcgaattagatccatcatgacaagggtttcttctggagacattccagcagtaggctcatcgagcaataaaagacttggcttgcaagctaatgccattgcaatttctaaggctcgttgctgaccatgggctaagtctcctgattttttgtgacgcagatgatgaagaccaacgcgctcgagaagttcatctgcgctaattatggtatccgatagggaatgggcatcttttaagaagttaaagcgcgaaacctgcatctgggcggcaacacgaacgttttcgtggacactgagttgtttaaatacattggtaatctggaagctctttgaaataccaattcgagcaaattcgtatggtttttgatgagtaatatcgacaccattaaaaagaatttgtccgtcagagggcggaaaggcgccacttagaacattaaaaaaagtacttttaccagcgccattaggtccaatgatggccgtaagactgcctgtagcaaaactggtagacacatcacttaaggccttgaactttccaaattgcatggatacgtggcgagcctcgagaataggggtggtgccaaacttattcattttgatgcacctttttgactaccaagacgctcaagaatgcttccccaaattcccttcggaaaaaatagcacgaaaaacataaaaataagtccaaccacagccatccagtgttttgtgaagctagtcacgacatcctcgagatatagcatcaccgtagcaccaacaaaggggccaaagaaagtccccatcccacccaagatactcatcatcaccgcttgaccagactgcaagtaatgcaaggaatcaattggcacaatagataaatgaagggcgcgtagtgagccagctaaaccacagatggctgctgacaagatgaagactaacaatttagtttgggcaacgttatagccgcatgccaagacccttttttcattctcacgaatagcctccataacggagcctaaaggtgattttaagattctggaaactagccaaatggcaatcaccacaaagaaaagaataatgtagtacttcaccaatggatttaagaagtcgactttaaaaccaaggatattaaatggatccactttcacacccctcaggccattttcaccaccggtcaacttctcggctttataaaatccgtagtacacaatttgacctaatgccagggttaccattgaaaaataaatacctcgagtacggattgctaaaaatccaataacaagaccaccaaaagcagccgcaatcacaccaaataaaattgctgcaccccaaggcattccgtagctcacaatgctgataccggttatgtaactacccattcctaagaaagcagcgtgtccaaacgagaggaggcccatgt

SEQ ID NO: 1015 - DNA, 4000 bp, Escherichia coli
  misc_feature (94)..(94): n is a, c, g, or t
  misc_feature (109)..(109): n is a, c, g, or t
  misc_feature (121)..(121): n is a, c, g, or t
  misc_feature (424)..(424): n is a, c, g, or t
  misc_feature (443)..(443): n is a, c, g, or t
  misc_feature (875)..(875): n is a, c, g, or t
  misc_feature (2712)..(2712): n is a, c, g, or t
  misc_feature (2718)..(2718): n is a, c, g, or t
  misc_feature (2801)..(2801): n is a, c, g, or t
  misc_feature (2854)..(2854): n is a, c, g, or t
  misc_feature (2871)..(2871): n is a, c, g, or t
  misc_feature (2883)..(2883): n is a, c, g, or t
  misc_feature (2887)..(2887): n is a, c, g, or t
  misc_feature (2890)..(2891): n is a, c, g, or t
  misc_feature (2893)..(2895): n is a, c, g, or t
  misc_feature (2897)..(2898): n is a, c, g, or t
  misc_feature (2901)..(2901): n is a, c, g, or t
  misc_feature (2903)..(2909): n is a, c, g, or t
  misc_feature (2911)..(2913): n is a, c, g, or t
  misc_feature (2916)..(2920): n is a, c, g, or t
  misc_feature (2923)..(2925): n is a, c, g, or t
  misc_feature (2927)..(2936): n is a, c, g, or t
  misc_feature (2938)..(2939): n is a, c, g, or t
  misc_feature (2941)..(2942): n is a, c, g, or t
  misc_feature (2950)..(2951): n is a, c, g, or t
  misc_feature (2953)..(2957): n is a, c, g, or t
  misc_feature (2965)..(2965): n is a, c, g, or t
  misc_feature (2970)..(2972): n is a, c, g, or t
  misc_feature (2974)..(2975): n is a, c, g, or t
  misc_feature (2977)..(2979): n is a, c, g, or t
  misc_feature (2984)..(2986): n is a, c, g, or t
  misc_feature (2988)..(2992): n is a, c, g, or t
  misc_feature (2996)..(2997): n is a, c, g, or t
  misc_feature (2999)..(3002): n is a, c, g, or t
  misc_feature (3004)..(3004): n is a, c, g, or t
  misc_feature (3006)..(3009): n is a, c, g, or t
  misc_feature (3011)..(3014): n is a, c, g, or t
  misc_feature (3016)..(3018): n is a, c, g, or t
  misc_feature (3020)..(3021): n is a, c, g, or t
  misc_feature (3024)..(3024): n is a, c, g, or t
  misc_feature (3027)..(3027): n is a, c, g, or t
  misc_feature (3029)..(3029): n is a, c, g, or t
  misc_feature (3032)..(3035): n is a, c, g, or t
  misc_feature (3039)..(3040): n is a, c, g, or t
  misc_feature (3042)..(3044): n is a, c, g, or t
  misc_feature (3046)..(3046): n is a, c, g, or t
  misc_feature (3052)..(3052): n is a, c, g, or t
  misc_feature (3054)..(3057): n is a, c, g, or t
  misc_feature (3061)..(3061): n is a, c, g, or t
  misc_feature (3067)..(3068): n is a, c, g, or t
  misc_feature (3071)..(3071): n is a, c, g, or t
  misc_feature (3079)..(3081): n is a, c, g, or t
  misc_feature (3083)..(3084): n is a, c, g, or t
  misc_feature (3086)..(3088): n is a, c, g, or t
  misc_feature (3090)..(3092): n is a, c, g, or t
  misc_feature (3097)..(3097): n is a, c, g, or t
  misc_feature (3099)..(3099): n is a, c, g, or t
  misc_feature (3101)..(3101): n is a, c, g, or t
  misc_feature (3105)..(3105): n is a, c, g, or t
  misc_feature (3107)..(3108): n is a, c, g, or t
  misc_feature (3116)..(3118): n is a, c, g, or t
  misc_feature (3120)..(3120): n is a, c, g, or t
  misc_feature (3123)..(3124): n is a, c, g, or t
  misc_feature (3126)..(3126): n is a, c, g, or t
  misc_feature (3129)..(3130): n is a, c, g, or t
  misc_feature (3132)..(3134): n is a, c, g, or t
  misc_feature (3136)..(3138): n is a, c, g, or t
  misc_feature (3140)..(3143): n is a, c, g, or t
  misc_feature (3146)..(3147): n is a, c, g, or t
  misc_feature (3149)..(3151): n is a, c, g, or t
  misc_feature (3156)..(3156): n is a, c, g, or t
  misc_feature (3161)..(3161): n is a, c, g, or t
  misc_feature (3168)..(3168): n is a, c, g, or t
  misc_feature (3171)..(3171): n is a, c, g, or t
  misc_feature (3178)..(3179): n is a, c, g, or t
  misc_feature (3182)..(3182): n is a, c, g, or t
  misc_feature (3187)..(3187): n is a, c, g, or t
  misc_feature (3189)..(3189): n is a, c, g, or t
  misc_feature (3197)..(3197): n is a, c, g, or t
  misc_feature (3199)..(3199): n is a, c, g, or t
  misc_feature (3202)..(3202): n is a, c, g, or t
  misc_feature (3205)..(3205): n is a, c, g, or t
  misc_feature (3207)..(3207): n is a, c, g, or t
  misc_feature (3212)..(3212): n is a, c, g, or t
  misc_feature (3215)..(3215): n is a, c, g, or t
  misc_feature (3231)..(3232): n is a, c, g, or t
  misc_feature (3238)..(3239): n is a, c, g, or t
  misc_feature (3241)..(3241): n is a, c, g, or t
  misc_feature (3253)..(3253): n is a, c, g, or t
  misc_feature (3255)..(3256): n is a, c, g, or t
  misc_feature (3258)..(3259): n is a, c, g, or t
  misc_feature (3261)..(3261): n is a, c, g, or t
  misc_feature (3265)..(3267): n is a, c, g, or t
  misc_feature (3272)..(3272): n is a, c, g, or t
  misc_feature (3277)..(3277): n is a, c, g, or t
  misc_feature (3295)..(3296): n is a, c, g, or t
  misc_feature (3301)..(3301): n is a, c, g, or t
  misc_feature (3303)..(3305): n is a, c, g, or t
  misc_feature (3307)..(3307): n is a, c, g, or t
  misc_feature (3309)..(3309): n is a, c, g, or t
  misc_feature (3317)..(3317): n is a, c, g, or t
  misc_feature (3320)..(3320): n is a, c, g, or t
  misc_feature (3328)..(3328): n is a, c, g, or t
  misc_feature (3332)..(3335): n is a, c, g, or t
  misc_feature (3340)..(3340): n is a, c, g, or t
  misc_feature (3345)..(3345): n is a, c, g, or t
  misc_feature (3348)..(3348): n is a, c, g, or t
  misc_feature (3358)..(3358): n is a, c, g, or t
  misc_feature (3369)..(3369): n is a, c, g, or t
  misc_feature (3371)..(3371): n is a, c, g, or t
  misc_feature (3378)..(3378): n is a, c, g, or t
  misc_feature (3381)..(3381): n is a, c, g, or t
  misc_feature (3383)..(3384): n is a, c, g, or t
  misc_feature (3393)..(3393): n is a, c, g, or t
  misc_feature (3406)..(3406): n is a, c, g, or t
  misc_feature (3416)..(3416): n is a, c, g, or t
  misc_feature (3423)..(3423): n is a, c, g, or t
  misc_feature (3437)..(3437): n is a, c, g, or t
  misc_feature (3439)..(3439): n is a, c, g, or t
  misc_feature (3449)..(3449): n is a, c, g, or t
  misc_feature (3452)..(3453): n is a, c, g, or t
  misc_feature (3457)..(3457): n is a, c, g, or t
  misc_feature (3479)..(3480): n is a, c, g, or t
  misc_feature (3483)..(3484): n is a, c, g, or t
  misc_feature (3486)..(3488): n is a, c, g, or t
  misc_feature (3493)..(3494): n is a, c, g, or t
  misc_feature (3497)..(3497): n is a, c, g, or t
  misc_feature (3500)..(3500): n is a, c, g, or t
  misc_feature (3502)..(3503): n is a, c, g, or t
  misc_feature (3505)..(3505): n is a, c, g, or t
  misc_feature (3507)..(3507): n is a, c, g, or t
  misc_feature (3510)..(3510): n is a, c, g, or t
  misc_feature (3513)..(3513): n is a, c, g, or t
  misc_feature (3516)..(3516): n is a, c, g, or t
  misc_feature (3518)..(3518): n is a, c, g, or t
  misc_feature (3520)..(3520): n is a, c, g, or t
  misc_feature (3528)..(3530): n is a, c, g, or t
  misc_feature (3533)..(3533): n is a, c, g, or t
  misc_feature (3535)..(3535): n is a, c, g, or t
  misc_feature (3539)..(3539): n is a, c, g, or t
  misc_feature (3542)..(3544): n is a, c, g, or t
  misc_feature (3547)..(3548): n is a, c, g, or t
  misc_feature (3552)..(3552): n is a, c, g, or t
  misc_feature (3554)..(3555): n is a, c, g, or t
  misc_feature (3557)..(3557): n is a, c, g, or t
  misc_feature (3559)..(3560): n is a, c, g, or t
  misc_feature (3562)..(3562): n is a, c, g, or t
  misc_feature (3566)..(3568): n is a, c, g, or t
  misc_feature (3570)..(3570): n is a, c, g, or t
  misc_feature (3572)..(3572): n is a, c, g, or t
  misc_feature (3576)..(3576): n is a, c, g, or t
  misc_feature (3578)..(3579): n is a, c, g, or t
  misc_feature (3583)..(3583): n is a, c, g, or t
  misc_feature (3585)..(3587): n is a, c, g, or t
  misc_feature (3592)..(3593): n is a, c, g, or t
  misc_feature (3595)..(3598): n is a, c, g, or t
  misc_feature (3603)..(3603): n is a, c, g, or t
  misc_feature (3607)..(3607): n is a, c, g, or t
  misc_feature (3609)..(3609): n is a, c, g, or t
  misc_feature (3611)..(3611): n is a, c, g, or t
  misc_feature (3613)..(3614): n is a, c, g, or t
  misc_feature (3620)..(3620): n is a, c, g, or t
  misc_feature (3622)..(3623): n is a, c, g, or t
  misc_feature (3625)..(3628): n is a, c, g, or t
  misc_feature (3631)..(3631): n is a, c, g, or t
  misc_feature (3635)..(3635): n is a, c, g, or t
  misc_feature (3637)..(3639): n is a, c, g, or t
  misc_feature (3642)..(3642): n is a, c, g, or t
  misc_feature (3644)..(3645): n is a, c, g, or t
  misc_feature (3647)..(3647): n is a, c, g, or t
  misc_feature (3649)..(3651): n is a, c, g, or t
  misc_feature (3654)..(3654): n is a, c, g, or t
  misc_feature (3657)..(3658): n is a, c, g, or t
  misc_feature (3663)..(3664): n is a, c, g, or t
  misc_feature (3671)..(3673): n is a, c, g, or t
  misc_feature (3677)..(3677): n is a, c, g, or t
  misc_feature (3680)..(3680): n is a, c, g, or t
  misc_feature (3683)..(3683): n is a, c, g, or t
  misc_feature (3687)..(3689): n is a, c, g, or t
  misc_feature (3692)..(3692): n is a, c, g, or t
  misc_feature (3694)..(3694): n is a, c, g, or t
  misc_feature (3696)..(3697): n is a, c, g, or t
  misc_feature (3701)..(3703): n is a, c, g, or t
  misc_feature (3705)..(3705): n is a, c, g, or t
  misc_feature (3708)..(3711): n is a, c, g, or t
  misc_feature (3713)..(3714): n is a, c, g, or t
  misc_feature (3716)..(3716): n is a, c, g, or t
  misc_feature (3719)..(3719): n is a, c, g, or t
  misc_feature (3722)..(3722): n is a, c, g, or t
  misc_feature (3724)..(3726): n is a, c, g, or t
  misc_feature (3730)..(3730): n is a, c, g, or t
  misc_feature (3733)..(3733): n is a, c, g, or t
  misc_feature (3735)..(3735): n is a, c, g, or t
  misc_feature (3737)..(3739): n is a, c, g, or t
  misc_feature (3745)..(3745): n is a, c, g, or t
  misc_feature (3747)..(3748): n is a, c, g, or t
  misc_feature (3751)..(3753): n is a, c, g, or t
  misc_feature (3755)..(3756): n is a, c, g, or t
  misc_feature (3760)..(3760): n is a, c, g, or t
  misc_feature (3763)..(3763): n is a, c, g, or t
  misc_feature (3769)..(3769): n is a, c, g, or t
  misc_feature (3771)..(3773): n is a, c, g, or t
  misc_feature (3775)..(3775): n is a, c, g, or t
  misc_feature (3788)..(3789): n is a, c, g, or t
  misc_feature (3804)..(3804): n is a, c, g, or t
  misc_feature (3808)..(3808): n is a, c, g, or t
  misc_feature (3811)..(3812): n is a, c, g, or t
  misc_feature (3818)..(3818): n is a, c, g, or t
  misc_feature (3820)..(3821): n is a, c, g, or t
  misc_feature (3831)..(3831): n is a, c, g, or t
  misc_feature (3834)..(3834): n is a, c, g, or t
  misc_feature (3837)..(3837): n is a, c, g, or t
  misc_feature (3841)..(3841): n is a, c, g, or t
  misc_feature (3845)..(3846): n is a, c, g, or t
  misc_feature (3848)..(3848): n is a, c, g, or t
  misc_feature (3852)..(3852): n is a, c, g, or t
  misc_feature (3859)..(3860): n is a, c, g, or t
  misc_feature (3864)..(3865): n is a, c, g, or t
  misc_feature (3869)..(3869): n is a, c, g, or t
  misc_feature (3873)..(3873): n is a, c, g, or t
  misc_feature (3876)..(3876): n is a, c, g, or t
  misc_feature (3898)..(3898): n is a, c, g, or t
  misc_feature (3900)..(3900): n is a, c, g, or t
  misc_feature (3902)..(3902): n is a, c, g, or t
  misc_feature (3904)..(3905): n is a, c, g, or t
  misc_feature (3908)..(3908): n is a, c, g, or t
  misc_feature (3910)..(3910): n is a, c, g, or t
  misc_feature (3913)..(3914): n is a, c, g, or t
  misc_feature (3917)..(3917): n is a, c, g, or t
  misc_feature (3925)..(3925): n is a, c, g, or t
  misc_feature (3934)..(3936): n is a, c, g, or t
  misc_feature (3938)..(3939): n is a, c, g, or t
  misc_feature (3956)..(3958): n is a, c, g, or t
  misc_feature (3960)..(3960): n is a, c, g, or t
  misc_feature (3963)..(3963): n is a, c, g, or t
  misc_feature (3965)..(3965): n is a, c, g, or t
  misc_feature (3970)..(3970): n is a, c, g, or t
  misc_feature (3972)..(3972): n is a, c, g, or t
  misc_feature (3974)..(3976): n is a, c, g, or t
  misc_feature (3982)..(3982): n is a, c, g, or t
  misc_feature (3986)..(3986): n is a, c, g, or t
  misc_feature (3992)..(3992): n is a, c, g, or t
  misc_feature (3996)..(3997): n is a, c, g, or t
  misc_feature (4000)..(4000): n is a, c, g, or t
gaaacagcagctccagaacattgaagacaatattgcctggttgcagcgttcggagttggaaattggacatattaatgaaatattgggacaaatncgcacacttgctatntcacaggccggnagtgattcaaacgaagaaacgaggcaaatggtggctcgagagtttgctgtggcccggaaaactttatttgacacaggaaatgcgcgtgaaggaaaactttatttgttttcgggcataaaaagtctttctcctgctttgaaaaaaaatggtatatttcaaccggcaaaagttgagaaaagcggagttgcgcagaaagacatcagggaattgctggatgtgaaacaatttagagcgcaatttgagggtttttctactaataattatcgaatcaaagtcacaaaaggcggaatttggggacaagcnaggataaagatttcagacnatggtggacgaacctggagtaaagaacagacattacgtccggtgattcacgtatttaaccaggatggaaaacttaacgaccaggttttgctcaaattttctgaccaggaaggtcgtttgggcaacattctgccaaaacaatttgattttaattcagagaaatcggcaaaatttgacttggatgcacttggtgttttgtttccggaaggaattgagtttgtgtatcagccaaacccggaagtatcatataatggatcaatacataaaaaagaatctttgatttcaaatggactttcaattccggtaaatattactgctcaggaactgctgcttggagaaggtgaggatggcgtggatacgttttctttacttgcggcaatggagagagctcttctcgaaaatgatggcattgcgattgcaaaacgtatagatnagcttaacttggcacaaaatcaggttttgaagcagcaggcagacgttggaaatattgttcgcgaactctattcaactcagtccaggctggaagatcagcagtttgaaaaggagagacaactttctgatatccaggatttagatgttgcggaagcaactgtggaccttaaagtcgcagaggctaacaacatactttcgctgaataccggagcccgcttgatccaaccgtcactgtcggattttctccgttaatttaacctgtgaatgataatcacaggttttgtataatttggaattaattatcaagaagacagatcattatgctcatactgacaaggaagtcgggagaaagtataaccattggggatgatgtaaaaatcacggtggttgaggtcaagggcaaacaagttcgaattggaattgatgcaccccgaagttatataatccacagagaagaagtatatataagcattcaggaagaaaacaggcgtgcggcagaagagtcaccactttcgttagccggaatcaaacacctttttggtaaactctaatcaataaaacattaatgcttgttcaaacctcacgcttcggtgagatcgaagttaaagacgatcaaataattagctttccttcaggattgataggtttttcggaagaccatcgttttgtgatccgggaagatgaagcagcagcaccttttcgctggctccagtccattgatagtgaagatcttgcttttgtgatgattgaaccgcatgtctctatttcaaattatgagcttgagttaacaaatgatcacctgaaaaaacttcatgcagaaaaaactgaagatctgtcagtctatagcctggtcaccatggccaaaaaaatggaagatgtgactataaatttacagggccccctgctttttaatcttgaaaagcgccttggaattcagatcattgttcaagatggtagatactctacccgtcattcactgtttgctgaaaaattaaaaaagagtactcctgagtcttcatctcaggaagagccggagaacagcagcaagtctttagaacaagccgggtgatcctgcatcagcccgtaatcggcaatgaaactgaagttctcatgctgacaaaattccttcctgcaaacactcaataatgagtgaaatacaaaaaccccttaaatctattgaagtcagacaaatctgtttagagaatgatttggagatttcagattcccaatggcagctgctggaaaagtgggctgttatgttgctggatgtcaaccagaaagtaaatttaatttcccgcaaagaaacagatttattgtgggaaaaacaaatattgccctgtctttcattactggttttacgtaaaattgaaaaaggtgcagatgtttgtgattttggtacaggaggaggattgccgggaatgatactggccatagtacgtcctgatttgcggcttactttgttggattcacgtcagaaaaaaattgtggtccttcaacaaatgattgatgcattaaagctcaaaaatgttcagactgtccctgggcgaggggaagagttaggcaaacaacgtccctggcgtcatagattcccgtttgtgacagcacgtgcagttgcacctttgatcgatttagtacgctggacctctgatttgagaaaaccggattcagtactgcatatttttaagggtggagaaatcaggaatgaagtaacggcactgactaaagtagtttccggaatcaaagtcaagaagtctctgatggtactaaaaggatatccacattttgcagagaatcaaaaatatttaatatctttagaattttcctcaaaataactcgtnagtcangagttctcgtaagataatgatattgttgtttacggtttgtcatctcgaccgaagagagggatctgataaaatacttatatcgngcaagattcttcacatactttcgggatgacatgacaaaactagtgtttgtccngtaaataaatacacaanttttccctaatntttnatnngnnnannatntnnnnnnntnnnaannnnnttnnntnnnnnnnnnnanngnntttttttnnannnnnacacacanaaaannnanntnnngtttnnntnnnnnaaannannnntnannnngnnnnannnannganatnangcnnnntccnncnnntntaaagngnnnntttntatttnntgnaaaaaaannntnntnnngnnntgggntntntttncnnaaaaaacnnnancgnntncannannntnnngnnnngtnngnnntgganaaagngggccgnttnattcagnnagnttttngnaaattgantnttntcncnctttntcnaccctccggaagcagnngagatnntnggcaaaattttnannannangtgnnngattntttanataaatggcttttggaanntaaantnnncngnagggaaantanaatctgcngagnnnngaatnttgcncanaaggagattnatttgaaaaantngagaaanaancnnaaaaattcngggtttttacccnaagaacgtgngtggatnacaaaaatattttntnaacttggttntgnngatntattccggacacttaatcctgnnccnnannnatatnnctngtngnnanancgnggnagngngngggataannntgntngttngannntannttancnngntnncnctcnnngnantggngnnaaancnnntaaanngnnnntttanaaanancngnntttttnanntnnnnccncacngnnnatngnntntnnntanagnntttanncacattnnntttntanaanagannntcncncnnctannntnttnnnntnnanatnccngnnnaaanacncngnnnaaaaantnnggnnncnnctcnccntttaangnnntnatttttgtgccgnncggtttaaaaaagantagngtnncccggntnncgttgtgatnttntgnaaancagnntncttntttgganntcannttancaancangaaacgtattttccctttatantncngnnggngnganntgnccacccgnttgagtgcnnngnnggaaggtcaaccggggnnntnaancnggacnancnnnttttcncccntgccgnttgnngan

SEQ ID NO: 1016 - DNA, 4000 bp, Escherichia coli
  misc_feature (1284)..(1284): n is a, c, g, or t
  misc_feature (1401)..(1401): n is a, c, g, or t
  misc_feature (1978)..(1978): n is a, c, g, or t
  misc_feature (1981)..(1981): n is a, c, g, or t
  misc_feature (1984)..(1984): n is a, c, g, or t
  misc_feature (1990)..(1990): n is a, c, g, or t
  misc_feature (2837)..(2837): n is a, c, g, or t
  misc_feature (2855)..(2855): n is a, c, g, or t
atggatactgcacttactgctgtttcagtcttatttatagccgtaagctgggcccctttgcttccttcttctcattggttagtaagagtgtgggaatttccgcgactacaaatagcagctatcatttctttgttaattgctgggcatatttttgaatcaacctattacgcacagatagatagcctagcagtaattattgtcgctggattaacagttagccttatttatcaggttatctggatcattccttatacccctctgtataaaagagaagttaggcacgtcgaggttgagagtgcgagccaaaagctaagtgttttatcaagcaatgtgtatatgcctaatgacgattttcgcaagctcattgaacatgtacgtaataagcaacctgattttctcgtaacgttggaatctaatgagaagtggcagaaaggcatcagtgaaattgaatctgaatacccgtatcgtaaattttgcccactcgaaaacctctacggtatgcatctttatagtaagcttccctttgaagaggtctcattgcgatttctaatagaagaagatgtgccgtctatgaaagttaaaatcaatcaccacggacaagatgtcacgctatattttcttcatccaaaaccaccaagcccaacagaaaacacgtatgcaaagcccagagacgtagaacttactgttgtgggggaagaaatagctgaaacagagggccctattgtcgtcgctggcgatcttaacgatgtggcttggtcacctactaccagaaagttcaagaaaataagcggacttttagacccacgagaggggcgcggttttttcaatacatttcacgcgaaatatcctttagtgaaatggccgttagaccacgtatttcactcggaacattttgcattggtcaatatagagaagcttgaaagcataggctcagaccactacccgctttataccgaactagcgctaatcacggacaaggagtaatactcaagactgtaaatctaatgagagctacggtgtttgacacaccacatgaggctatcacacgcctcttcacgctttttaaaatgggctagccctattagcttgttatcccgaggccaaaccgcttggtttagcacctcttgatcttctgccgatagttgttcgctatctaacacaatctcaaccgcttttttgttgggttttattaatgtggggttagcttctttgaccagagcagagttcacacaaatatactctctcttaacagggtctctcaccacgccgatgtagttgttgtcncaaattatagctggccagccttccgttattctgctctgtccaaacattacgagtgtaaaagcaacaagaacgaaaagtgttaaaccgataaattgagcgctcaaatctggtgctacncttacaataacgccgacaacagctgcgaaaaatatccagccgccaaatactctgcgcatagcatttggtgagataccagatataacatcaaccacctttaatgattgtttgtcatagtgtcgaataaatacagacgattgtgattccacagcctttgtccaccagaaaaaatacgaaattcagaaattaatacgttacaagtaaggctgaagatttacctacactctgagtgagtaaaaaccaataatatgagattagttctactcgaaagaaaacgtgttaagcaatatttgtaggaatatttaaactattgaattgtaatgtttaacctactaaccaagcatatcaaaatatgtgggaacggcaaagcaattacgcgctagatgcacagtaaaacaagacttatgaaaagaagcgtcatgttaatctgcaaattagaacagaccaccaaaaattaacataaaaaactgctgttggcctccatacattcgtttgtaaatttttctctcactttgcacctcttgcttgccttggcgctcaaccattgctgcaaatactcaaaaacagaacttgaaantanacnttttancaaaaaatcaataatttacaaaacaggaacactctttgcttctacgaaagtataacgttcaacgtttcatgtcgtcgttattacaggttcaacaaattagaaagggaggaagagtatgcgttcaccaataagtgcagtaactattgttaagagcagaactgagaaactggccaatttgattactcagttagagcaatgctctccaacgccagatgagctagtcattgtttggatggcacctccttctgatttgtcactcgtacgcagtgacaaattcgacattgttcacaagtttgtgactcaagatgctcttccgatagcgaaagcgcgcaacaagggtatgtcagcggccaagcacgcgaatttagtttacctaaacgtagacgcagttattgccccatcgctttttagagatggcttgcttgcgcttcgtgacaacaccgtagtgttcacatcagtggtgtttttacccaacgagcgctgttgtaagccctaccgacaaatttcaaaagatgaaaaagaaatcggttatttagcaagtaatgacgacacgttacccgaagacgacaataacgaaataccttcaagagatcaggaaattaatcatggaaagtttagtgacgatagtatttgttctacagtgttttttattcgtaaggcagactttcagaaaaccggcggcttcgatgaaggctacgcgggtttcggactaaacgacgaagatttcttcactaactgtagggcattagggttttcgttagagcaattgcccacgcgaacatttgcaccacaccggcctaattatcaatgcccgataaatcaccttttagactttgttcataatgcncagcgttttcactcgaantggggattttacccatgtgtcaatgtattgaacgcgtatgcagaccaaggttttattaatgctgacttcaagcaaaacggcattaagatcaagcacctcccccagcaggtagaggaagacaaggcggacgcgccggttgagcaattaacggtaaccaacgcccaaaacaatgttgaatttacgtcttttcattcgccggagaaaggctctgaccttttaagcacgaccgcataaaacgctttcagggagatatggaatgtctttattgaaaccgaatctaaccgagcgctttttgtcgtttgtaggggaagccgatttcccctgcgtcggagccaaaacagccctcaataaaagccaaattcatgtgaatcaatacgacgatattcgctgtcctctcaatgagacagatatgttggcgtcaattcaccaatttgtagagtcgtttgatcttgaacgggacatgtactcctctttggtcgcaacttttgagcttccagatacgataagcgaaactgaatttgatcgggttttatgggaaaaattgcagcgtttacacgagattgacgcctgtttaaaaccttgggatagtaaagtatcaagtgaccctcataacgctcagtttagcttgagtttaggcggaaagggtttctttgtagttggactgcatccaaatgcatcaagaaaaagccgtcgatttccctaccctgccatcgtgtttaatttacacgagcaatttgacatgttgagaaagcagaagcgttttgaagcattcaaagaccacattcgtaaacgagataccgcgtactgcggaagtaaaaatgagctactcgcaaaccatggtgatagctcagaggtatatcaatatagtggtgtaaaacattccgaaaactgggaatgcccgttcaagcggattaagcactaaacctaaataaaagggacaagtcacataatgttacaaactatacagccaagaagcggcactgcatttactatgaaaaaaggggaaagacttaaagttattgatccagaaggtgaacaagtggccgacctctatgcgttcaatgaacacgataaaaatgagtttatctcttcaggacgaagtttagattacaatgaaagcatccaattcaaaaaaggcagcttgc

SEQ ID NO: 1017 - DNA, 4000 bp, Escherichia coli
  misc_feature (1577)..(1579): n is a, c, g, or t
  misc_feature (1985)..(1985): n is a, c, g, or t
  misc_feature (3242)..(3246): n is a, c, g, or t
  misc_feature (3248)..(3249): n is a, c, g, or t
  misc_feature (3252)..(3253): n is a, c, g, or t
  misc_feature (3255)..(3258): n is a, c, g, or t
  misc_feature (3260)..(3262): n is a, c, g, or t
  misc_feature (3264)..(3264): n is a, c, g, or t
  misc_feature (3267)..(3268): n is a, c, g, or t
  misc_feature (3270)..(3278): n is a, c, g, or t
  misc_feature (3283)..(3291): n is a, c, g, or t
  misc_feature (3294)..(3294): n is a, c, g, or t
  misc_feature (3296)..(3299): n is a, c, g, or t
  misc_feature (3302)..(3305): n is a, c, g, or t
  misc_feature (3308)..(3308): n is a, c, g, or t
  misc_feature (3311)..(3311): n is a, c, g, or t
  misc_feature (3313)..(3319): n is a, c, g, or t
  misc_feature (3322)..(3322): n is a, c, g, or t
  misc_feature (3324)..(3325): n is a, c, g, or t
  misc_feature (3327)..(3331): n is a, c, g, or t
  misc_feature (3335)..(3335): n is a, c, g, or t
  misc_feature (3337)..(3340): n is a, c, g, or t
  misc_feature (3344)..(3345): n is a, c, g, or t
  misc_feature (3347)..(3351): n is a, c, g, or t
  misc_feature (3354)..(3355): n is a, c, g, or t
  misc_feature (3357)..(3361): n is a, c, g, or t
  misc_feature (3363)..(3366): n is a, c, g, or t
  misc_feature (3368)..(3368): n is a, c, g, or t
  misc_feature (3373)..(3384): n is a, c, g, or t
  misc_feature (3386)..(3386): n is a, c, g, or t
  misc_feature (3389)..(3390): n is a, c, g, or t
  misc_feature (3392)..(3396): n is a, c, g, or t
  misc_feature (3398)..(3404): n is a, c, g, or t
  misc_feature (3407)..(3411): n is a, c, g, or t
  misc_feature (3413)..(3419): n is a, c, g, or t
  misc_feature (3421)..(3428): n is a, c, g, or t
  misc_feature (3431)..(3433): n is a, c, g, or t
  misc_feature (3435)..(3441): n is a, c, g, or t
  misc_feature (3444)..(3448): n is a, c, g, or t
  misc_feature (3450)..(3456): n is a, c, g, or t
  misc_feature (3458)..(3458): n is a, c, g, or t
  misc_feature (3461)..(3467): n is a, c, g, or t
  misc_feature (3469)..(3469): n is a, c, g, or t
  misc_feature (3472)..(3472): n is a, c, g, or t
  misc_feature (3475)..(3476): n is a, c, g, or t
  misc_feature (3478)..(3480): n is a, c, g, or t
  misc_feature (3482)..(3484): n is a, c, g, or t
  misc_feature (3486)..(3486): n is a, c, g, or t
  misc_feature (3488)..(3496): n is a, c, g, or t
  misc_feature (3498)..(3505): n is a, c, g, or t
  misc_feature (3507)..(3517): n is a, c, g, or t
  misc_feature (3519)..(3520): n is a, c, g, or t
  misc_feature (3522)..(3526): n is a, c, g, or t
  misc_feature (3528)..(3528): n is a, c, g, or t
  misc_feature (3534)..(3543): n is a, c, g, or t
  misc_feature (3545)..(3546): n is a, c, g, or t
  misc_feature (3550)..(3550): n is a, c, g, or t
  misc_feature (3554)..(3556): n is a, c, g, or t
  misc_feature (3558)..(3561): n is a, c, g, or t
  misc_feature (3564)..(3573): n is a, c, g, or t
  misc_feature (3575)..(3575): n is a, c, g, or t
  misc_feature (3578)..(3581): n is a, c, g, or t
  misc_feature (3583)..(3597): n is a, c, g, or t
  misc_feature (3599)..(3605): n is a, c, g, or t
  misc_feature (3607)..(3607): n is a, c, g, or t
  misc_feature (3609)..(3611): n is a, c, g, or t
  misc_feature (3615)..(3616): n is a, c, g, or t
  misc_feature (3618)..(3618): n is a, c, g, or t
  misc_feature (3620)..(3621): n is a, c, g, or t
  misc_feature (3623)..(3626): n is a, c, g, or t
  misc_feature (3628)..(3636): n is a, c, g, or t
  misc_feature (3638)..(3643): n is a, c, g, or t
  misc_feature (3645)..(3652): n is a, c, g, or t
  misc_feature (3654)..(3661): n is a, c, g, or t
  misc_feature (3663)..(3665): n is a, c, g, or t
  misc_feature (3667)..(3668): n is a, c, g, or t
  misc_feature (3672)..(3676): n is a, c, g, or t
  misc_feature (3678)..(3684): n is a, c, g, or t
  misc_feature (3686)..(3688): n is a, c, g, or t
  misc_feature (3691)..(3695): n is a, c, g, or t
  misc_feature (3700)..(3701): n is a, c, g, or t
  misc_feature (3703)..(3710): n is a, c, g, or t
  misc_feature (3712)..(3712): n is a, c, g, or t
  misc_feature (3716)..(3716): n is a, c, g, or t
  misc_feature (3718)..(3722): n is a, c, g, or t
  misc_feature (3724)..(3732): n is a, c, g, or t
  misc_feature (3734)..(3736): n is a, c, g, or t
  misc_feature (3739)..(3739): n is a, c, g, or t
  misc_feature (3741)..(3743): n is a, c, g, or t
  misc_feature (3746)..(3762): n is a, c, g, or t
  misc_feature (3765)..(3769): n is a, c, g, or t
  misc_feature (3772)..(3778): n is a, c, g, or t
  misc_feature (3781)..(3781): n is a, c, g, or t
  misc_feature (3783)..(3801): n is a, c, g, or t
  misc_feature (3803)..(3803): n is a, c, g, or t
  misc_feature (3806)..(3811): n is a, c, g, or t
  misc_feature (3813)..(3815): n is a, c, g, or t
  misc_feature (3817)..(3819): n is a, c, g, or t
  misc_feature (3822)..(3822): n is a, c, g, or t
  misc_feature (3824)..(3824): n is a, c, g, or t
  misc_feature (3826)..(3827): n is a, c, g, or t
  misc_feature (3830)..(3831): n is a, c, g, or t
  misc_feature (3836)..(3843): n is a, c, g, or t
  misc_feature (3846)..(3846): n is a, c, g, or t
  misc_feature (3848)..(3848): n is a, c, g, or t
  misc_feature (3850)..(3851): n is a, c, g, or t
  misc_feature (3853)..(3861): n is a, c, g, or t
  misc_feature (3863)..(3873): n is a, c, g, or t
  misc_feature (3877)..(3885): n is a, c, g, or t
  misc_feature (3888)..(3891): n is a, c, g, or t
  misc_feature (3893)..(3893): n is a, c, g, or t
  misc_feature (3895)..(3897): n is a, c, g, or t
  misc_feature (3899)..(3899): n is a, c, g, or t
  misc_feature (3901)..(3905): n is a, c, g, or t
  misc_feature (3907)..(3908): n is a, c, g, or t
  misc_feature (3910)..(3912): n is a, c, g, or t
  misc_feature (3915)..(3925): n is a, c, g, or t
  misc_feature (3927)..(3936): n is a, c, g, or t
  misc_feature (3938)..(3940): n is a, c, g, or t
  misc_feature (3943)..(3943): n is a, c, g, or t
  misc_feature (3945)..(3950): n is a, c, g, or t
  misc_feature (3952)..(3957): n is a, c, g, or t
  misc_feature (3960)..(3960): n is a, c, g, or t
  misc_feature (3963)..(3968): n is a, c, g, or t
  misc_feature (3970)..(3974): n is a, c, g, or t
  misc_feature (3976)..(3977): n is a, c, g, or t
  misc_feature (3979)..(3981): n is a, c, g, or t
  misc_feature (3983)..(3990): n is a, c, g, or t
  misc_feature (3993)..(3993): n is a, c, g, or t
  misc_feature (3995)..(4000): n is a, c, g, or t
ttcctcacgacgtccggccgtggcgcataaacgtgctgttggacgaagagggattcaaagatgagtgtcgccgatgggacgtcaacgagcttgtttttggcgatatttggaaaatttaccaaccgctgatgcgcgcagattttcacttgtttgacaaatacgatcacgtacacgatgggaaggagaactttacatggcctctgaccgtgtttcacggcgagagcgatcggatgatcacgcgcgagatgtgtcaaggctgggaaacgcacacgacgggcgagttcgagctgctcgcgatccccggtcatcacttgttcccgcttcaaaaagatcaaaaggcgatgtggcttcgaaaaatcgccgaaagacttcagaacgtcgtcgcgcgcaccgcggcgtaatcactcgggtgcattcgagtcgcgaacggttgtcattgatgatgttttgtgttcacatcgctattctctatcgattctaccgactacgcgcctcccgcagctttgcgtttccgctcgagatacctcgctcgcgcgtcgctcacgtcggcttctgtgttcctcctcgcattcgagtcaacttttaccggtggcggcgtctcgacggcgatggctcccgctgctttcgttggcctctccaccagcgtcacgtcggacgggatcggaggtatcgccggcgtctccgccgcccgcgcgatgagttcacgatcgcgatcggccgcgctcgtgagcttaggcgccgtcgtcgcgtttgatggcttcgttgcatcgggttcgggcgcggctcgccgcgtgtctctcgctgcatcgccgcccatggctgaattcctatgcatgaggttggagtaaaacgaagtcatcgcaccggcgccacgctttgtgacatcttcctcttcctccactgcatcgcgcgccttgtcttccgccaaccacttcgcgtcttcctgtagcttggctctatacgccgccgtcacaaacttgtccttatccgcatacaagtgatcctccttcaatctttccttcaacagtcgtctctcgtacgacgcgtcgtcctccttcttcctcgcctccgccttggctatcaaatctcctatatacctcgactgtcgctccacgcgttcgctcgccagctccttcgccttcgcacctcgtgactttgcgatatcatcgaacaccgcgtcgtactcaaacgcgttcgcgtcttccttcaacgcctcgctcgtcgtcgtcgccgctctcgccgcgtctcgtctcgccttgagcgccatcgcctcttgttgtcgcttcacctccgcgttcgcccgctcccgcgccttgacgggatcgtcatcatcaccttcatcgctgtcggaatcgcacgcgaacgccgccaacgccggtctcggcgcgggtttcccgcccgacgtccctcgcggtttcttctttggaagatttaacccgtacgccagcgtcgcgtgcgacgacgcgtcgtcgcgcgcgttcgacatcgagatcttccttccttcctgccaccttccgcgtcgtcgtcgccgtcgcctcgcgatcgtcgccgtcgccgtcgtcgcctcgcggtcgtcnnngtcgccgccgtcgtggtgtggggacgtcgcgacgggtccgaacgaagccaacgccgacggggtcgagatggcgtcgtcgcgcgaggacgacgacggacgagcgacgcgatgggagacgcgacgggagacgattttcttcggacttcgggcttcggacttcgccgtcggcgtcgaccgcgcgcgcgcgcgtcgcgcgtctcgcgaacgacgatcgcgtcttcaacgactcgaaacgtcattcgttcgttcgttcgttcgttcgttcgttcgttcgttcgttcgcgcgcgcgcgcgtttccgcgacgtcgcggacgcgcgccatcggcgacgtcgcggacgcgcgccgtcgtcgtcgatcgcggtcggtcgcggatgcgcgtcgacgtcgtcgcccgtcgacgacggncgcgtcctagggttgtgcgcccggtaccgggcgcgacgccccgcggcgtttcgcgtggaggtcgggaggtcagtcgacgacgcgcggtggcggcgcgacggtggactcgagacgaatcgaacgtcgaacgaacgacgcgcatcgaatcgacccgacgcgacgtcgcgcgcgacgaggcgagacgcggccgacgccgccgacgccgccgacgacgaatcgcattcgcggagattgtgaatcgcggagattgtgaatcgcgtggcgcgagacgaacgatatgggtgcgtgtgcgtcgatgctgtgcgatgcaccgccggagggaggagaagtgtcgcgattggcggatacactcgtgcgtctgggggcggagcggaggacggtgaacggtgcgctgcggttattctggcgcgctgataaagacgggagcgggacgctcgggttgaaggaattcgcagagacgtttgcgttgcgcacgcggaacgcgtttttaccgcgtatgatatcgcttttcgacgtcggaggcgacggggacatcggggcgttggagtttgtcatgtgcatggcgcagtttcacgaaagaagcgcgtcggcgcacatatatttcgcttggcgactgttcgaccaagacgactcgggttcgatgacgatggaggagtttgaaaccatcataaacaactcgatgagctacacgggatcgaatgaaggtttcagcggtggatcacatgatcatatgggggaccgcatcgttagagctggccgcaacggggcacgagtgcgggtgaaaggcatgagacaaatcatcaaacaagccgacttggacaacaacggcgtgatcacaatcgacgagtttaaggttctttgcgcgaatagctcgcatatcgccgcgccggctttcgagctgtggagtgcagtcgaggcacaatcgaaaccttgttggaaactgaaggaagagctcaaggcgaaaggcaagcttgaagcagtactagagatgctcagcccagcggcgagaaaagcgttgggagtgaaacgcaaaacggacgtggatcgcaaagataggcgtcacggtgcagcacgccggacgatggggaacaacagaagaaagccagaacgaaagatacccggtgacctcgcgttcatggactccgtgaaaataaaaaatgaagacgacgctgcgcgcggtgagcggcagtcgggcgagcggcgcgcgggcgcgcgagaacatcgagatcaccgcgaacgcagtcatcgacatcaccnnnnncnnagnnannnncnnnancanngnnnnnnnnncgatnnnnnnnnncgngnnnntcnnnntgntcncnnnnnnnatnanncnnnnngtcncnnnnatcnncnnnnnganngnnnnnannnncnaccgnnnnnnnnnnnntncgnncnnnnncnnnnnnncgnnnnngnnnnnnncnnnnnnnncgnnngnnnnnnnggnnnnnannnnnnncngtnnnnnnnanacnaanngnnncnnncncnnnnnnnnnannnnnnnngnnnnnnnnnnngnnannnnngnggcggnnnnnnnnnncnnccgngcgnnngnnnnccnnnnnnnnnngncgnnnncnnnnnnnnnnnnnnngnnnnnnncnannncganntntnngnnnngnnnnnnnnngnnnnnnannnnnnnngnnnnnnnntnnntnntatnnnnngnnnnnnnannnttnnnnncatcnntnnnnnnnntnttcncnnnnncnnnnnnnnngnnnttngnnntcnnnnnnnnnnnnnnnnntgnnnnnaannnnnnngcncnnnnnnnnnnnnnnnnnnngncgnnnnnncnnncnnngcncncnncgnngcgcnnnnnnnngcncncnncnnnnnnnnntnnnnnnnnnnngacnnnnnnnnnttnnnncncnnngncnnnnnanncnnncgnnnnnnnnnnngnnnnnnnnnncnnnggngnnnnnngnnnnnncgncannnnnncnnnnngnnannncnnnnnnnntangnnnnnn

SEQ ID NO: 1018 - DNA, 4000 bp, Escherichia coli
  misc_feature (23)..(23): n is a, c, g, or t
  misc_feature (201)..(202): n is a, c, g, or t
  misc_feature (207)..(208): n is a, c, g, or t
  misc_feature (563)..(563): n is a, c, g, or t
  misc_feature (565)..(565): n is a, c, g, or t
  misc_feature (587)..(587): n is a, c, g, or t
  misc_feature (608)..(608): n is a, c, g, or t
  misc_feature (1978)..(1978): n is a, c, g, or t
  misc_feature (1981)..(1981): n is a, c, g, or t
  misc_feature (1988)..(1988): n is a, c, g, or t
  misc_feature (2163)..(2163): n is a, c, g, or t
  misc_feature (2168)..(2168): n is a, c, g, or t
  misc_feature (2170)..(2170): n is a, c, g, or t
  misc_feature (2177)..(2177): n is a, c, g, or t
  misc_feature (3805)..(3805): n is a, c, g, or t
ctcctttttcaggttcagatcantctccaccttcagcggcggcttcaccgccgccttcaaacttcaaagcttcatacattgttttttgaacgggcggcagatagttcatcaagtcgttttcaataaaatccggacgctgtccgccctcaatgtaaagcacgccgtcacggatcatttccatcaaaactttttcctcacccnnatagnnttcaagcttctttttggctggagcaaaaatagtattcgcaaaaagggatccataaaaggtggtaatcaaagccacagccattgcagggccaatagcggaaggatcatcaaggttctggagaagaagtaccagtccaaccagcgttccaagcattccccaggcagggcagagagaagccattgttccaaccacagcaatttcattatccttgccggacattgtatattttacttcgtgagccatcatgttcactattgcctcccggtcagcacggtccaccaccagtcttaatcctccgcgcaggaaaaggttttcgacgctgggcagtgcgtcttcaattgccagaatatttttncnggcaattttagaaacgtcaatnatcaaggtcagcgtttctacnagttgaaccgaattcggcttccatgacttaccgatatatcccaaaaaacccttcgcatctcccatcgggtgagaaataaaggtcgaggcgattgttcctccaaaaacgatcattaatgaaggtgtgtccaagaaatatattacgtttccggcattgactgagagagtggcaaaatcaaaagtcatggcaaacaacaacataaaccatgctaaaatagtcccaattagcgtaccctgttccataaaaagttttctacagatgtttatgaaatgaggttttaaagcctcaaaaattaattatttaaatagttatttttgtaacacgctttaggattagcaataactgtgaaaattcaaacagttgatctgaattaattgtggaacattatatgatcaccaccgaaaaatcctggtttaacaaaaagtggaaaaatttttctgcatctttgcatgccagttaagaaatcaataaacgcaaataaattttcaattattatagacgcagattgttgtttttacaggattttatttaatattatggaaggattatcgatacaggactttattaagaatgcagcaccattcactcatcaaagttaaacaagcgctgtgcgtttgctgtggtttgttgtgctaattcctccagggaaatttttctcaacttagcaataaaaccggcaatggcgggaatgtgtgccggtttgttgggttttccacgaaagggaattggggcaagaaagggtgagtctgtttccagaagtaaatgctcaagtggaagccaacgcaccacttctcgtaaatcttcggcattcttaaaagttactattccattaatgcccagataccatcccatatccacaagtatttttgccatttcaattgaactggtgaaactgtgtgccacaccaagagatggtaccggaaactcctgcagaatactcagggtatcggtttctgcttcccggctgtgcaggataactgggagattgagctcaactgccagttgaagctgttttcggaacgcctgttgctggatctcagcaggactgttcatataatgataatcaagtccagtttcgccaattgcaatcagtttatgctgttcttcggcaagttgccgaattttttgtaatagcgactttgtaagttttgaagcatcatgcggatgaaaaccaacacttccgtaaactgcaggaaattcctgtactgtacttgagacgaaatccagagatggctcatctacagcaatagtaaccatccgttgaacacctgcctgttttgcttcaataattgcttcttccggagttgattccaggatgtcaaggtggcagtgagtatcaataaaacttgtcatagagtgtgtaaatgggntanatttgtngtgataataattttaagaatttgcttgctgtttgtaatgtcgaagccgtcagttttgactctgaactcacagcagaaatccgtctgctgctctgcaacctttcaaaattttggcaaatgatcaacttaaaattcagctttaatcctgcgtccatcttatcattgctgattgcttncgtantntcggttntgctttccggctgttataccgtacgtgtttatcacgatacagacatgctgcgtgaaaagcacgatggggaaatttccagcgtcagtatgctattcacagacagccaaatcggcggcccggcaaaaattagttcagcctgtcccggaggtgcttcacttatcgaaatagagcaaactgtttcagacggtctggtgcattatctgagccttggattctacagtccgcaaaccattcgcgtctggtgcaaacgaagaaaaaggtaaaatgatgaaacaagaatggatccgcttatgtcaacgtgttgattatcaattcaaaaaaccggaaattctccgccaagcactgacgcataaatcttatctgccagtggatttagatgaaaaatttagtaataacgaaaggattgagtttcttggtgatgcagtcctggacctggtgatcagtgaaatgctgatggaagggtttccggaactcgatgagggaggactctcaaaattccgggcaagcctggtcagtgaatccggactcagcaaacaggccgtgaccctggaattaggcgaatgtttgttacttggcaggggtgaagaaatgacaggagggcgaaagaaaaaatctttgctggctgacacctttgaagcagttatggcagctatctaccttgacagccgtgaagaacacggactctcccaaatcaccagagtaattcgcaaaatttttcttccacatttgccgcaagatgcagagggttatattacacgagattataagtcagaactgcaggaacacgtacagaaaataatgggaattccctcgacatatgaactggttgaagaatctggtcctgatcatgaaaaggaatttacgatggcagtttatgtcaaagaaaaagaatacggacgagggcgcggtgccagcaaaaaactagccagtcagcttgctgcagaaaaagctttattgaggatacaagaggacacttcttttcttcaaacagaaggtaccagctgatgcaaaattttcattcagcagagcctgtacggatccaaaaagttattgcccaggccggaattgcgtcaagacgtgctgcagaaaaattaattttggccggcgaagtgaggctgaatggtgaaactgtcctgaagatgggacagaaaatgctcgttggaaaagaccacttgagcgtggaaggacggcgggtaaaattaccgcagcgtcaaaaaacgcaggtatatgctctttacaagcctaaaaattgcatcacgaccctcaacgatcctgagggacgcaccacaatcagtgacttttttcctcgaacttcagccaggctttttcctgtaggacggcttgattatgatgcagaaggcttgattttactgaccaacgacggtgaattggcccagcagctgatgcatccccggcacaaggtttggaaaggttattttgttaaggtacgtggtatcgttgagaatgcagctctgtcaactttgcggaaaggaccggtgattgaaaaacgcaggcaccagcctgtacgggtaaaaattctgcatactgtaaacgataaaacatggcttgaggtctttctcagggaaggaacaaaccggcaaatcaaaaaaatgctccaagacttaggntatccggtgcaaaaaattaagcgcttccaggttggaacggtttctttaggtgacttgcagtccggcgaaagcagagctttgagtccggaggaaatgaaacaattaatgaattaagtccgaaagtcaacaccaccctccactcaagacccaacattctacactcaaacaatggccaaggctgaattatataaaatt

SEQ ID NO: 1019 - DNA, 4000 bp, Escherichia coli
  misc_feature (1229)..(1229): n is a, c, g, or t
  misc_feature (1283)..(1283): n is a, c, g, or t
  misc_feature (1534)..(1534): n is a, c, g, or t
  misc_feature (1970)..(1985): n is a, c, g, or t
  misc_feature (1987)..(1999): n is a, c, g, or t
  misc_feature (2047)..(2076): n is a, c, g, or t
  misc_feature (2124)..(2126): n is a, c, g, or t
  misc_feature (2128)..(2135): n is a, c, g, or t
  misc_feature (2137)..(2137): n is a, c, g, or t
  misc_feature (2139)..(2139): n is a, c, g, or t
  misc_feature (2141)..(2143): n is a, c, g, or t
  misc_feature (2146)..(2153): n is a, c, g, or t
  misc_feature (2155)..(2155): n is a, c, g, or t
  misc_feature (2201)..(2201): n is a, c, g, or t
  misc_feature (2204)..(2204): n is a, c, g, or t
  misc_feature (2206)..(2207): n is a, c, g, or t
  misc_feature (2210)..(2211): n is a, c, g, or t
  misc_feature (2214)..(2234): n is a, c, g, or t
  misc_feature (2237)..(2237): n is a, c, g, or t
  misc_feature (2239)..(2239): n is a, c, g, or t
  misc_feature (2241)..(2242): n is a, c, g, or t
  misc_feature (2244)..(2247): n is a, c, g, or t
  misc_feature (2250)..(2256): n is a, c, g, or t
  misc_feature (2258)..(2258): n is a, c, g, or t
  misc_feature (2261)..(2262): n is a, c, g, or t
  misc_feature (2265)..(2267): n is a, c, g, or t
  misc_feature (2270)..(2274): n is a, c, g, or t
  misc_feature (2276)..(2276): n is a, c, g, or t
  misc_feature (2278)..(2295): n is a, c, g, or t
  misc_feature (2297)..(2301): n is a, c, g, or t
  misc_feature (2303)..(2305): n is a, c, g, or t
  misc_feature (2307)..(2309): n is a, c, g, or t
  misc_feature (2311)..(2311): n is a, c, g, or t
  misc_feature (2314)..(2314): n is a, c, g, or t
  misc_feature (2316)..(2316): n is a, c, g, or t
  misc_feature (2318)..(2319): n is a, c, g, or t
  misc_feature (2321)..(2324): n is a, c, g, or t
  misc_feature (2328)..(2328): n is a, c, g, or t
  misc_feature (2330)..(2333): n is a, c, g, or t
  misc_feature (2335)..(2335): n is a, c, g, or t
  misc_feature (2338)..(2338): n is a, c, g, or t
  misc_feature (2342)..(2344): n is a, c, g, or t
  misc_feature (2347)..(2348): n is a, c, g, or t
  misc_feature (2351)..(2351): n is a, c, g, or t
  misc_feature (2353)..(2366): n is a, c, g, or t
  misc_feature (2368)..(2387): n is a, c, g, or t
  misc_feature (2392)..(2395): n is a, c, g, or t
  misc_feature (2397)..(2400): n is a, c, g, or t
  misc_feature (2405)..(2409): n is a, c, g, or t
  misc_feature (2411)..(2411): n is a, c, g, or t
  misc_feature (2414)..(2415): n is a, c, g, or t
  misc_feature (2419)..(2419): n is a, c, g, or t
  misc_feature (2421)..(2421): n is a, c, g, or t
  misc_feature (2423)..(2426): n is a, c, g, or t
  misc_feature (2429)..(2449): n is a, c, g, or t
  misc_feature (2451)..(2455): n is a, c, g, or t
  misc_feature (2457)..(2463): n is a, c, g, or t
  misc_feature (2467)..(2477): n is a, c, g, or t
  misc_feature (2481)..(2487): n is a, c, g, or t
  misc_feature (2491)..(2491): n is a, c, g, or t
  misc_feature (2494)..(2495): n is a, c, g, or t
  misc_feature (2498)..(2498): n is a, c, g, or t
  misc_feature (2500)..(2503): n is a, c, g, or t
  misc_feature (2506)..(2524): n is a, c, g, or t
  misc_feature (2526)..(2534): n is a, c, g, or t
  misc_feature (2536)..(2541): n is a, c, g, or t
  misc_feature (2543)..(2553): n is a, c, g, or t
  misc_feature (2555)..(2556): n is a, c, g, or t
  misc_feature (2558)..(2565): n is a, c, g, or t
  misc_feature (2567)..(2568): n is a, c, g, or t
  misc_feature (2570)..(2572): n is a, c, g, or t
  misc_feature (2576)..(2579): n is a, c, g, or t
  misc_feature (2581)..(2608): n is a, c, g, or t
  misc_feature (2610)..(2628): n is a, c, g, or t
  misc_feature (2631)..(2632): n is a, c, g, or t
  misc_feature (2634)..(2649): n is a, c, g, or t
  misc_feature (2652)..(2653): n is a, c, g, or t
  misc_feature (2655)..(2674): n is a, c, g, or t
  misc_feature (2676)..(2697): n is a, c, g, or t
  misc_feature (2699)..(2705): n is a, c, g, or t
  misc_feature (2707)..(2709): n is a, c, g, or t
  misc_feature (2711)..(2714): n is a, c, g, or t
  misc_feature (2718)..(2721): n is a, c, g, or t
  misc_feature (2723)..(2726): n is a, c, g, or t
  misc_feature (2729)..(2730): n is a, c, g, or t
  misc_feature (2732)..(2751): n is a, c, g, or t
  misc_feature (2753)..(2781): n is a, c, g, or t
  misc_feature (2784)..(2792): n is a, c, g, or t
  misc_feature (2795)..(2806): n is a, c, g, or t
  misc_feature (2808)..(2838): n is a, c, g, or t
  misc_feature (2840)..(2850): n is a, c, g, or t
  misc_feature (2852)..(2854): n is a, c, g, or t
  misc_feature (2857)..(2862): n is a, c, g, or t
  misc_feature (2864)..(2877): n is a, c, g, or t
  misc_feature (2879)..(2881): n is a, c, g, or t
  misc_feature (2883)..(2883): n is a, c, g, or t
  misc_feature (2885)..(2917): n is a, c, g, or t
  misc_feature (2919)..(2929): n is a, c, g, or t
  misc_feature (2932)..(2954): n is a, c, g, or t
  misc_feature (2956)..(2958): n is a, c, g, or t
  misc_feature (2960)..(2961): n is a, c, g, or t
  misc_feature (2963)..(2978): n is a, c, g, or t
  misc_feature (2980)..(2981): n is a, c, g, or t
  misc_feature (2983)..(2989): n is a, c, g, or t
  misc_feature (2991)..(2994): n is a, c, g, or t
  misc_feature (2996)..(3011): n is a, c, g, or t
  misc_feature (3013)..(3018): n is a, c, g, or t
  misc_feature (3020)..(3040): n is a, c, g, or t
  misc_feature (3043)..(3117): n is a, c, g, or t
  misc_feature (3119)..(3132): n is a, c, g, or t
  misc_feature (3134)..(3145): n is a, c, g, or t
  misc_feature (3147)..(3170): n is a, c, g, or t
  misc_feature (3172)..(3172): n is a, c, g, or t
  misc_feature (3174)..(3184): n is a, c, g, or t
  misc_feature (3186)..(3195): n is a, c, g, or t
  misc_feature (3197)..(3203): n is a, c, g, or t
  misc_feature (3205)..(3207): n is a, c, g, or t
  misc_feature (3209)..(3209): n is a, c, g, or t
  misc_feature (3211)..(3229): n is a, c, g, or t
  misc_feature (3231)..(3240): n is a, c, g, or t
  misc_feature (3242)..(3242): n is a, c, g, or t
  misc_feature (3244)..(3244): n is a, c, g, or t
  misc_feature (3246)..(3248): n is a, c, g, or t
  misc_feature (3250)..(3250): n is a, c, g, or t
  misc_feature (3252)..(3252): n is a, c, g, or t
  misc_feature (3254)..(3254): n is a, c, g, or t
  misc_feature (3256)..(3256): n is a, c, g, or t
  misc_feature (3258)..(3280): n is a, c, g, or t
  misc_feature (3282)..(3282): n is a, c, g, or t
  misc_feature (3285)..(3285): n is a, c, g, or t
  misc_feature (3288)..(3293): n is a, c, g, or t
  misc_feature (3295)..(3296): n is a, c, g, or t
  misc_feature (3298)..(3299): n is a, c, g, or t
  misc_feature (3301)..(3312): n is a, c, g, or t
  misc_feature (3315)..(3321): n is a, c, g, or t
  misc_feature (3324)..(3328): n is a, c, g, or t
  misc_feature (3330)..(3330): n is a, c, g, or t
  misc_feature (3333)..(3333): n is a, c, g, or t
  misc_feature (3336)..(3336): n is a, c, g, or t
  misc_feature (3338)..(3340): n is a, c, g, or t
  misc_feature (3342)..(3344): n is a, c, g, or t
  misc_feature (3346)..(3350): n is a, c, g, or t
  misc_feature (3352)..(3354): n is a, c, g, or t
  misc_feature (3356)..(3357): n is a, c, g, or t
  misc_feature (3359)..(3360): n is a, c, g, or t
  misc_feature (3362)..(3362): n is a, c, g, or t
  misc_feature (3364)..(3376): n is a, c, g, or t
  misc_feature (3379)..(3387): n is a, c, g, or t
  misc_feature (3389)..(3389): n is a, c, g, or t
  misc_feature (3391)..(3392): n is a, c, g, or t
  misc_feature (3396)..(3397): n is a, c, g, or t
  misc_feature (3399)..(3403): n is a, c, g, or t
  misc_feature (3405)..(3408): n is a, c, g, or t
  misc_feature (3411)..(3411): n is a, c, g, or t
  misc_feature (3413)..(3417): n is a, c, g, or t
  misc_feature (3419)..(3426): n is a, c, g, or t
  misc_feature (3428)..(3435): n is a, c, g, or t
  misc_feature (3439)..(3448): n is a, c, g, or t
  misc_feature (3450)..(3451): n is a, c, g, or t
  misc_feature (3453)..(3454): n is a, c, g, or t
  misc_feature (3456)..(3457): n is a, c, g, or t
  misc_feature (3459)..(3459): n is a, c, g, or t
  misc_feature (3461)..(3470): n is a, c, g, or t
  misc_feature (3472)..(3474): n is a, c, g, or t
  misc_feature (3476)..(3477): n is a, c, g, or t
  misc_feature (3479)..(3480): n is a, c, g, or t
  misc_feature (3482)..(3484): n is a, c, g, or t
  misc_feature (3486)..(3490): n is a, c, g, or t
  misc_feature (3492)..(3492): n is a, c, g, or t
  misc_feature (3496)..(3496): n is a, c, g, or t
  misc_feature (3498)..(3498): n is a, c, g, or t
  misc_feature (3501)..(3509): n is a, c, g, or t
  misc_feature (3511)..(3511): n is a, c, g, or t
  misc_feature (3513)..(3514): n is a, c, g, or t
  misc_feature (3516)..(3520): n is a, c, g, or t
  misc_feature (3522)..(3523): n is a, c, g, or t
  misc_feature (3525)..(3527): n is a, c, g, or t
  misc_feature (3529)..(3536): n is a, c, g, or t
  misc_feature (3538)..(3539): n is a, c, g, or t
  misc_feature (3541)..(3581): n is a, c, g, or t
  misc_feature (3583)..(3585): n is a, c, g, or t
  misc_feature (3587)..(3589): n is a, c, g, or t
  misc_feature (3591)..(3600): n is a, c, g, or t
  misc_feature (3602)..(3603): n is a, c, g, or t
  misc_feature (3605)..(3616): n is a, c, g, or t
  misc_feature (3618)..(3620): n is a, c, g, or t
  misc_feature (3622)..(3624): n is a, c, g, or t
  misc_feature (3627)..(3631): n is a, c, g, or t
  misc_feature (3633)..(3650): n is a, c, g, or t
  misc_feature (3652)..(3679): n is a, c, g, or t
  misc_feature (3681)..(3700): n is a, c, g, or t
  misc_feature (3702)..(3703): n is a, c, g, or t
  misc_feature (3705)..(3705): n is a, c, g, or t
  misc_feature (3707)..(3713): n is a, c, g, or t
  misc_feature (3715)..(3756): n is a, c, g, or t
  misc_feature (3758)..(3771): n is a, c, g, or t
  misc_feature (3773)..(3776): n is a, c, g, or t
  misc_feature (3778)..(3779): n is a, c, g, or t
  misc_feature (3782)..(3794): n is a, c, g, or t
  misc_feature (3796)..(3799): n is a, c, g, or t
  misc_feature (3801)..(3802): n is a, c, g, or t
  misc_feature (3804)..(3814): n is a, c, g, or t
  misc_feature (3816)..(3841): n is a, c, g, or t
  misc_feature (3843)..(3867): n is a, c, g, or t
  misc_feature (3869)..(3872): n is a, c, g, or t
  misc_feature (3874)..(3883): n is a, c, g, or t
  misc_feature (3885)..(3916): n is a, c, g, or t
  misc_feature (3919)..(3921): n is a, c, g, or t
  misc_feature (3923)..(3935): n is a, c, g, or t
  misc_feature (3937)..(3937): n is a, c, g, or t
  misc_feature (3939)..(3944): n is a, c, g, or t
  misc_feature (3946)..(3947): n is a, c, g, or t
  misc_feature (3949)..(3951): n is a, c, g, or t
  misc_feature (3953)..(3964): n is a, c, g, or t
  misc_feature (3966)..(3968): n is a, c, g, or t
  misc_feature (3970)..(3973): n is a, c, g, or t
  misc_feature (3975)..(3977): n is a, c, g, or t
  misc_feature (3979)..(3987): n is a, c, g, or t
  misc_feature (3989)..(3992): n is a, c, g, or t
  misc_feature (3994)..(4000): n is a, c, g, or t
aaaaggaaccaacctgttctttgctatctatgaaacagaagagattgataaggatacgaaaaaagtaatccgtaaaagaagttatagcacgattcccttaaatgtagtgatcgaacgccaaaagcagggactttcctcggctcctgaagatgagaatggtaatctacctaaatatatactctctcctaatgatctggtatatgtaccgacacaggaggagattaataagggggaagtcgtaatgccgatagatagggatcgaatatacaaaatggttgactcaagtggcattaccgctaatttcatcccagcttcaacagccaatttgatttttgctttacctaaagctactgcagaaatctattgtaatggtgaaaattgcattcagaatgaatatggtattggtagtcctcaatctaaaaatcaaaaagctataacaggtgaaatggttaaagaaatatgttttcccattaaagttgatagattaggaaatataattcaagtaggttcatgtatactaactaattagattttatcctatgattaagaaaacattttattttggtaatcctgcttacctgtcacttcgtaaccagcaattagttattaagttaccggagatagtaaagaatgatactgtgcccgaaagcttcaaacgacaatcagaaattactaaaccaattgaagatattgcagtgatagttcttgacaacaaacaaattactattacccagggtgtattggaagcattactagagaataattgcgcagttattacatgtgatggacgaagtatgccagtaggcctcatgcttccgctttatggaaacacgacacaaaatgagcgctttcgagatcaattagacgcttccttacctttaaagaaacaactttggcaacagactattcaagcgaaaatcaacaatcaagcatcagtattatgctcttgtaaaaacgaagaaataaaatgtatgcgaatatgggccaatgatgtacgtagtggagatcctgacaatttggaaggacgtgcagctgcttattattggaagtatctgttcggacacatagaaggttttacaagagatcgggaaggtatacctcctaataatttattaaattatggttatgctatccttcgtgctattgttgcacgtggactagtcacaagtggtatgttacccacattgggtattcatcaccataaccgatataatgcttattgtttagcngatgacatcatggaaccttatagaccttatgttgatgagcttgtatttggtttnataagaacaaagggtatatcacccgaaatattaacaaaagaatggaaagcatcacttctttctattcctacattagaagttaagattggaggtaaacgaagtccgttaatgatcgctgtcgctcaaacaacagcctctctttacaaatgtttcagtggagagcaacgaagaatcgtgtatccagaacggtaataatcatggatcgatttagcgaatatcgtattatgtgggtgttggtattatttgacttncctacggaaacaaaaaaagaaaagaaagcttatagtgatttccgtaagaatctgcagcgtgatggctttaccatgtttcagttctctatttatgtgcgacattgcgccagccaagaaaatgcagaagtacacataaaacgagtaaaatcatttttaccagaacacgggcaaataggaataatgtgcattacagacaaacaatttgggaatattgagttgttctatgggaaaaaagtacaacctcctaatacacccggccaacaattagagcttttctagaaataataaatcccgtcataaaacgggatttattacattggaaacttttcttttttattttctaaccattctatcatctagttgatatacagcatataatacagattaagctgtttccaatggatcaaagatactaatttgaaagcaaatcacaacnnnnnnnnnnnnnnnntnnnnnnnnnnnnngctgtttccaatggatcaaagatactaatttgaaagcaaatcacaacnnnnnnnnnnnnnnnnnnnnnnnnnnnnnngctgtttccaatggatcaaagatactaatttgaaagcaaatcacaacnnntnnnnnnnnantncnnnaannnnnnnngntgtttccaatggatcaaagatactaatttgaaagcaaatcacaacntgntnntanngannnnnnnnnnnnnnnnnnnnnttncnanngnnnnaannnnnnnanttnnaannnaannnnnancnnnnnnnnnnnnnnnnnncnnnnnannngnnntnttncnanngnnnnaaanannnnanttnaaannnaanncanannnnnnnnnnnnnngnnnnnnnnnnnnnnnnnnnntttcnnnngnnnnaaaannnnnanttnnaaananannnnaannnnnnnnnnnnnnnnnnnnntnnnnnannnnnnntttnnnnnnnnnnnaaannnnnnntttnaannaanannnnacnnnnnnnnnnnnnnnnnnnannnnnnnnnannnnnntnnnnnnnnnnnannannnnnnnntnnannnaaannnnannnnnnnnnnnnnnnnnnnnnnnnnnnnannnnnnnnnnnnnnnnnnnaannannnnnnnnnnnnnnnnaannannnnnnnnnnnnnnnnnnnnannnnnnnnnnnnnnnnnnnnnnannnnnnnannnannnnaaannnnannnnaannannnnnnnnnnnnnnnnnnnnannnnnnnnnnnnnnnnnnnnnnnnnnnnnaannnnnnnnnaannnnnnnnnnnnannnnnnnnnnnnnnnnnnnnnnnnnnnnnnnannnnnnnnnnntnnnggnnnnnnannnnnnnnnnnnnnannnanannnnnnnnnnnnnnnnnnnnnnnnnnnnnnnnntnnnnnnnnnnnttnnnnnnnnnnnnnnnnnnnnnnnannnanncnnnnnnnnnnnnnnnnannannnnnnnannnnannnnnnnnnnnnnnnntnnnnnnannnnnnnnnnnnnnnnnnnnnttnnnnnnnnnnnnnnnnnnnnnnnnnnnnnnnnnnnnnnnnnnnnnnnnnnnnnnnnnnnnnnnnnnnnnnnnnnntnnnnnnnnnnnnnnannnnnnnnnnnnannnnnnnnnnnnnnnnnnnnnnnnantnnnnnnnnnnncnnnnnnnnnnannnnnnnannnanannnnnnnnnnnnnnnnnnngnnnnnnnnnntntncnnntntncngncnnnnnnnnnnnnnnnnnnnnnnnanaanaannnnnntnnannannnnnnnnnnnnacnnnnnnntannnnntnccnccncnnncnnnannnnncnnncnnannanannnnnnnnnnnnnctnnnnnnnnncncnntatnntnnnnntnnnnccncnnnnnannnnnnnnannnnnnnnaaannnnnnnnnnanncnncnngnannnnnnnnnnannnanncnntnnncnnnnntnccgnanggnnnnnnnnnanannannnnnanntnnntnnnnnnnngnncnnnnnnnnnnnnnnnnnnnnnnnnnnnnnnnnnnnnnnnnngnnnannnannnnnnnnnnanntnnnnnnnnnnnncnnngnnntannnnntnnnnnnnnnnnnnnnnnngnnnnnnnnnnnnnnnnnnnnnnnnnnnntnnnnnnnnnnnnnnnnnnnntnnantnnnnnnncnnnnnnnnnnnnnnnnnnnnnnnnnnnnnnnnnnnnnnnnnntnnnnnnnnnnnnnnannnntnnagnnnnnnnnnnnnncnnnngnntnnnnnnnnnnnannnnnnnnnnnnnnnnnnnnnnnnnnannnnnnnnnnnnnnnnnnnnnnnnngnnnntnnnnnnnnnngnnnnnnnnnnnnnnnnnnnnnnnnnnnnnnnngannnannnnnnnnnnnnntncnnnnnnanncnnngnnnnnnnnnnnngnnngnnnncnnngnnnnnnnnncnnnngnnnnnnn

SEQ ID NO: 1020 - DNA, 4000 bp, Escherichia coli
  misc_feature (1)..(2): n is a, c, g, or t
  misc_feature (4)..(10): n is a, c, g, or t
  misc_feature (14)..(14): n is a, c, g, or t
  misc_feature (16)..(17): n is a, c, g, or t
  misc_feature (20)..(24): n is a, c, g, or t
  misc_feature (27)..(27): n is a, c, g, or t
  misc_feature (29)..(38): n is a, c, g, or t
  misc_feature (40)..(40): n is a, c, g, or t
  misc_feature (42)..(43): n is a, c, g, or t
  misc_feature (47)..(48): n is a, c, g, or t
  misc_feature (50)..(50): n is a, c, g, or t
  misc_feature (52)..(53): n is a, c, g, or t
  misc_feature (55)..(64): n is a, c, g, or t
  misc_feature (67)..(72): n is a, c, g, or t
  misc_feature (76)..(77): n is a, c, g, or t
  misc_feature (79)..(80): n is a, c, g, or t
  misc_feature (82)..(83): n is a, c, g, or t
  misc_feature (85)..(88): n is a, c, g, or t
  misc_feature (90)..(90): n is a, c, g, or t
  misc_feature (94)..(96): n is a, c, g, or t
  misc_feature (99)..(100): n is a, c, g, or t
  misc_feature (104)..(107): n is a, c, g, or t
  misc_feature (109)..(110): n is a, c, g, or t
  misc_feature (112)..(112): n is a, c, g, or t
  misc_feature (115)..(115): n is a, c, g, or t
  misc_feature (117)..(117): n is a, c, g, or t
  misc_feature (120)..(122): n is a, c, g, or t
  misc_feature (124)..(130): n is a, c, g, or t
  misc_feature (132)..(138): n is a, c, g, or t
  misc_feature (140)..(155): n is a, c, g, or t
  misc_feature (157)..(157): n is a, c, g, or t
  misc_feature (160)..(167): n is a, c, g, or t
  misc_feature (169)..(173): n is a, c, g, or t
  misc_feature (175)..(177): n is a, c, g, or t
  misc_feature (179)..(179): n is a, c, g, or t
  misc_feature (183)..(183): n is a, c, g, or t
  misc_feature (185)..(188): n is a, c, g, or t
  misc_feature (191)..(191): n is a, c, g, or t
  misc_feature (193)..(198): n is a, c, g, or t
  misc_feature (200)..(200): n is a, c, g, or t
  misc_feature (203)..(205): n is a, c, g, or t
  misc_feature (208)..(210): n is a, c, g, or t
  misc_feature (213)..(219): n is a, c, g, or t
  misc_feature (224)..(224): n is a, c, g, or t
  misc_feature (227)..(227): n is a, c, g, or t
  misc_feature (229)..(232): n is a, c, g, or t
  misc_feature (245)..(245): n is a, c, g, or t
  misc_feature (247)..(247): n is a, c, g, or t
  misc_feature (250)..(256): n is a, c, g, or t
  misc_feature (258)..(266): n is a, c, g, or t
  misc_feature (269)..(270): n is a, c, g, or t
  misc_feature (275)..(279): n is a, c, g, or t
  misc_feature (281)..(281): n is a, c, g, or t
  misc_feature (284)..(284): n is a, c, g, or t
  misc_feature (286)..(287): n is a, c, g, or t
  misc_feature (289)..(289): n is a, c, g, or t
  misc_feature (1963)..(1963): n is a, c, g, or t
  misc_feature (1965)..(1965): n is a, c, g, or t
  misc_feature (1980)..(1980): n is a, c, g, or t
  misc_feature (1984)..(1984): n is a, c, g, or t
  misc_feature (1987)..(1987): n is a, c, g, or t
  misc_feature (1991)..(1992): n is a, c, g, or t
  misc_feature (1996)..(1996): n is a, c, g, or t
  misc_feature (2013)..(2013): n is a, c, g, or t
  misc_feature (2016)..(2016): n is a, c, g, or t
  misc_feature (2024)..(2025): n is a, c, g, or t
  misc_feature (2116)..(2116): n is a, c, g, or t
  misc_feature (2130)..(2130): n is a, c, g, or t
  misc_feature (2132)..(2133): n is a, c, g, or t
  misc_feature (2147)..(2147): n is a, c, g, or t
  misc_feature (2197)..(2197): n is a, c, g, or t
  misc_feature (2246)..(2247): n is a, c, g, or t
  misc_feature (2258)..(2258): n is a, c, g, or t
  misc_feature (2336)..(2336): n is a, c, g, or t
  misc_feature (2340)..(2340): n is a, c, g, or t
  misc_feature (2343)..(2343): n is a, c, g, or t
  misc_feature (3069)..(3069): n is a, c, g, or t
  misc_feature (3115)..(3124): n is a, c, g, or t
  misc_feature (3128)..(3130): n is a, c, g, or t
  misc_feature (3462)..(4000): n is a, c, g, or t
nngnnnnnnncgcngnngannnnngangnnnnnnnnnngngnngagnngncnncnnnnnnnnnncgnnnnnngcgnngnngnngnnnncngcgnnncgnngcgnnnngnngnggngnggnnntnnnnnnngnnnnnnngnnnnnnnnnnnnnnnngnggnnnnnnnnannnnngnnntntttntnnnntcntnnnnnnangannngannngannnnnnngcggnggngnnnnacgacgacgacgncntcnnnnnnnannnnnnnnngtnntaatnnnnnanttnanntnaaataaaaagtcagtcactcgcgagagacttctagtagttatagggaattaacagcgcgtggtggacgcgcggcgcgcgaatgatcggcgacgcgcggcgctcattggcccgcgcgctcgtcgcgagcggcggcttcttcagccttcatcttggcgatcttcctcgacatgccgagagttttgacgagcgccggcggggcgttgaccggagcgccgttgttgtcgtcgcagtccttgcagtagcagagcaagatggtgtcgataccgagttcgacgatggacatgaagacgttcgcgatgatgaaggcgaacaagatgacgacgacgacgatgaagagcggggaagaaaccttttcgtcaccgtagttgaacgtgtcggcgtcgagcatcaagaaggcgatcgtaccagagcccaaggcgacgaccagcttgccgaggacgagcatgatgtcgccgacgatgttgactgtggcgacggccgcgacgttcttcaccatgagcgccaaggcgttccaggcagagttgcagaaggacgtgccttcgatggcggtcatgatgtacgcgttgcggttcaaccactcgatcgtcttttgcaagtaccacaagcagtattccacgtagtacccgacgtacttgataatcttgctgtccttggacaactttttcatgcggtgcacgatgaagcgcacgatgagtcgaatgaactgcaacaaggcgacgaagaaagaaccgacggcggcggtaccggtgtggtaccacatcatccttttggtcgaggtgataatcggtttgttcttaaggccgttgtagttaccgcccttgaagtagtactgcacaaagacgcacgcgatgatcaagtagcacatggcgacgatccactgcgagccccagaggaagccaaagacgtagtacgcgagagcgccttgcaagttgcggtcccagacggtcgcgtaaccgcagtggcagtcatcagtcggcgtcgtcgaaggagtggcgcagtacatgtacggcggttcgcccgccgccaaggtgcaatcttgttgcttgacttcacccgccgcgaacaagtagacgaaggtgatgagccagtagacgaagagcaacaccatggcaaaggcgggcaagatcgggaacagagtcaactgcggcatctttccgagagcacccgtggcaaccttgatgacgccgacggcaaccttgacgcgacggagcatcaacaaggtgaagaggaaaatgacgcaggtgagcgccgtcgagatgtacgcgaaaatcttgagcgtgtcttgaccgctctcagccggatcggcgtagttggtgatagaagccgacgcactatcggaaaccttgctcacgtacgcgttgacttgatcggaaccgatgacaccggccttgaggtacaagtaaatggtgaccacgacggcgagcgcgttcaccgagaagagcgtggtgtacgcgaagacgctggtgaagtatcggaggaagaacaagaaggcgatgctcaaaacgatcggacaggcgccaccggcgacgacgacaaccttccaaccagtggtgaagtcatcgatgtagcgttccaccgtggcgagcggaccagagagcgccttgtcgatttcgtcgccgagcaacttggtgtaagtccccaaagtgccggagctgtaaccggtgccgaaaggntngacgtacggagccgnaccnacngtcnngggntcctcgcgttccgcctncgnttctccgnncgaatcgccgtcaccaaagagttggcaagtgtagaacgtgttgacgctctcgtagagcacggggtagcacggccccttccactcgagcgangacgttttttgggngnnatccaagtactggnagtagtcgtagttgtccgtcacccattgattcttgtcgtagttcggttgnaacgtgatagtgacgtcttcggggtaatcgcacacaaacgcaaccgagnnggccgtcattntcggctgcgggcaatccttcaagcaaatgctcttcgcgtcgcgcaagttgtacttacgcgtcgcgctcgccgattgancggngtncacacccgccgcccaagcgagttcgcccgggttcatgaaataccgcgtcttgaacccatcgttcttcccttgatcgcaaacttcgccgcggtaatcggtgccgaagagcaaaatcttcggtttccccgtgccgacgccgtaaaagcccagcacgagcatcgcgatccaaaacgcgatgaaaacgatcagaaacaaaatatccgtgcattttcgcggtcctttcatgtgttgatccaactcatccttatcgctgtgcgtcgaatcgtcgcgcgcgttcgcgtcgtcagtcgcgcgttcgtcgccacctggcgccgcgtctcctcccccctccctccattctcacccatcgcgcgcgtccgcgtccgcgcctcgtccgcgcgcgatcgcgtctccatcgtcctcgcgcgcgtctccatcgccgcgcgtccgatccgcgccgcccgcgcgtccgcgcgcgcgactccccggacgattcgattcacgaatttcgcgacgattctcaacgatcgtcgcctctcgcgcgcctctcgcgcgcctctcgcgcgttcgcgcgcgcgttcgcgcgcatcgcgcgagcgcgcgtcaccgcccgcgccgcacgcgtcgcgcgcacctcatgacgaccgtctcgcgcgtcgcgcgcgtgtgcgggcgcgcgcgacgacgcgcgtcgcccgcggccccgcgcgtgcgcgcgatcacgcattcgagcgccgaaaacgcccntgtaaaacgacgaggcgcgcgcgaacataaacggtcggtcgccgtnnnnnnnnnncgannncgcgcgacgccgaacgcgcatattcgagcgcgaaaaacgcccatgtaaaagtgtaaaacgacgaggcgcgcgtcggcgtcgcgtcggcactcggcgacgcgcgacgacgacggcgcgcgcgatgggcgacggcgacgcgcgcgcgagcgacggcgcgatggacgacgcggtgcgcggcgcgcgcgcgcgatcggtggtgcggtgcgtgcgcgacgcgacgacgacgacgacgacgacgacgacgacgaggcgacgacgacgacgacgatgacgatgcgacgatgatgcgggaattcagccgccgcatttgtcaattgacgatgatgaatcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1021 - DNA, 4000 bp, Escherichia coli
  misc_feature (22)..(22): n is a, c, g, or t
  misc_feature (79)..(79): n is a, c, g, or t
  misc_feature (121)..(121): n is a, c, g, or t
  misc_feature (181)..(181): n is a, c, g, or t
  misc_feature (208)..(208): n is a, c, g, or t
  misc_feature (352)..(353): n is a, c, g, or t
  misc_feature (424)..(424): n is a, c, g, or t
  misc_feature (559)..(559): n is a, c, g, or t
  misc_feature (562)..(562): n is a, c, g, or t
  misc_feature (646)..(646): n is a, c, g, or t
  misc_feature (704)..(704): n is a, c, g, or t
  misc_feature (855)..(855): n is a, c, g, or t
  misc_feature (921)..(921): n is a, c, g, or t
  misc_feature (1145)..(1145): n is a, c, g, or t
  misc_feature (1712)..(1712): n is a, c, g, or t
  misc_feature (1728)..(1728): n is a, c, g, or t
  misc_feature (2192)..(2192): n is a, c, g, or t
  misc_feature (2600)..(2600): n is a, c, g, or t
  misc_feature (2660)..(2660): n is a, c, g, or t
  misc_feature (2673)..(2673): n is a, c, g, or t
  misc_feature (2747)..(2747): n is a, c, g, or t
  misc_feature (2921)..(2921): n is a, c, g, or t
  misc_feature (2999)..(2999): n is a, c, g, or t
  misc_feature (3015)..(3015): n is a, c, g, or t
  misc_feature (3212)..(3212): n is a, c, g, or t
  misc_feature (3251)..(3251): n is a, c, g, or t
  misc_feature (3260)..(3260): n is a, c, g, or t
  misc_feature (3275)..(3275): n is a, c, g, or t
  misc_feature (3329)..(3329): n is a, c, g, or t
  misc_feature (3395)..(3395): n is a, c, g, or t
  misc_feature (3473)..(3473): n is a, c, g, or t
  misc_feature (3500)..(3500): n is a, c, g, or t
  misc_feature (3587)..(3587): n is a, c, g, or t
  misc_feature (3605)..(3605): n is a, c, g, or t
  misc_feature (3638)..(3639): n is a, c, g, or t
  misc_feature (3644)..(3644): n is a, c, g, or t
  misc_feature (3662)..(3662): n is a, c, g, or t
  misc_feature (3677)..(3677): n is a, c, g, or t
  misc_feature (3702)..(3702): n is a, c, g, or t
  misc_feature (3719)..(3719): n is a, c, g, or t
  misc_feature (3827)..(3827): n is a, c, g, or t
  misc_feature (3830)..(3830): n is a, c, g, or t
  misc_feature (3836)..(3836): n is a, c, g, or t
  misc_feature (3838)..(3839): n is a, c, g, or t
  misc_feature (3842)..(3842): n is a, c, g, or t
  misc_feature (3863)..(3863): n is a, c, g, or t
  misc_feature (3875)..(3875): n is a, c, g, or t
  misc_feature (3908)..(3908): n is a, c, g, or t
  misc_feature (3923)..(3923): n is a, c, g, or t
  misc_feature (3995)..(3995): n is a, c, g, or t
gacccagccgtcattttgagcntattttttaaagaaattatttatatcatttttgcctatcttttcatatctattttcngcagcaaacaaggtatttggatctgaggcgtagtaggagtgnctgtgatcgatctcttttgtatctacgtaaagatcgggactatttgtgattattgctttntggtttagctcttctcttgctatttgnttgtgatttatgacatttgtgctgataaactgcctaagatcaactctagccgtgacgtcacttaaatttgctattttttcatttccgtctttgtcgtatcctcttacttttagcttgtcaaagagcatatctttttgatctagnntgccgtcattattgctatcaaagctaaaaagtgcgctgttgttttctagctttccaacgcctagctcatcnttatcgccataaatgtctaaaaagacttccacttcgccataatttgtctttagagtgtttgagtaggcgtagtcgtttaaatttttaaattttgtattttctaagtagccactttttaagacaggtagcatggcngcntcatctgtggcatttatatttttaaagtaggcgtttttgctaaagccattagaaagttcgtctgagtaaattttgttgttgctntttattaaattttgcgagtaatcttttaaaatttcttctgctttttgtattgctagangtttgttgtattctttgatatcagcctcagttatgtagatggtatctgttttatttgcttcataaagctcgttaaactggcttaaatttacttttgagctattttgatcgccatgatttgaaaatcttttggagagattttgcaaatcatntaaatttataaaatcatacttttgcggtgcaacattcatctaaaatccttttaaagatgttgcaantaatatcggctaaatttataaaatgtttaagcttataatggtgcccgaggtcggactcgaaccgacacaaggttgcccttatcagattttgagtctgacgcgtctaccagtttcaccactcgggctaagttaagattgaaattttagatttgtgagaagaaagaaaaaggggagacttgctccccgaaaaagaaaattatttctttttaccttttttagcagcnccagcagcaactgcttctttaagttttttgccaactttgaatttgactgctttgctagcaggaacgtcgatcactttcttagttccaggaactctagctttccttgcagctctgtcagcagtaccgaaagtaccaaagcctataaagctaattgtatcgcctttttcaagaaccgcttggattgtctccaaagtagcatcaacaacttttagagtatctttttttgaaagaccagccttgtcggcaaccgcttgaataaattcagcttttttcatgaaccatccttttaagaagttatgcggcaattctacactcttttaaaaaaaaatacaatactttttccctaaatttagctctttttttgcatttttttagtaaaaaagaccaaaatttgaactttcactcacaaatttcaaacgtaagctcgttttttagccctatctttttcatatctacaagctttaaattttcaaaatttaaacccattagctcatctttgtttgtcactttagcatttgcgatctggcgcaaaacctcacctctataagcttttgcatggtggcttantatctttttgtttttnaaaaagcaaaatgtcgtaaattctttttttaccacataaaatttctcataaaatttagctctaagatctaaaatttcatcattttctaaaaagctatcgactgccttgctaaaattttgctcataaaatttacaaatatcaaagccagctagcttttcgccttgctttagtttgtactcagctatctcatcttttgctaaaattggcccaaataaatttgaaaatatcaaaacattattatctatatatttttgagcctcatcgcttagtccgcggtagtttaggtgcttataggcaacgccgtcatatcttaagatagcttttatgctaccttttttagatagactttctcgcagttgctcgctatcctcaagctcttttagtccaaaaagcttttttatctcgtctaaatttgcactttttaaaaactcatcatatctttttaaaatttcagcccttttgcnaaaaagctcagaaaatatcaaatttttaccatcaaatttatcatttgtatttagagaaattttgctttcgcttggtgagaagaggatttttaacgccattttctttcctattttatatatgtaaattttggcagattatacaataaaacttttttgcactaaaaaaaatcaaattttcaccgatatatcacaaagcggaattattcttgcttagagtgaataaaaatttagggaaaaattatgagaattacaaatcaactacgttttagtcagactttgcacgactatcaaaaaaatatggttggcgtaaataaaagctaccagcagctctcaaacggacttaaaatccaagatccatacgacggtgctgcggtttataacgatgcgatgaggcttgattatgaagcnaccactctcactcaagtggcagatgctaccggtaagtcagtaaattttgcaaaaaacacngacaatgcgctgnaagaatttgaaaaacagcttgaaaattttaaaacaaaagtcgttcaagcagccagcgacgtgcatagcacaacntctcttgaagctttggcaaacgaccttcagggcatcaaaaaccaccttgtaaatatcgcaaatacctctataaatgggcagtttttattctcaggaagtgctgtggatactaagccgatcgatggctcaggtaaatatcaaggcaaccgcgactatatgaaaacttcagccggngcgcaggttgagctaccttacaatatcccaggatttgatctatttttaggaaaagatggcgactacaacaaaattttnacaacaaacgtgatgntagctgatcaaactagaactgacatctcttatgcgccaaaatatcttgatgaaaatagcaagataaaaaatatgatcggtctaaactacgcaagcgactcagttgtgggcagtgatggctcttataaaggcacgatcgagcctgattttgactttttggatacttcaaatgtaaatttccctgacacatactttttnatgcagggcaaaaagccagacggcacgacatttacgagnaaatttaanatgagtgctgatacntcaatggctggtttgatggagaagatcggtatggaatttggcaacacaaagacnacaaaagttgtcgatgtgagcataaataacgacggacaatttaatataaaagaccttactaaaggnaatcaaacgatagactttcacatggttgcagctacttctgtggcggcaaatcgtggtgcgatagctccaaacaatacncttgatacggtaaattcgctacaaagncttgaaaatatggcaaatgctgtgccaaaaacggttcatataactgaatttacaaagagcaaataccttgataaagatggaaatttnacaaacgcatttgactangacaaggttagatttgagcgaaaagacaatganntaatngcaaatttacctcaagtngctagaagaacgggngagtttgcaactgatcagacaaagntaagcgaggtttctggnacaaaagagagctacaatagaaatttatacccaaaagatgtcgatgctagaaagagagagctttacaatatagataatcaagagataggtcttcaagtaaaatcaatnacnggcacnanntangacatcaaagtaaaaatgggngaagcaggtggngtaaataccccagtgcagtttcaaataacatcnacaactgctgctggngtggtatctccaactagaaatttgaccgtctataactcagatgaatttggcagttacagaacctatgcaagngactt

SEQ ID NO: 1022 - DNA, 4000 bp, Escherichia coli
  misc_feature (1)..(4): n is a, c, g, or t
  misc_feature (6)..(14): n is a, c, g, or t
  misc_feature (17)..(28): n is a, c, g, or t
  misc_feature (30)..(30): n is a, c, g, or t
  misc_feature (32)..(38): n is a, c, g, or t
  misc_feature (40)..(40): n is a, c, g, or t
  misc_feature (42)..(43): n is a, c, g, or t
  misc_feature (46)..(71): n is a, c, g, or t
  misc_feature (73)..(78): n is a, c, g, or t
  misc_feature (80)..(87): n is a, c, g, or t
  misc_feature (90)..(91): n is a, c, g, or t
  misc_feature (93)..(94): n is a, c, g, or t
  misc_feature (96)..(97): n is a, c, g, or t
  misc_feature (99)..(111): n is a, c, g, or t
  misc_feature (113)..(113): n is a, c, g, or t
  misc_feature (115)..(134): n is a, c, g, or t
  misc_feature (136)..(141): n is a, c, g, or t
  misc_feature (143)..(146): n is a, c, g, or t
  misc_feature (148)..(174): n is a, c, g, or t
  misc_feature (176)..(182): n is a, c, g, or t
  misc_feature (184)..(192): n is a, c, g, or t
  misc_feature (194)..(202): n is a, c, g, or t
  misc_feature (204)..(212): n is a, c, g, or t
  misc_feature (214)..(221): n is a, c, g, or t
  misc_feature (223)..(233): n is a, c, g, or t
  misc_feature (235)..(269): n is a, c, g, or t
  misc_feature (271)..(276): n is a, c, g, or t
  misc_feature (279)..(280): n is a, c, g, or t
  misc_feature (282)..(294): n is a, c, g, or t
  misc_feature (296)..(300): n is a, c, g, or t
  misc_feature (302)..(304): n is a, c, g, or t
  misc_feature (306)..(315): n is a, c, g, or t
  misc_feature (317)..(318): n is a, c, g, or t
  misc_feature (320)..(330): n is a, c, g, or t
  misc_feature (332)..(333): n is a, c, g, or t
  misc_feature (335)..(348): n is a, c, g, or t
  misc_feature (350)..(375): n is a, c, g, or t
  misc_feature (377)..(389): n is a, c, g, or t
  misc_feature (391)..(396): n is a, c, g, or t
  misc_feature (398)..(410): n is a, c, g, or t
  misc_feature (413)..(414): n is a, c, g, or t
  misc_feature (416)..(416): n is a, c, g, or t
  misc_feature (418)..(425): n is a, c, g, or t
  misc_feature (427)..(431): n is a, c, g, or t
  misc_feature (433)..(434): n is a, c, g, or t
  misc_feature (437)..(441): n is a, c, g, or t
  misc_feature (443)..(446): n is a, c, g, or t
  misc_feature (450)..(450): n is a, c, g, or t
  misc_feature (452)..(465): n is a, c, g, or t
  misc_feature (468)..(471): n is a, c, g, or t
  misc_feature (474)..(478): n is a, c, g, or t
  misc_feature (480)..(502): n is a, c, g, or t
  misc_feature (504)..(514): n is a, c, g, or t
  misc_feature (519)..(521): n is a, c, g, or t
  misc_feature (525)..(529): n is a, c, g, or t
  misc_feature (531)..(534): n is a, c, g, or t
  misc_feature (536)..(537): n is a, c, g, or t
  misc_feature (539)..(542): n is a, c, g, or t
  misc_feature (544)..(551): n is a, c, g, or t
  misc_feature (553)..(558): n is a, c, g, or t
  misc_feature (560)..(560): n is a, c, g, or t
  misc_feature (563)..(567): n is a, c, g, or t
  misc_feature (569)..(569): n is a, c, g, or t
  misc_feature (571)..(575): n is a, c, g, or t
  misc_feature (578)..(582): n is a, c, g, or t
  misc_feature (585)..(585): n is a, c, g, or t
  misc_feature (587)..(587): n is a, c, g, or t
  misc_feature (590)..(594): n is a, c, g, or t
  misc_feature (596)..(599): n is a, c, g, or t
  misc_feature (601)..(601): n is a, c, g, or t
  misc_feature (603)..(612): n is a, c, g, or t
  misc_feature (614)..(618): n is a, c, g, or t
  misc_feature (620)..(628): n is a, c, g, or t
  misc_feature (630)..(640): n is a, c, g, or t
  misc_feature (642)..(642): n is a, c, g, or t
  misc_feature (644)..(648): n is a, c, g, or t
  misc_feature (651)..(651): n is a, c, g, or t
  misc_feature (654)..(666): n is a, c, g, or t
  misc_feature (668)..(679): n is a, c, g, or t
  misc_feature (683)..(689): n is a, c, g, or t
  misc_feature (692)..(701): n is a, c, g, or t
  misc_feature (704)..(706): n is a, c, g, or t
  misc_feature (708)..(710): n is a, c, g, or t
  misc_feature (712)..(721): n is a, c, g, or t
  misc_feature (723)..(728): n is a, c, g, or t
  misc_feature (730)..(732): n is a, c, g, or t
  misc_feature (734)..(741): n is a, c, g, or t
  misc_feature (743)..(747): n is a, c, g, or t
  misc_feature (751)..(752): n is a, c, g, or t
  misc_feature (754)..(759): n is a, c, g, or t
  misc_feature (761)..(779): n is a, c, g, or t
  misc_feature (781)..(795): n is a, c, g, or t
  misc_feature (797)..(797): n is a, c, g, or t
  misc_feature (799)..(815): n is a, c, g, or t
  misc_feature (818)..(824): n is a, c, g, or t
  misc_feature (828)..(832): n is a, c, g, or t
  misc_feature (834)..(834): n is a, c, g, or t
  misc_feature (839)..(840): n is a, c, g, or t
  misc_feature (846)..(846): n is a, c, g, or t
  misc_feature (848)..(848): n is a, c, g, or t
  misc_feature (851)..(865): n is a, c, g, or t
  misc_feature (867)..(867): n is a, c, g, or t
  misc_feature (869)..(887): n is a, c, g, or t
  misc_feature (889)..(894): n is a, c, g, or t
  misc_feature (897)..(902): n is a, c, g, or t
  misc_feature (904)..(905): n is a, c, g, or t
  misc_feature (907)..(912): n is a, c, g, or t
  misc_feature (914)..(917): n is a, c, g, or t
  misc_feature (922)..(926): n is a, c, g, or t
  misc_feature (929)..(938): n is a, c, g, or t
  misc_feature (941)..(941): n is a, c, g, or t
  misc_feature (944)..(947): n is a, c, g, or t
  misc_feature (949)..(960): n is a, c, g, or t
  misc_feature (962)..(962): n is a, c, g, or t
  misc_feature (965)..(965): n is a, c, g, or t
  misc_feature (968)..(971): n is a, c, g, or t
  misc_feature (974)..(988): n is a, c, g, or t
  misc_feature (990)..(990): n is a, c, g, or t
  misc_feature (992)..(994): n is a, c, g, or t
  misc_feature (996)..(998): n is a, c, g, or t
  misc_feature (1001)..(1002): n is a, c, g, or t
  misc_feature (1004)..(1017): n is a, c, g, or t
  misc_feature (1019)..(1033): n is a, c, g, or t
  misc_feature (1035)..(1053): n is a, c, g, or t
  misc_feature (1055)..(1057): n is a, c, g, or t
  misc_feature (1059)..(1078): n is a, c, g, or t
  misc_feature (1082)..(1091): n is a, c, g, or t
  misc_feature (1093)..(1094): n is a, c, g, or t
  misc_feature (1096)..(1107): n is a, c, g, or t
  misc_feature (1109)..(1109): n is a, c, g, or t
  misc_feature (1111)..(1112): n is a, c, g, or t
  misc_feature (1114)..(1116): n is a, c, g, or t
  misc_feature (1118)..(1125): n is a, c, g, or t
  misc_feature (1127)..(1128): n is a, c, g, or t
  misc_feature (1130)..(1134): n is a, c, g, or t
  misc_feature (1136)..(1137): n is a, c, g, or t
  misc_feature (1139)..(1145): n is a, c, g, or t
  misc_feature (1147)..(1151): n is a, c, g, or t
  misc_feature (1153)..(1156): n is a, c, g, or t
  misc_feature (1160)..(1160): n is a, c, g, or t
  misc_feature (1163)..(1163): n is a, c, g, or t
  misc_feature (1166)..(1167): n is a, c, g, or t
  misc_feature (1169)..(1173): n is a, c, g, or t
  misc_feature (1175)..(1185): n is a, c, g, or t
  misc_feature (1187)..(1189): n is a, c, g, or t
  misc_feature (1192)..(1198): n is a, c, g, or t
  misc_feature (1200)..(1200): n is a, c, g, or t
  misc_feature (1203)..(1206): n is a, c, g, or t
  misc_feature (1208)..(1210): n is a, c, g, or t
  misc_feature (1213)..(1223): n is a, c, g, or t
  misc_feature (1225)..(1227): n is a, c, g, or t
  misc_feature (1230)..(1236): n is a, c, g, or t
  misc_feature (1238)..(1242): n is a, c, g, or t
  misc_feature (1244)..(1256): n is a, c, g, or t
  misc_feature (1259)..(1259): n is a, c, g, or t
  misc_feature (1261)..(1261): n is a, c, g, or t
  misc_feature (1265)..(1265): n is a, c, g, or t
  misc_feature (1271)..(1273): n is a, c, g, or t
  misc_feature (1277)..(1278): n is a, c, g, or t
  misc_feature (1280)..(1281): n is a, c, g, or t
  misc_feature (1283)..(1283): n is a, c, g, or t
  misc_feature (1285)..(1285): n is a, c, g, or t
  misc_feature (1294)..(1296): n is a, c, g, or t
  misc_feature (1299)..(1302): n is a, c, g, or t
  misc_feature (1306)..(1306): n is a, c, g, or t
  misc_feature (1308)..(1312): n is a, c, g, or t
  misc_feature (1315)..(1316): n is a, c, g, or t
  misc_feature (1319)..(1320): n is a, c, g, or t
  misc_feature (1322)..(1323): n is a, c, g, or t
  misc_feature (1325)..(1325): n is a, c, g, or t
  misc_feature (1327)..(1329): n is a, c, g, or t
  misc_feature (1331)..(1342): n is a, c, g, or t
  misc_feature (1344)..(1347): n is a, c, g, or t
  misc_feature (1349)..(1351): n is a, c, g, or t
  misc_feature (1353)..(1353): n is a, c, g, or t
  misc_feature (1356)..(1363): n is a, c, g, or t
  misc_feature (1365)..(1366): n is a, c, g, or t
  misc_feature (1368)..(1369): n is a, c, g, or t
  misc_feature (1371)..(1372): n is a, c, g, or t
  misc_feature (1374)..(1374): n is a, c, g, or t
  misc_feature (1376)..(1376): n is a, c, g, or t
  misc_feature (1378)..(1378): n is a, c, g, or t
  misc_feature (1380)..(1386): n is a, c, g, or t
  misc_feature (1388)..(1392): n is a, c, g, or t
  misc_feature (1394)..(1402): n is a, c, g, or t
  misc_feature (1404)..(1411): n is a, c, g, or t
  misc_feature (1414)..(1415): n is a, c, g, or t
  misc_feature (1417)..(1418): n is a, c, g, or t
  misc_feature (1420)..(1428): n is a, c, g, or t
  misc_feature (1430)..(1445): n is a, c, g, or t
  misc_feature (1450)..(1454): n is a, c, g, or t
  misc_feature (1459)..(1460): n is a, c, g, or t
  misc_feature (1463)..(1463): n is a, c, g, or t
  misc_feature (1468)..(1468): n is a, c, g, or t
  misc_feature (1480)..(1480): n is a, c, g, or t
  misc_feature (1484)..(1491): n is a, c, g, or t
  misc_feature (1495)..(1496): n is a, c, g, or t
  misc_feature (1499)..(1505): n is a, c, g, or t
  misc_feature (1511)..(1512): n is a, c, g, or t
  misc_feature (1515)..(1515): n is a, c, g, or t
  misc_feature (1520)..(1524): n is a, c, g, or t
  misc_feature (1991)..(1991): n is a, c, g, or t
  misc_feature (2424)..(2429): n is a, c, g, or t
  misc_feature (2433)..(2435): n is a, c, g, or t
  misc_feature (2439)..(2440): n is a, c, g, or t
  misc_feature (2445)..(2447): n is a, c, g, or t
  misc_feature (2449)..(2451): n is a, c, g, or t
  misc_feature (2453)..(2463): n is a, c, g, or t
  misc_feature (2465)..(2465): n is a, c, g, or t
  misc_feature (2467)..(2467): n is a, c, g, or t
  misc_feature (2469)..(2471): n is a, c, g, or t
  misc_feature (2473)..(2474): n is a, c, g, or t
  misc_feature (2476)..(2476): n is a, c, g, or t
  misc_feature (2483)..(2485): n is a, c, g, or t
  misc_feature (2489)..(2489): n is a, c, g, or t
  misc_feature (2491)..(2491): n is a, c, g, or t
  misc_feature (2493)..(2496): n is a, c, g, or t
  misc_feature (2500)..(2500): n is a, c, g, or t
  misc_feature (2502)..(2504): n is a, c, g, or t
  misc_feature (2509)..(2511): n is a, c, g, or t
  misc_feature (2513)..(2513): n is a, c, g, or t
  misc_feature (2516)..(2517): n is a, c, g, or t
  misc_feature (2526)..(2527): n is a, c, g, or t
  misc_feature (2530)..(2531): n is a, c, g, or t
  misc_feature (2533)..(2533): n is a, c, g, or t
  misc_feature (2535)..(2535): n is a, c, g, or t
  misc_feature (2537)..(2537): n is a, c, g, or t
  misc_feature (2540)..(2540): n is a, c, g, or t
  misc_feature (2544)..(2546): n is a, c, g, or t
  misc_feature (2548)..(2548): n is a, c, g, or t
  misc_feature (2550)..(2552): n is a, c, g, or t
  misc_feature (2554)..(2554): n is a, c, g, or t
  misc_feature (2556)..(2556): n is a, c, g, or t
  misc_feature (2559)..(2560): n is a, c, g, or t
  misc_feature (2562)..(2562): n is a, c, g, or t
  misc_feature (2564)..(2564): n is a, c, g, or t
  misc_feature (2566)..(2567): n is a, c, g, or t
  misc_feature (2574)..(2585): n is a, c, g, or t
  misc_feature (2592)..(2594): n is a, c, g, or t
  misc_feature (2600)..(2601): n is a, c, g, or t
  misc_feature (2603)..(2603): n is a, c, g, or t
  misc_feature (2606)..(2606): n is a, c, g, or t
  misc_feature (2609)..(2620): n is a, c, g, or t
  misc_feature (2622)..(2622): n is a, c, g, or t
  misc_feature (2624)..(2624): n is a, c, g, or t
  misc_feature (2626)..(2627): n is a, c, g, or t
  misc_feature (2630)..(2630): n is a, c, g, or t
  misc_feature (2633)..(2634): n is a, c, g, or t
  misc_feature (2642)..(2643): n is a, c, g, or t
  misc_feature (2651)..(2655): n is a, c, g, or t
  misc_feature (2658)..(2658): n is a, c, g, or t
  misc_feature (2660)..(2661): n is a, c, g, or t
  misc_feature (2663)..(2663): n is a, c, g, or t
  misc_feature (2665)..(2666): n is a, c, g, or t
  misc_feature (2668)..(2668): n is a, c, g, or t
  misc_feature (2670)..(2670): n is a, c, g, or t
  misc_feature (2672)..(2672): n is a, c, g, or t
  misc_feature (2675)..(2675): n is a, c, g, or t
  misc_feature (2677)..(2677): n is a, c, g, or t
  misc_feature (2679)..(2683): n is a, c, g, or t
  misc_feature (2685)..(2685): n is a, c, g, or t
  misc_feature (2687)..(2688): n is a, c, g, or t
  misc_feature (2690)..(2694): n is a, c, g, or t
  misc_feature (2696)..(2696): n is a, c, g, or t
  misc_feature (2698)..(2701): n is a, c, g, or t
  misc_feature (2704)..(2708): n is a, c, g, or t
  misc_feature (2710)..(2713): n is a, c, g, or t
  misc_feature (2715)..(2718): n is a, c, g, or t
  misc_feature (2721)..(2722): n is a, c, g, or t
  misc_feature (2724)..(2725): n is a, c, g, or t
  misc_feature (2729)..(2729): n is a, c, g, or t
  misc_feature (2731)..(2731): n is a, c, g, or t
  misc_feature (2733)..(2736): n is a, c, g, or t
  misc_feature (2738)..(2738): n is a, c, g, or t
  misc_feature (2740)..(2740): n is a, c, g, or t
  misc_feature (2742)..(2751): n is a, c, g, or t
  misc_feature (2753)..(2753): n is a, c, g, or t
  misc_feature (2755)..(2755): n is a, c, g, or t
  misc_feature (2757)..(2761): n is a, c, g, or t
  misc_feature (2763)..(2764): n is a, c, g, or t
  misc_feature (2766)..(2766): n is a, c, g, or t
  misc_feature (2768)..(2768): n is a, c, g, or t
  misc_feature (2772)..(2774): n is a, c, g, or t
  misc_feature (2776)..(2776): n is a, c, g, or t
  misc_feature (2778)..(2778): n is a, c, g, or t
  misc_feature (2781)..(2782): n is a, c, g, or t
  misc_feature (2784)..(2784): n is a, c, g, or t
  misc_feature (2786)..(2790): n is a, c, g, or t
  misc_feature (2792)..(2792): n is a, c, g, or t
  misc_feature (2797)..(2797): n is a, c, g, or t
  misc_feature (2799)..(2805): n is a, c, g, or t
  misc_feature (2807)..(2807): n is a, c, g, or t
  misc_feature (2809)..(2810): n is a, c, g, or t
  misc_feature (2812)..(2812): n is a, c, g, or t
  misc_feature (2815)..(2825): n is a, c, g, or t
  misc_feature (2832)..(2832): n is a, c, g, or t
  misc_feature (2834)..(2835): n is a, c, g, or t
  misc_feature (2837)..(2846): n is a, c, g, or t
  misc_feature (2848)..(2848): n is a, c, g, or t
  misc_feature (2851)..(2851): n is a, c, g, or t
  misc_feature (2853)..(2853): n is a, c, g, or t
  misc_feature (2855)..(2856): n is a, c, g, or t
  misc_feature (2863)..(2867): n is a, c, g, or t
  misc_feature (2869)..(2872): n is a, c, g, or t
  misc_feature (2875)..(2875): n is a, c, g, or t
  misc_feature (2877)..(2878): n is a, c, g, or t
  misc_feature (2883)..(2886): n is a, c, g, or t
  misc_feature (2889)..(2889): n is a, c, g, or t
  misc_feature (2891)..(2891): n is a, c, g, or t
  misc_feature (2893)..(2893): n is a, c, g, or t
  misc_feature (2895)..(2896): n is a, c, g, or t
  misc_feature (2898)..(2898): n is a, c, g, or t
  misc_feature (2900)..(2907): n is a, c, g, or t
  misc_feature (2909)..(2912): n is a, c, g, or t
  misc_feature (2914)..(2917): n is a, c, g, or t
  misc_feature (2930)..(2932): n is a, c, g, or t
  misc_feature (2934)..(2934): n is a, c, g, or t
  misc_feature (2937)..(2937): n is a, c, g, or t
  misc_feature (2940)..(2940): n is a, c, g, or t
  misc_feature (2942)..(2942): n is a, c, g, or t
  misc_feature (2944)..(2944): n is a, c, g, or t
  misc_feature (2950)..(2952): n is a, c, g, or t
  misc_feature (2956)..(2958): n is a, c, g, or t
  misc_feature (2960)..(2960): n is a, c, g, or t
  misc_feature (2962)..(2962): n is a, c, g, or t
  misc_feature (2964)..(2970): n is a, c, g, or t
  misc_feature (2972)..(2972): n is a, c, g, or t
  misc_feature (2977)..(2977): n is a, c, g, or t
  misc_feature (2980)..(2980): n is a, c, g, or t
  misc_feature (2982)..(2984): n is a, c, g, or t
  misc_feature (2986)..(2986): n is a, c, g, or t
  misc_feature (2988)..(2989): n is a, c, g, or t
  misc_feature (2991)..(2991): n is a, c, g, or t
  misc_feature (2993)..(2994): n is a, c, g, or t
  misc_feature (2996)..(2996): n is a, c, g, or t
  misc_feature (3000)..(3000): n is a, c, g, or t
  misc_feature (3002)..(3004): n is a, c, g, or t
  misc_feature (3006)..(3006): n is a, c, g, or t
  misc_feature (3008)..(3010): n is a, c, g, or t
  misc_feature (3012)..(3014): n is a, c, g, or t
  misc_feature (3016)..(3016): n is a, c, g, or t
  misc_feature (3018)..(3019): n is a, c, g, or t
  misc_feature (3021)..(3026): n is a, c, g, or t
  misc_feature (3028)..(3028): n is a, c, g, or t
  misc_feature (3030)..(3031): n is a, c, g, or t
  misc_feature (3033)..(3034): n is a, c, g, or t
  misc_feature (3036)..(3036): n is a, c, g, or t
  misc_feature (3038)..(3047): n is a, c, g, or t
  misc_feature (3049)..(3049): n is a, c, g, or t
  misc_feature (3051)..(3051): n is a, c, g, or t
  misc_feature (3053)..(3053): n is a, c, g, or t
  misc_feature (3057)..(3057): n is a, c, g, or t
  misc_feature (3060)..(3062): n is a, c, g, or t
  misc_feature (3065)..(3065): n is a, c, g, or t
  misc_feature (3067)..(3067): n is a, c, g, or t
  misc_feature (3069)..(3069): n is a, c, g, or t
  misc_feature (3071)..(3073): n is a, c, g, or t
  misc_feature (3075)..(3076): n is a, c, g, or t
  misc_feature (3078)..(3078): n is a, c, g, or t
  misc_feature (3082)..(3085): n is a, c, g, or t
  misc_feature (3087)..(3091): n is a, c, g, or t
  misc_feature (3094)..(3094): n is a, c, g, or t
  misc_feature (3096)..(3097): n is a, c, g, or t
  misc_feature (3099)..(3099): n is a, c, g, or t
  misc_feature (3101)..(3123): n is a, c, g, or t
  misc_feature (3126)..(3126): n is a, c, g, or t
  misc_feature (3128)..(3128): n is a, c, g, or t
  misc_feature (3130)..(3130): n is a, c, g, or t
  misc_feature (3132)..(3137): n is a, c, g, or t
  misc_feature (3141)..(3143): n is a, c, g, or t
  misc_feature (3153)..(3153): n is a, c, g, or t
  misc_feature (3155)..(3156): n is a, c, g, or t
  misc_feature (3162)..(3165): n is a, c, g, or t
  misc_feature (3167)..(3167): n is a, c, g, or t
  misc_feature (3169)..(3170): n is a, c, g, or t
  misc_feature (3173)..(3173): n is a, c, g, or t
  misc_feature (3175)..(3175): n is a, c, g, or t
  misc_feature (3177)..(3178): n is a, c, g, or t
  misc_feature (3180)..(3180): n is a, c, g, or t
  misc_feature (3182)..(3183): n is a, c, g, or t
  misc_feature (3185)..(3185): n is a, c, g, or t
  misc_feature (3187)..(3198): n is a, c, g, or t
  misc_feature (3201)..(3201): n is a, c, g, or t
  misc_feature (3207)..(3208): n is a, c, g, or t
  misc_feature (3210)..(3210): n is a, c, g, or t
  misc_feature (3213)..(3213): n is a, c, g, or t
  misc_feature (3220)..(3226): n is a, c, g, or t
  misc_feature (3228)..(3232): n is a, c, g, or t
  misc_feature (3234)..(3235): n is a, c, g, or t
  misc_feature (3237)..(3243): n is a, c, g, or t
  misc_feature (3248)..(3249): n is a, c, g, or t
  misc_feature (3251)..(3251): n is a, c, g, or t
  misc_feature (3253)..(3253): n is a, c, g, or t
  misc_feature (3255)..(3255): n is a, c, g, or t
  misc_feature (3257)..(3264): n is a, c, g, or t
  misc_feature (3266)..(3266): n is a, c, g, or t
  misc_feature (3270)..(3270): n is a, c, g, or t
  misc_feature (3276)..(3276): n is a, c, g, or t
  misc_feature (3279)..(3279): n is a, c, g, or t
  misc_feature (3281)..(3281): n is a, c, g, or t
  misc_feature (3283)..(3283): n is a, c, g, or t
  misc_feature (3287)..(3288): n is a, c, g, or t
  misc_feature (3290)..(3290): n is a, c, g, or t
  misc_feature (3293)..(3293): n is a, c, g, or t
  misc_feature (3295)..(3295): n is a, c, g, or t
  misc_feature (3297)..(3298): n is a, c, g, or t
  misc_feature (3300)..(3300): n is a, c, g, or t
  misc_feature (3302)..(3306): n is a, c, g, or t
  misc_feature (3310)..(3310): n is a, c, g, or t
  misc_feature (3312)..(3312): n is a, c, g, or t
  misc_feature (3314)..(3317): n is a, c, g, or t
  misc_feature (3319)..(3320): n is a, c, g, or t
  misc_feature (3324)..(3329): n is a, c, g, or t
  misc_feature (3331)..(3332): n is a, c, g, or t
  misc_feature (3334)..(3334): n is a, c, g, or t
  misc_feature (3336)..(3340): n is a, c, g, or t
  misc_feature (3343)..(3343): n is a, c, g, or t
  misc_feature (3345)..(3349): n is a, c, g, or t
  misc_feature (3351)..(3351): n is a, c, g, or t
  misc_feature (3353)..(3357): n is a, c, g, or t
  misc_feature (3359)..(3359): n is a, c, g, or t
  misc_feature (3361)..(3361): n is a, c, g, or t
  misc_feature (3366)..(3366): n is a, c, g, or t
  misc_feature (3371)..(3377): n is a, c, g, or t
  misc_feature (3379)..(3379): n is a, c, g, or t
  misc_feature (3381)..(3383): n is a, c, g, or t
  misc_feature (3385)..(3385): n is a, c, g, or t
  misc_feature (3388)..(3388): n is a, c, g, or t
  misc_feature (3390)..(3390): n is a, c, g, or t
  misc_feature (3392)..(3392): n is a, c, g, or t
  misc_feature (3394)..(3396): n is a, c, g, or t
  misc_feature (3398)..(3398): n is a, c, g, or t
  misc_feature (3401)..(3401): n is a, c, g, or t
  misc_feature (3403)..(3403): n is a, c, g, or t
  misc_feature (3406)..(3406): n is a, c, g, or t
  misc_feature (3408)..(3409): n is a, c, g, or t
  misc_feature (3411)..(3411): n is a, c, g, or t
  misc_feature (3415)..(3417): n is a, c, g, or t
  misc_feature (3419)..(3421): n is a, c, g, or t
  misc_feature (3425)..(3425): n is a, c, g, or t
  misc_feature (3427)..(3427): n is a, c, g, or t
  misc_feature (3429)..(3429): n is a, c, g, or t
  misc_feature (3434)..(3434): n is a, c, g, or t
  misc_feature (3436)..(3436): n is a, c, g, or t
  misc_feature (3440)..(3440): n is a, c, g, or t
  misc_feature (3446)..(3446): n is a, c, g, or t
  misc_feature (3448)..(3450): n is a, c, g, or t
  misc_feature (3452)..(3452): n is a, c, g, or t
  misc_feature (3467)..(3468): n is a, c, g, or t
  misc_feature (3470)..(3470): n is a, c, g, or t
  misc_feature (3472)..(3472): n is a, c, g, or t
  misc_feature (3474)..(3475): n is a, c, g, or t
  misc_feature (3477)..(3483): n is a, c, g, or t
  misc_feature (3485)..(3485): n is a, c, g, or t
  misc_feature (3487)..(3489): n is a, c, g, or t
  misc_feature (3491)..(3491): n is a, c, g, or t
  misc_feature (3493)..(3493): n is a, c, g, or t
  misc_feature (3495)..(3499): n is a, c, g, or t
  misc_feature (3501)..(3502): n is a, c, g, or t
  misc_feature (3504)..(3504): n is a, c, g, or t
  misc_feature (3508)..(3508): n is a, c, g, or t
  misc_feature (3510)..(3510): n is a, c, g, or t
  misc_feature (3512)..(3512): n is a, c, g, or t
  misc_feature (3514)..(3516): n is a, c, g, or t
  misc_feature (3518)..(3519): n is a, c, g, or t
  misc_feature (3521)..(3521): n is a, c, g, or t
  misc_feature (3523)..(3524): n is a, c, g, or t
  misc_feature (3526)..(3526): n is a, c, g, or t
  misc_feature (3534)..(3534): n is a, c, g, or t
  misc_feature (3537)..(3538): n is a, c, g, or t
  misc_feature (3540)..(3540): n is a, c, g, or t
  misc_feature (3543)..(3550): n is a, c, g, or t
  misc_feature (3552)..(3553): n is a, c, g, or t
  misc_feature (3555)..(3555): n is a, c, g, or t
  misc_feature (3557)..(3571): n is a, c, g, or t
  misc_feature (3573)..(3577): n is a, c, g, or t
  misc_feature (3579)..(3583): n is a, c, g, or t
  misc_feature (3587)..(3593): n is a, c, g, or t
  misc_feature (3595)..(3596): n is a, c, g, or t
  misc_feature (3600)..(3605): n is a, c, g, or t
  misc_feature (3609)..(3620): n is a, c, g, or t
  misc_feature (3622)..(3623): n is a, c, g, or t
  misc_feature (3625)..(3625): n is a, c, g, or t
  misc_feature (3627)..(3629): n is a, c, g, or t
  misc_feature (3638)..(3639): n is a, c, g, or t
  misc_feature (3641)..(3641): n is a, c, g, or t
  misc_feature (3644)..(3644): n is a, c, g, or t
  misc_feature (3649)..(3649): n is a, c, g, or t
  misc_feature (3654)..(3655): n is a, c, g, or t
  misc_feature (3659)..(3663): n is a, c, g, or t
  misc_feature (3665)..(3665): n is a, c, g, or t
  misc_feature (3669)..(3669): n is a, c, g, or t
  misc_feature (3671)..(3671): n is a, c, g, or t
  misc_feature (3673)..(3677): n is a, c, g, or t
  misc_feature (3681)..(3681): n is a, c, g, or t
  misc_feature (3683)..(3683): n is a, c, g, or t
  misc_feature (3685)..(3690): n is a, c, g, or t
  misc_feature (3692)..(3692): n is a, c, g, or t
  misc_feature (3694)..(3697): n is a, c, g, or t
  misc_feature (3701)..(3701): n is a, c, g, or t
  misc_feature (3704)..(3704): n is a, c, g, or t
  misc_feature (3706)..(3706): n is a, c, g, or t
  misc_feature (3708)..(3708): n is a, c, g, or t
  misc_feature (3710)..(3713): n is a, c, g, or t
  misc_feature (3715)..(3715): n is a, c, g, or t
  misc_feature (3717)..(3717): n is a, c, g, or t
  misc_feature (3720)..(3720): n is a, c, g, or t
  misc_feature (3723)..(3724): n is a, c, g, or t
  misc_feature (3726)..(3726): n is a, c, g, or t
  misc_feature (3728)..(3728): n is a, c, g, or t
  misc_feature (3731)..(3731): n is a, c, g, or t
  misc_feature (3734)..(3734): n is a, c, g, or t
  misc_feature (3736)..(3737): n is a, c, g, or t
  misc_feature (3739)..(3747): n is a, c, g, or t
  misc_feature (3749)..(3749): n is a, c, g, or t
  misc_feature (3751)..(3751): n is a, c, g, or t
  misc_feature (3753)..(3758): n is a, c, g, or t
  misc_feature (3760)..(3761): n is a, c, g, or t
  misc_feature (3763)..(3765): n is a, c, g, or t
  misc_feature (3767)..(3768): n is a, c, g, or t
  misc_feature (3772)..(3774): n is a, c, g, or t
  misc_feature (3776)..(3776): n is a, c, g, or t
  misc_feature (3781)..(3781): n is a, c, g, or t
  misc_feature (3783)..(3783): n is a, c, g, or t
  misc_feature (3785)..(3786): n is a, c, g, or t
  misc_feature (3788)..(3793): n is a, c, g, or t
  misc_feature (3795)..(3807): n is a, c, g, or t
  misc_feature (3809)..(3809): n is a, c, g, or t
  misc_feature (3811)..(3813): n is a, c, g, or t
  misc_feature (3815)..(3816): n is a, c, g, or t
  misc_feature (3818)..(3818): n is a, c, g, or t
  misc_feature (3821)..(3821): n is a, c, g, or t
  misc_feature (3824)..(3827): n is a, c, g, or t
  misc_feature (3830)..(3834): n is a, c, g, or t
  misc_feature (3840)..(3845): n is a, c, g, or t
  misc_feature (3847)..(3849): n is a, c, g, or t
  misc_feature (3854)..(3854): n is a, c, g, or t
  misc_feature (3856)..(3856): n is a, c, g, or t
  misc_feature (3858)..(3858): n is a, c, g, or t
  misc_feature (3862)..(3862): n is a, c, g, or t
  misc_feature (3864)..(3864): n is a, c, g, or t
  misc_feature (3866)..(3868): n is a, c, g, or t
  misc_feature (3873)..(3878): n is a, c, g, or t
  misc_feature (3880)..(3880): n is a, c, g, or t
  misc_feature (3883)..(3883): n is a, c, g, or t
  misc_feature (3886)..(3887): n is a, c, g, or t
  misc_feature (3889)..(3890): n is a, c, g, or t
  misc_feature (3896)..(3897): n is a, c, g, or t
  misc_feature (3899)..(3899): n is a, c, g, or t
  misc_feature (3901)..(3902): n is a, c, g, or t
  misc_feature (3907)..(3911): n is a, c, g, or t
  misc_feature (3913)..(3915): n is a, c, g, or t
  misc_feature (3917)..(3918): n is a, c, g, or t
  misc_feature (3920)..(3920): n is a, c, g, or t
  misc_feature (3923)..(3926): n is a, c, g, or t
  misc_feature (3928)..(3929): n is a, c, g, or t
  misc_feature (3931)..(3932): n is a, c, g, or t
  misc_feature (3934)..(3942): n is a, c, g, or t
  misc_feature (3944)..(3944): n is a, c, g, or t
  misc_feature (3946)..(3946): n is a, c, g, or t
  misc_feature (3948)..(3949): n is a, c, g, or t
  misc_feature (3951)..(3953): n is a, c, g, or t
  misc_feature (3957)..(3958): n is a, c, g, or t
  misc_feature (3960)..(3961): n is a, c, g, or t
  misc_feature (3963)..(3963): n is a, c, g, or t
  misc_feature (3965)..(3965): n is a, c, g, or t
  misc_feature (3967)..(3972): n is a, c, g, or t
  misc_feature (3974)..(3974): n is a, c, g, or t
  misc_feature (3976)..(3978): n is a, c, g, or t
  misc_feature (3980)..(3980): n is a, c, g, or t
  misc_feature (3982)..(3983): n is a, c, g, or t
  misc_feature (3985)..(3993): n is a, c, g, or t
  misc_feature (3995)..(3996): n is a, c, g, or t
  misc_feature (3998)..(3998): n is a, c, g, or t
  misc_feature (4000)..(4000): n is a, c, g, or t
nnnncnnnnnnnnncgnnnnnnnnnnnncngnnnnnnncngnncgnnnnnnnnnnnnnnnnnnnnnnnnnnannnnnngnnnnnnnnggnngnncnngnnnnnnnnnnnnngnannnnnnnnnnnnnnnnnnnnannnnnncnnnngnnnnnnnnnnnnnnnnnnnnnnnnnnncnnnnnnngnnnnnnnnngnnnnnnnnngnnnnnnnnngnnnnnnnngnnnnnnnnnnncnnnnnnnnnnnnnnnnnnnnnnnnnnnnnnnnnnngnnnnnncgnncnnnnnnnnnnnnncnnnnncnnncnnnnnnnnnngnncnnnnnnnnnnngnncnnnnnnnnnnnnnngnnnnnnnnnnnnnnnnnnnnnnnnnngnnnnnnnnnnnnngnnnnnnannnnnnnnnnnnnaanntntnnnnnnnntnnnnntnntannnnncnnnngcgncnnnnnnnnnnnnnntcnnnntcnnnnngnnnnnnnnnnnnnnnnnnnnnnncnnnnnnnnnnnttttnnntttnnnnntnnnncnngnnnncnnnnnnnncnnnnnncnccnnnnncncnnnnnccnnnnnccncnccnnnnncnnnnanannnnnnnnnncnnnnncnnnnnnnnnannnnnnnnnnngngnnnnngcnctnnnnnnnnnnnnncnnnnnnnnnnnncgcnnnnnnncgnnnnnnnnnnccnnntnnntnnnnnnnnnntnnnnnntnnnannnnnnnntnnnnntttnngnnnnnntnnnnnnnnnnnnnnnnnnntnnnnnnnnnnnnnnncncnnnnnnnnnnnnnnnnnccnnnnnnntttnnnnncncgcgnncgcggncncgnnnnnnnnnnnnnnntncnnnnnnnnnnnnnnnnnnncnnnnnngcnnnnnncnngnnnnnngnnnncgcgnnnnngcnnnnnnnnnnccnccnnnncnnnnnnnnnnnntnccnccnnnnccnnnnnnnnnnnnnnntncnnntnnnccnncnnnnnnnnnnnnnncnnnnnnnnnnnnnnntnnnnnnnnnnnnnnnnnnngnnntnnnnnnnnnnnnnnnnnnnncccnnnnnnnnnncnncnnnnnnnnnnnngngnntnnncnnnnnnnngnncnnnnncnncnnnnnnncnnnnncnnnncccncgnccnngnnnnngnnnnnnnnnnncnnnttnnnnnnngnggnnnngnnnaannnnnnnnnnngnnncgnnnnnnngnnnnngnnnnnnnnnnnnncgngngcgngcgcgnnngcgnncnngngnggggggggnnnggnnnngggngnnnnngcnncgnngnngncnnngnnnnnnnnnnnntnnnngnnngngcnnnnnnnntnngnngnngngngngnnnnnnnannnnnannnnnnnnnannnnnnnnccnncnncnnnnnnnnncnnnnnnnnnnnnnnnnttttnnnnnccggnnaanttttnccccaacctttnaaannnnnnnntttnnccnnnnnnncctttnnccnccggnnnnngagcagcagctcaacttcgggagtggaacgcgacacgacatccgtcactcgctcgacgcacacgccacctcacttcgctcgacgcagaggctacctcgtcgaccgagcacaaaatgcgcgcgggcgtggcgtccgcggtcctcgtggcgtggctcgcggtcctcgccccctcccacgcgctggcgcccgcggacggcgcctccgcggacctcggcgcgtccgagaccgcctcgccgtggttctgccacggcctcgactgtccgccgttcgcggtggagcgccggggcgacgggtacgacgtgcgcgtctaccccgccggcctgaggtggacctccacgaccgtctcgggctcgagctacgacgacgccacggccaccgggttcgagcgtctgtttaggtacatcagcggagagaacgagggaaacgagaagatcccgatgaccgcgcctgtgcgagtagcagtcgcncccggcgacggcccgttctgcgactccaacttcacggtctcgttcttcgtgccgttcgaggaggagggggtcgaaacgacacgttcggaaatggacggtcacgggactcacgggacacacactcgtcgttctcagcgagacgtcccggaacccacggacccggacgtgttccgagacgcggacgcggaggagacgcgcgttttcgtccgcgcgttcggcgggtacgccgacgcgaaacgcctgcgccgagaggcgagcgcgttggcgcggcggctcgaggaggacggcgtcgaggttgccgcgagcgcgtacttctacgcggggtacgactcgccgttcaggccgataggcaggcacaacgaggtgtggttgaagccggcggcggagtgacgcgcgcggagacgcggcgcgaaaaagacgacgacgagtgaannnnnnagannngagnngcccnnntnnncnnnnnnnnnnncncncnnntnnantttggannngcgnangnnnngcgntnnngtcgnnncnccnncacccacannacnncncncnccncgtnnngngnnncntntcnncncncnnctctctnnnnnnnnnnnnggcgcgnnnctctcnncnccnccnnnnnnnnnnnncncncnnccncgnngcgcgcgnngcgcgcgnnnnnacncnncncnncncncnccncncnnnnncncnncnnnnncncnnnngcnnnnnannnncnnnnccnncnncgcngngnnnngngngnnnnnnnnnntntncnnnnngnngngncgcnnngngngcnncncnnnnncnccccngnnnnnnncncnncnccnnnnnnnnnnncacaccncnncnnnnnnnnnngnggngngnngcgcgcnnnnngnnnngcncnncgcgnnnnccncncncnncncnnnnnnnncnnnngnnnnttttttttttttnnncnccnccncncnccacannntgtnnngngngnnnnnnngngcgcnccncnnncncnncncnncncggngnnnanannncnnngngnngnnnnnngngnncnncncnnnnnnnnnncncncngcgnggnnnccncngngnnncnncncgcnnnncnnnnnganannanannnnnnnnnnnnnnnnnnnnnnnggngngngnnnnnncgcnnngcgcgcgccncnnccgcgnnnnanannacncncnncncnncncnnnnnnnnnnnnccncgcgcnncnccnccgcgcnnnnnnngnnnnngnngnnnnnnntctcnncncncncnnnnnnnngngcgngggggnggngngncgcnncnccncncnncncnnnnngcgngngnnnngnnctcnnnnnngnngngnnnnnatntnnnnnanannnnngngnggcgncgcgnnnnnnncncnnngnggngncncnnncnccncnccncnncncgcnnngnnncgcncncncacangngggngcgcgngnnnanaccccccgcgccgcnncncncnngnnnnnnncncnnngngngnnnnncnncncccncncncnnngnngngnntntttttttntcnncncannnnnnnngnngngnnnnnnnnnnnnnnncnnnnngnnnnngcgnnnnnnngnngagnnnnnncgcnnnnnnnnnnnncnncncnnngcgccgcgnngnggnggggnggcgnngcgnnnnncncggngngnnnnncgcngngnnnnnngngnnnngcgnggngncncnnnngngnggngcnncncncgnggngnngnnnnnnnnngngngnnnnnncnncnnngnngcgnnncncgcgncncnncnnnnnngnnnnnnnnnnnnncncnnntnntnttnttnnnntgnnnnntcgcgnnnnnntnnncgcgncncncgcngngnnngcgcnnnnnncnccnccnncnncacacnncncnncgcgnnnnnannncnncncgnnnntnngnntnnnnnnnnncncncnntnnngtgnncnncncncnnnnnncncnnncncnncnnnnnnnnncnncncn

SEQ ID NO: 1023 - DNA, 4000 bp, Escherichia coli
  misc_feature (1442)..(1444): n is a, c, g, or t
  misc_feature (1447)..(1447): n is a, c, g, or t
  misc_feature (1449)..(1455): n is a, c, g, or t
  misc_feature (1457)..(1459): n is a, c, g, or t
  misc_feature (1461)..(1462): n is a, c, g, or t
  misc_feature (1466)..(1467): n is a, c, g, or t
  misc_feature (1469)..(1471): n is a, c, g, or t
  misc_feature (1473)..(1478): n is a, c, g, or t
  misc_feature (1480)..(1485): n is a, c, g, or t
  misc_feature (1487)..(1487): n is a, c, g, or t
  misc_feature (1489)..(1497): n is a, c, g, or t
  misc_feature (1499)..(1499): n is a, c, g, or t
  misc_feature (1501)..(1501): n is a, c, g, or t
  misc_feature (1503)..(1522): n is a, c, g, or t
  misc_feature (1525)..(1533): n is a, c, g, or t
  misc_feature (1535)..(1544): n is a, c, g, or t
  misc_feature (1546)..(1546): n is a, c, g, or t
  misc_feature (1551)..(1553): n is a, c, g, or t
  misc_feature (1555)..(1555): n is a, c, g, or t
  misc_feature (1557)..(1557): n is a, c, g, or t
  misc_feature (1560)..(1577): n is a, c, g, or t
  misc_feature (1580)..(1580): n is a, c, g, or t
  misc_feature (1584)..(1584): n is a, c, g, or t
  misc_feature (1589)..(1589): n is a, c, g, or t
  misc_feature (1591)..(1591): n is a, c, g, or t
  misc_feature (1593)..(1595): n is a, c, g, or t
  misc_feature (1598)..(1602): n is a, c, g, or t
  misc_feature (1605)..(1605): n is a, c, g, or t
  misc_feature (1608)..(1610): n is a, c, g, or t
  misc_feature (1612)..(1612): n is a, c, g, or t
  misc_feature (1615)..(1615): n is a, c, g, or t
  misc_feature (1618)..(1620): n is a, c, g, or t
  misc_feature (1622)..(1622): n is a, c, g, or t
  misc_feature (1629)..(1631): n is a, c, g, or t
  misc_feature (1633)..(1635): n is a, c, g, or t
  misc_feature (1638)..(1640): n is a, c, g, or t
  misc_feature (1643)..(1645): n is a, c, g, or t
  misc_feature (1647)..(1647): n is a, c, g, or t
  misc_feature (1649)..(1651): n is a, c, g, or t
  misc_feature (1653)..(1653): n is a, c, g, or t
  misc_feature (1655)..(1656): n is a, c, g, or t
  misc_feature (1668)..(1672): n is a, c, g, or t
  misc_feature (1674)..(1678): n is a, c, g, or t
  misc_feature (1686)..(1686): n is a, c, g, or t
  misc_feature (1694)..(1696): n is a, c, g, or t
  misc_feature (1721)..(1724): n is a, c, g, or t
  misc_feature (1774)..(1774): n is a, c, g, or t
  misc_feature (1815)..(1815): n is a, c, g, or t
ggcgtcgccaacggcatcgcttgcccgctctgaaccactgagccagtaccagtccactgttggatcggttgctgcacttgtgcggcggcggtcggctgcgccgcccaaggcggcaaagcgggacccgtcgagacggcgtcctgcggggcttcaacttcttcgccgttcgacgaatgatgatgtcgtctgtgatgtctcgtggaatcgccattcgagtattcaatgaagtcgcccgaaggcgctcgatacggttcgattttgtcgacttcctcggctcccgaggcgtccagcgaattaatcatgcgttccaagttgtcgttctcgatcaccgtctgcgtttcgctcgatacccggtgcgaatggtggtgaggcgatcccgtggacgcgacgtcgctacgctcgctaacctgcgacgccgcttgcctggtttcgtacagcgcagactcgtacgacgtcaacggcttgcgcggacgtagctgttgctgcgccgtgggctctgtggaaacatcgatgggcatcgagaccccggtcgggtgactggatgcgagcatgtctctaaactcactctccgccgccggtgcggccggtgccgccatcgctccgttcgccatcaaagatttgatcgtcgcgtccaagtcgtcgatattcgccggcgcgcccgtcgggaacagcgcgcgcgcctgcggcacgatgttgaaaaactgcttcgtcatcgtgctcagcgtctgcgacgtgaccgttcccggattgaacatcgcgttacgaatctgtaaccgcaaccctctgagcgccgtcatctgcgtcggcgtcggcgtcatccccgtcgccgcatccgcccccaaccgcgccctctccgtcgacgtcgtcccccaccgcgcgatcgacgcctcgcccgcgcgcgctcccctcgctcgcatcgctaactcctcccccggcaccggtcgccacgcctcctgcagcgtctcgctccggtgcgtccacaccccgatcgacgcgcacgccgcgagcgcgcacgcgccgcccaccaccatcgccgtccgcgtcgtcccgcgcgtcgtcccgccccgcgcgcgtcctcgcccgtcaccgcgcgcgtcgccgtcgtccccgagcagcgccgccgtctccgcgcgctccacgtcccggtcgtcgcgcgtcatggtgttggccctcgcgctcgccgtcgcgccgtccgtcgtcccgcgcgtcccgcgtccgagcgtcgaccgcgcgcaccgcgtcgaccgcgcctcacgcgcgcgtcgcgtcccgcgtcgccgcgcgtcccgcgtcgcgcgccgtcgtgtgcgcgccgtttgcctcgccgaacgtcacattagtgttgagccgaaatcacactcgcgcgcggcgctcgtcgatattcacacacccgggtgtttcagcgatcgcgtgagcggcgaaaccctatttaatttacttcnnnacncnnnnnnnannncnnacanncnnncnnnnnnannnnnnancnnnnnnnnncncncnnnnnnnnnnnnnnnnnnnncgnnnnnnnnngnnnnnnnnnngnctcgnnngncncgnnnnnnnnnnnnnnnnnncgnacgncgcgncncnnncgnnnnncgncgnnngncgncgnnngncgacgannnannncgnnncgnnncncnnnancnnccgcgacgacgnnnnncnnnnnacgacgangacgacgnnnggcgcgaacgatgatgatgaccgcnnnncggtgcctcgaatggcgaacgcgaatcgcgcgttcgtgtcgccgtacatnggtgcgaacggcgcgaacggcgcgacgcgcgcgcctctgtncgcgcggcgcgcggtgaaagtcgccgggtgcggacgggagaccgccggggacgatgcggcgcggcgatgcttctcggcgctgtacgcgaagcgcaaggcgggcggcggcgggaagcaaaggtcggcgaagacgttcgtggacggcgtggtgatcgcgcgaggcgcgcgcgagcaggcggagctgtgcgatatgcgagggaaacgggtggcgagagggtgcgcggggacgatcgtggaggggacgacgtgcgaaatcggacagtacgaggtggaaatcggcgaggcggtgcgcgcggaggacgtggactcgggcgcggcgttctcgcgcggcggcgcggcggtggcgccggagaaggtggtcgtcgcgaacgagcagaaagtgaaatcgttcgtggcgccggtgcgcgggatcggcggcgccgtcggatcggcgacgacgtcggaggcgaagaagacgttcgcgccggaggcgccgttgcacagcgacgtcgcggacggggcgctcgtgttgtcgacgctcgacactgatttccatcgcagagattatcgcacggcgtgtgcggtggtgtgcgatccgttcatatcgaggtttctccgcccgcatcaacgcgacggcgtgcagttcatgtacgaagccgtcatgggactgcgaacgagcgtgcacacgaacagggcgcacaccgggtgcttgttggcgcacgaaatgggtcttggtaaaacgttgcaagtcatcgcgctcgtgtggactttactcaagcagtcaccgttcaagcgcggccaaccgacgtgtcgacgcgtcgtcgtgtgcgtgccggcgtcgctcacggggaactgggccttggagtttcgcaagtggctcggcgaggaacgctgcgatccaaaagtcgtggaaggcggtgataaggaggcgagaaagagtttcgaggaattcgcgcttccatcgcagcgcagatacaacgtgttgattacatcgtacgaaaccttgagagcgcaggcggacgtcgtcgcgagggcgaacgtcgacttgctcgtgtgcgacgaggcgcatcgcctgaagaacgcgacgcagtccacgaaaggcgcgcaagcgctcgcgtcgctcaagtgtcatcgcagggtgcttctgacgggcacgccgattcagaataacttggacgagttgtggggtgtgatggacttcgcggcgcccggcttgctgggagacctcgattcgtttcgcaaaatttattccgggccgatcgagaaagcgagcgagcgtggggccaaggaagaagttgtgcgaatcggtaacgcgcgtcgcgaagaggtcggtcgtttgatcggccctttcattcactcgagaaaagcggatgagatcaacgcgtcgctgctgccgccaaagaccgagtacgtcgtcttcgttcgactttctgaagtgcagaaaggcttgtacgtcgaccaactcaagcaaaagtcgatgctttcgatgctcgggcgaatcggcaagacgcaagatgcggaatccatctcgccgcttcaggcgattcagacgctgcaaaagctctgcaacgcggcggcgctcgcgactgaggtgagcgatccggtggcttcgtcgagcaaactcgccgtgttgcgcgccatgttccgggcgctcgccaacgatgaacgcatcgtcgtcgtctctggcttcaccacgacgttagacctcatcgccaagctttgcgagagcgagcacctgaagtatgatagattacaaggttccacgccgccgaaagagcgcacgtccattgttcgcacgttcaataattctggcaagattttgttgctctccacgaaagctggaggtgtcgggcttaatctggtcggagcgaacagattggtactagtcgactcgtcgtggaatcccgcacacgatttgcaagcccaggcgcgcgtgtggcgagaaggtcaaacgaaaccgtgttccatctatcgcttgctgagcacgggaacgatcgaggagcgcatgtttcagcgccaagagctcaaaggcgcgctcgcgcgaacgctcggattcaaatcaacttctggtaacaacaactccgccggatcgagctccagcacgttcacgcaagccgaactgcgagacctgttttcgtacgtcaaggacacgcggtgtgacaccgccgaccggatcgccgccatgacgggcgagacgcccgaccac

SEQ ID NO: 1024 - DNA, 4000 bp, Escherichia coli
  misc_feature (1275)..(1275): n is a, c, g, or t
  misc_feature (1280)..(1280): n is a, c, g, or t
  misc_feature (1295)..(1295): n is a, c, g, or t
  misc_feature (1325)..(1325): n is a, c, g, or t
  misc_feature (1328)..(1328): n is a, c, g, or t
  misc_feature (1986)..(1986): n is a, c, g, or t
tttaggcgcgccttatacttcggctcgaattactactcaaggaaagcagtcgttcaaatacggaagaatagatatacgagcaaaggttccttatggatctggaatatggccagcactatggatgttgggtgataacttttctacagaaggctggccgagctgtggcgaaatcgatctaatggaactgatcggaggtgatggttataacgatcgtactgtctatgggactgggcattggtcaaataatggtagtcatgcttcgcatagcggaaataacagccttacctctggtaaatacaatgacgaatttcatgtattctccatagtttgggatagcggatctattaaatggtatagagacgatattcagtatcatacgttgaacatctccaacctaggagcgtttaagaagaaatttttctttatcctaaacattgccgtagaaggaaactggcccggtccagtcggcccttcaacaacattcccccagtacatgctggtggattatatcagagtatttcaataattactaactataaataatgcttaacatgaaaaaaatctacgctttattaatgctggccctacctatgttgggttttgcacaaaaagacgttacgtttatcgttgatatgcgtgactatgcaggttcttacactactgtacaccttaatggtgattttaacagttggtgtggtacttgtaatccaatgactgattcagaaggagattctatctggaccgtaacgcttcctttgactgctgattcgattgagtacaaattcactttggacggttggacaggtcaggaaaacttgacttcaggaactgcttgtactaagacttctggtatttacactaaccgttttgcagccttcactggcgatactattctacctggtgtagcatgggaatcttgtgcagctaaagcaggacaagtttatgtaacgatgcaagtaaacatggaatttgagactgttgattctactggtgtattcctaggtggaggttcaggctttggtactccaggtcaaaatctaatgcatcacatcggtgattcagtatactctatcacacttccacgtgatacagggttcttctcgttctttacattcatgaatggtaactgtccgagctggggatgtaaggaaaatcttgcaggaaagccttgtggtgaccctgcaaactataatgatcgtagtgttggttccgccctatacggagacttccacttgacaacttgttttggacaatgttcaacagatggctcttgtnctacncctccttcaccggtnaatgtaacattccgttctgatcgtacaaantcnccatctttcactgatgcgtacctttctggtactatgaacggttggagtggcgatgctacggcaatgactgatgctgatggtgatggtgtttatgaagtaaccgtatcacttttaccgggtgcttacgagtggaaatttacagctgataactgggcggttcaagaaaacttagaccctgctactagtgattcagtttgtactatcactcaaggtgcatttacaaaccgttatatgatgttgggcggaactgcggatacgactttggagatccacggttgggagcaatgtggtaacgcatctactgtaggcatcgatgaagcaacagctgaattcgttgtgaagccaaaccctgcttcagatgtattattcattgagaacactactggtactgcttctaccgttgcaatctacaatgtaacaggagctaaggtgatggagcaaaactttgaggcgaatactcgtcttgatgttgcaacattgccacgtggtatgtacatcgtgcgtttacagagcgaggatacggatagtgtaattcgtatttcacttaactaaaatctaatttggttagtaagaaagtgttaaagggacccggtaacgggtccctttttcatttgtaaattgctgtatgcgaagattcttatataccgttctttttgtngcctgttcactttttgcaagcggccagtccatacgtcatataggtgctgctgagggactcaataatcccacagtgtattccatagttcaagacgactggggttttgtttggataggaactcgcgacggtttatataaatacaatgaaggtcgcgcacgttcatttccttttctagattctacagattttcgtagatcgaacaatgtccagagcttattagtcactcaagattcagtcctgcttatagggctgcagctaggcggcataatgggggttgatcttgaaagtcttcggcctattccggataataagattccacaacttccaagagaggtatcaataatctcccttcaccaagattcggaaggaactatatgggcaggaagttctggttccggaatattccaactcagactgggtagtgaagactgggagcgtttcgtatccgatgaatatgcggaggaccttaaattcatatttgattttgaagatcaaggagataccttatggatcgcaacaagcggtgatcatctgctgtattatttgaaatcacaatcttctgtttatgcgctggaggcaaataaaagcgtgagttcgtttcgaaaatcggttgatgtatcaggcggaaaagtcattttttctgttgaaggaaccggcgtttttgaattgaccggcgatgtgttttatgaattggcgattccgaccaagggaacccaacgtgacgccattttttatgaaggcaacgtatggatttctactgatggatatggcgtataccaatggaacggtagtaccgctcagcattttacgaaacaagatcctacctcaggaattattacggatcaattctatggaatatatgaagtgtatgatgcgctctggttgggaacctataatggaggtatcgcccaattccctgtaaaaagtagtgccgtatcgttactgccaaagcccaagaaattcgtcgcttcgagcattcagagtgccattagcatggtaagcgataacgatttatgggttggttttgatggtgatggtcttgtacgctatcgagagacagaatctatatggcagcccactacttttgataatccctttttaccggacgtggttacaagtcttgagttttatcaagacgaattgtggattggaagtctgggtcaaggattatttgtgatggacacatcgggtaccatcaaagaacatttcttagcctactctcaatcttcacgtggactcgaaaattcaaacatttggtctttggagaaaacctggggcgatagtttatggattggtacgctttatggcttgcaattctgggatggggtcgaaattacatcgccatttgacaccccgtggcgcgtaggtcgaaacataatggatttagagtttgatggggatttactttgggtaggcacagaatttcaaggcatttataccctctcaagacaaggcgccattcagagcataccaataaaaaattcagtcttggacattgagacctatttaaattataagctcgtaggtaccgaaggaagtggggtgttggtgattgacgaaggtagagtcatcgatacaattattgggaaagagtcgtttgtgaattgctattccattagcgaaaaaaagggaagggtgtatgccgcaacaagtgtcggccttttagaaattaaaataaatgaccagttggaatggtcctatgaagtgttcaaagagctagatgaactgcaagtaggtctctcgaataggaaagcgttgttatggaatggggaacgcctattgttgggaggtactcaaggcgttgttgaaatttcaactgaagattcctctgcagcagcgattcctccaatacttattacgggagtatttgcagataatcttccaaaggctattcccataataaaggacggtgtttcttcagcgcagacggtagtattcgcggcaggaactaaatctgtgcgttttaatttcgaattggccagcaatacgctccggaatggtataagcaatgcat

SEQ ID NO: 1025 - DNA, 4000 bp, Escherichia coli
  misc_feature (2793)..(2793): n is a, c, g, or t
  misc_feature (2799)..(2799): n is a, c, g, or t
  misc_feature (2817)..(2817): n is a, c, g, or t
  misc_feature (2826)..(2826): n is a, c, g, or t
  misc_feature (3012)..(3012): n is a, c, g, or t
  misc_feature (3466)..(3466): n is a, c, g, or t
  misc_feature (3481)..(3481): n is a, c, g, or t
  misc_feature (3550)..(3550): n is a, c, g, or t
  misc_feature (3583)..(3583): n is a, c, g, or t
  misc_feature (3589)..(3589): n is a, c, g, or t
aactccttgtttgggcttctggcaatggtttcataagaaaactcggtgatttttttaattgaatgctttccaaaatgagcccctacccagggcataacattagtaaaggcaatcgaaatggtgtctccttgtccaatcgtagcaaaaaattcaactccatcataatactcatccaaagactcttgagtaagttttgaacgggcagtgcttatgtgtttagaaaactccagatgaacggactcaaatgcacattttagattacgatcatcagtatggttggtcatcacagtgtaatgaatttatccaaaaatagcttccatagaggtattcatggcttctctgacttcagtatcgtcagtaataggctttatcaaagctatttgacatgcgtcttttatatcaacacctttgcttatcaaaacaccagcataattcagaagtcttgtcgaggcaccctcatcaagaccatgcccgacaagtttacgtgtggcatttgcaaattgaactaactttttagctatttcaggatcaactcctgactcattacttacaataattgcttctatctcagggcttgcaaaatcaaaatctagggctacaaatcgttgtttagtagactgcttaaggtccttcattattgactggtaacctgggttatatgaaataaccaactgaaaatctggatgcgcttttaatagttcgccttttttgtcaatcatcaattcacgacgatggtcagttaatgaatgtattacaaccatagtgtcttgacgagcttctacaatttcatcaagatagcagattgcgccatgacgagcagcaatagttaatggaccatcaacccaccttgttccatcagagtcaagtaagaaacgaccaattaaatccgaagctgtaatatcttcattacaagatactgtaataagtggcttatcaagtttgtaagccatatgctcaataaatctagatttaccacagccagttgggccctttatcattaatggtaggcgtgaactgtatgcaaccttatagagatcaacttcattaaattgctcttgataataaggactctcaactaccttaaactgacttatatcaaaattagccataactattctccgaataatcgtttgtaaaaaatataaacactttcgccattttaatgttaaaaacacacattagttggcacattcattttgcaaaaataacaatggtaagcataaaaaaattaaacagagaccaagcacttgacctaataagaggaattgcaatcataatgatgatactgtttcatttaatttatgatctaaacgaattcggctatacaaatattcctctatctaacttttggcttaccagctattggcgctacttaattgttttcttgtttctaaatgcagtaggaattagtcttgtgcttgcctacggaaataactttaacttaaacaaatttataaaacgcctttttttgcttggtcttgctgcactctcagtttctatcagcacctatataatgtttccagatgcttgggtctatttcggcatcctgcatttaatctggacaggaacattgattgctatcttttttacacaactgcctaaaatttctctatttattgctgccttaatatttctatctggttatttaaatttaactgacctttcttttgtaagagtgttgctatcagattatttgccattatctagtgtagatttctacccacttttcccttggatcgcatttatatttactggcatttatctaggtcataatccgatatataaaaaaatatttttcatgaggctacccctattacaacttataggtcaacattcgttgattatctatttattacatcaggtaatacttttttccttagtaggtgcaatttatttcttattcagtcaataaattacaccctctactagacattttacttatgaacacctaacttatctctccacccaggatataagttgtctgcatcgcctgggaatgattcaaatgctcttgcaaattcatggtgttcttttgcaaactcaattgggtctgagcctgatttccagcactcataagcttggcgaagagatgttgctccagctgcaggagaatcaatatgaccataagagccaccgccagaagtattgattacattaccatggcccaaattctcaaagaaacctggaagacgcagtgcattcataccgcctgaaattattggtgtagtaggtttcataccaaaccactcctgatggaaaaaaggaccatctgaactgtcacgttcaatcatatatgcaatgtttctatcatccgcaccgccttccatttttccgtaccccatagtacctacatggataccagaagctcccattaagcgtgatagctttgcaagtacaaatgcagtataacctctaacggctgatggagaagttactgcaccatgaccagctctatgataatgtaggtattgattaggataattacgtcgcgctgtagtaaccatacctggtccaccaacatacccatcaactaggaaggcaacatggtgagcattctcagcaaatgtttcaagaatataatctgcacgggcacacatttcgtggtgatcatctgcagttatattggctgagaataattttgcttcacctgtttcgtcttgtgcacgtctcattgagtcggctaccaaaggtgtaacatctttaattcttgcatatacttgatttccttgtggttcatcattcttaataaagtcaccacctagccagaactggtatgctgcctttgcaaatggntcaggncgcaaacccaatttaggnttaattatngtacctgcaatgtaaccaccgtctgttcgtgaacgacctaatagattccataaatctgtaatatcttttgaaggaccatcaaaaatatcaagcattgattttggaacccaaaaatcttgcatctgtgcacatttaacatcacccataccttggttgttaccaatagcaagcgttaagaatgatacnaccatcgcacgaccatcaattatattgcgatcaaaaagatcatttggataggcaattttcataatgccattagtttcatcgatttcgtaaaccatcgcatctaaatctttagtaaagtcgtcagttgtcgaaacttcaacattagtcccagtagatgactctgctgcaaagtgagcagcagttgataagtaaccataaccttcggctggtgtcatagtataagcaaccaatatatgcttaccttcagcaattagagtgtcttcgtctaacgacaagtcagcatatctattagattgatccattttcttaactcctatttatttaaataaggttgattatagattgagcaataaataatgtaaaataatatttatttataaaatcattagttattattatgattaattacactataaaacaactttatagttttgaagcggttattagattgggnggctttacaagtgcnagtaaagagctacatattacacaaccagcagtctatatgcaggtgcaacaattacaagacaatattggngcaaaaatatttaatgttaatggaaaaaaaatnactccnacttttattggtaacaagatttatgagacggcagttaaagctatcaatgttgttgagaactcaaaactagaaatcaatcaaagtttaaatcctgactctggtcaccttcaaattgcagttgctacaacagcaaactcatttgtaagcaatcttttatcaaaatttaaaaaagaatttccaaaaatgactttttatatggatgttaccaataggcattcactacttgataacctaaaaaatcataatgcagatatagtgataatgggcgaacctccaaaaaatatcccattaatttctcacgcatttatgaaaaatccattgatcgctattgctcatcctgaaaatgaacttctaactaagaatatagtcacaattaaagacttagccaaagaaaccttacttacaagagaa

SEQ ID NO: 1026 - DNA, 4000 bp, Escherichia coli
  misc_feature (96)..(96): n is a, c, g, or t
  misc_feature (103)..(103): n is a, c, g, or t
  misc_feature (273)..(273): n is a, c, g, or t
  misc_feature (598)..(598): n is a, c, g, or t
  misc_feature (1266)..(1266): n is a, c, g, or t
  misc_feature (1989)..(1989): n is a, c, g, or t
  misc_feature (1991)..(1992): n is a, c, g, or t
  misc_feature (2163)..(2163): n is a, c, g, or t
  misc_feature (2553)..(2553): n is a, c, g, or t
  misc_feature (2675)..(2675): n is a, c, g, or t
  misc_feature (2927)..(2927): n is a, c, g, or t
  misc_feature (2943)..(2943): n is a, c, g, or t
  misc_feature (3207)..(3207): n is a, c, g, or t
  misc_feature (3579)..(3579): n is a, c, g, or t
  misc_feature (3582)..(3582): n is a, c, g, or t
  misc_feature (3722)..(3722): n is a, c, g, or t
  misc_feature (3724)..(3727): n is a, c, g, or t
  misc_feature (3730)..(3730): n is a, c, g, or t
  misc_feature (3733)..(3736): n is a, c, g, or t
  misc_feature (3738)..(3738): n is a, c, g, or t
  misc_feature (3740)..(3742): n is a, c, g, or t
  misc_feature (3746)..(3748): n is a, c, g, or t
  misc_feature (3750)..(3751): n is a, c, g, or t
  misc_feature (3753)..(3755): n is a, c, g, or t
  misc_feature (3757)..(3763): n is a, c, g, or t
  misc_feature (3766)..(3770): n is a, c, g, or t
  misc_feature (3772)..(3773): n is a, c, g, or t
  misc_feature (3775)..(3775): n is a, c, g, or t
  misc_feature (3780)..(3780): n is a, c, g, or t
  misc_feature (3783)..(3783): n is a, c, g, or t
  misc_feature (3789)..(3792): n is a, c, g, or t
  misc_feature (3794)..(3795): n is a, c, g, or t
  misc_feature (3797)..(3800): n is a, c, g, or t
  misc_feature (3803)..(3803): n is a, c, g, or t
  misc_feature (3805)..(3806): n is a, c, g, or t
  misc_feature (3809)..(3813): n is a, c, g, or t
  misc_feature (3815)..(3817): n is a, c, g, or t
  misc_feature (3821)..(3822): n is a, c, g, or t
  misc_feature (3824)..(3824): n is a, c, g, or t
  misc_feature (3828)..(3828): n is a, c, g, or t
  misc_feature (3831)..(3831): n is a, c, g, or t
  misc_feature (3833)..(3833): n is a, c, g, or t
  misc_feature (3835)..(3835): n is a, c, g, or t
  misc_feature (3837)..(3837): n is a, c, g, or t
  misc_feature (3841)..(3841): n is a, c, g, or t
  misc_feature (3843)..(3846): n is a, c, g, or t
  misc_feature (3848)..(3848): n is a, c, g, or t
  misc_feature (3851)..(3851): n is a, c, g, or t
  misc_feature (3855)..(3858): n is a, c, g, or t
  misc_feature (3860)..(3860): n is a, c, g, or t
  misc_feature (3862)..(3862): n is a, c, g, or t
  misc_feature (3864)..(3867): n is a, c, g, or t
  misc_feature (3869)..(3869): n is a, c, g, or t
  misc_feature (3871)..(3872): n is a, c, g, or t
  misc_feature (3874)..(3875): n is a, c, g, or t
  misc_feature (3877)..(3881): n is a, c, g, or t
  misc_feature (3883)..(3885): n is a, c, g, or t
  misc_feature (3888)..(3888): n is a, c, g, or t
  misc_feature (3890)..(3890): n is a, c, g, or t
  misc_feature (3892)..(3894): n is a, c, g, or t
  misc_feature (3896)..(3899): n is a, c, g, or t
  misc_feature (3901)..(3904): n is a, c, g, or t
  misc_feature (3907)..(3909): n is a, c, g, or t
  misc_feature (3912)..(3913): n is a, c, g, or t
  misc_feature (3919)..(3920): n is a, c, g, or t
  misc_feature (3924)..(3924): n is a, c, g, or t
  misc_feature (3929)..(3930): n is a, c, g, or t
  misc_feature (3932)..(3934): n is a, c, g, or t
  misc_feature (3937)..(3947): n is a, c, g, or t
  misc_feature (3951)..(3957): n is a, c, g, or t
  misc_feature (3960)..(3965): n is a, c, g, or t
  misc_feature (3967)..(3971): n is a, c, g, or t
  misc_feature (3973)..(3974): n is a, c, g, or t
  misc_feature (3976)..(3979): n is a, c, g, or t
  misc_feature (3982)..(3983): n is a, c, g, or t
  misc_feature (3985)..(3989): n is a, c, g, or t
  misc_feature (3991)..(3993): n is a, c, g, or t
  misc_feature (3995)..(4000): n is a, c, g, or t
caaacttgcacagactccatcaggacctcaaaaatattgccattttttagtgccgcctctctgagacgttccatcattgagtctcgttctttggantggaacntgtgaaaattctccagatcatggatttgcatggtcttttcttcttccgttgaacgcgccagttcaatttctgcatcagtttcagcaggatttgggttaagaaaagtgttcacgcccattataggcagttctccggaatgtttaagagtttcgtaataaagtgattcctcntgaattttgttacgctggtacatcgtttccattgcacccaaaactcctcctcgttcggaaagtctgacaaattccgacaaaattgcttcttcaactaattcagtcaattcctcaatcagaaaactgccctgcattggattttggttgaatgcctgtcctaattcacgattgataatgagctgaatagcgagtgcacgacgaactgactcacccgttggagttgtaaccgcttcgtcgtaagcgttggtgtgaagtgaattacagttatcgtaaacggcataaagtgcctgaagtgttgtccggatgtcattgaaatccatctccnttgcatgcagggaacgtccggaagtttgaatgtgatattttaatttttgtgagcgttcatttgctccatacaaattacgcagtgtgacagcaaaaattctgcgtgctacccttccaattacagcatattccggatccattccgttactgaaaaagaagctcaggttacgcgcaaaatcgtcaatcgccaagccgcgtgccagataatactcaatcagagtaaatccattagcaagtgtgaaggcaacctggctgatcggatttgctccggcttcagcaatatgatatccggaaatgcttaccgaataaaagttacgtacatcgtttgcggtaaaatattcctgaatgtcacccatcatctgcaaagcaaaatttgtgctgaaaatacaagtgttttgcgcctggtcttccttcaaaatatctgcctgaaccgttccgcggacgttgtttaacaaatcagcctttatagcaccgtaagtttcattatctacaaaatgtttaccggacaatcccaacaattccaaacccagtccatcgtgattttccggacgttccatacgatactccggaggctctacaccctgttttttgtagcgttcttgaagcgttttttgcgctttttctaaatgcccgttttcacgtaaatgtttttctatttgctgatcaatngctgcattcatgaaaaaagcgagaaccactggagcaggtccgttgattgtcatggaaacggaagtcttcggtaaaagcagatcaaaaccagaatatagtcgtttcgcgtcatcaactgtgcaaattgaaactccggcatttccgatttttccaaaaatatcgggtcgcaaatgcggatttgaaccataaagcgtcaccgagtcaaacgctgtactcaagcgtgttgcaggctgatcgcaggccagcaaatgaaaacgccggtttgtacgctccgcaattccttctccggcaaacatgcgggtcgggtcttcgccttcacgtttgaaaggaaaaacaccaccggtaaacggaaaacttccgggaaaattttccaatcccaaccagcttgcaatctcgccccagtcgttaaatttgggtgtggcgattttaggaattttgagtccggaaagactgatgttgtgattcgaaattttcagttctttgttgcgaatatcaaagctgaaattttcgcccagatacgcctggttcttttcatgaaattcactcagttgcagccgcagtgattccggaagttttgaggttttttcattgtacagttcggccactgtatgagcagtttccggaatattttcaatcgggcagggctggagtatgttccagctatttttattttcggtttcccccagcatttgtttaagagttccgtgcaattgtccgcattcngnngcagtctgtgcgtttttccggacttcttttttgtagctacgtacgcagccggcgatttgccgtaaatattctttacggtccgacggtatcaactctgtaatttcggaaacagcaaattcagcttcatgactgcgtttccagttaagtgaatttttcttgatcaggatttcnatcaacttgtgataaaaccagtttgtgccgctgtcgttgaaacgattggcaaccacaccaaaaaccggcattgtttcagtagttgcatcaaagtcatttcgactgcgtttatactgtttgcccacggccagcaaagcatcctgtgctccgggtttgtcaaatttgttgattacaatacaatcggcaaagtcaatcatatcaatcttttccagttgagtagccgcaccaaattccggtgtcatcacataaacactcaaatcaacaaaatccgaaatctcggagtcgctctgaccgatgccggcagtttccaccaaaatcaaatcaaatcctccgcctcctgattttccggttgcctgcagtaagctaacagcaccttccagtgcagtagangtggccaggtgggaacggcgtgtggccagtgagcgcatgtaaacacggggatcgttgatggcattcatacgcatccggtcaccaagcagtgctccaccggttttgcgtttggagggatcgantgacaaaatcgctatgcgcttttcaggaaattcttcaagaaaacttcgcaccaattcatctgccagacacgactttcctgcacctcctgttcctgtcaaaccaatcaccggagcctgtgaattctccaccggagagtcttgtgagtggagtttattcaaaactttttgtactgcttcctgaggttccactactttattttcaggtgccagctgtgaacctttcacgttttgttcgatccaagtcagactatnagcaatatgctgaacnttttccgtaaccagtttgtctgcatgaggttcaaatttatccggcaaaacctgaaaatcagaacgtttcagcatatcagcaatcatgcccgtcaggccaagttcacggccgtcttcaggagaataaacgcgactgataccgtaatccgtcaattcctgaatttcactttgaatgatcacacctccgccgccggcaaaaacctgaatatgtcctgaacctttctcccgcaacaagtccagcatgtagcggaaaaattccatgtgnccgccttggtacgaactgactgcaatactttgggcgtcttcctgaatggcaacattgactatttcctcaacgctgcgatcgtggccgaggtgaatcacttccgcaccctgtgactgcattatgcggcgcataatgttaatcgcagcatcatgtccgtcaaataaactcgtggcggtaacaatacgaacactgttttttagtttgattgtttttttgacaggttggggcgagttcatcgttattttaattatttgagtttatttctcttccagttgccaattgataaattttcaacaaatcatcttcggtaacatcaatgaaagtgtccatttggctgagtgcataaacaaaatcagcatgatccactggtgnatnttcgctattagtgtagtctttttcggtttcttttgatagcaaaaatgcaggatagcgccgccaatgaaacaaggcattaaataaaagtgccaccaggagaatggttgtagtattgattgcaattggagtaaggatatacngnnnnccnagnnnntntnnntttnnncnncnnntnnnnnnngcnnnnncnntngcacngcnaggggnnnnanngnnnnggntnnaannnnnannnccanncnccanccnancncnggcncnnnntncantgcnnnngnangnnnncnanngnnannnnncnnntcngntnnngnnnnannnnaannnacnnccaatnncatnccaanncnnnccnnnnnnnnnnngggnnnnnnnaannnnnngnnnnncnnannnnccnntnnnnntnnnannnnnn

SEQ ID NO: 1027 - DNA, 4000 bp, Escherichia coli
gcacaagcgaaacccaagtaggtgcgccaagcaccggagcttgatttgcgggatatacattccaccaccggacaaaactggcaactgccacatctccataaatagaaatatctacgtcctctattgttgttacgaactccgtcttacctccattcaatgcttcttgggcttctcttgtcgctatctgattccgcatatttagtgattcgttggtctgacgcatgcctccagttatgtagactcgatcgggatgcattaactccgcttgtgctgcaaggtcaccctctaaattcccataagcctctatcaccgccatcacatcatccatatcgtcagcgagaagatctaacggcataaccaaaagtaatgttgcaacccacttagtcataaatattttcactcttaatctccttttattttttcaaaccgacttgcctatattgaagaatatacttgttcacacttatagattttgtccgacacaagagcaggtctggacgcagtaacgagggcataagcttgttcagaccatgactctgaattcaaaacatcaaatacctcacctaatcgatataacgtaggtgcaacagcaacaacattcagcaatggctgactgccactaccaattggctggtagacgtcaaattctatatcgtcatagccgttttcatgatatgcagactctaagttcttgatcgccgcaatatattgctggacatcggttggatttacttccaccaaacgagttgcccacgtgtctcttatttctcccccgtagccatcaataatttgccatgtctcattgccagctagcgttctattagcgcttaattcctcttgcagctgtcttattgaggcactgccgatcattgtgtcccatacttgcatagcatcagctacgctcggtacgaaggaaaagaattgcatttcaccaggtacctggtttcctgaaacagcagtgcaagctccagcgatcgtgacaccaagttgttcaaatatttccccatttaatttttggctagccacgtaactgctggggtcttgagctacaaggtttatgataccgactgcacccgttcccagtgcctcattagaggtatggtgatctgcaagtaagggcgaacaaaccactgtcaaaaccgttactaccaagctgcgacctaacgaacttaattttttcatcattgccattatctcctttttatattttctaactggcggcatcactgctataggccccagtgagtcacataactgttaaacaggtttctgtcagtgcaattttcaaaaatcccccctgagggcgtaccgacgctcgccggaaatgaggcatctagcctcttagcaagatccggccaatctcgccctactaacctgatagtgattcgcgtacccatctcagttccggcgggcgtaccaaacaaggcatgagaaagttgcatctgagtttccgatccagaatctgatctgcgcccgttagctgcgtacagctccgaatacacatcctgaattgaaacatctggagaaacagtgcaaaacctggcagccactcctgagacaagatttgcaccactatcgtaggcattcccgcttccgacagagtaattttttaagaaggtgcgattattaccgtcacaagctaacagctcatttaaatggtctctgggcccgcttggagaaaagctcgcagaagcaaaatgcgcaaaatcgtcccaataaacgaccctcagcgcccaattttctgaaaaatctgatccagaaacgggcgttctgtagaagactgcattaggtgctccgtccgcaggataatcgatggctcttgcaacagtgactacttcgtctattgagtgaccgtgtgcaatttcgcaagcagtcacaactataagactcccggaaggcagctcctgtgaccaagagaaatttgaaaaaagcgcaaagctagaaaaaaagattgtaaaaaaaagacgcgctagcctcataacgacccttccacaactaattttatctactcgttttagctcggtcagatgcatttggtcaagcaagaaattcaaaataatctctttctttaccgaacggtcataaaatggtgcgaaagacatcaatgtagtgcattttgttgcgcaggattgcactaaaatagtgcgcaaaatacattatcgcggtcctaggtcgttgctcatagatcagcaatgaatcggcaaaataaagtagtcacaaattcgaatggtaaaagactaatgctttaagatgttatagattccacgtgcaagatttgaaagctagaccctttcatctctcaagcaatcgaatgtaatccagcaatttaccaaaatgaaataaggggcagaaaatgagtctatctgatttgatcaagttaaaagatgaacaactttcgtttgaaggggaattgacttcagtcgtcctatctgatgagggtggaactatcactggcaagggcgacgcgactctctatggcgctgtgtatttgacttacaatttaacccctaacccaaagatagcgggtcaaggcgttatgaccgggaatgcatcggcgatcgatgattctggacaactcaacacggccatactgagtggggtgttcgatagatcaggacatgcgatgaaaatttattgcgtggacgacatttctgacggcaatatcaatctggcagttgttcaaatagacctgagatcaggaaaaattagagtagattggtcgcaactagataggtagattttacctcatgcttcgactgccaggccgttgagtgacttggcggccgaagcaagtgatgagggcttttctgttacttcattccaactaacgagcgagttgctctaagaacaccttacagaattcgagcgagtagtacgccctaactcattgcctagtcatcgttagacgatatcaatgcggatgataattgcttgagcgcgcgcagattgccttcaattttcggaagtgctcgacgccgtacggacattcgctctgaagttgctagttcactagctgaaatgcagctaccttccgcttcatcgatccgacctttcagggctaaatacacgcaaagattattgagatcagcgaaatctaacttaccattgaagtgcttttccgctgcatcgatatctcccttcgatagagcaggcccacccgctgcatctccaaatacgtgataagaagaaccgagcgtcgcgccagaaagagtaatagcaagggttgtaaaaattgctttaaaagtttttggatatttcattggaatagcctcgtagtgaatttaaaagtttatatatgttgttatgcacgctgataagcaataggagtgccaacatttggctaagatgctattcaaatttatacttaaaaatattttcaataaattcaacagtttgaaggcgaacagcttaaaaaaacatgccatttgactgctcaaatgattacgcgtaaatgcttgtgattggtgcgtaggtgctttacgggtgcaagatggacgacttttggaaccattctgaataaagtgggacatccccgaaggtgggtgctgccagagtgcgattgggttttaaaagggggtctatttggaccactgcggcgcaactgaccacaactgattacaatcgcaggcaactgataaagttaggtgttatagtaggaaacgtgacgcaggctgttgtggttgattatctgcgagggactcataatccgtcggtcccagattcgagtcctggtgggcccaccaactaaatcaatgaattacacctccctcgcagtaactccctaatccatgcggaccaaagatgcaggccatcatgctggtttcgctcgcccccggcaagcgccgcggcgaaatcctgaatctacgcttttagattgcgcaaatcgatcgtgcggggcttggaaagatcgaagacgtatcgcatcacaagtggttctcgatgaccaagcgttatagccatcttcgaagatcataattatcgaactggctgatggatggtg

SEQ ID NO: 1028 - DNA, 4000 bp, Escherichia coli
  misc_feature (62)..(62): n is a, c, g, or t
  misc_feature (67)..(67): n is a, c, g, or t
  misc_feature (94)..(94): n is a, c, g, or t
  misc_feature (124)..(124): n is a, c, g, or t
  misc_feature (178)..(178): n is a, c, g, or t
  misc_feature (218)..(218): n is a, c, g, or t
  misc_feature (220)..(220): n is a, c, g, or t
  misc_feature (412)..(412): n is a, c, g, or t
  misc_feature (478)..(478): n is a, c, g, or t
  misc_feature (538)..(538): n is a, c, g, or t
  misc_feature (691)..(691): n is a, c, g, or t
  misc_feature (784)..(784): n is a, c, g, or t
  misc_feature (1988)..(1988): n is a, c, g, or t
  misc_feature (2311)..(2311): n is a, c, g, or t
  misc_feature (2323)..(2323): n is a, c, g, or t
acatctgatgattgaaaaatctaattacgaaagtcctgctaaagcttacgaaacaattaatnatatntataaaagtctggaatctaaggaaatnctatttgaagatgctgtttctcaatccagngaagatctcgcatcaaaagatataggcggtgacttaggcttatcatcaggtgangcatttcctgaagaattcgaaaatgcaatcttgtcaatgnanctggattctattagcccaattattgagcttgaagactcactgcacattcttaaattaactgaggtgattaaacctcaaattaaaacaaaaacagaaatgtctgaaacactattgagcgagcttatcgatgccgaagcgttggctttgatgcaagatgattttttggaattagaatcattggtgcttgaaggngtctcattaaatgcgttagcgaatgctattgatgccccaattcaagttacgggcttgaaggatatngaatctattgaacttgatggcttcgctgaaatctcatcatcagaattatttgatgcatcnatattgcctaacaaaatagaaatttttgaaggcgatgaaagttatgcttttgtgatgttgactcaggctcttcaaccaagtgtacgaccttttgttgatgttgcagatttggccattcaagaagtgcggaatgaaaaagcaaatttaattatnaatgattttgctgatgatgctgaaagtattatcaatggtgaaaaagcactgccaagtcaaaacgggtttaccattgaaagttttaaaggcgtnaaacgattttcttcattgctcccaccagaaattattaactcaacatttgaatcatctctaggcaccttggtttcaagtgaagcatttaatggagatcgttattgggctaagtcttccaatgaatcgataccaacaatagacgagcttggggagtcaattgagcaataccaaggtttttataacgagagtttaagtcaacaattttctggatttattgatcgagccttcaaaaaaggccaaaaagttcgtctagaaaatattactacaaattaatcgctatattcttcaatagacattgcagctgtattaaagccgccatcaacgtaggtaatttcacctgttacaccgctagctaaatcagaacataaaaaagctgcaacattacccacttcccgagttgttacaaccctgcgaagtggagctctgttggcatagtttgttaacatttttctgaagtttttaaccccagaagcagccagagttttaattgggccagctgagatagcatttaccctgatgctatcaggacccatagctgcggcaagaaatctagtatttgcttctaagcttgcttttgcaagacccatgacgttgtaatttggaagtgactgcatcgaccctaaataggttaaggttaatagagcagcattttcattgagcattggtttagcgcccttggccatagctgtaaagctataggagcttatatcatgagctatctgaaaaccctctctagtggcaacatcaacaaagttaccttctagttcatgagctggcgcaaaaccaattgagtgaacaaatccatcaaaagacttccattgctttgaaagttcctggtacattcttgtaatgctatcgtctgatgcaacatcacactcaaatagcaaatcagtgccaagttcagttgcaattttttctacgttacctttcaacctttcgttttgatatgtaaaagctagttctgctccttgagcgtgcattgcttgagctataccagctgcaatagaatgtttatttgcaagcccagctattagtatttttttattttctaacatctatttatatataccttgtattaatttttaccgatttaattatatatgagttcaattatctttaatcaaatgaattaattgaagcaagtcctaatagataattatgcattaaaacttctaatctcatgaaaacaaggttatgatgcccntcagcaagttttgtaaagatttgtgcaccataaaaaacttaggagtattttaaatgattgatttaaaaaaatatttattcagcgcttttgcagtaatctctctttctgtgcctttagccattgctcaagactctgaagaagatgttgaagaagttattgtaactggatcaaggattgttgatcccaacattattagttcatctcaaatcgctgttatcgatgggcaagatataattgatgctggtgtaactcgagttgaagactatcttaatgatatgcctcaaatttctcctggccaatctattactaattcaaatggctcnaacggaactgcnacagttaatttgagaaatctgggttgttcaagaacattggttctgatgaatggcagaagacttgtccccggaactactggtggcggaagctgtgctgatttaaacactatcccaactcttcttttaaagaaggttgaagtgttaacaggtggcgcatcatcagtttatggttctgacgctgttgctggtgttgttaactttgtcttagatgatgagtttgaagggtttaaagccgcttactcccatggtttttacaatcataaaaatgatatcagcagcttaagagagctccaaagaagctatggttatgaaaatgctcctaaagatgtacaaactggtgatactggtaaattttcaattgcttttggcggtgacatcaatgatggtaaaggtcatgtaactgctttctatgagcacaccgatacaaaaccaatgcttcaaggtgaatttgatattagtgcttgtgcgctaagtggtggtattggaagatgtggtggttcatcaactattcctccaggaagatgggctgattttagtggttataagaatggtggatttgtaaatgttgatccaacagttactggtgttgactggaaagtgcaaggaaatgattttgttaatagagatggtcaaacatataactacaacccaacgaacttcttccaaagacctgacgacagaatgaatatgggattctttggaaaatatgaaattactgataatgcagaagtttatttagatttcaccgcaatgaaatctgaatcaaacgctcagattgcatattcaggtactttcggcaatatcgaatcattgccttgttataatgcattgctttcagctcaacaataccaagttgcctgtgctgactggataggaatgggtggatcacatgcgcctgattttgcaactggcgcagctgcattagcttatatcaatggtttgaatacagcagtggctgatggaactattcttggatacagcgcaccattaacctctttaaaaagaaacgttgagggtaaccctagacagagcattacaacatacaagagctataacacaactctaggaatcaaaggcgatattaatgatgactggtcatacgacatttattatcaaaactcagctgttaactatggtaatgaatacaggaacgatctttctgtaatagcaattaaccgtgcggttaacgttattagcgttgctggcgtaccaacttgtgttagtaagcttcaaggcattgatgcaaactgtgttccatataacctatttcaaggtggattacctggtgatgccggaattcaaggcgtaattgatagcggtcaaactgctcaagattacttagctaaatctacttttattaacggtgatggaaagcaaaaaattctttcaggatacgttacaggtgatacagggttcactctcccaggagctcctggttcagtttcattggttgctggttttgaaacaaaagaactttcaaccgactttagacctgatactccaactcttatgggcgatagatctggttcaggaggagcgacacttccaattggcggtaagtatgatgtagatgaattcttcctagaattaggtattccagtgatggataatctaagtgtagaagttggatacagaactgcagattactcaacagggaatgatactgactcaactaaa

SEQ ID NO: 1029 - DNA, 4000 bp, Escherichia coli
  misc_feature (1986)..(1986): n is a, c, g, or t
  misc_feature (1988)..(1988): n is a, c, g, or t
  misc_feature (1991)..(1991): n is a, c, g, or t
  misc_feature (2139)..(2139): n is a, c, g, or t
  misc_feature (2142)..(2142): n is a, c, g, or t
  misc_feature (2382)..(2383): n is a, c, g, or t
  misc_feature (2385)..(2385): n is a, c, g, or t
  misc_feature (2388)..(2389): n is a, c, g, or t
  misc_feature (2391)..(2392): n is a, c, g, or t
  misc_feature (2394)..(2405): n is a, c, g, or t
  misc_feature (2407)..(2411): n is a, c, g, or t
  misc_feature (2413)..(2417): n is a, c, g, or t
  misc_feature (2420)..(2420): n is a, c, g, or t
  misc_feature (2423)..(2425): n is a, c, g, or t
  misc_feature (2427)..(2427): n is a, c, g, or t
  misc_feature (2429)..(2440): n is a, c, g, or t
  misc_feature (2443)..(2446): n is a, c, g, or t
  misc_feature (2448)..(2449): n is a, c, g, or t
  misc_feature (2451)..(2453): n is a, c, g, or t
  misc_feature (2455)..(2458): n is a, c, g, or t
  misc_feature (2460)..(2464): n is a, c, g, or t
  misc_feature (2468)..(2469): n is a, c, g, or t
  misc_feature (2471)..(2473): n is a, c, g, or t
  misc_feature (2475)..(2484): n is a, c, g, or t
  misc_feature (2486)..(2497): n is a, c, g, or t
  misc_feature (2500)..(2505): n is a, c, g, or t
  misc_feature (2507)..(2510): n is a, c, g, or t
  misc_feature (2512)..(2517): n is a, c, g, or t
  misc_feature (2519)..(2525): n is a, c, g, or t
  misc_feature (2528)..(2530): n is a, c, g, or t
  misc_feature (2532)..(2532): n is a, c, g, or t
  misc_feature (2534)..(2537): n is a, c, g, or t
  misc_feature (2539)..(2541): n is a, c, g, or t
  misc_feature (2543)..(2550): n is a, c, g, or t
  misc_feature (2552)..(2557): n is a, c, g, or t
  misc_feature (2564)..(2567): n is a, c, g, or t
  misc_feature (2569)..(2569): n is a, c, g, or t
  misc_feature (2571)..(2574): n is a, c, g, or t
  misc_feature (2576)..(2576): n is a, c, g, or t
  misc_feature (2580)..(2580): n is a, c, g, or t
  misc_feature (2583)..(2583): n is a, c, g, or t
  misc_feature (2585)..(2585): n is a, c, g, or t
  misc_feature (2589)..(2589): n is a, c, g, or t
  misc_feature (2596)..(2597): n is a, c, g, or t
  misc_feature (2600)..(2600): n is a, c, g, or t
  misc_feature (2602)..(2603): n is a, c, g, or t
  misc_feature (2605)..(2605): n is a, c, g, or t
  misc_feature (2609)..(2609): n is a, c, g, or t
  misc_feature (2611)..(2611): n is a, c, g, or t
  misc_feature (2614)..(2615): n is a, c, g, or t
  misc_feature (2619)..(2619): n is a, c, g, or t
  misc_feature (2622)..(2623): n is a, c, g, or t
  misc_feature (2631)..(2632): n is a, c, g, or t
  misc_feature (2634)..(2635): n is a, c, g, or t
  misc_feature (2637)..(2637): n is a, c, g, or t
  misc_feature (2642)..(2642): n is a, c, g, or t
  misc_feature (2645)..(2649): n is a, c, g, or t
  misc_feature (2651)..(2651): n is a, c, g, or t
  misc_feature (2655)..(2655): n is a, c, g, or t
  misc_feature (2661)..(2661): n is a, c, g, or t
  misc_feature (2664)..(2666): n is a, c, g, or t
  misc_feature (2669)..(2669): n is a, c, g, or t
  misc_feature (2672)..(2672): n is a, c, g, or t
  misc_feature (2674)..(2674): n is a, c, g, or t
  misc_feature (2678)..(2679): n is a, c, g, or t
  misc_feature (2681)..(2681): n is a, c, g, or t
  misc_feature (2683)..(2683): n is a, c, g, or t
  misc_feature (2685)..(2686): n is a, c, g, or t
  misc_feature (2691)..(2691): n is a, c, g, or t
  misc_feature (2694)..(2698): n is a, c, g, or t
  misc_feature (2700)..(2701): n is a, c, g, or t
  misc_feature (2704)..(2704): n is a, c, g, or t
  misc_feature (2708)..(2712): n is a, c, g, or t
  misc_feature (2716)..(2716): n is a, c, g, or t
  misc_feature (2720)..(2720): n is a, c, g, or t
  misc_feature (2722)..(2726): n is a, c, g, or t
  misc_feature (2729)..(2729): n is a, c, g, or t
  misc_feature (2731)..(2734): n is a, c, g, or t
  misc_feature (2737)..(2739): n is a, c, g, or t
  misc_feature (2741)..(2744): n is a, c, g, or t
  misc_feature (2746)..(2752): n is a, c, g, or t
  misc_feature (2754)..(2757): n is a, c, g, or t
  misc_feature (2759)..(2759): n is a, c, g, or t
  misc_feature (2761)..(2762): n is a, c, g, or t
  misc_feature (2765)..(2766): n is a, c, g, or t
  misc_feature (2768)..(2771): n is a, c, g, or t
  misc_feature (2778)..(2778): n is a, c, g, or t
  misc_feature (2780)..(2783): n is a, c, g, or t
  misc_feature (2785)..(2785): n is a, c, g, or t
  misc_feature (2787)..(2787): n is a, c, g, or t
  misc_feature (2791)..(2792): n is a, c, g, or t
  misc_feature (2794)..(2795): n is a, c, g, or t
  misc_feature (2797)..(2798): n is a, c, g, or t
  misc_feature (2802)..(2802): n is a, c, g, or t
  misc_feature (2804)..(2809): n is a, c, g, or t
  misc_feature (2811)..(2817): n is a, c, g, or t
  misc_feature (2819)..(2822): n is a, c, g, or t
  misc_feature (2824)..(2824): n is a, c, g, or t
  misc_feature (2828)..(2828): n is a, c, g, or t
  misc_feature (2830)..(2831): n is a, c, g, or t
  misc_feature (2833)..(2834): n is a, c, g, or t
  misc_feature (2837)..(2838): n is a, c, g, or t
  misc_feature (2840)..(2841): n is a, c, g, or t
  misc_feature (2843)..(2843): n is a, c, g, or t
  misc_feature (2848)..(2850): n is a, c, g, or t
  misc_feature (2852)..(2855): n is a, c, g, or t
  misc_feature (2857)..(2857): n is a, c, g, or t
  misc_feature (2860)..(2863): n is a, c, g, or t
  misc_feature (2865)..(2867): n is a, c, g, or t
  misc_feature (2869)..(2871): n is a, c, g, or t
  misc_feature (2874)..(2876): n is a, c, g, or t
  misc_feature (2881)..(2883): n is a, c, g, or t
  misc_feature (2885)..(2885): n is a, c, g, or t
  misc_feature (2890)..(2890): n is a, c, g, or t
  misc_feature (2893)..(2894): n is a, c, g, or t
  misc_feature (2898)..(2901): n is a, c, g, or t
  misc_feature (2905)..(2911): n is a, c, g, or t
  misc_feature (2914)..(2914): n is a, c, g, or t
  misc_feature (2917)..(2918): n is a, c, g, or t
  misc_feature (2922)..(2922): n is a, c, g, or t
  misc_feature (2925)..(2927): n is a, c, g, or t
  misc_feature (2930)..(2932): n is a, c, g, or t
  misc_feature (2934)..(2934): n is a, c, g, or t
  misc_feature (2939)..(2940): n is a, c, g, or t
  misc_feature (2947)..(2949): n is a, c, g, or t
  misc_feature (2952)..(2958): n is a, c, g, or t
  misc_feature (2960)..(2961): n is a, c, g, or t
  misc_feature (2965)..(2965): n is a, c, g, or t
  misc_feature (2968)..(2969): n is a, c, g, or t
  misc_feature (2971)..(2971): n is a, c, g, or t
  misc_feature (2974)..(2975): n is a, c, g, or t
  misc_feature (2977)..(2977): n is a, c, g, or t
  misc_feature (2979)..(2979): n is a, c, g, or t
  misc_feature (2983)..(2983): n is a, c, g, or t
  misc_feature (2986)..(2988): n is a, c, g, or t
  misc_feature (2990)..(2992): n is a, c, g, or t
  misc_feature (2995)..(2995): n is a, c, g, or t
  misc_feature (2997)..(2997): n is a, c, g, or t
  misc_feature (2999)..(3001): n is a, c, g, or t
  misc_feature (3005)..(3007): n is a, c, g, or t
  misc_feature (3009)..(3011): n is a, c, g, or t
  misc_feature (3016)..(3018): n is a, c, g, or t
  misc_feature (3020)..(3020): n is a, c, g, or t
  misc_feature (3022)..(3022): n is a, c, g, or t
  misc_feature (3025)..(3026): n is a, c, g, or t
  misc_feature (3029)..(3029): n is a, c, g, or t
  misc_feature (3031)..(3033): n is a, c, g, or t
  misc_feature (3035)..(3035): n is a, c, g, or t
  misc_feature (3038)..(3041): n is a, c, g, or t
  misc_feature (3043)..(3043): n is a, c, g, or t
  misc_feature (3045)..(3046): n is a, c, g, or t
  misc_feature (3048)..(3049): n is a, c, g, or t
  misc_feature (3051)..(3051): n is a, c, g, or t
  misc_feature (3053)..(3055): n is a, c, g, or t
  misc_feature (3057)..(3057): n is a, c, g, or t
  misc_feature (3059)..(3061): n is a, c, g, or t
  misc_feature (3063)..(3071): n is a, c, g, or t
  misc_feature (3073)..(3081): n is a, c, g, or t
  misc_feature (3083)..(3085): n is a, c, g, or t
  misc_feature (3087)..(3089): n is a, c, g, or t
  misc_feature (3091)..(3091): n is a, c, g, or t
  misc_feature (3094)..(3094): n is a, c, g, or t
  misc_feature (3096)..(3097): n is a, c, g, or t
  misc_feature (3100)..(3101): n is a, c, g, or t
  misc_feature (3103)..(3103): n is a, c, g, or t
  misc_feature (3107)..(3109): n is a, c, g, or t
  misc_feature (3111)..(3114): n is a, c, g, or t
  misc_feature (3117)..(3121): n is a, c, g, or t
  misc_feature (3123)..(3123): n is a, c, g, or t
  misc_feature (3125)..(3128): n is a, c, g, or t
  misc_feature (3130)..(3132): n is a, c, g, or t
  misc_feature (3134)..(3134): n is a, c, g, or t
  misc_feature (3138)..(3138): n is a, c, g, or t
  misc_feature (3141)..(3141): n is a, c, g, or t
  misc_feature (3144)..(3146): n is a, c, g, or t
  misc_feature (3148)..(3152): n is a, c, g, or t
  misc_feature (3157)..(3157): n is a, c, g, or t
  misc_feature (3159)..(3159): n is a, c, g, or t
  misc_feature (3161)..(3166): n is a, c, g, or t
  misc_feature (3170)..(3174): n is a, c, g, or t
  misc_feature (3176)..(3181): n is a, c, g, or t
  misc_feature (3183)..(3186): n is a, c, g, or t
  misc_feature (3188)..(3188): n is a, c, g, or t
  misc_feature (3190)..(3192): n is a, c, g, or t
  misc_feature (3194)..(3195): n is a, c, g, or t
  misc_feature (3197)..(3199): n is a, c, g, or t
  misc_feature (3201)..(3201): n is a, c, g, or t
  misc_feature (3204)..(3206): n is a, c, g, or t
  misc_feature (3208)..(3208): n is a, c, g, or t
  misc_feature (3210)..(3214): n is a, c, g, or t
  misc_feature (3217)..(3217): n is a, c, g, or t
  misc_feature (3219)..(3220): n is a, c, g, or t
  misc_feature (3223)..(3225): n is a, c, g, or t
  misc_feature (3227)..(3232): n is a, c, g, or t
  misc_feature (3234)..(3236): n is a, c, g, or t
  misc_feature (3238)..(3241): n is a, c, g, or t
  misc_feature (3244)..(3245): n is a, c, g, or t
  misc_feature (3248)..(3253): n is a, c, g, or t
  misc_feature (3255)..(3262): n is a, c, g, or t
  misc_feature (3265)..(3267): n is a, c, g, or t
  misc_feature (3270)..(3270): n is a, c, g, or t
  misc_feature (3272)..(3274): n is a, c, g, or t
  misc_feature (3276)..(3276): n is a, c, g, or t
  misc_feature (3279)..(3287): n is a, c, g, or t
  misc_feature (3291)..(3293): n is a, c, g, or t
  misc_feature (3295)..(3296): n is a, c, g, or t
  misc_feature (3298)..(3302): n is a, c, g, or t
  misc_feature (3305)..(3309): n is a, c, g, or t
  misc_feature (3313)..(3313): n is a, c, g, or t
  misc_feature (3315)..(3315): n is a, c, g, or t
  misc_feature (3317)..(3318): n is a, c, g, or t
  misc_feature (3320)..(3321): n is a, c, g, or t
  misc_feature (3324)..(3324): n is a, c, g, or t
  misc_feature (3327)..(3332): n is a, c, g, or t
  misc_feature (3335)..(3335): n is a, c, g, or t
  misc_feature (3337)..(3338): n is a, c, g, or t
  misc_feature (3340)..(3341): n is a, c, g, or t
  misc_feature (3343)..(3343): n is a, c, g, or t
  misc_feature (3346)..(3350): n is a, c, g, or t
  misc_feature (3353)..(3354): n is a, c, g, or t
  misc_feature (3357)..(3357): n is a, c, g, or t
  misc_feature (3359)..(3366): n is a, c, g, or t
  misc_feature (3368)..(3368): n is a, c, g, or t
  misc_feature (3371)..(3377): n is a, c, g, or t
  misc_feature (3380)..(3380): n is a, c, g, or t
  misc_feature (3382)..(3382): n is a, c, g, or t
  misc_feature (3385)..(3387): n is a, c, g, or t
  misc_feature (3389)..(3393): n is a, c, g, or t
  misc_feature (3395)..(3398): n is a, c, g, or t
  misc_feature (3400)..(3402): n is a, c, g, or t
  misc_feature (3404)..(3404): n is a, c, g, or t
  misc_feature (3406)..(3407): n is a, c, g, or t
  misc_feature (3409)..(3412): n is a, c, g, or t
  misc_feature (3414)..(3414): n is a, c, g, or t
  misc_feature (3417)..(3417): n is a, c, g, or t
  misc_feature (3420)..(3423): n is a, c, g, or t
  misc_feature (3425)..(3427): n is a, c, g, or t
  misc_feature (3429)..(3433): n is a, c, g, or t
  misc_feature (3435)..(3438): n is a, c, g, or t
  misc_feature (3442)..(3442): n is a, c, g, or t
  misc_feature (3444)..(3445): n is a, c, g, or t
  misc_feature (3447)..(3448): n is a, c, g, or t
  misc_feature (3450)..(3459): n is a, c, g, or t
  misc_feature (3463)..(3463): n is a, c, g, or t
  misc_feature (3465)..(3465): n is a, c, g, or t
  misc_feature (3467)..(3467): n is a, c, g, or t
  misc_feature (3470)..(3474): n is a, c, g, or t
  misc_feature (3476)..(3479): n is a, c, g, or t
  misc_feature (3485)..(3487): n is a, c, g, or t
  misc_feature (3490)..(3491): n is a, c, g, or t
  misc_feature (3493)..(3493): n is a, c, g, or t
  misc_feature (3495)..(3496): n is a, c, g, or t
  misc_feature (3498)..(3498): n is a, c, g, or t
  misc_feature (3500)..(3501): n is a, c, g, or t
  misc_feature (3503)..(3510): n is a, c, g, or t
  misc_feature (3512)..(3514): n is a, c, g, or t
  misc_feature (3516)..(3518): n is a, c, g, or t
  misc_feature (3520)..(3520): n is a, c, g, or t
  misc_feature (3523)..(3530): n is a, c, g, or t
  misc_feature (3532)..(3537): n is a, c, g, or t
  misc_feature (3539)..(3539): n is a, c, g, or t
  misc_feature (3541)..(3541): n is a, c, g, or t
  misc_feature (3543)..(3545): n is a, c, g, or t
  misc_feature (3548)..(3549): n is a, c, g, or t
  misc_feature (3551)..(3551): n is a, c, g, or t
  misc_feature (3554)..(3554): n is a, c, g, or t
  misc_feature (3557)..(3557): n is a, c, g, or t
  misc_feature (3559)..(3559): n is a, c, g, or t
  misc_feature (3561)..(3562): n is a, c, g, or t
  misc_feature (3566)..(3566): n is a, c, g, or t
  misc_feature (3568)..(3571): n is a, c, g, or t
  misc_feature (3573)..(3575): n is a, c, g, or t
  misc_feature (3577)..(3577): n is a, c, g, or t
  misc_feature (3579)..(3581): n is a, c, g, or t
  misc_feature (3583)..(3584): n is a, c, g, or t
  misc_feature (3586)..(3586): n is a, c, g, or t
  misc_feature (3589)..(3590): n is a, c, g, or t
  misc_feature (3592)..(3592): n is a, c, g, or t
  misc_feature (3594)..(3596): n is a, c, g, or t
  misc_feature (3598)..(3598): n is a, c, g, or t
  misc_feature (3600)..(3601): n is a, c, g, or t
  misc_feature (3603)..(3605): n is a, c, g, or t
  misc_feature (3611)..(3614): n is a, c, g, or t
  misc_feature (3617)..(3617): n is a, c, g, or t
  misc_feature (3619)..(3620): n is a, c, g, or t
  misc_feature (3622)..(3626): n is a, c, g, or t
  misc_feature (3628)..(3629): n is a, c, g, or t
  misc_feature (3631)..(3632): n is a, c, g, or t
  misc_feature (3636)..(3640): n is a, c, g, or t
  misc_feature (3642)..(3642): n is a, c, g, or t
  misc_feature (3644)..(3644): n is a, c, g, or t
  misc_feature (3646)..(3646): n is a, c, g, or t
  misc_feature (3648)..(3648): n is a, c, g, or t
  misc_feature (3650)..(3651): n is a, c, g, or t
  misc_feature (3653)..(3653): n is a, c, g, or t
  misc_feature (3655)..(3671): n is a, c, g, or t
  misc_feature (3673)..(3674): n is a, c, g, or t
  misc_feature (3676)..(3679): n is a, c, g, or t
  misc_feature (3683)..(3683): n is a, c, g, or t
  misc_feature (3686)..(3696): n is a, c, g, or t
  misc_feature (3698)..(3701): n is a, c, g, or t
  misc_feature (3703)..(3703): n is a, c, g, or t
  misc_feature (3706)..(3706): n is a, c, g, or t
  misc_feature (3708)..(3713): n is a, c, g, or t
  misc_feature (3715)..(3715): n is a, c, g, or t
  misc_feature (3718)..(3719): n is a, c, g, or t
  misc_feature (3721)..(3722): n is a, c, g, or t
  misc_feature (3724)..(3730): n is a, c, g, or t
  misc_feature (3732)..(3735): n is a, c, g, or t
  misc_feature (3737)..(3738): n is a, c, g, or t
  misc_feature (3740)..(3743): n is a, c, g, or t
  misc_feature (3746)..(3747): n is a, c, g, or t
  misc_feature (3750)..(3751): n is a, c, g, or t
  misc_feature (3754)..(3758): n is a, c, g, or t
  misc_feature (3760)..(3764): n is a, c, g, or t
  misc_feature (3770)..(3775): n is a, c, g, or t
  misc_feature (3777)..(3778): n is a, c, g, or t
  misc_feature (3781)..(3781): n is a, c, g, or t
  misc_feature (3783)..(3784): n is a, c, g, or t
  misc_feature (3786)..(3791): n is a, c, g, or t
  misc_feature (3793)..(3795): n is a, c, g, or t
  misc_feature (3798)..(3799): n is a, c, g, or t
  misc_feature (3801)..(3806): n is a, c, g, or t
  misc_feature (3808)..(3808): n is a, c, g, or t
  misc_feature (3810)..(3812): n is a, c, g, or t
  misc_feature (3814)..(3818): n is a, c, g, or t
  misc_feature (3820)..(3823): n is a, c, g, or t
  misc_feature (3827)..(3829): n is a, c, g, or t
  misc_feature (3831)..(3831): n is a, c, g, or t
  misc_feature (3833)..(3843): n is a, c, g, or t
  misc_feature (3846)..(3847): n is a, c, g, or t
  misc_feature (3849)..(3849): n is a, c, g, or t
  misc_feature (3852)..(3855): n is a, c, g, or t
  misc_feature (3857)..(3857): n is a, c, g, or t
  misc_feature (3861)..(3866): n is a, c, g, or t
  misc_feature (3868)..(3868): n is a, c, g, or t
  misc_feature (3870)..(3871): n is a, c, g, or t
  misc_feature (3873)..(3874): n is a, c, g, or t
  misc_feature (3876)..(3882): n is a, c, g, or t
  misc_feature (3885)..(3885): n is a, c, g, or t
  misc_feature (3887)..(3893): n is a, c, g, or t
  misc_feature (3896)..(3899): n is a, c, g, or t
  misc_feature (3901)..(3903): n is a, c, g, or t
  misc_feature (3905)..(3917): n is a, c, g, or t
  misc_feature (3919)..(3920): n is a, c, g, or t
  misc_feature (3922)..(3924): n is a, c, g, or t
  misc_feature (3926)..(3928): n is a, c, g, or t
  misc_feature (3930)..(3933): n is a, c, g, or t
  misc_feature (3936)..(3948): n is a, c, g, or t
  misc_feature (3950)..(3956): n is a, c, g, or t
  misc_feature (3958)..(3958): n is a, c, g, or t
  misc_feature (3960)..(3961): n is a, c, g, or t
  misc_feature (3963)..(3964): n is a, c, g, or t
  misc_feature (3966)..(3970): n is a, c, g, or t
  misc_feature (3972)..(3974): n is a, c, g, or t
  misc_feature (3976)..(3977): n is a, c, g, or t
  misc_feature (3979)..(3983): n is a, c, g, or t
  misc_feature (3985)..(3987): n is a, c, g, or t
  misc_feature (3989)..(3991): n is a, c, g, or t
  misc_feature (3993)..(3996): n is a, c, g, or t
  misc_feature (3999)..(4000): n is a, c, g, or t
tcggacgggaaaggcgacgcgcggacgcggtggaagtcatgctctggggcggtttcgctatttggttgctattggttacacgtatcatcacaactgaaacaacgagctaataatgccgatatcgaacgaatgggaacaaccgtgagagcgagcgatgagcgagcgagacagagacggagaccggcgctatgtctcccccgcctctttcgccctggtgttcacgaagtaaataccgaccaaggtgacgacggctccgccgagctgcgtcgaagtgagggtctcgtccaacgcaaagtaaccgagagccgaggcgaacatgggcgtgagaaacgtgagcgtgctaagctttgtgagtgaacccttgttcgcaaagtaaaagaaggcgccgtaggcgacagcgcctccgaaaatggaggcgtacgcgagactggcgacatccgtcgtcgagagcgccatgtttgagtatagttctggttccgtcgcgagcgagtacgcgagcaacggtacgcctccgagcgccatatgccaacccgtcgccatgacgggatcgacgtacttgcacacccaacgaaccatgacggtgccgatggccatggattgcgccgccaacaacatccaccactccccgctatcccaaaggttgccatcaaaaagcgcaacgttactcaaagcctccgcgccatccgagttcaccacagatgttaaaacctccggagggagttcgaggagtaagagacccaagacgccgagcgcgaggccggcgacgccctccgcgccgagcgtctctccgtagaagatggacgccaacacagccacagtcagaggctgagaatctatgatgaccgatcccagaccagcgcttgtgcgctgcaatccctcagccaaaaacccttgaaacatcgccgcgtcaaccacggcgaagagcgccaccgcggtccaggcctgggcggatttgggaagcggtctccctttactcaacgcccacgcgacgagaatcaatcccgacggaatgaggcgcaccgaagccacaaacatcggcgaagtcacgggcaatacacccttcatcgccaccatactcgtgccccacaagaagaagggcgagacgagcgccaaacttccaaacaacgacgcgacgtccgacgtcgtcgcctctgccaccctctcgctcgcgctcgcgaccctatcgtccacatccatcgacacgtcgcacgacgcctccatccccacaccgacgcacgaaatctctctctcatttaccaccggttccggaatcacgcactcggcgcccatcgtcgacgcgacgcactccaaaccttcatccgccgaacgcgcttgactctccgccaccgcgccgacgccgtccgcgtcctgttctgcgcgcacccgactcctcacgcatcgcgacgacgacgacgacgacgacgacggcgcatacaccatcgacaccgcgcgtcgcgtccgcacatctctcaccgtcggcgtcgttcgcctcaaaccaccgttcgccgctggcgccatcgtcatcacccgcaccgtcgtcatccgcatcgtcttgattctgataacacccgtcgtccaggcgtggcgcgaacacccacgcgaacgaccgacggtgaagcgaagtagcgaacgacgcggtcgacgacgactgcgtccgcccgtcgcgcactgcggcgcgcgcgcgacgcgcgcgtcgtcgtcacaaatctatgtaccagagaatcacagtacaacgacccacgacaatacgacacatatgtaccatactaaaaccacataaacatctatataaatgaataaaatagaaaattaactcaaaaaatttaactcgtcgtattgtaccaccgtttaacgccgttcaacactcaagatttgttagtcccaggtcgatcccacgggttgcgaatctcaacgatcgagatgtttgaaaatcatgcataaaaacacgtagggtttacaaataccatattgtaggacatttaaaancnatncgaatatattttccaaggagtcattcatggatactttcgtgcgggaacgaacgaacgaacgttggaacgctcggttcgacacaccgcgacgacggaaggaaccgcgaggtacgaaccgggagaccgcgcgacgcgacgcgaacgccgncgncgacgacgacgccacccccgcccgcgcggtggcgttccgttccgcgcggcgccgacgacgacgccgacgcgccagtaaaatgaatgaaatgcgcgaacccgagcgagggattcgactgacgaacgaacgcgaacgcgtcgcgcgcgcgcaggattctctcgaaaaacgaaggatcgaacgaaatgaaggctcaggaaaaggtgcgtccgtcgcgtctcgcgcgatcaaagtcgacgcgtnnanagnncnnannnnnnnnnnnngnnnnngnnnnncgngannngngnnnnnnnnnnnntcnnnnanncnnncnnnngnnnnngtgnntnnntnnnnnnnnnntnnnnnnnnnnnnttnnnnnntnnnngnnnnnngnnnnnnngtnnncntnnnngnnncnnnnnnnngnnnnnnggttgtnnnntngnnnncnaganggngngacngacgganngangnnanggangncgnngcgncgnncgcagcanncnnangaatngannnnncnaccnccgaancgnnngangangncgtnntngntnntttgntcnnnnnanngangagnnnnnatgnggcngnnnnnccncnnnncgnnngnnnngnnnnnnngnnnngngnngcnnannnngacgacnannnngncngccnngnngnngaanannnnnncnnnnnnncnnnngnaggngnngnnggnngnngntaagnnnannnngncgnnnnannngnnnaannnggcgnnncngccgncgnngctnnnnaagnnnnnnngcncgnngaanaannnaannngncaaanngtcatcnnngcnnnnnnngnnaagncgnngngcnncngnacgncgnnncnnntcntntnnngcannnannnaagannngngntgnnggnannncnccnnnncnannannanannntnannngnnnnnnnnngnnnnnnnnnannncnnnantancnnatnngnggannnannnnacnnnnncngnnnngnnnanttgnaangannnannnnncaagnancnnnnnnactnnnnnannnnnnannnngnannncnncnnncngtnnncngnnnnncgnannagnnnannnnnncnnncnnnnctnnaannnnnnannnnnnnncgnnnaancnnncnacnnnnnnnnngctnnntnncnnnnnacnnnnnaacnancnnannaantcnnnnnntcngnncnncnacnnnnncanntcnannnnnnnngncgnnnnnnngangnaannnannnnngnnnngnnngnannannnnanaanaannnnannngnnnnncnnnncagntnncnngnnnnnnnnnnaagnangnaannnnngnnnngccgcnnngcnncnanncnannannnnnnnntnnncnnntnacnnnnnnnncnnnnnngngncnnngtnncnatnaananannaaanannnnannncnannnannanaannanannnanannannnaactannnnacnannannnnnanntnntcannnnncnancnancnnanannnnnnnnnnnnnnnnntnnannnntttnatnnnnnnnnnnngnnnngncgncnnnnnngnganngnngnnnnnnngnnnncnngnnnncgnngcnncgnnnnncnnnnnatcacnnnnnnanncancnnannnnnncnnnccnncnnnnnngncnnngnnnnntnnnnctcnnncntnnnnnnnnnnncgnngnttnnnntntttnnnnnntngnncnncnnnnnnncgngnnnnnnngcnnnntnnntnnnnnnnnnnnnncnncnnncnnncnnnngcnnnnnnnnnnnnncnnnnnnncntnncnncnnnnngnnncnnannnnncnnncnnncnnnntcnn

SEQ ID NO: 1030 - DNA, 4000 bp, Escherichia coli
  misc_feature (188)..(188): n is a, c, g, or t
  misc_feature (239)..(239): n is a, c, g, or t
  misc_feature (317)..(317): n is a, c, g, or t
  misc_feature (319)..(319): n is a, c, g, or t
  misc_feature (428)..(428): n is a, c, g, or t
  misc_feature (664)..(664): n is a, c, g, or t
  misc_feature (1138)..(1138): n is a, c, g, or t
  misc_feature (1206)..(1207): n is a, c, g, or t
  misc_feature (1399)..(1399): n is a, c, g, or t
  misc_feature (1404)..(1404): n is a, c, g, or t
  misc_feature (1987)..(1987): n is a, c, g, or t
  misc_feature (2015)..(2015): n is a, c, g, or t
  misc_feature (2048)..(2048): n is a, c, g, or t
  misc_feature (2319)..(2319): n is a, c, g, or t
  misc_feature (2565)..(2565): n is a, c, g, or t
  misc_feature (2640)..(2640): n is a, c, g, or t
  misc_feature (2661)..(2661): n is a, c, g, or t
  misc_feature (3009)..(3009): n is a, c, g, or t
gcaagtggtctacctgtggagcgagagggcatataccatcgttgatgatttcataatcactacgtcgtatcacttcctcttgcggtagttgacgtgctatccactcaagggtcttttccctactaatactatcacgtgccatcacacgacgaatacgtacttcttctggcgccgtaacgcatactacnttatcaatgtgggtacgcttatcaaaaccactatcaaagagtatcgcactntcaagccacgattgacccgattgctcaaaatcatgagctacagcaggatgtatcacggcattgaccgcctgtacatgngnctcactctgtaagagataggctgcaagaatggctttttgcaagacaccatcacggaagacatcctcaccgacaagtgcagaaagctgttgttgtagtggttgagaggtncgcatcaattcctttgcgtgcgcatcacaatcgtaaacagagatacctcgctccgcaagaagcttacagacgtaagactttccgctaccaataccaccagtcaacgctactatcatcgctgctcaatgagataatcaaccgtatttacttctggtcgtacgttgcgtacaccattaggagaacttatcacatagataggacatttctcgctattatttttctctatatcttcgtanttgactacaacacggaagcctacagggagaagttcctttgtctccgcattctttggcatcgaacgcatacgataggcacctaccacaaacttcacttttatcttgcttgggaaggtacgcatcaccttgttgtcaggcatattgacagcttcaattggtacctcaaccgtctcctctgtaagtacatctggatagagtttcatctttacactggaaggaacacacttggcattcgtaaactttcggaggtctacagtcaactccttgacatctgtgaaattggtaatatactgtcgctctgtatagactgtttgaatactatccaacacattacgcgctgcataaacctgaacgctatctggagtaaagtctacacgagcaagataataattatcaccaggtgttactgtccccaaaaggcgtacaggtacctttttatgacgaccaaagttaaatgagaaagagaactttccngccttgacagaagctatctttgaactctttgacagttgaagataaatctgacgttgaaggtctgcaannggtacatctcccttacttcgtccgtcactatgaactttgtagtcgacatagatagggcggaatgtatcatcaagaccataatacgcaatcatatatcccttgtctcgcacagtaaaacggacaacagaatcaaggtcactggtaataaccacattacgaggaacacccgtcatgcgaagtggtatactgaantcacnctcataagtttcgttcagtgtcattatcaaccagaaccctccactcaataccaagaaaaacaaaaaaatcagaaactccttgttgaatatcctcaacaagaagttcctgaaggtactgaatgtatgaagcgatttgcttgttttcatcaaatgctttccttcttttctaccaataaggtttacttagtctgaccctgctgagaagcctgtacgtttgcgaatacgtagttcttatcaacagtgataacaacaccacgtgcaatctcaacttcaaccttattggttgtcatatcaatatgctttactgtgccatagattccaccaccagtcacaacagaatcacctgctgagagagcattctggaaagcacgaatctccttctgcttcttctgctgtggacgaatcatgaaaaaccacatgatggcgaagatagctaccatcatgataatcataggcattgggctgccttgacctgcagcctgtgctgcgaggattaatgttgtattcattatttatcagttattatgttcttaatttatgagcgtgaaaaggaggctataggcaagcataacgtctgaaaggnttttataaacactcatcattattatgcnaaacaagcctctttcgtgacgattcttaaaagntttccgcctatgtctttattccttattctccgcctgatcagttgcttgctgctgacgataagccacacgctgagcagaagtttgcgcaatcgttgggcgacgtccctcacgacgtggtgctctttcctcttggcgatcattgcgaggacgatgttggcgaggctctggcattgtcttcatcatcttaccagtctgtatgagatgacgtgcaattgtatcaagcataccattgatatatccaccacttcgcggtgtactatacaatttagcnaagtcaacatactcgttgatggtcaccgttactgggatattagggaatgtaagcatctcagcaatagctatctgcatgatgacaacatccatataagccaagcgagagaaatcccagttacgacttgactcactcatataacgctgataatcgtctgcattgaggatagttgaacggaagagtttaagtgcaaagtcacggtcctcttcgtcacgatattctggcagaagttcttgatcagcaccnttagcagggtcgaatcgtttgatagtcttgataacgaaggtatcaacaacttccttatcatcattccaataaagnctcttctcctccaacacagcntccaaatcaggattctcctgtatgagagtacgatatatcttacgccacacctcacggtctgcctcgtacgaatcatcatcacttgccatgtactcttggtagatagtgctctgttcaatctgatcacagagtttacgaacagcctccatatcatcttcccaacgacgtttttgtgattccatgaaaaggttaagctgcttattctcttccaactgaacagcaaacttattgtttacaaaacgacttgagggagcctcagtcccctcacggttggcacgatttgcagctatctccacgcgatggcgctcctcttgcgtgactgatacgattaaggccaagaggtaattntagaggtcatacgctttcgccaagctgaaaagaagttccttctcagcattgtccatattcctgttaccgttctgatagtatgcataggttaactggacaatcttaattcttattaattccctattgatcattgtcttttctaaaagattgtgtttcgtattgaatactttattttgcaaatgtaggaaatttccttcgtacatgcaagcattagtatctttttctatgtttttttagagaatacttgctcaatccattgaaaagaagtaactttgcaacgctttttgcaaattgaggattgaaagttgtgatattcattagatttccaattccttagtctctcagtgtgtgatggcgaattaaagttcatattaatttagagtaacacagaattatgaaagaaattaaagtaacaggtcagaagcgtacagaccttggaaagaaagcttctaagcagctccgtaaggagggtttgattccatgtaacctctatggtgaggcacagcaggatggcaagccagtagcattctcattcacagctcctatgtcagagttgcgtaagttggtttacacaccacacatctacgttgtagagttgattattgatggtgagagacgtactgcagttcttaaggaactccagttccacccagtaacagacgctctgcttcacgtagacttctatgaggtgaacgaccagaagccaatcgttatgggtgtaccagttaagctcgtaggtttggcacagggtgttcgcgatggtggtcgtatgaacatgtctatccgtaagattaacgttaaggctccttatcagcagattccagagcacctcgatatcaacgttactgagcttcgtcttggtaagagtatcaaggttggcgagttgagcttcgagggtcttgagttggtaactccaaaggaggttgtagtttgctctatcaaggctacacgtaattctatccaggctgcgcaggctgctgcagctgctgag

SEQ ID NO: 1031 - DNA, 4000 bp, Escherichia coli
  misc_feature (87)..(87): n is a, c, g, or t
  misc_feature (135)..(135): n is a, c, g, or t
  misc_feature (168)..(168): n is a, c, g, or t
  misc_feature (411)..(411): n is a, c, g, or t
  misc_feature (435)..(435): n is a, c, g, or t
  misc_feature (908)..(908): n is a, c, g, or t
  misc_feature (2013)..(2013): n is a, c, g, or t
  misc_feature (3042)..(3042): n is a, c, g, or t
  misc_feature (3051)..(3051): n is a, c, g, or t
  misc_feature (3099)..(3099): n is a, c, g, or t
agtattgttaggcatatttagaaatattaaaatatatcactagtgatatcactagtgatgatttctgaatggtttcagagggtaggnagttcagttccaagaggattttcaaggtattttattctggaattactnaaagagaaaacatacacgggaaaggaaattatngattatgctgtaaaacaaagtaatgggatttggaaaccatctccaggattaatctatccattattaggtagactacttgatgaaaaattaattgaagaaacaaaagatggtagatatcaattaacaaaacaaggtttagagacagcacaagatgtggacaaaattaatgatattgttaaaaatcaattagaagttcttttcagattaggaaacgttggaagatttgttgcattagatttactngaaaaaatttcatctatgggttcnattctaagttctaatttatcaaacatgacagaggatgaaactcaaaaatataaaaaattccttcaagaagaattagagaaaatggaaggcaagaaagtagataaaaaaattaaaatcgaataataaaaaattaataaataattcaaaaaaaatagaaatttatgaaaaaattatctagtatgataaaatcaaaaaaacctctggtcataccaggagtctatgatgcaattggagcaaaaattgctgaaaaagttggatttgatgcaatgtttcaaactggatatggaacatcagctacattatttggaatgccagattatggatttattggagcaacagaaacagtagataatgcaagaaggatatcaaatgcaatatcagttccacttattgttgattcagatacaggttatggtaatgcactaagtgtttggaaattagtaaaagaattagaagctgcaggagcagcaggnatatttctagaagatcaaaaatggccaaaaagatgtggacatatgcaaggaaaagaggtaataccacaagaagaatatacagaaaagctaggtgctgcaattgatgcacgtgaaaataaagacttcatcattgtggccagaacagattcaagagcaacagaaggacttgacaaatcaattgaaagaggaattcaaaataaaaaaacaggtgctgatgccatattcattgaagcaccaagatcattagatgaaatgaagaaaattggaaaagagatcaaagcacctctagtagcaaatatgattgagggaggagcaaccccaatgaattcagcaaaaacattaaacaaaattggattcaacataattctatatccattatcagtattatttgcaaatacatttgcaacaatgaatattttacaagaattaaaaaattctggaacaacttcaaaatataaacaaaaagtggtaaattttgatcaatttaacaaattagtggaattagataaattcaaaaaaatggaaacaaaatacaaatttacaaaaagaaaataaaaaattttaagtaaagtgcaattattctgcgtttctctttacttcaatttctattgttgaaacatttcgtgttctaccatcttctgattccaaagattctgaatcaattttgacatttccgatagaatatccggcattttcagtttttcgtgcaacaatttgagctacatctacagcacgacctatgctgagtcccctagctttgatgttgacagatggcacatttgccaattgaattagcgttgatgttacatatgccatcaatggttttttaccaatgaatatggtgtctctagtttcagtggacatggatagtatagtatttaacgataatttaaagttaaaatgaattttttataaatattataaaaaattgaaaaaatttaagattattatgttgaaaatagaatttaaaaatagtttggaagatatttcaaaaatactagaatcagaaaacgctcaagaaaaaattagaattttagaaactctacatgaaacaaataatttgaaaatattgcaacaagtaatttcaagattaaatgataacagnatacaagttagaggagaagcatttaattcacttttattaaatcaaaatgatatctcaaaaattttaattgataatcttaattcttcaaataaaaatatcaaaagttttacagcactagtattagctaacagaaatgaaaaaaaggcaattccagatataattaaactggtagataacgaacatggaatggtaagatcttgtgcaattggatctctaggatatctaaaagcagatgaaattacagatatcattttggatgcattttcagattccaatttagatgtacaaaaaagtgcattacaagcagcaattcaaacaaatatttttgtttcagaagaaaaaattaaagaaatttcaaaaaataatgatcctcaaatacaaaatctattattgaaattaaaaaaataagtggaccgaaagggatttgaacccttgatccgatgcatgccatgcacctatcctaccagactagacgaccggcccaataatcagaaatctgattgaataatattttgtaaattggttattaacgtttagcgatttaaaaaattaggttagtcaaattatcacaatatatttaaagttcaagatgctgattgaattgtcatggtagtagataacaaagcaactgtcacttatgttcaattattaaaagaagaccttctcataatgagaattgttccaaaggaaggtccagttcctgattttgaagcaggtcaatttctcacattaggattaccaaataaagctgataaagataaaatggttagacgagcatattcaatagcatctcatccagaaaataaagattacattgaatttgtaattagatgggttagaaaaccacttccaggaagattaactacacaaatatttaatgtaaaagaaggggacgaaatatcttggttgaaacctacaggtagagcattaggaatcagtcaagaattaccaagtggtgaaaaagatacaagaagaattgtatgtattggtggtggaactggtcttgcaccatttgtgagttttgcacancatcttcangatactaatgataaaagagaagttgttgttttacatggcgcaagttangttgatgaattaagttacaaagatttgcttaccaatcttgaagatgaaagtattgcaaaaggtaaggatgtatggaattttaaatatagagcagcaataagtagacctcaagagtggttcaatagaagttgggcaggtcaagttggtagagttgaaacgttcctaagacctagagataatggaatgtcaccattagaggaattaattggtgataaagtaacacaaaaaaatacaattttctatgtatgtggctggcaaggcaccatagatggagttatggactttttaaaaccaaaaggattcatcacagaacacgataaacgtgaagatggaagttttgaagtcaaatacgaatcatacggatagaattattcaataaattaatcattgaaatatgagaattatttagaaatcataattgatcacagccatatatcttgctcatctaaatccagtaacaaatgctcatgtagagatcattaaggaattgaaaaaagatgcagatattgtcaaagtaatgccagttatttttagatctgatgaaaaagaagtaaacagtaaaagttttccatttaattttgaaactagaaaaaagatgcttgaatcaatttttggggattcaatcaaaataactgatgattatgcatttctggcaccattcaaaaaatatctcccaccattagtaagaagaaaatcatggaaattaagaaagcagatactcaatggtgttgaaggagattatttttcatacacaggagacaaggcagaaggatacatgttgaaaatgtatagactaaaaccaaaacttggtgaacgaaaagcattgtctgcaacatcagttaaagagaaactgtataattcagtatttgaaaaaaattctacttggaaagaagatgttcca

SEQ ID NO: 1032 - DNA, 4000 bp, Escherichia coli
  misc_feature (187)..(187): n is a, c, g, or t
  misc_feature (2022)..(2022): n is a, c, g, or t
  misc_feature (2514)..(2514): n is a, c, g, or t
  misc_feature (2538)..(2538): n is a, c, g, or t
  misc_feature (2544)..(2544): n is a, c, g, or t
  misc_feature (2546)..(2546): n is a, c, g, or t
  misc_feature (2552)..(2552): n is a, c, g, or t
  misc_feature (2624)..(2624): n is a, c, g, or t
  misc_feature (2627)..(2627): n is a, c, g, or t
  misc_feature (2709)..(2709): n is a, c, g, or t
  misc_feature (2759)..(2759): n is a, c, g, or t
  misc_feature (2790)..(2790): n is a, c, g, or t
  misc_feature (2919)..(2919): n is a, c, g, or t
  misc_feature (2931)..(2931): n is a, c, g, or t
  misc_feature (3153)..(3153): n is a, c, g, or t
  misc_feature (3213)..(3213): n is a, c, g, or t
  misc_feature (3223)..(3223): n is a, c, g, or t
  misc_feature (3358)..(3358): n is a, c, g, or t
  misc_feature (3362)..(3362): n is a, c, g, or t
  misc_feature (3371)..(3375): n is a, c, g, or t
  misc_feature (3377)..(3378): n is a, c, g, or t
  misc_feature (3380)..(3381): n is a, c, g, or t
  misc_feature (3383)..(3384): n is a, c, g, or t
  misc_feature (3386)..(3392): n is a, c, g, or t
  misc_feature (3394)..(3394): n is a, c, g, or t
  misc_feature (3401)..(3404): n is a, c, g, or t
  misc_feature (3406)..(3407): n is a, c, g, or t
  misc_feature (3411)..(3413): n is a, c, g, or t
  misc_feature (3415)..(3415): n is a, c, g, or t
  misc_feature (3418)..(3421): n is a, c, g, or t
  misc_feature (3424)..(3430): n is a, c, g, or t
  misc_feature (3432)..(3432): n is a, c, g, or t
  misc_feature (3434)..(3434): n is a, c, g, or t
  misc_feature (3438)..(3438): n is a, c, g, or t
  misc_feature (3441)..(3441): n is a, c, g, or t
  misc_feature (3446)..(3449): n is a, c, g, or t
  misc_feature (3452)..(3458): n is a, c, g, or t
  misc_feature (3460)..(3461): n is a, c, g, or t
  misc_feature (3471)..(3484): n is a, c, g, or t
  misc_feature (3488)..(3491): n is a, c, g, or t
  misc_feature (3493)..(3494): n is a, c, g, or t
  misc_feature (3496)..(3496): n is a, c, g, or t
  misc_feature (3499)..(3501): n is a, c, g, or t
  misc_feature (3504)..(3506): n is a, c, g, or t
  misc_feature (3514)..(3515): n is a, c, g, or t
  misc_feature (3521)..(3521): n is a, c, g, or t
  misc_feature (3526)..(3526): n is a, c, g, or t
  misc_feature (3529)..(3531): n is a, c, g, or t
  misc_feature (3533)..(3533): n is a, c, g, or t
  misc_feature (3538)..(3541): n is a, c, g, or t
  misc_feature (3543)..(3543): n is a, c, g, or t
  misc_feature (3547)..(3548): n is a, c, g, or t
  misc_feature (3550)..(3550): n is a, c, g, or t
  misc_feature (3552)..(3552): n is a, c, g, or t
  misc_feature (3554)..(3554): n is a, c, g, or t
  misc_feature (3556)..(3556): n is a, c, g, or t
  misc_feature (3561)..(3562): n is a, c, g, or t
  misc_feature (3564)..(3565): n is a, c, g, or t
  misc_feature (3568)..(3568): n is a, c, g, or t
  misc_feature (3572)..(3572): n is a, c, g, or t
  misc_feature (3578)..(3579): n is a, c, g, or t
  misc_feature (3584)..(3590): n is a, c, g, or t
  misc_feature (3599)..(3599): n is a, c, g, or t
  misc_feature (3603)..(3604): n is a, c, g, or t
  misc_feature (3606)..(3609): n is a, c, g, or t
  misc_feature (3611)..(3616): n is a, c, g, or t
  misc_feature (3619)..(3619): n is a, c, g, or t
  misc_feature (3624)..(3624): n is a, c, g, or t
  misc_feature (3629)..(3629): n is a, c, g, or t
  misc_feature (3631)..(3632): n is a, c, g, or t
  misc_feature (3635)..(3635): n is a, c, g, or t
  misc_feature (3641)..(3643): n is a, c, g, or t
  misc_feature (3647)..(3647): n is a, c, g, or t
  misc_feature (3649)..(3649): n is a, c, g, or t
  misc_feature (3653)..(3653): n is a, c, g, or t
  misc_feature (3656)..(3659): n is a, c, g, or t
  misc_feature (3661)..(3661): n is a, c, g, or t
  misc_feature (3664)..(3664): n is a, c, g, or t
  misc_feature (3667)..(3669): n is a, c, g, or t
  misc_feature (3675)..(3679): n is a, c, g, or t
  misc_feature (3690)..(3691): n is a, c, g, or t
  misc_feature (3701)..(3702): n is a, c, g, or t
  misc_feature (3709)..(3709): n is a, c, g, or t
  misc_feature (3715)..(3715): n is a, c, g, or t
  misc_feature (3721)..(3725): n is a, c, g, or t
  misc_feature (3732)..(3736): n is a, c, g, or t
  misc_feature (3738)..(3738): n is a, c, g, or t
  misc_feature (3741)..(3742): n is a, c, g, or t
  misc_feature (3749)..(3751): n is a, c, g, or t
  misc_feature (3754)..(3754): n is a, c, g, or t
  misc_feature (3759)..(3764): n is a, c, g, or t
  misc_feature (3767)..(3767): n is a, c, g, or t
  misc_feature (3771)..(3771): n is a, c, g, or t
  misc_feature (3775)..(3775): n is a, c, g, or t
  misc_feature (3777)..(3777): n is a, c, g, or t
  misc_feature (3782)..(3784): n is a, c, g, or t
  misc_feature (3788)..(3793): n is a, c, g, or t
  misc_feature (3800)..(3800): n is a, c, g, or t
  misc_feature (3803)..(3804): n is a, c, g, or t
  misc_feature (3807)..(3808): n is a, c, g, or t
  misc_feature (3810)..(3816): n is a, c, g, or t
  misc_feature (3818)..(3819): n is a, c, g, or t
  misc_feature (3821)..(3824): n is a, c, g, or t
  misc_feature (3828)..(3835): n is a, c, g, or t
  misc_feature (3838)..(3838): n is a, c, g, or t
  misc_feature (3840)..(3841): n is a, c, g, or t
  misc_feature (3843)..(3843): n is a, c, g, or t
  misc_feature (3848)..(3848): n is a, c, g, or t
  misc_feature (3850)..(3850): n is a, c, g, or t
  misc_feature (3855)..(3855): n is a, c, g, or t
  misc_feature (3859)..(3862): n is a, c, g, or t
  misc_feature (3865)..(3866): n is a, c, g, or t
  misc_feature (3868)..(3868): n is a, c, g, or t
  misc_feature (3872)..(3875): n is a, c, g, or t
  misc_feature (3878)..(3878): n is a, c, g, or t
  misc_feature (3881)..(3887): n is a, c, g, or t
  misc_feature (3889)..(3889): n is a, c, g, or t
  misc_feature (3891)..(3891): n is a, c, g, or t
  misc_feature (3893)..(3893): n is a, c, g, or t
  misc_feature (3897)..(3897): n is a, c, g, or t
  misc_feature (3899)..(3899): n is a, c, g, or t
  misc_feature (3904)..(3904): n is a, c, g, or t
  misc_feature (3908)..(3914): n is a, c, g, or t
  misc_feature (3919)..(3920): n is a, c, g, or t
  misc_feature (3925)..(3925): n is a, c, g, or t
  misc_feature (3929)..(3930): n is a, c, g, or t
  misc_feature (3934)..(3936): n is a, c, g, or t
  misc_feature (3939)..(3939): n is a, c, g, or t
  misc_feature (3943)..(3943): n is a, c, g, or t
  misc_feature (3947)..(3947): n is a, c, g, or t
  misc_feature (3949)..(3956): n is a, c, g, or t
  misc_feature (3961)..(3961): n is a, c, g, or t
  misc_feature (3964)..(3965): n is a, c, g, or t
  misc_feature (3967)..(3968): n is a, c, g, or t
  misc_feature (3977)..(3979): n is a, c, g, or t
  misc_feature (3981)..(3989): n is a, c, g, or t
  misc_feature (3992)..(3993): n is a, c, g, or t
  misc_feature (4000)..(4000): n is a, c, g, or t
agctgcagttgcaccgtaacaagcttctttaacttctatagctcgtacaaatggttgaatgtctaataatccatgaataaatacagaagaggctttactttggtcaacacctgattctgttcctactataatcatatcaattttttctaagtcttctttatctaaaatttcaaatgctgcttgagcnccaagagtaactatatcttgagacacaggtggaatactcatttcaagttgaagtaatcctttagtaaatttatcaggctctatgccacgagcagtcgctagatcgcgaatgtctaagtaatacttaggcatggcaaaacctattttatcaattcctattttcatttccttttacctttcgatctacgtaattattctataaatagtatgtatagaatatattaatattatgtagtatatagatttataataatcatatacttatgtcaaaaataaaaattatcgcaattactattgtataagattttttaaaaatagtccacagtttgactattaaatttttaaaaagttgtatagcactcaaattttaatatagtatacttaaattaagcttaaataaagacacaaaaaagagctaatagagaagaaacctttctctattagcatatttttattttttagaaattgccatagcgacaccttgtcctccgccgatacatagtgaacatattccgcgatttttgttttcgttaattaaagaatgtactaaagtaactagaacacggcaaccgcttgcgccgataggatgtcctaacgctattgcaccaccattaatattaactttagaactatctaagccaagttcacgtgtaacagcaatagattgtgaagcaaaggcttcgttcatttcgaataaatctatgtctttaatatctagatttagttttgataacactttttgagttgcatgaattggtccaagccccataactttattatctaaaccaactgtagtatagccatctacgtaagctaatatatctagacctaattcgtttgctttatcttcagacattaaaataacgcatgcagccccatcattgataccagaagcattaccagcagttactgtaccatcttttttaaatgctggtcgtagttttgatagtgattcaagggttgtttcagggcgaacgtattcgtctgtatcgaaaataatttcttctcgacgagttttaattgtgataggggtaatttcattaacaaacttattattttctatagctgaactagctttttgttgactagctaaagcaaaactatcctgttcttctctagtaatattgaattgttcagcaatattttctgcagtaatacccatatgataattttcaaaagcatcagttagaccatcttttataacgctatcttctaattcaaaattaccaagtttatgaccaaagcgaggtgaactagttacaaatggtgcggcactcatattttctacaccaccacaaactactatgtcgctatctcctagtagaatagcttgtgctcctaagataacactctttaatcctgatccgcaaactttgttgacagtaaacgcacttttttcctttgggatacccgcattaacagctatttggcgcgcgatattttgcccaagtccaccttgaagaacattaccaaaaattacttcatcaacaagtggtgggtctaagttaatattatttaaagcatcttgaacaactgctgaacctaaagctgcagcagaaacatttttaagacttcctccaaaacttccaatagggcttcgttttgcacttacaatagcaactctattcatataataatctccttataagtatatttatcgagtatattttactataaacatttagcaagttcaaataaatgtatctttatacaagataaagagaaaatatgaatgcattttaatagaatctaaggtttctgtaacataattgtaacattgtaacaaaaaaataataacgttcaatacttataaatattaatttagcaacgttcaangactattagaaatatttatgtaatatttttgtaacaattttgtaataaaagtattgcattttgaaatttttaggagtataataagtttgtaaaaaatattgaaaagaatttttattaaaagaaggtatagttatgaacaaattattaaaaacaacaggcgtatttattttaggtgtaggacttttaacagggtgctcacatacttcatcacaaaaatcagataatggcaatgaatcatcaaaagtagctattgcacatgtagatgaaaataaagacaaaaatgataatagaaataatgtaactgaagagaatagtaataataataatgtagcccaagaaaataatggcaacaatacaggttataaagcaactagtgattacaatgatcaaaatagtaaaatagctcaaaataattcaaatatatatagagctattcaagatagcagttatgttaacaaagtaactagaaatagtggagaaaacaataaagtngttaaagataataatactactagnaaagtngnacaaantaatagtaatagcagcaaagtagctcaaaacactaaaaaaactcaacaaaatgctagtgataataaagtaantgntgctaataataaagtcgaacaaaaaaataaaaatgtaaataaagatgagaaaaaatcagttgaacaaaaaaatgttaaaaanaataacgatgtaaaagcaactgaacaaaaaaatccaaaagctgatgatanttctaaagctactgaaaaacaaaataatggntataaacataactttaaagaagtagaaaaattattaaacgttattaattatagcttaagcaatactaaaaattcaaaaatgatagatataataagatttagtgcaagtatctctagtacacaaaatcangttgtttatctnccagcagctaatttattagatagacttaatacaaataacgctgaaacatacaatgttaatgcagttctaaataaattatttgttgaaaatggtgtaaaactagttactgcaaataaagcaaaaagtgaatacactccagctgaattagaaaaattagtaccagataataacactgttgtttacttcaaaaaagataatatgtttgctatacgtagtgtagtnggttatggaggaactactaattctatatttgctccaacagaagattggaaagtagaaggngataaaatcntaattccttatgtaacagtagcaactaataaaccaactggtcttatgacagtaagattaaataataaagtttatccaaatggacaaaataaaactatgtactatgttgaaagctttatctactattaaaaaatanaaanaaaaaaggnnnnnannanntnntnnnnnnntnttttttnnnnannaaannnanttnnnnaannnnnnnananaaanaanaaaannnnaannnnnnntnntaaaagggannnnnnnnnnnnnngggnnnnannanccnnnttnnnaaaaaaannaaaaanttttnttnnntnttaannnnanaaannantnancnaaatnntnnttnaaanaaaaannttttnnnnnnnaaaaggganaaannannnntnnnnnnaanttaanaaaantnnttntttttnnntaananaatnttnnnngnctnttnnntaaaannnnnttaaaattttnnttaaaatttnnttaaaanaaattnattttnnnnnttaaaannnnntngtnntttcccnnnttnttttnnnnnnttntttntttnanaaaannntttnnnnnnaaaaaanccnnggnnannnnnnnanngnnnngggnnnnnnnnttntnnanttttntnttttntttnnnntannantttnnnnttnccnnnnnnntntncncccnanaatanaaannnnnnnttatnnttttntttnnaaannnttnttanaatntnnnnnnnnaaatnttnncnnccaaggttnnnannnnnnnnnggnnaattttn

SEQ ID NO: 1033 - DNA, 4000 bp, Escherichia coli
  misc_feature (308)..(310): n is a, c, g, or t
  misc_feature (312)..(315): n is a, c, g, or t
  misc_feature (317)..(319): n is a, c, g, or t
  misc_feature (321)..(326): n is a, c, g, or t
  misc_feature (329)..(331): n is a, c, g, or t
  misc_feature (333)..(333): n is a, c, g, or t
  misc_feature (335)..(337): n is a, c, g, or t
  misc_feature (339)..(339): n is a, c, g, or t
  misc_feature (341)..(341): n is a, c, g, or t
  misc_feature (343)..(344): n is a, c, g, or t
  misc_feature (346)..(348): n is a, c, g, or t
  misc_feature (351)..(354): n is a, c, g, or t
  misc_feature (357)..(358): n is a, c, g, or t
  misc_feature (360)..(365): n is a, c, g, or t
  misc_feature (367)..(369): n is a, c, g, or t
  misc_feature (371)..(373): n is a, c, g, or t
  misc_feature (375)..(375): n is a, c, g, or t
  misc_feature (380)..(381): n is a, c, g, or t
  misc_feature (383)..(384): n is a, c, g, or t
  misc_feature (388)..(388): n is a, c, g, or t
  misc_feature (390)..(390): n is a, c, g, or t
  misc_feature (392)..(393): n is a, c, g, or t
  misc_feature (398)..(405): n is a, c, g, or t
  misc_feature (407)..(411): n is a, c, g, or t
  misc_feature (413)..(417): n is a, c, g, or t
  misc_feature (420)..(421): n is a, c, g, or t
  misc_feature (423)..(425): n is a, c, g, or t
  misc_feature (427)..(439): n is a, c, g, or t
  misc_feature (442)..(442): n is a, c, g, or t
  misc_feature (444)..(445): n is a, c, g, or t
  misc_feature (452)..(455): n is a, c, g, or t
  misc_feature (458)..(461): n is a, c, g, or t
  misc_feature (464)..(468): n is a, c, g, or t
  misc_feature (471)..(471): n is a, c, g, or t
  misc_feature (473)..(477): n is a, c, g, or t
  misc_feature (479)..(483): n is a, c, g, or t
  misc_feature (485)..(488): n is a, c, g, or t
  misc_feature (491)..(491): n is a, c, g, or t
  misc_feature (493)..(495): n is a, c, g, or t
  misc_feature (497)..(498): n is a, c, g, or t
  misc_feature (500)..(500): n is a, c, g, or t
  misc_feature (502)..(506): n is a, c, g, or t
  misc_feature (508)..(511): n is a, c, g, or t
  misc_feature (513)..(520): n is a, c, g, or t
  misc_feature (522)..(526): n is a, c, g, or t
  misc_feature (528)..(529): n is a, c, g, or t
  misc_feature (531)..(538): n is a, c, g, or t
  misc_feature (540)..(542): n is a, c, g, or t
  misc_feature (544)..(545): n is a, c, g, or t
  misc_feature (547)..(548): n is a, c, g, or t
  misc_feature (550)..(550): n is a, c, g, or t
  misc_feature (552)..(557): n is a, c, g, or t
  misc_feature (561)..(561): n is a, c, g, or t
  misc_feature (564)..(566): n is a, c, g, or t
  misc_feature (568)..(570): n is a, c, g, or t
  misc_feature (572)..(573): n is a, c, g, or t
  misc_feature (575)..(575): n is a, c, g, or t
  misc_feature (577)..(580): n is a, c, g, or t
  misc_feature (583)..(586): n is a, c, g, or t
  misc_feature (588)..(590): n is a, c, g, or t
  misc_feature (595)..(596): n is a, c, g, or t
  misc_feature (598)..(600): n is a, c, g, or t
  misc_feature (603)..(607): n is a, c, g, or t
  misc_feature (609)..(612): n is a, c, g, or t
  misc_feature (614)..(614): n is a, c, g, or t
  misc_feature (616)..(617): n is a, c, g, or t
  misc_feature (620)..(625): n is a, c, g, or t
  misc_feature (627)..(628): n is a, c, g, or t
  misc_feature (630)..(633): n is a, c, g, or t
  misc_feature (635)..(637): n is a, c, g, or t
  misc_feature (640)..(642): n is a, c, g, or t
  misc_feature (644)..(644): n is a, c, g, or t
  misc_feature (647)..(648): n is a, c, g, or t
  misc_feature (650)..(650): n is a, c, g, or t
  misc_feature (652)..(653): n is a, c, g, or t
  misc_feature (655)..(664): n is a, c, g, or t
  misc_feature (666)..(668): n is a, c, g, or t
  misc_feature (671)..(671): n is a, c, g, or t
  misc_feature (673)..(674): n is a, c, g, or t
  misc_feature (676)..(677): n is a, c, g, or t
  misc_feature (679)..(681): n is a, c, g, or t
  misc_feature (683)..(691): n is a, c, g, or t
  misc_feature (693)..(693): n is a, c, g, or t
  misc_feature (696)..(705): n is a, c, g, or t
  misc_feature (707)..(717): n is a, c, g, or t
  misc_feature (719)..(720): n is a, c, g, or t
  misc_feature (722)..(722): n is a, c, g, or t
  misc_feature (725)..(729): n is a, c, g, or t
  misc_feature (731)..(731): n is a, c, g, or t
  misc_feature (733)..(734): n is a, c, g, or t
  misc_feature (736)..(736): n is a, c, g, or t
  misc_feature (739)..(739): n is a, c, g, or t
  misc_feature (741)..(741): n is a, c, g, or t
  misc_feature (744)..(744): n is a, c, g, or t
  misc_feature (746)..(748): n is a, c, g, or t
  misc_feature (750)..(750): n is a, c, g, or t
  misc_feature (752)..(753): n is a, c, g, or t
  misc_feature (755)..(761): n is a, c, g, or t
  misc_feature (770)..(770): n is a, c, g, or t
  misc_feature (772)..(772): n is a, c, g, or t
  misc_feature (774)..(774): n is a, c, g, or t
  misc_feature (1159)..(1159): n is a, c, g, or t
  misc_feature (1162)..(1162): n is a, c, g, or t
  misc_feature (1297)..(1297): n is a, c, g, or t
tcagtccatcacgcgttatctccgctctcacggtttgaggcgcaacgaactgcatgtccacgatcgcccggctcgtcagctgcggaatgaggtaagcgcgcccgaagcacaggctcgatgccagcatatagaacagcgactccggcgattcaagcccgcccgttttgttcttccaatcggcggatgtgtcgtacagttcgccgttctctctcagtatgccaaatggcagtgcgctcacggcgttggcggtcatgtccaccgcctttgccagccacggcaccacgcgcctgagctgctgcgcctgcgcnnngnnnntnnncnnnnnnccnnngntnnncncnannannncgnnnntgnncnnnnnnannncnnngntgatnncnntgangntnncgccnnnnnnnntnnnnntnnnnnctnntnnntnnnnnnnnnnnnntcntnnctgatgnnnnacnnnncgnnnnngangnnnnncnnnnngnnnncgngnnncnncncnnnnncnnnntnnnnnnnntnnnnngnngnnnnnnnntnnntnncnnangnnnnnngctngcnnncnnngnntngnnnntcnnnnannnggatnngnnngtnnnnnannnngntnngtnnnnnntnnannnngnnntgnnntntcnngntnntnnnnnnnnnngnnntgntnntnntnnngnnnnnnnnnangtnnnnnnnnnncnnnnnnnnnnngnngntcnnnnncncnncnatncngtncnnntncnntnnnnnnnaggccgcangnancctgtcctccagcactgggtaatccacgcggttgaatcggtcaagcgccaccatttcgcgcgtgttcacgtccagcaccgtgataaccgtgtaatccacggaagccgccacatccaccccagcgctgtactggtgcccatcaagcggttgctcaagtggttgcaggatggccgcgtcgtgtaccctgcggaagaccatgccctctgaatcaacgaactccgccaggtattcctgcctgaatatgatttcaggtaactccgcccgcgccgcttcgatctcacctttcggcatgaaagggttcgcgcttgtcgggtaggtgaacgatgaccaatccggctccgccccacccttgcggtgaatgtcccaaaaccagttgcgcccgcgnggngtggagatgaacagcgcccgccctaacctgtctgacaatgccggcctgattgcctctatccacgcctccggcataatgtacgcggcttcatccataacaacaaaatcaagcccctcaccgcgcagactgtcaggnttgtcggctgatctaacagccaccaatccaccgcctggaaacaccgcttgccgttctgacttattgaccgataccccgtcaagaggtgaacaaacctgcctgattggccgccagccgacattactcatcttgtaggttggtgcgatccaccaggcgcgcccgccacgcatagcgacttgcaaacattctgtaactgcaagccacgttttgccgaaacgcctgccggctgatacagtcctgaagcgcgtatcatccttgtaaatcttgaactgcgccggatgtaagtctgatataacctcaatcggaatcaccgccctgcgtcaattccctcaccgtcaatgaatgttttatgtccccaccatccgcgcccgtgacctcctgccgctcaacgtaaccgcgattcttgcccttcgtggatagttgatacttcagcgcccacgggtcagcattgatcaccgctttgcgtagattaagctcggcaatatctgtaacctcttcgtcaaactgatccttcaattcttgcaactctggatacttgttaatataagcatagatggcggtatgcgagcatcctaagtcggcagcagccaagtagaccgctcccttcttgttcttcagcgcctctataaccatcttcttgctcagcctgcggtgtcccatataaacttagtaaacctcttgccatatcaccatggattgcctattgacaatgagcacaattgcgcgtataatataagtgtaagttaaattcaattctattggaggacaaaatgaaagcaaaatatgaccaatatattcacgagtattacgatgaatccggaaatgtgcgttattccgtagcatggtgggacgagaataccggacagtatcagcgtccgctagatgctcggacacgggcattgaccggatgtcatacggaatacacccaccggattgaagagtttggtggttatctgaccaagcgccaggctctgcgccgggcacgatatctgtttggcgagaatgaataagatgatatacatgattggctattccaattttgaaccatcgcaaatcaagcagatcgcggatgaattgaacggggtaatatttgacgtgcgattgcacgcattttcgtatacaaccgcatattgcaagtccaaactggcggagctgctgggtgatagatatctccatattccccaatggggcaatgtgaattataaagaccggaatctcccgtttcggatagcggatttttatggcgggctggaaatatttgagcacgaatccaggccggtcatattgatgtgtacatgcaaaaattttttgaattgccatagattcatcctggtgagtagaatcggtggacaatacacagagataaaatccgcgtcgcagatattgcaaccatcgctgttctaaggcctccggcatctatatacatctgggactccttccggtaagtacggaaggagttccttcttaatgaagtaaggtatgtcattctcaagcatgaattttgttactcgctcggcaaaaccataccagttaatcgtcttttcatgcgcgtttctgttcaggcgtccaatacgataatgattgacgaaatttcgcgtcttttcaacgatcttataaacttcgtcttcgtacaacactggctcaagactcacccacgtaggtattccggcttcatggaatgtccgcagcgcattacagcgatcctcgaataacgccgcccctggctcccacttgcgactaagttcatctgttgtagttgttagagtgctggcgaattcatcgcgcggcgtaaatagcttgatgtcgcgcaacgcccgcgttccacccttcgtcagtgttacaaaggtatgacctgtagcatgaagtatttgaattgccttgcgtgtcaacccgtattccaattcggctggttgataagggtcgtttagaaacgacatcagaacgtgcccaccctctccacgctgatagcgcgcaattgcgtccttttccagcattaccaggaagttagcacgaggctcaatcctggcgttaaatatttctcgttttgtgaacgtagcagacggaacataacaatatgcacaggcatgcgtacatccatgatagatattcaacgcaagtgctgcatcactgcgcgccgatccggttggctcataaatcactgacactgttcacctctaacaccggctgaataccaatcttgctaaattgctccagtagaaatgcgatgtacatcggttcaatatcaatcccgacacaagacttcccgagctgctggcaggcaagtgctgtatttccgcaacctaaaaacggatcaaacaccgaattaccagagaaacagtcccctatcagcaggcgcacccaatcaagcggtttttcatacggatgaaatccatcattatgtaattgcggaagcggcatctggaagatgtcgctcaagtgctttccgcgcgggtcgggatggaatgtatacgctccacgtgagttttttacttcatgctcttctccagcatcaccataatgagccccgtcgaagttgtattgctcaatatctccgaaccacagcgccagcttcgcacgacgcaaaggacgatttggagtataccaagaggtgcaaccatcccatgcgaatatccacgtcggcaacccaaacattttaatcacatcccgcgccctgtatccatcactgtaagcgattattccctg

SEQ ID NO: 1034 - DNA, 4000 bp, Escherichia coli
atatttctcataaagaggagccatagcatgcgcgaatgctacgtttaattcaggactattgcccatgttgaggactgaaggatctgctgcatcacgagcttcttcagagtgacgttctgctagagcatcaattaggtctttttctaactcagaacaaccgtctttgagagttattgctttttggatatggtcgtgccctgaacctaggcctggagcccagttgtaatttgaagaaacacaatatgcaataccccaccatgccatagcacaatctggatcgatttcagcacatttactgaaacatgcaatcgcttcttcgtggttgtaattcaacatgtgcccataagcacggacaaacatttttcgggcatcatcattggcacaagttatcgtagttgcgaatgaaaaattcgcggcatttccgaaattataatcagttggggctaaagacatattttagcggaaatgagttctgaattaatgatttatgattaagttctaataggaggtagtcattttttagattggtgaatcagttatcttgtttaactgtaagatgaggataaggaataccgatattatttgacttgaatctatctaacatttctataagcagccaatctttagcttttctctcactattgtagtcatcaacccaacaatcgagtctgaatactagggcagtttcagtcacatcgtatagtagcacctcggtttttggactatcaatagtaaaactgcaatcattaattatattatttattagagattttacaattttaggatcagcatccagagaggttcgtattcggaaacgaagattcattgagtctttatctcccagagagcctcctaatgcatagttctcaactatttcacctgaaagtgttgtatttggtatcactactaaacgttcgttacccgtacgtatcttagtagtcatgaggccgacatcatcaacccttcctttcacccccattactatcactttatcaccctttgagaaaggcttgtcgagcaacatgagtagcccagaaactagatttgctgccgtttcttgtaatgcgagtcctataactaatgtcaatatagttgcagatgcaacaattgctgtgacatcgatattcatttggtctagagcgatgagaattgcagccagccaagcaaggagtttggaaacactaactgtaattgtttttagtgttgataaatcaagagatgtgttttcatccattgattgaaataatggaggtatgaactcatcgactatcgaagtaagaaactgagcaaataatatcagcaatatagccgctgatccaccagcaaaagcagatctttcgaaagagccctcttcaaatgcaaaacgaaatgtcaaccaaattccaataaggaatacacctgtattaagaattggtgtagctagattgaataatcggtcatcatatatgttatcacttgaagaaattaccttcaatactggtccacgtaatatcaatcttgaaattaaagttgcaacgatacttgccacgattccaacaagaatttgaacaaatatacttgaggattctaaatcatcaaaatatgattcgaatggggccatcatcaagtcttcaaagtgaggaatagtttatttgatttgtgccgacaatgatgtgaaattagtcgaaaaatagaacttttggtgctcgtgccgggatttgaacccgggtcgccgcctcgaaagggcggcatgatggaccgaactacaccacacgagcggtaagccgccgagaagcaaaccccacataatcgcaacggttcaaaccactacaaaaaaatataaactaatcttctatatcatcttcaatagactgactagaagatgaataagaagaaatccaaaaaaggaataaaactaaacccaataaataaaatattagcaacggattttgagtatcagatttaagccatctttcagaatctgtagggaaaaaatccgaattatcccctactccatcatcatcagaatctaaagtctcatttgaatcataagggaaggcgtcagaattatctccaattccatcaccatctgaatctaaatattcatcaggattattcgggaatacatcagaattatctcccaccccatcattatcaaaatcaattgtttcattagaatcataagggaaggaatctgaattatctcccactccatcgttatcagaatcggatatctcattagaatcataagggaaggcatcggaattatcccctactccatcgttatcggaatcaattgtttcatcaggatcatatgggaacatatctgaattgtcccctactccatcattgtctgaatctgctgtttcattagaattgttagggaacatatctgaattatctcccactccatcgttatcagaatcaattgtttcatcagggtcgtatggaaaaacatctgaattatctcctactccatcattgtcagaatctaaagtctcatttgaatcataagggaaggcatcagaattatctccaattccatcaccgtcagaatccatattttctaatggattatatggaaaagcatcagaattatctccaacaccatcgctatctgtatctagatgttcatttggattgagaggaaatacatcagagttatctccgattccatccctatctgtatctgaaatttcagtagaatcatcagggaactcatctgagttatcacctactccatcattatctgagtctactgtttcagtcgaatcattagggaactcatctgagttatcacctactccatcattatctgaatctactgtttcggttgaatcgttcggaaaagcatctgagttatcccctactccatcatcatctgaatctaatgtttcagttgaatcgttcggaaaagcatcagagttatcccctacaccatcgccatcagaatcttgattttcaagcggatcatgcgggaagtcgtctacatcatctctgaaaccatctccgtctgaatcaggggagtatccagtgaggccccaattcagtattgtttcagcgaaatcatcatcacttgcagatgatacagcaggtagatgaccaccatctggaattttccaaagagaaacacgattaccaaagttacagtttagatattcatattcaatcgtatcattttgtccactaggggatataatatctaattcgtctatcaaagttagagaagcgtcacattctgagcgattcgcccaataattaactgtttgaggtgctgaaggataattaccaccaaataatgaaccaccatcatactgaattacagagtctagagtcccatgtatttgtaaaatattgggatgaccagtgttctgacaatcattaaaatcagaatatgtggctccagcaagagatatcgcggctctgatcatatcgcctctttcacaggccatgcggtgagccatgaaaccaccattggaatgacctacgagtattattccctctggatctgcaccgtgatatgtgattgcctcatttatcaaaactgtcagccacgacacgtcatcaacatcttcattccaaatattacagcatgcatccgtggcattccagtacctttgaccagtagcactgtatgacccatctggcctcaataaaagatgcccgtttttatgcacactttctattaaatcaaagtatgaagaaacgaaagaacctgaattcgtaaaaccatgtaaagcaacaactaatggcaatttatagctagtattatggccaccaggcatctctaatatggcttttctagaagaaggaccaatctctaccgtagtatggttatctgtatattcaatagaatatctttcatcaatattagagttgttctcttcgaactgattaatagaattatttgtcgataatgaaaaagattgtgtgatgaaaattaatactatcaagaacggaattacttgggtccttatcattgagaaatctccacatttaatgaattccaccaattaattaa

SEQ ID NO: 1035 - DNA, 4000 bp, Escherichia coli
  misc_feature (49)..(49): n is a, c, g, or t
  misc_feature (92)..(92): n is a, c, g, or t
  misc_feature (202)..(202): n is a, c, g, or t
  misc_feature (959)..(959): n is a, c, g, or t
  misc_feature (1107)..(1107): n is a, c, g, or t
  misc_feature (1228)..(1228): n is a, c, g, or t
  misc_feature (1992)..(1993): n is a, c, g, or t
  misc_feature (2139)..(2139): n is a, c, g, or t
  misc_feature (2149)..(2151): n is a, c, g, or t
  misc_feature (2157)..(2159): n is a, c, g, or t
  misc_feature (2161)..(2162): n is a, c, g, or t
  misc_feature (2164)..(2169): n is a, c, g, or t
  misc_feature (2171)..(2171): n is a, c, g, or t
  misc_feature (2173)..(2173): n is a, c, g, or t
  misc_feature (2182)..(2188): n is a, c, g, or t
  misc_feature (2190)..(2194): n is a, c, g, or t
  misc_feature (2196)..(2197): n is a, c, g, or t
  misc_feature (2199)..(2201): n is a, c, g, or t
  misc_feature (2203)..(2208): n is a, c, g, or t
  misc_feature (2210)..(2211): n is a, c, g, or t
  misc_feature (2213)..(2213): n is a, c, g, or t
  misc_feature (2215)..(2215): n is a, c, g, or t
  misc_feature (2222)..(2222): n is a, c, g, or t
  misc_feature (2224)..(2227): n is a, c, g, or t
  misc_feature (2231)..(2232): n is a, c, g, or t
  misc_feature (2234)..(2250): n is a, c, g, or t
  misc_feature (2253)..(2254): n is a, c, g, or t
  misc_feature (2258)..(2293): n is a, c, g, or t
  misc_feature (2297)..(2301): n is a, c, g, or t
  misc_feature (2303)..(2304): n is a, c, g, or t
  misc_feature (2307)..(2308): n is a, c, g, or t
  misc_feature (2315)..(2316): n is a, c, g, or t
  misc_feature (2318)..(2318): n is a, c, g, or t
  misc_feature (2320)..(2321): n is a, c, g, or t
  misc_feature (2323)..(2326): n is a, c, g, or t
  misc_feature (2328)..(2330): n is a, c, g, or t
  misc_feature (2333)..(2336): n is a, c, g, or t
  misc_feature (2338)..(2342): n is a, c, g, or t
  misc_feature (2345)..(2347): n is a, c, g, or t
  misc_feature (2350)..(2350): n is a, c, g, or t
  misc_feature (2352)..(2354): n is a, c, g, or t
  misc_feature (2356)..(2359): n is a, c, g, or t
  misc_feature (2361)..(2363): n is a, c, g, or t
  misc_feature (2365)..(2366): n is a, c, g, or t
  misc_feature (2370)..(2370): n is a, c, g, or t
  misc_feature (2372)..(2372): n is a, c, g, or t
  misc_feature (2374)..(2378): n is a, c, g, or t
  misc_feature (2381)..(2382): n is a, c, g, or t
  misc_feature (2384)..(2386): n is a, c, g, or t
  misc_feature (2388)..(2389): n is a, c, g, or t
  misc_feature (2391)..(2391): n is a, c, g, or t
  misc_feature (2393)..(2394): n is a, c, g, or t
  misc_feature (2400)..(2400): n is a, c, g, or t
  misc_feature (2402)..(2402): n is a, c, g, or t
  misc_feature (2404)..(2406): n is a, c, g, or t
  misc_feature (2408)..(2412): n is a, c, g, or t
  misc_feature (2414)..(2419): n is a, c, g, or t
  misc_feature (2421)..(2422): n is a, c, g, or t
  misc_feature (2424)..(2424): n is a, c, g, or t
  misc_feature (2426)..(2427): n is a, c, g, or t
  misc_feature (2429)..(2432): n is a, c, g, or t
  misc_feature (2435)..(2435): n is a, c, g, or t
  misc_feature (2437)..(2438): n is a, c, g, or t
  misc_feature (2440)..(2441): n is a, c, g, or t
  misc_feature (2445)..(2446): n is a, c, g, or t
  misc_feature (2451)..(2451): n is a, c, g, or t
  misc_feature (2454)..(2455): n is a, c, g, or t
  misc_feature (2459)..(2459): n is a, c, g, or t
  misc_feature (2461)..(2464): n is a, c, g, or t
  misc_feature (2466)..(2466): n is a, c, g, or t
  misc_feature (2469)..(2469): n is a, c, g, or t
  misc_feature (2472)..(2480): n is a, c, g, or t
  misc_feature (2484)..(2487): n is a, c, g, or t
  misc_feature (2494)..(2496): n is a, c, g, or t
  misc_feature (2498)..(2500): n is a, c, g, or t
  misc_feature (2505)..(2505): n is a, c, g, or t
  misc_feature (2507)..(2507): n is a, c, g, or t
  misc_feature (2510)..(2518): n is a, c, g, or t
  misc_feature (2521)..(2521): n is a, c, g, or t
  misc_feature (2523)..(2523): n is a, c, g, or t
  misc_feature (2525)..(2525): n is a, c, g, or t
  misc_feature (2528)..(2530): n is a, c, g, or t
  misc_feature (2532)..(2533): n is a, c, g, or t
  misc_feature (2535)..(2535): n is a, c, g, or t
  misc_feature (2537)..(2537): n is a, c, g, or t
  misc_feature (2540)..(2543): n is a, c, g, or t
  misc_feature (2545)..(2547): n is a, c, g, or t
  misc_feature (2550)..(2550): n is a, c, g, or t
  misc_feature (2552)..(2553): n is a, c, g, or t
  misc_feature (2556)..(2558): n is a, c, g, or t
  misc_feature (2560)..(2560): n is a, c, g, or t
  misc_feature (2562)..(2564): n is a, c, g, or t
  misc_feature (2567)..(2573): n is a, c, g, or t
  misc_feature (2575)..(2579): n is a, c, g, or t
  misc_feature (2581)..(2584): n is a, c, g, or t
  misc_feature (2587)..(2587): n is a, c, g, or t
  misc_feature (2589)..(2589): n is a, c, g, or t
  misc_feature (2591)..(2592): n is a, c, g, or t
  misc_feature (2595)..(2595): n is a, c, g, or t
  misc_feature (2597)..(2597): n is a, c, g, or t
  misc_feature (2599)..(2599): n is a, c, g, or t
  misc_feature (2601)..(2602): n is a, c, g, or t
  misc_feature (2608)..(2610): n is a, c, g, or t
  misc_feature (2615)..(2619): n is a, c, g, or t
  misc_feature (2621)..(2646): n is a, c, g, or t
  misc_feature (2650)..(2662): n is a, c, g, or t
  misc_feature (2666)..(2675): n is a, c, g, or t
  misc_feature (2677)..(2684): n is a, c, g, or t
  misc_feature (2687)..(2688): n is a, c, g, or t
  misc_feature (2690)..(2694): n is a, c, g, or t
  misc_feature (2696)..(2700): n is a, c, g, or t
  misc_feature (2704)..(2706): n is a, c, g, or t
  misc_feature (2710)..(2714): n is a, c, g, or t
  misc_feature (2716)..(2719): n is a, c, g, or t
  misc_feature (2722)..(2722): n is a, c, g, or t
  misc_feature (2724)..(2725): n is a, c, g, or t
  misc_feature (2727)..(2727): n is a, c, g, or t
  misc_feature (2729)..(2729): n is a, c, g, or t
  misc_feature (2731)..(2732): n is a, c, g, or t
  misc_feature (2734)..(2737): n is a, c, g, or t
  misc_feature (2739)..(2739): n is a, c, g, or t
  misc_feature (2741)..(2742): n is a, c, g, or t
  misc_feature (2744)..(2744): n is a, c, g, or t
  misc_feature (2746)..(2746): n is a, c, g, or t
  misc_feature (2748)..(2749): n is a, c, g, or t
  misc_feature (2751)..(2751): n is a, c, g, or t
  misc_feature (2753)..(2754): n is a, c, g, or t
  misc_feature (2756)..(2764): n is a, c, g, or t
  misc_feature (2766)..(2767): n is a, c, g, or t
  misc_feature (2769)..(2770): n is a, c, g, or t
  misc_feature (2772)..(2772): n is a, c, g, or t
  misc_feature (2774)..(2774): n is a, c, g, or t
  misc_feature (2776)..(2778): n is a, c, g, or t
  misc_feature (2780)..(2781): n is a, c, g, or t
  misc_feature (2783)..(2783): n is a, c, g, or t
  misc_feature (2785)..(2787): n is a, c, g, or t
  misc_feature (2789)..(2789): n is a, c, g, or t
  misc_feature (2791)..(2791): n is a, c, g, or t
  misc_feature (2793)..(2793): n is a, c, g, or t
  misc_feature (2796)..(2805): n is a, c, g, or t
  misc_feature (2807)..(2808): n is a, c, g, or t
  misc_feature (2810)..(2810): n is a, c, g, or t
  misc_feature (2812)..(2814): n is a, c, g, or t
  misc_feature (2818)..(2819): n is a, c, g, or t
  misc_feature (2821)..(2824): n is a, c, g, or t
  misc_feature (2826)..(2835): n is a, c, g, or t
  misc_feature (2839)..(2839): n is a, c, g, or t
  misc_feature (2841)..(2841): n is a, c, g, or t
  misc_feature (2848)..(2848): n is a, c, g, or t
  misc_feature (2851)..(2856): n is a, c, g, or t
  misc_feature (2858)..(2858): n is a, c, g, or t
  misc_feature (2860)..(2869): n is a, c, g, or t
  misc_feature (2871)..(2873): n is a, c, g, or t
  misc_feature (2877)..(2878): n is a, c, g, or t
  misc_feature (2880)..(2880): n is a, c, g, or t
  misc_feature (2882)..(2884): n is a, c, g, or t
  misc_feature (2886)..(2887): n is a, c, g, or t
  misc_feature (2889)..(2889): n is a, c, g, or t
  misc_feature (2891)..(2893): n is a, c, g, or t
  misc_feature (2895)..(2895): n is a, c, g, or t
  misc_feature (2897)..(2897): n is a, c, g, or t
  misc_feature (2899)..(2899): n is a, c, g, or t
  misc_feature (2901)..(2901): n is a, c, g, or t
  misc_feature (2903)..(2903): n is a, c, g, or t
  misc_feature (2905)..(2905): n is a, c, g, or t
  misc_feature (2907)..(2909): n is a, c, g, or t
  misc_feature (2913)..(2921): n is a, c, g, or t
  misc_feature (2923)..(2924): n is a, c, g, or t
  misc_feature (2926)..(2926): n is a, c, g, or t
  misc_feature (2930)..(2930): n is a, c, g, or t
  misc_feature (2932)..(2932): n is a, c, g, or t
  misc_feature (2934)..(2950): n is a, c, g, or t
  misc_feature (2954)..(2957): n is a, c, g, or t
  misc_feature (2959)..(2959): n is a, c, g, or t
  misc_feature (2961)..(2964): n is a, c, g, or t
  misc_feature (2966)..(2966): n is a, c, g, or t
  misc_feature (2969)..(2972): n is a, c, g, or t
  misc_feature (2974)..(2974): n is a, c, g, or t
  misc_feature (2976)..(2979): n is a, c, g, or t
  misc_feature (2981)..(2981): n is a, c, g, or t
  misc_feature (2983)..(2983): n is a, c, g, or t
  misc_feature (2985)..(2990): n is a, c, g, or t
  misc_feature (2994)..(2994): n is a, c, g, or t
  misc_feature (2996)..(2996): n is a, c, g, or t
  misc_feature (2998)..(2998): n is a, c, g, or t
  misc_feature (3000)..(3003): n is a, c, g, or t
  misc_feature (3005)..(3006): n is a, c, g, or t
  misc_feature (3009)..(3015): n is a, c, g, or t
  misc_feature (3017)..(3017): n is a, c, g, or t
  misc_feature (3019)..(3020): n is a, c, g, or t
  misc_feature (3022)..(3022): n is a, c, g, or t
  misc_feature (3024)..(3024): n is a, c, g, or t
  misc_feature (3026)..(3032): n is a, c, g, or t
  misc_feature (3034)..(3035): n is a, c, g, or t
  misc_feature (3038)..(3044): n is a, c, g, or t
  misc_feature (3046)..(3046): n is a, c, g, or t
  misc_feature (3048)..(3048): n is a, c, g, or t
  misc_feature (3051)..(3055): n is a, c, g, or t
  misc_feature (3057)..(3058): n is a, c, g, or t
  misc_feature (3060)..(3060): n is a, c, g, or t
  misc_feature (3063)..(3063): n is a, c, g, or t
  misc_feature (3066)..(3066): n is a, c, g, or t
  misc_feature (3069)..(3072): n is a, c, g, or t
  misc_feature (3075)..(3075): n is a, c, g, or t
  misc_feature (3077)..(3080): n is a, c, g, or t
  misc_feature (3082)..(3082): n is a, c, g, or t
  misc_feature (3085)..(3085): n is a, c, g, or t
  misc_feature (3087)..(3088): n is a, c, g, or t
  misc_feature (3091)..(3094): n is a, c, g, or t
  misc_feature (3096)..(3096): n is a, c, g, or t
  misc_feature (3100)..(3100): n is a, c, g, or t
  misc_feature (3102)..(3103): n is a, c, g, or t
  misc_feature (3105)..(3105): n is a, c, g, or t
  misc_feature (3111)..(3112): n is a, c, g, or t
  misc_feature (3114)..(3114): n is a, c, g, or t
  misc_feature (3117)..(3120): n is a, c, g, or t
  misc_feature (3124)..(3125): n is a, c, g, or t
  misc_feature (3128)..(3130): n is a, c, g, or t
  misc_feature (3133)..(3133): n is a, c, g, or t
  misc_feature (3135)..(3136): n is a, c, g, or t
  misc_feature (3140)..(3140): n is a, c, g, or t
  misc_feature (3142)..(3142): n is a, c, g, or t
  misc_feature (3145)..(3145): n is a, c, g, or t
  misc_feature (3147)..(3148): n is a, c, g, or t
  misc_feature (3150)..(3150): n is a, c, g, or t
  misc_feature (3153)..(3153): n is a, c, g, or t
  misc_feature (3156)..(3159): n is a, c, g, or t
  misc_feature (3161)..(3162): n is a, c, g, or t
  misc_feature (3164)..(3167): n is a, c, g, or t
  misc_feature (3169)..(3169): n is a, c, g, or t
  misc_feature (3171)..(3173): n is a, c, g, or t
  misc_feature (3175)..(3179): n is a, c, g, or t
  misc_feature (3181)..(3181): n is a, c, g, or t
  misc_feature (3183)..(3188): n is a, c, g, or t
  misc_feature (3190)..(3190): n is a, c, g, or t
  misc_feature (3192)..(3192): n is a, c, g, or t
  misc_feature (3194)..(3204): n is a, c, g, or t
  misc_feature (3210)..(3210): n is a, c, g, or t
  misc_feature (3212)..(3215): n is a, c, g, or t
  misc_feature (3217)..(3217): n is a, c, g, or t
  misc_feature (3219)..(3220): n is a, c, g, or t
  misc_feature (3222)..(3228): n is a, c, g, or t
  misc_feature (3230)..(3231): n is a, c, g, or t
  misc_feature (3233)..(3241): n is a, c, g, or t
  misc_feature (3244)..(3244): n is a, c, g, or t
  misc_feature (3247)..(3256): n is a, c, g, or t
  misc_feature (3258)..(3258): n is a, c, g, or t
  misc_feature (3260)..(3260): n is a, c, g, or t
  misc_feature (3262)..(3262): n is a, c, g, or t
  misc_feature (3264)..(3264): n is a, c, g, or t
  misc_feature (3266)..(3267): n is a, c, g, or t
  misc_feature (3272)..(3274): n is a, c, g, or t
  misc_feature (3277)..(3281): n is a, c, g, or t
  misc_feature (3283)..(3283): n is a, c, g, or t
  misc_feature (3285)..(3292): n is a, c, g, or t
  misc_feature (3294)..(3296): n is a, c, g, or t
  misc_feature (3298)..(3302): n is a, c, g, or t
  misc_feature (3304)..(3304): n is a, c, g, or t
  misc_feature (3308)..(3313): n is a, c, g, or t
  misc_feature (3315)..(3315): n is a, c, g, or t
  misc_feature (3318)..(3318): n is a, c, g, or t
  misc_feature (3320)..(3326): n is a, c, g, or t
  misc_feature (3328)..(3328): n is a, c, g, or t
  misc_feature (3330)..(3331): n is a, c, g, or t
  misc_feature (3333)..(3334): n is a, c, g, or t
  misc_feature (3336)..(3339): n is a, c, g, or t
  misc_feature (3341)..(3344): n is a, c, g, or t
  misc_feature (3346)..(3346): n is a, c, g, or t
  misc_feature (3349)..(3353): n is a, c, g, or t
  misc_feature (3355)..(3355): n is a, c, g, or t
  misc_feature (3357)..(3361): n is a, c, g, or t
  misc_feature (3363)..(3366): n is a, c, g, or t
  misc_feature (3368)..(3368): n is a, c, g, or t
  misc_feature (3370)..(3373): n is a, c, g, or t
  misc_feature (3375)..(3377): n is a, c, g, or t
  misc_feature (3379)..(3379): n is a, c, g, or t
  misc_feature (3381)..(3386): n is a, c, g, or t
  misc_feature (3388)..(3388): n is a, c, g, or t
  misc_feature (3390)..(3391): n is a, c, g, or t
  misc_feature (3394)..(3404): n is a, c, g, or t
  misc_feature (3406)..(3406): n is a, c, g, or t
  misc_feature (3409)..(3409): n is a, c, g, or t
  misc_feature (3411)..(3412): n is a, c, g, or t
  misc_feature (3414)..(3414): n is a, c, g, or t
  misc_feature (3417)..(3417): n is a, c, g, or t
  misc_feature (3422)..(3428): n is a, c, g, or t
  misc_feature (3430)..(3443): n is a, c, g, or t
  misc_feature (3445)..(3445): n is a, c, g, or t
  misc_feature (3448)..(3448): n is a, c, g, or t
  misc_feature (3450)..(3454): n is a, c, g, or t
  misc_feature (3456)..(3467): n is a, c, g, or t
  misc_feature (3471)..(3472): n is a, c, g, or t
  misc_feature (3474)..(3474): n is a, c, g, or t
  misc_feature (3476)..(3476): n is a, c, g, or t
  misc_feature (3478)..(3479): n is a, c, g, or t
  misc_feature (3483)..(3485): n is a, c, g, or t
  misc_feature (3487)..(3489): n is a, c, g, or t
  misc_feature (3491)..(3491): n is a, c, g, or t
  misc_feature (3493)..(3495): n is a, c, g, or t
  misc_feature (3498)..(3503): n is a, c, g, or t
  misc_feature (3505)..(3508): n is a, c, g, or t
  misc_feature (3510)..(3510): n is a, c, g, or t
  misc_feature (3512)..(3513): n is a, c, g, or t
  misc_feature (3519)..(3522): n is a, c, g, or t
  misc_feature (3524)..(3525): n is a, c, g, or t
  misc_feature (3527)..(3528): n is a, c, g, or t
  misc_feature (3531)..(3541): n is a, c, g, or t
  misc_feature (3543)..(3547): n is a, c, g, or t
  misc_feature (3549)..(3549): n is a, c, g, or t
  misc_feature (3552)..(3552): n is a, c, g, or t
  misc_feature (3555)..(3558): n is a, c, g, or t
  misc_feature (3560)..(3564): n is a, c, g, or t
  misc_feature (3566)..(3569): n is a, c, g, or t
  misc_feature (3571)..(3576): n is a, c, g, or t
  misc_feature (3579)..(3582): n is a, c, g, or t
  misc_feature (3584)..(3584): n is a, c, g, or t
  misc_feature (3587)..(3587): n is a, c, g, or t
  misc_feature (3589)..(3589): n is a, c, g, or t
  misc_feature (3591)..(3592): n is a, c, g, or t
  misc_feature (3594)..(3594): n is a, c, g, or t
  misc_feature (3597)..(3597): n is a, c, g, or t
  misc_feature (3600)..(3601): n is a, c, g, or t
  misc_feature (3603)..(3604): n is a, c, g, or t
  misc_feature (3606)..(3623): n is a, c, g, or t
  misc_feature (3625)..(3630): n is a, c, g, or t
  misc_feature (3634)..(3636): n is a, c, g, or t
  misc_feature (3638)..(3638): n is a, c, g, or t
  misc_feature (3640)..(3645): n is a, c, g, or t
  misc_feature (3647)..(3652): n is a, c, g, or t
  misc_feature (3654)..(3655): n is a, c, g, or t
  misc_feature (3657)..(3658): n is a, c, g, or t
  misc_feature (3660)..(3669): n is a, c, g, or t
  misc_feature (3672)..(3674): n is a, c, g, or t
  misc_feature (3678)..(3678): n is a, c, g, or t
  misc_feature (3683)..(3690): n is a, c, g, or t
  misc_feature (3692)..(3692): n is a, c, g, or t
  misc_feature (3698)..(3698): n is a, c, g, or t
  misc_feature (3701)..(3701): n is a, c, g, or t
  misc_feature (3703)..(3703): n is a, c, g, or t
  misc_feature (3706)..(3706): n is a, c, g, or t
  misc_feature (3708)..(3708): n is a, c, g, or t
  misc_feature (3710)..(3724): n is a, c, g, or t
  misc_feature (3726)..(3726): n is a, c, g, or t
  misc_feature (3728)..(3731): n is a, c, g, or t
  misc_feature (3733)..(3733): n is a, c, g, or t
  misc_feature (3736)..(3736): n is a, c, g, or t
  misc_feature (3738)..(3738): n is a, c, g, or t
  misc_feature (3742)..(3742): n is a, c, g, or t
  misc_feature (3745)..(3745): n is a, c, g, or t
  misc_feature (3747)..(3747): n is a, c, g, or t
  misc_feature (3749)..(3753): n is a, c, g, or t
  misc_feature (3755)..(3756): n is a, c, g, or t
  misc_feature (3758)..(3759): n is a, c, g, or t
  misc_feature (3761)..(3761): n is a, c, g, or t
  misc_feature (3765)..(3765): n is a, c, g, or t
  misc_feature (3768)..(3768): n is a, c, g, or t
  misc_feature (3771)..(3772): n is a, c, g, or t
  misc_feature (3774)..(3777): n is a, c, g, or t
  misc_feature (3782)..(3782): n is a, c, g, or t
  misc_feature (3784)..(3784): n is a, c, g, or t
  misc_feature (3786)..(3791): n is a, c, g, or t
  misc_feature (3794)..(3796): n is a, c, g, or t
  misc_feature (3798)..(3798): n is a, c, g, or t
  misc_feature (3800)..(3800): n is a, c, g, or t
  misc_feature (3802)..(3810): n is a, c, g, or t
  misc_feature (3814)..(3814): n is a, c, g, or t
  misc_feature (3816)..(3816): n is a, c, g, or t
  misc_feature (3818)..(3818): n is a, c, g, or t
  misc_feature (3820)..(3825): n is a, c, g, or t
  misc_feature (3827)..(3832): n is a, c, g, or t
  misc_feature (3836)..(3844): n is a, c, g, or t
  misc_feature (3846)..(3846): n is a, c, g, or t
  misc_feature (3848)..(3849): n is a, c, g, or t
  misc_feature (3851)..(3852): n is a, c, g, or t
  misc_feature (3854)..(3866): n is a, c, g, or t
  misc_feature (3868)..(3868): n is a, c, g, or t
  misc_feature (3870)..(3871): n is a, c, g, or t
  misc_feature (3874)..(3881): n is a, c, g, or t
  misc_feature (3883)..(3883): n is a, c, g, or t
  misc_feature (3885)..(3888): n is a, c, g, or t
  misc_feature (3890)..(3890): n is a, c, g, or t
  misc_feature (3892)..(3895): n is a, c, g, or t
  misc_feature (3897)..(3899): n is a, c, g, or t
  misc_feature (3901)..(3901): n is a, c, g, or t
  misc_feature (3903)..(3903): n is a, c, g, or t
  misc_feature (3905)..(3907): n is a, c, g, or t
  misc_feature (3909)..(3909): n is a, c, g, or t
  misc_feature (3914)..(3915): n is a, c, g, or t
  misc_feature (3919)..(3920): n is a, c, g, or t
  misc_feature (3923)..(3928): n is a, c, g, or t
  misc_feature (3930)..(3930): n is a, c, g, or t
  misc_feature (3932)..(3934): n is a, c, g, or t
  misc_feature (3936)..(3936): n is a, c, g, or t
  misc_feature (3942)..(3945): n is a, c, g, or t
  misc_feature (3949)..(3950): n is a, c, g, or t
  misc_feature (3952)..(3952): n is a, c, g, or t
  misc_feature (3954)..(3954): n is a, c, g, or t
  misc_feature (3958)..(3958): n is a, c, g, or t
  misc_feature (3960)..(3962): n is a, c, g, or t
  misc_feature (3965)..(3966): n is a, c, g, or t
  misc_feature (3968)..(3968): n is a, c, g, or t
  misc_feature (3970)..(3970): n is a, c, g, or t
  misc_feature (3972)..(3972): n is a, c, g, or t
  misc_feature (3975)..(3975): n is a, c, g, or t
  misc_feature (3977)..(3978): n is a, c, g, or t
  misc_feature (3980)..(3982): n is a, c, g, or t
  misc_feature (3984)..(3987): n is a, c, g, or t
  misc_feature (3989)..(3989): n is a, c, g, or t
  misc_feature (3991)..(3994): n is a, c, g, or t
  misc_feature (3999)..(4000): n is a, c, g, or t
cacgccttcttccttgtcggccatgtcgctcgaaagcttcgtgccgtcngtgatcagaccgtcttgcgtgagtttgccgctggtagcatctncgatgcggttgcccgaagcgtcaacacccatgtaagcgaagccgttgttgtaagcagtttgtgcctgctggaggagcttctgggccttttcgttgttgatgtcttgttcngcactcttcaggaggtcagccacttcctggtcggtgatggtgcgtgccttgaaggtcgaaccgtcagcctgccagtcccaaaccacggtaccgttgtggtcactgccggtgtgtacaccgccgaattcccaacggtcgccgccgttgtaaccccagtagttacccttaccgcgccagaggtcgggcgagtagaagcagaagtagccgggatagttgcggctggtcacgatgttgtaggaagcctcggctccatccgtcatttcgatacgagcgctgggaacgatactgccgttggaggcaatgttctgagccgtacccacgtaacgattggtagccaagttttggaagaagaagtaaccgggtttcgcatcgttcttcgtcaccttccagatgtacttcaagctcttgtagtcgagcggagcatccttcttgtaggtgatgtcgccacccttgtaagtccaatgcagttgcttgtccttatcgttcactgcaccaccgtcgtaaagtgcaccgtcgtcatagccggtaccctgcgagcggtaggaagtgaggatgtagtaaccgggctcgagcaccttacccgaggtggtgaaggtggtgtaagccttgggcagatctaccacgagctgatcgatctcgtcgtcggtagccgttgcgccaccgttgaggatctcttgcgacttgttgtagagtgccatgaaggcgtcgtacttcgcctggttgtactcaccgatgttgttaccgcgggggaacttcncggagaattcatccacgttgaagttggcaccgagcgattcggcgatcacagcctggaggtcttccttggcagtgagctcgttggcggcgtataccaaccacgcgttgcggttgtagtccgtgcccttgccggcatcgccgttgagcgncgtcttggggcaggtgagcaagaagttgtactcgctgtacttgtcgtccttctttttcgcttcgggcgaaacgagcacgacggtgttgtcaccattcacaaaggtgaaggtgctcaagtcnagattctcgttgttggcacgagcttcttccacgtaagcgcgaacgcccttgatggtttcggttgtgtcaacaccgtcagccttggcatgcgtccactcgtaggagtgttcgggatccttgacttcagtgacttgcttcacttcgatcttccaagcacgatccgtagcggaggtgtagaagttttggttcgaaggatctgcaagatactggttttcgttcacgcctttgcgcttgaggtagaaggtcttaccgtcacccgttgattcaaagacgaaaacgttgtcgagcgtcaagctggtcgttgtggtgaacttctgtccggcgaggaagcagttgccgttcgcagcttcggagaacgcaggctgaagcacatacgattgtccggctacgatgttggtcactgcaccatcgttgacgttagcaccccaatggcgagcagacgcacttgtcgctccggccaccaggagggcggtcaaagcaaacaaattgcaaacctttttcattgaagatttaacattaaagttagacatagagataattcgatgggacacgatgcgacttccatgtacctcccccatcgaaaacagaagggtcacggaagtttagtgcagggtgttcgtgcgacaaagatagagaaaaaaaactacacatggcagattcgcatctaaaaaacgacgagtttctgcccgacagcactgcattttatactttgtcgccccttgtgttttttgaaaaatctaaatgatttccgctggtcccgttgnnggattaactgaaaagtgttgaatctgtccttgtgtttttccggtttcgtgtgggagaaggggatgcttcggcgcgctgtttgtgccgttcgtcaggtctgttcggtaaacgacggaaaggggtgccgatgctcggtgggagacagngcgtcgatgnnngccgannncnncnnnnnngnanaaaaaacgnnnnnnntnnnnnannannncnnnnnngnngncnccccccntnnnntttnngnnnnnnnnnnnnnnnnnggnntttnnnnnnnnnnnnnnnnnnnnnnnnnnnnnnnnnnnncccnnnnnannttnnttttttnncntnncnnnntnnnccnnnngnnnnnaannnttntnnntnnnntnnntnngggngnannnnnttnngnnnanncntnncccccncngnnngnnnnncnnnnnngnngnanntnnnncgncnntnnttcnnttttnccnncggngnnnncnttnttnnnnnnnnntttnnnngaaaaannngnnnttttncnaannnnnnnnnggngnanggnnnannancnaannnntnnnccntnnttnnntntnnnttnnnnnnntnnnnnannnnggngnannggngnangnnaaaaannnaaaannnnngnnnnnnnnnnnnnnnnnnnnnnnnnngggnnnnnnnnnnnnncccnnnnnnnnnngnnnnnnnnttnngnnnnncnnnnngggnnngcgnnnnngnnnnagngnngngngnntnnnngngnngngncnngngnnannnnnnnnngnngnncncncnnngnncncnnngngncntcnnnnnnnnnntnncncnnncgcnntnnnngnnnnnnnnnnaaangngggcgcncannnnnngngnnnnnnnnnncnnngtgnncncnnngnncncnnngngngngngncncnnngagnnnnnnnnncnncncccncncnnnnnnnnnnnnnnnnngggnnnncncnnnncnccnnnngngnnnncncncnnnnnnaacncncngnnnngnnttnnnnnnnananngnanannnnnnngnngcnnnnnnngngnggnnnnngnngngcnccnccnnnngtntnnnncnccncnnccnnnngngggngnngnggcgcnngngtnnnngtgnngannncgngnngtgngnggngnntnttntgnnnntnntnnnncncnnngnnnnngngnnnnnngngnannnnnnnnnnngcgtcncnnnngngnngnnnnnnncnncnnnnnnnnngcncannnnnnnnnngngngngncnnagagnnnaannnnncncnnnnnnnngnnnannnnncncgcnnnnnncnccncnnnnnnngngnngnngnnnntnnnncncannnnncncnnnnncnnnntntnnnngnnncncnnnnnngngnnatnnnnnnnnnnngngcngnncnccncgcgnnnnnnngnnnnnnnnnnnnnngnggngnnnnncnnnnnnnnnnnngtgnngngngnngtgnnnannngngnnnagnnnnnnannnncncnncgcgcnnnncnncnnagnnnnnnnnnnncnnnnnanagngcnnnngnnnnnannnngnnnnnnacnnnngnggngngnngnggnggnncnncnnnnnnnnnnnnnnnnnntnnnnnntgtnnntntnnnnnnannnnnngnngnncnnnnnnnnnnttnnncacngcgcnnnnnnnncnccgcgnggngnggngngnnnnnnnnnnnnnnncncnnnngnggngngcgnggngngnnnnngnngnngngagnggnggnngnnnnagagntntnnnnnnggnnnananannnnnnnnngcgngnanannnnnncnnnnnngtgnnnnnnnnngngnngnncnnnnnnnnnnnnncncnnctnnnnnnnntntnnnntntnnnncnnngngngnnncncgcgnngcgnnggnnnnnncncnnngnggagannnngcgnngngngggngnnnaanngngngnggngnncnnnannnngngnnnngtgtnn

SEQ ID NO: 1036 - DNA, 4000 bp, Escherichia coli
  misc_feature (1160)..(1160): n is a, c, g, or t
  misc_feature (1646)..(1646): n is a, c, g, or t
  misc_feature (1658)..(1658): n is a, c, g, or t
  misc_feature (4000)..(4000): n is a, c, g, or t
tccatttaaagtttgataatatccacgagctgttggtgttccagctacgtgaaacgtatctattgtagaccaatcctcataagagtttccattatggtgtgtatagttattcattattcctgatacataactccataatatataagtgtcgtttaactgaaataaatcatctccgtcaacatcaccaataaagtattcaatagaatttaatgtgtctattctaccaccaccactattataattgtgatgtttacctgattggaagttaaatgacattatagcatcggttacatttgtaatttgatttctatctaattcaagttgaacgtggttttcaatatcatcacttgcatcaggaggccaaaatgacattcggtatccattgtttcttggtaactgtatattataatatccattagaatctgtataagttgaatcataataagatataccaagaaatccctctgcgggcactacttggtctgctattgttgtttttttaagataaaaatatcctggagctcctgattgataattaccaataacgtcatcggtagtattagtttctgttgttgtagtagcatctgtaattgattctatgttataccaattagaataagaatgtggattactttggtctaattcaaattttattttccaatatggatatgtgttgtctgttgctgtagtgaatgctgctgcaacggctctacctttaccttgaacatatcttaaataaccctctacatctactaactttggatgtaatgtaatatcaccacgtgcaccacctataccaactccatcttgtcctgtgttaccatctatataaatttgatatgtagttagataatttccatttgttacataagtataatatccagttccagctaaatatttagttgctactctaaatgatttagcagaaaaattatctacaacatcttttattctaaaatgtaattttaataattctgtttgagtagaatctccattaccaaatgtgtgcgtatttccattatgagaaaccattgtgattcttaaccaatcatatcgagcatctgtaatagattttgaagtatcttgtgttccacctgcggctaatgaatcagcatatcctacatcagcatacctaacaacttcgtaagagtaatgtgcanctgctgcactatctccttcagtccaaccatttatatatgcacctttctctacgtgggttgaatcgtgagtccaatctattaaatcattatcaaatactaaatctaaacgaaaagcagttacatcggcatcgttgtcatcaagtgtaacagcaattgtcattactgaatctctccaagcatcaaagttattattcttatacgcaacacctctagtcttacttttataagtaccgttagttggattagctaaaccagtagtatcatctgctaaaaatcctcttagcttaaaattttcttgtgctccccaccaatactttggtgtgttatactcccttgattgcataagtctaattattggtgtctgagtatatacgaaactcatcaccatcaagaggcttaataaaaatttacgcaatgtaaatctcctcgttatgttctaagttaagtaaccttttagaataaaaagggttttgatttattccttanatataaatattntatatataagttataattagtttattggatgtattaatttgtattaatttgtgtcgaatttcacaacaaaattacttataaatcaaacctaatagtgaatgccatgtcatatttttttgatttttttattggtttggcaagttttgaaactgctaataaatcatcattatcgttatataaccctatcgtagttacataagtatgaaaatctgaatgtgatacaaaattttctaacttaaatgtaggttttattaaagtattttcttgatactcttcatattttgtataatgaccaattgcaggatatgcacttgaagttctttctaacccctgtctaacttctggaaaatattctaaattagaacctacccaatcagaaccagaaccttcaaaagttgcacttttatttgttggggtgttaaattcatttttctttgctatgactaaatattcgtgttcgtatattgtttgagaattttcaaattctaattcccaaccatcagaaccagaacctaaacccacttcattataactacctgtatctgttatacaaactaatccatgttgataaaaaacatttccaactaaactaccactattattactgtctggagttcctgctgcataacttgaactaaatgcagtatcgtacatattgccataaccatcatcaaccaacacaagtgtttgtgatgtactattatcaagtattcttacactacctggatatatctgttctccaaaaaatttacggggaacattaaatacttgtactgaatcgtgtaattgtcgtctacgaggtgtagaaagagttgtttcattaggtcttggccaagcaagttctaaatcatcaaaagttttatcgggttgtggacagtttgcagaccatggattaggtgtttcttcaccttttacatataagtgatgaattgatctccatattggtttatgataccaagtaccaacactataccattcatcttttccgtgtcctaaagatttagattcttcactaaatgcaccaattgattgtgaggccgcactggcagagttaaaccccaacaaacttccactatgtccttcaagaacaaagacaccacttccagaatctacttctgtaaaggaatatgccttatgaaccttaaagggtgtgaatttataatccccaacaccaaggttcttaaacatcctgtatctcccttagaagtctaatctgacttttactgttgcttctcttgagggtgtttttaagaatggtttggaaagtttagcgactgctaataattcatctgtaccattatacaaaccaactgtagttacataagaacgaggatcggttaagaaattaggattagttaaatctccattacttcctgtaaaatatgttggattttgactataattaaacatattgtttttaactctacagaaataatgagttgatttaatttcttcttcacgtcttgcttgaaaatatcccgtaccagatgcatctgatttaaatgctttaaacaacttactatgattaaagtcatccgcgttatctgaatatgcagttcctaaacttacaccacttaccgtgcctgcggcttctgctggtgcatcatctaagagttttctatcaagataaatcacacctaaatatggatagaatctaccataatatttcttagtagttccagtactatatcggtatgcggatgctccaccttgaattgaaccagacactacattaaaatatgtagatgcctttccagtttcagggtttgtagttgcatcactatcatcaattaggcttaatccttcagcaccagctggcgttcgtaaatctatttgccagttacctggatccattttctctctcattcgggctcttgccacactaagaaaatatccatcagtagaacttgattctgctcccgttgccccaattttaaaatatgtttgggatgggggaagtatcagattcttaaattgtctataaattgcctgacttggattattacctgattgagcattctttgaaccacttcctgcgaagtgtccgtaagcaatactaaattgtacctctgatgtagttgaagatgttacttcgttgtgaatatctaaataatattcaccactgcttccactttgtaaggatgatgtaaacatccctgctgttgtggatgtagcatctaatttaattgctccaccagaccacattccagtagataccgttgatgttgtttcttgtacatcactttggccgtcgaattcaacaaatactgccatttttaactcctgttataataatttaatttttttgtcattaccctactcaatatttactatctctctan

SEQ ID NO: 1037 - DNA, 4000 bp, Escherichia coli
  misc_feature (126)..(126): n is a, c, g, or t
  misc_feature (174)..(174): n is a, c, g, or t
  misc_feature (177)..(177): n is a, c, g, or t
  misc_feature (492)..(492): n is a, c, g, or t
  misc_feature (495)..(495): n is a, c, g, or t
  misc_feature (1001)..(1001): n is a, c, g, or t
  misc_feature (1193)..(1193): n is a, c, g, or t
  misc_feature (1566)..(1566): n is a, c, g, or t
  misc_feature (1985)..(1985): n is a, c, g, or t
  misc_feature (1988)..(1988): n is a, c, g, or t
  misc_feature (1990)..(1990): n is a, c, g, or t
  misc_feature (2624)..(2624): n is a, c, g, or t
  misc_feature (3029)..(3029): n is a, c, g, or t
  misc_feature (3065)..(3065): n is a, c, g, or t
  misc_feature (3143)..(3143): n is a, c, g, or t
  misc_feature (3191)..(3191): n is a, c, g, or t
  misc_feature (3194)..(3194): n is a, c, g, or t
  misc_feature (3201)..(3201): n is a, c, g, or t
  misc_feature (3385)..(3385): n is a, c, g, or t
  misc_feature (3469)..(3469): n is a, c, g, or t
  misc_feature (3490)..(3490): n is a, c, g, or t
  misc_feature (3492)..(3492): n is a, c, g, or t
  misc_feature (3503)..(3504): n is a, c, g, or t
  misc_feature (3526)..(3526): n is a, c, g, or t
  misc_feature (3553)..(3553): n is a, c, g, or t
  misc_feature (3557)..(3557): n is a, c, g, or t
  misc_feature (3560)..(3560): n is a, c, g, or t
  misc_feature (3579)..(3579): n is a, c, g, or t
  misc_feature (3583)..(3583): n is a, c, g, or t
  misc_feature (3586)..(3586): n is a, c, g, or t
  misc_feature (3588)..(3589): n is a, c, g, or t
  misc_feature (3599)..(3599): n is a, c, g, or t
  misc_feature (3613)..(3614): n is a, c, g, or t
  misc_feature (3618)..(3618): n is a, c, g, or t
  misc_feature (3621)..(3621): n is a, c, g, or t
  misc_feature (3628)..(3628): n is a, c, g, or t
  misc_feature (3634)..(3636): n is a, c, g, or t
  misc_feature (3638)..(3639): n is a, c, g, or t
  misc_feature (3652)..(3652): n is a, c, g, or t
  misc_feature (3658)..(3658): n is a, c, g, or t
  misc_feature (3664)..(3664): n is a, c, g, or t
  misc_feature (3667)..(3667): n is a, c, g, or t
  misc_feature (3678)..(3678): n is a, c, g, or t
  misc_feature (3682)..(3682): n is a, c, g, or t
  misc_feature (3690)..(3690): n is a, c, g, or t
  misc_feature (3706)..(3706): n is a, c, g, or t
  misc_feature (3712)..(3712): n is a, c, g, or t
  misc_feature (3715)..(3715): n is a, c, g, or t
  misc_feature (3744)..(3744): n is a, c, g, or t
  misc_feature (3748)..(3748): n is a, c, g, or t
  misc_feature (3813)..(3814): n is a, c, g, or t
  misc_feature (3832)..(3832): n is a, c, g, or t
  misc_feature (3835)..(3835): n is a, c, g, or t
  misc_feature (3838)..(3838): n is a, c, g, or t
  misc_feature (3840)..(3840): n is a, c, g, or t
  misc_feature (3922)..(3922): n is a, c, g, or t
  misc_feature (3932)..(3932): n is a, c, g, or t
  misc_feature (3934)..(3934): n is a, c, g, or t
  misc_feature (3946)..(3946): n is a, c, g, or t
  misc_feature (3948)..(3948): n is a, c, g, or t
  misc_feature (3952)..(3952): n is a, c, g, or t
  misc_feature (3954)..(3956): n is a, c, g, or t
  misc_feature (3959)..(3959): n is a, c, g, or t
  misc_feature (3961)..(3961): n is a, c, g, or t
  misc_feature (3963)..(3963): n is a, c, g, or t
ggaaccggtaaaacaaaacttgcacaggaatttgctaaaacagaaaaccgacccttatttgaagtaccaataacttcagaaagcaaagtttcgctcctcgtttcacgtttcgatgaagttcaacgnctgatggatacacaggctgctgttgccaatgcccagatgaaacaagcnggnattgacatgcagatcgataccggtggacgtaaagtggacaacttggaagaatacgtccatttgggaccactcgcagaagccttctctacaccaggttcggttcttttactggatgaaattgacaaagctccccgtgaacttcccaataatctattgtttttactttccgaacgtaagattgttgttccggaaacacagcaaacaattgcctgtgaaccgggtaaaatgccgattattgtgatcacatccaaccacgaacaggatttgcctgctccatttattcgtcgttgcatctacatgtatatcgaatttccnccnccggaaagattgcgtgaaattgttcggatgcatcatcctggagcaaatgagaaaattgtcgcagcagcaattgaaatcttctatcagttacgtgaacttgacttgacacggaaaccctctaccagtgaaatattagattggatttcatacctcgttcagacaaatgtccttgatactaaagttgttgaaagacttaaaggtgcacaaactctggttaaacatcgtgacgaccgtgagctattacgagtaattcaggaaaaaggtattgagtctgcaaccagtcgaaaaacaccaaactggtaaattctttctcactcatgaactaaaacatgtttcaaattagcttcttcatttttatttttttacttggaagcatccctttcggtttgttgatcagccgttactggttaaaaatagacatccgccagcagggaagcggaaacatcgggatgacaaatgtcatgcgggtcggtggcaaattaccagggattatgacttttttgctngatttcggaaaaggcagtctcgcagttttactggcccaaacagcttttcctgtatccgaaacatctccgcaagctcagctgttattcctcagtctcgctggaatcgttgttgtttgcggacacgtcttttccgtatttctacgttttaaaggaggcaaaggaatttcgacattatttggagttttagcggtnttgcatttcagcatcggtctcagtgcagccttggtttgggcaggcatgtttttatggaaaaagatctcaagcctttctgcaatcaccatgctgatagtacttccgtggttatttatcctgattccctggttacaaaatgaaactcctgtttggactatgtttttccttttccttctgttatcatcactgctaatctttaagcatcgtgaaaatattcagcgtctgctcaaaggtcaagaaggccaactcagttccaataaaaaagactgaaaacatctttcaaagaaaccttaaatgaatccacttgctccattcttgttcttctttggtaaagatatgttccggcacgtaattcttttttccggaattgcantcattgcctggttcctgacactcagcggaattggctggggaggttatttgttgtggatttcacttattctgatcgccacattaataatttggcgggccggtgattttttctcgccagcagcaacttatgtccagaataaacacgatatcccgcagtcaattaaagccgcagttatcgacgcaatcgcgagttcctttccggagttttgtgtcgccattattgcggtaatcttgattggacgagccgaggttggcatctccacaatcgtgggttctgcactttataatgtgctcgttattccagccgccgctggtttggtcgccgctagtccaatggtcatcagccgggaagttgtctggcgtgataatatttattatctttgcgttactcttttgctaggcgcgatgctctggatgttnccnantgaatggggtgccggtgtcgctgtggtgtttttactggcctacattggttatgtctttcttcttcatcgggacttcaaaaaatcaaaaaaacaaactgcggattttcaggaaactgatattttggaaacaaagactgaggatgatgatgaacttaacttaacatccgaaaaaaaggcgtggatgtggattgtcgggatgatgcttgtgatgggaggagcatctcacctgttggttgaagcttcacttgctcttggtgacatgttgggtattgacgcagttatcatgggctttgtcgtgattgccgctggaacatccgtgcccgatactgccctctcggtaatcagcgctaaaaaaggtcattacgatgctgccgtttcaaatgttttcggcagtaacattttcgacatctgcatttgtttaagtattcctatcttactcgcacttgccatgagtggcgagccaaccgctattgatctgccgcaattgggtttgatctggagcctgataggcgccaccttcttagcggtctatttcttctggagtaataactacacactcaccaaattaaaagcaggcatgatggggatgctctacctgcttataattatagtttcattttcgttttaatttaantcaaaaagcagaaactcactggacttggaggcacgtattttcaaggtgccttcatcgcttattgccataccgtctccagagtttagttcaattccattcagtagaagttcccctctcaccatctgcaaccaagcatgactatttgtctcaagcgtgtgttcaatttcctgatcgtcatttaaaatgcccatgtagagtagtgcatcggcgtgcattgtcaatgcaccacctttccctgtcggtccagccagcaatcccaactttccgggtgtaactacatcacgcacaaatttctgtgtgtactccggctcaattccgtttttttccggttcaatccaaatctgcagcacatgagcttcttctgtatctgaggcgttatattcactgtgctgtattccgcttccngcactcatgtgctggatttcacctggacggatcacntcacgattacccatactgtctttgtgctcaagtgcaccggaaatcatgtaggtgataatttccatgtcttgatgaccntgagttggaaaaccgcgtgagggagcaatcttgtcttcattgattacncgnaagttanggaagcccatgaatcttggatcgtaataattgccaaacgaaaagctgggacgtgcttccaaccagctaaattttacatgaccacgttctgcggattttcgaatgttaagcatttacacaccccaaactttttctgatacgaaagacaatgcaactaaagttaaacagcaaagtttactgccatnacaagataaaaaacaacttcactcaactgctgagttgcacccagacagtcaccggttacaccaccaagttttcttttgaaatanattattaaaacccaccagacnancgcgaccgccnncaatgccacccagacttgattnccgataaaaagcaacggcaacaagccnaaancancatttacaattaaatcaantccngananntctgtcattnatccggatttgctnnttgnccnatcctgnacatannntnnaaaacggagctgngaaatngaaacnaancggctcaaagnatgncctgcaanccaaacccaaggtaanatttcngtntcaatttgtaaaagcgcaaaaaatttcancaanaccagaaacactaaaccaagtgcgccgtatgttccaatccgggaatccttcatgatccggagtcnntcttccggagtccatccnccnccnantccgtcgcaggtgtctgcaaatccatcttcgtgtaaagctccggtcaacaaaacagcagcaatcattcccagcaaaaccgcnatcggcaaantnacttccggaaangnccangnnnaancngngaacagcatttgcgccagcagccaaactcccacactc

SEQ ID NO: 1038 - DNA, 4000 bp, Escherichia coli
  misc_feature (1)..(1): n is a, c, g, or t
  misc_feature (4)..(6): n is a, c, g, or t
  misc_feature (8)..(10): n is a, c, g, or t
  misc_feature (13)..(14): n is a, c, g, or t
  misc_feature (23)..(23): n is a, c, g, or t
  misc_feature (25)..(27): n is a, c, g, or t
  misc_feature (38)..(39): n is a, c, g, or t
  misc_feature (42)..(42): n is a, c, g, or t
  misc_feature (44)..(44): n is a, c, g, or t
  misc_feature (47)..(48): n is a, c, g, or t
  misc_feature (56)..(56): n is a, c, g, or t
  misc_feature (59)..(60): n is a, c, g, or t
  misc_feature (63)..(63): n is a, c, g, or t
  misc_feature (67)..(67): n is a, c, g, or t
  misc_feature (71)..(72): n is a, c, g, or t
  misc_feature (75)..(76): n is a, c, g, or t
  misc_feature (79)..(80): n is a, c, g, or t
  misc_feature (85)..(85): n is a, c, g, or t
  misc_feature (87)..(87): n is a, c, g, or t
  misc_feature (91)..(94): n is a, c, g, or t
  misc_feature (97)..(98): n is a, c, g, or t
  misc_feature (100)..(100): n is a, c, g, or t
  misc_feature (102)..(104): n is a, c, g, or t
  misc_feature (106)..(106): n is a, c, g, or t
  misc_feature (111)..(116): n is a, c, g, or t
  misc_feature (118)..(120): n is a, c, g, or t
  misc_feature (122)..(123): n is a, c, g, or t
  misc_feature (129)..(129): n is a, c, g, or t
  misc_feature (132)..(132): n is a, c, g, or t
  misc_feature (138)..(141): n is a, c, g, or t
  misc_feature (150)..(151): n is a, c, g, or t
  misc_feature (154)..(154): n is a, c, g, or t
  misc_feature (161)..(161): n is a, c, g, or t
  misc_feature (164)..(165): n is a, c, g, or t
  misc_feature (167)..(167): n is a, c, g, or t
  misc_feature (172)..(172): n is a, c, g, or t
  misc_feature (175)..(176): n is a, c, g, or t
  misc_feature (178)..(178): n is a, c, g, or t
  misc_feature (184)..(184): n is a, c, g, or t
  misc_feature (186)..(187): n is a, c, g, or t
  misc_feature (190)..(190): n is a, c, g, or t
  misc_feature (192)..(192): n is a, c, g, or t
  misc_feature (200)..(201): n is a, c, g, or t
  misc_feature (206)..(207): n is a, c, g, or t
  misc_feature (217)..(217): n is a, c, g, or t
  misc_feature (219)..(219): n is a, c, g, or t
  misc_feature (228)..(228): n is a, c, g, or t
  misc_feature (233)..(233): n is a, c, g, or t
  misc_feature (235)..(235): n is a, c, g, or t
  misc_feature (242)..(242): n is a, c, g, or t
  misc_feature (244)..(244): n is a, c, g, or t
  misc_feature (246)..(247): n is a, c, g, or t
  misc_feature (249)..(249): n is a, c, g, or t
  misc_feature (256)..(256): n is a, c, g, or t
  misc_feature (258)..(258): n is a, c, g, or t
  misc_feature (263)..(263): n is a, c, g, or t
  misc_feature (268)..(268): n is a, c, g, or t
  misc_feature (271)..(271): n is a, c, g, or t
  misc_feature (278)..(280): n is a, c, g, or t
  misc_feature (283)..(283): n is a, c, g, or t
  misc_feature (286)..(286): n is a, c, g, or t
  misc_feature (293)..(297): n is a, c, g, or t
  misc_feature (301)..(302): n is a, c, g, or t
  misc_feature (306)..(309): n is a, c, g, or t
  misc_feature (317)..(318): n is a, c, g, or t
  misc_feature (320)..(320): n is a, c, g, or t
  misc_feature (324)..(324): n is a, c, g, or t
  misc_feature (326)..(326): n is a, c, g, or t
  misc_feature (328)..(330): n is a, c, g, or t
  misc_feature (335)..(335): n is a, c, g, or t
  misc_feature (342)..(342): n is a, c, g, or t
  misc_feature (345)..(345): n is a, c, g, or t
  misc_feature (353)..(353): n is a, c, g, or t
  misc_feature (359)..(360): n is a, c, g, or t
  misc_feature (364)..(364): n is a, c, g, or t
  misc_feature (371)..(371): n is a, c, g, or t
  misc_feature (375)..(377): n is a, c, g, or t
  misc_feature (383)..(383): n is a, c, g, or t
  misc_feature (388)..(390): n is a, c, g, or t
  misc_feature (392)..(393): n is a, c, g, or t
  misc_feature (400)..(400): n is a, c, g, or t
  misc_feature (402)..(402): n is a, c, g, or t
  misc_feature (405)..(408): n is a, c, g, or t
  misc_feature (411)..(411): n is a, c, g, or t
  misc_feature (417)..(417): n is a, c, g, or t
  misc_feature (419)..(419): n is a, c, g, or t
  misc_feature (422)..(422): n is a, c, g, or t
  misc_feature (428)..(429): n is a, c, g, or t
  misc_feature (432)..(434): n is a, c, g, or t
  misc_feature (437)..(437): n is a, c, g, or t
  misc_feature (440)..(440): n is a, c, g, or t
  misc_feature (444)..(446): n is a, c, g, or t
  misc_feature (449)..(452): n is a, c, g, or t
  misc_feature (457)..(463): n is a, c, g, or t
  misc_feature (468)..(468): n is a, c, g, or t
  misc_feature (471)..(471): n is a, c, g, or t
  misc_feature (473)..(473): n is a, c, g, or t
  misc_feature (476)..(477): n is a, c, g, or t
  misc_feature (481)..(484): n is a, c, g, or t
  misc_feature (487)..(489): n is a, c, g, or t
  misc_feature (492)..(493): n is a, c, g, or t
  misc_feature (495)..(495): n is a, c, g, or t
  misc_feature (497)..(497): n is a, c, g, or t
  misc_feature (500)..(500): n is a, c, g, or t
  misc_feature (502)..(502): n is a, c, g, or t
  misc_feature (504)..(504): n is a, c, g, or t
  misc_feature (510)..(510): n is a, c, g, or t
  misc_feature (518)..(518): n is a, c, g, or t
  misc_feature (520)..(520): n is a, c, g, or t
  misc_feature (523)..(523): n is a, c, g, or t
  misc_feature (528)..(529): n is a, c, g, or t
  misc_feature (533)..(535): n is a, c, g, or t
  misc_feature (538)..(539): n is a, c, g, or t
  misc_feature (544)..(544): n is a, c, g, or t
  misc_feature (549)..(549): n is a, c, g, or t
  misc_feature (552)..(552): n is a, c, g, or t
  misc_feature (555)..(555): n is a, c, g, or t
  misc_feature (560)..(560): n is a, c, g, or t
  misc_feature (562)..(562): n is a, c, g, or t
  misc_feature (571)..(571): n is a, c, g, or t
  misc_feature (576)..(580): n is a, c, g, or t
  misc_feature (583)..(583): n is a, c, g, or t
  misc_feature (589)..(589): n is a, c, g, or t
  misc_feature (592)..(592): n is a, c, g, or t
  misc_feature (595)..(596): n is a, c, g, or t
  misc_feature (602)..(605): n is a, c, g, or t
  misc_feature (613)..(613): n is a, c, g, or t
  misc_feature (617)..(621): n is a, c, g, or t
  misc_feature (624)..(625): n is a, c, g, or t
  misc_feature (628)..(628): n is a, c, g, or t
  misc_feature (631)..(631): n is a, c, g, or t
  misc_feature (638)..(638): n is a, c, g, or t
  misc_feature (641)..(644): n is a, c, g, or t
  misc_feature (646)..(648): n is a, c, g, or t
  misc_feature (651)..(651): n is a, c, g, or t
  misc_feature (653)..(655): n is a, c, g, or t
  misc_feature (658)..(659): n is a, c, g, or t
  misc_feature (666)..(669): n is a, c, g, or t
  misc_feature (671)..(675): n is a, c, g, or t
  misc_feature (679)..(680): n is a, c, g, or t
  misc_feature (683)..(683): n is a, c, g, or t
  misc_feature (689)..(694): n is a, c, g, or t
  misc_feature (697)..(697): n is a, c, g, or t
  misc_feature (703)..(703): n is a, c, g, or t
  misc_feature (713)..(719): n is a, c, g, or t
  misc_feature (722)..(723): n is a, c, g, or t
  misc_feature (735)..(737): n is a, c, g, or t
  misc_feature (739)..(741): n is a, c, g, or t
  misc_feature (746)..(747): n is a, c, g, or t
  misc_feature (749)..(751): n is a, c, g, or t
  misc_feature (757)..(757): n is a, c, g, or t
  misc_feature (760)..(760): n is a, c, g, or t
  misc_feature (762)..(762): n is a, c, g, or t
  misc_feature (766)..(767): n is a, c, g, or t
  misc_feature (769)..(769): n is a, c, g, or t
  misc_feature (772)..(772): n is a, c, g, or t
  misc_feature (777)..(777): n is a, c, g, or t
  misc_feature (780)..(780): n is a, c, g, or t
  misc_feature (783)..(784): n is a, c, g, or t
  misc_feature (790)..(790): n is a, c, g, or t
  misc_feature (792)..(793): n is a, c, g, or t
  misc_feature (802)..(802): n is a, c, g, or t
  misc_feature (805)..(808): n is a, c, g, or t
  misc_feature (810)..(810): n is a, c, g, or t
  misc_feature (812)..(816): n is a, c, g, or t
  misc_feature (819)..(820): n is a, c, g, or t
  misc_feature (827)..(829): n is a, c, g, or t
  misc_feature (832)..(833): n is a, c, g, or t
  misc_feature (836)..(838): n is a, c, g, or t
  misc_feature (919)..(919): n is a, c, g, or t
  misc_feature (1199)..(1199): n is a, c, g, or t
  misc_feature (1263)..(1263): n is a, c, g, or t
  misc_feature (1276)..(1276): n is a, c, g, or t
  misc_feature (1285)..(1285): n is a, c, g, or t
  misc_feature (1293)..(1293): n is a, c, g, or t
  misc_feature (1300)..(1300): n is a, c, g, or t
  misc_feature (1464)..(1464): n is a, c, g, or t
  misc_feature (1503)..(1504): n is a, c, g, or t
  misc_feature (1987)..(1988): n is a, c, g, or t
  misc_feature (1992)..(1992): n is a, c, g, or t
  misc_feature (3256)..(3256): n is a, c, g, or t
nccnnnannnggnncattttccncnnnagtttttaaannaananatnnttccaaanttnnttnaaanaaannaanngtnnctttntntaannnnaanncncnnnanagagnnnnnngnnncnntttttnaanattttnnnnttttccaannaanacaccanccnntnttccnccnngnaatttntnnccncngaaggccnncaaannaggaccggcngngagttcctnttccncngttgaanantnncncaaaccncnttggnggaanttntaaaaannnccnctnccccaannnnnaaannaaannnnaccttttnngngtgngngnnntgccnttttttnaanggaaaccncttccnnaaanccttggntttnnnaatttnaaggnnntnnttttaananagnnnnggngttttntntgngggccnnttnnnaanccncaannnggnnnnggttnnnnnnnccaanttntnccnntttnnnnccnnnttnncncnttntntngggaanccggaaananccnccaanntctnnnaannctccnctggnganaanaaccncnggttttttnttttnnnnntcntttccnttnaanncctttnnnnttaaaaanacannnnnggnnttnttnttaaccnccnnnncnnnttntnnnccnnaaagggnnnncnnnnntttnnggntttttnnnnnncgngaaccncgttttcccnnnnnnngannaaattccaaggnnnannnggaanncnnnccgggnaanantttnngnaanaaaanttnggnnaaaggngnncggcccaanttnnnntntnnnnnaannccggttnnnttnnttnnnctttgggtggtctgagattgattgcggacttgtgctgcaacacgctccaatatttctgcattggcagttgaaacagctttntgtggatttttggaaatttctgatcgtagctgatccagcacgatgtttacctgctccctgactgctttgccgtgagggagcttttgttccttgagaaacgcatcacactctgtgatggacggaaggttttggtaagacattatgccctggaaactttatcagtggccttaagcagcagactcttctgctttgggagcagcagccggtgttacgggcttatcttgctgctgctgaggaatttttgcctttggcttaggttttgtggttttaagcgatttcncaggagaattcttatcctgttctgcacgttttggagttgctgattttgcagaatccttttttgnagcagagactttnctttgagcngatttagnttttgcnacggacttttcagcagaatctactttcgcttttttgggttgtgcttttgtggagacttttgcggaatccgtctttttagcgataggtttttttgcagttgatttacgcggagcagattttacagactttttatccgtaactggcgccgttttatctgctgctgncggagctttagagtcctgctttgcagcaagctgtttggnntttttttctgcatcgcctaaatgaacactactgaacattggtgtttctgcagtatcttcttttactgttttattagcagcaacaattttagttttctctgttaaattctgctgatcttcgaggtgaacacttgtataagttgcaacagtaggttcgtccttgttctcagcaattttttcctgagttgagatgatctttttcggagcaacctctgcttttacaggttcatggctactcttaaaaagtactaccgtttcttctgttttttctgcatttgctgttgaaggtttgctgattcctgctggttttttatcggattcagcagttttttgcggatcctttattgatgactcttcagctccctttttcgcttcagcagttgtatccggaagttcagttttcacgctggactctttagcggactttagctcttcatttttcgacaaagtctttgcaggagtttctgttgatttgggctgttcnnccgntgttttcttttccggagaacttttaacagttacggaatcgtcctttttatcaaactcttttttgtcctgctcttttttagcacgaccttttttcctgcctggtttatcgtcacgcatatcagaggcggaaattggcacggatgttctggtttctcctccgctctgtccttttaaagtaacttccatttccggaatttcttcaactccaagtaaagtgtcaggagttattgaaatgcggattccgtaatccatttccatttgagttaaacgttggcgcttaatattgagcagatgggtcgccaattttaaaggcagtctgaggtaaatctgcatcactttttgttcaattgcggaatcatgaattttccgtaaaatcctgtttgctaaagtgatttcaatagaattaagtgacaagctgctggcaattctctgacgacttaattccaataatccgaatttggaaattatgccaaacgaagtcttggccttgtctgaagacatttcttcttcaattaattgttctacagcaaggcggtttttagagttttccatatcgataaaatccaccacaatcaaaccaccgaggtttcttaaacgtaactgtcttgcaacctcatctgcagcctcaaggtttgtacgtaatgcggttgcctcaacgtttctttcttgagtggatcttccggaattgacgtcaattgccacaagtgcttctgtaggcatgatgactaatgaaccgcctgaaggcaaaggaacctgcgggtgatgcagtacttcaatttggccttcaatatcataagttgaaaaaagagatttttcgccaagataaagctgcagcttattttgttctgccggcatatgagttttaaaaaactccaaggcatgttgaaatgcaaccggttcatcaatcacaacttccgaaatactgtcattgtaataatcacggatcatccgcagcatcgcgtcttcttcctgatagagtatgccaggagttgattgctcttcgtactcgtctttgatttcattccaggtacggcgtaaaatcgtgtagtcacgtttcaattcagtgagcgaacgatcaactccaaccgtacggataatagctgatgaattttcacttccgagacctttcagtaagtgacgcaaacgcgccctttggtcttcatcttcaatttttttggaaacaccgccacggtcactgtccggcataaaaacaagaaaacgtcccgccaaagaaatgtttgtggttattgacgcgcctttgtgnccaatttcatctttgattacctgaaccagaattttttgtccgggtttaagaacctgtgtgatggaaggccgtccgcgtccttcacggtttggtttatagacttggaagtttatatcggaaagggaaaggaaaccgtgacgttcttcaccgtaatcaatgaaggccgcctgaaaggaaggttgtacttttattactttaccgcaataaatattaccaactttttgggagcggtgagtttgttcaatgtaaaggttatccagcttattgccgtgtaataacgcaattctggtttcgtcatcctctacattgatgaggattttattatctacttctgtcattttttacctgatttttatgagtttaaaatcaggatgttctgacaaatatttgatttacagatcagaaatcgaaaagaggaaccgtagtgacgcaattacttatacattgaacagtacaacccagcattcgcttgagcttgcgtagacttgcagttttattttctagaattcagtaatcagaaatcagcatcccccattctttctttccatcaaggggagacagaacatctctgaaatattagttttgatttacggacattttccgcaaaccgtgttcttcagtcgagtacaaattctttttgttcgtactcaccattttcattctttaatattttttctatacgttgctctgcgttttcgaggaatttgttgcattccctactccagcgaacacctgattcaaaag

SEQ ID NO: 1039 - DNA, 4000 bp, Escherichia coli
gtttgggcgcaagccgccactgtattttggcctggtggtgtttgccctggcgtctattggctgcgccatgtcaccgaccattaactggcttatagcgatgcgcttcgtgcaggggattggcgcagcggcggtaatgtcgattccgcgcgcggttattcgtgactgttataccggaaatgaggcgacaaggttaatgtctaccatcatgatcattattgctatttcaccgatgtttgcgcccttgctgggtagcgcggtgattattccctttggctggcgtgcagtgtttgtggcggtttccctggcctctatagttggttttctgatgacccgtttcggactcagggaaaccctgaagtcggagaacagaagtccttttaagctcagtcgcatgatgaatgcctttggtattctgtttcgcgatacccattacatggggcttaccctgattggcggtatgggcatgggcagcttttttgctttcctggcaaccagttcgttcctctacatggattattatgggctgacttcttttcagtacagcctggcgtttgccttgaatgcttttggcttctttgctgccagccagcttgccgcaacactggaagcccgctttggcactattaatgtaatcaagtgggctgtggctggctactgcttctttgcctgcctgctgtttagtgtagtaatgctgggctttgacagttttcctctgctggtaggcttactactggtgacttatgcttttctgggattgatattacctacctcaatggttctggcgcttgaggatcatggaccgattgctggcacagctgcatctctgggtgggacattacagatggttattggcgctatcagtatcgccattgtcagtgcggtattcaacaatacgccggtgccactggttgttgcgatcgccatctgcggtgtgatcgccgccaccctgtcagtgtttgctttaaaaaaaccacaggtcttgcaggaagcgtaattcaatagtaaaagtgctgcagaatttaagctgcatattctgcttgttaatcgctggtcagcgttaacagaatgtcggcaaaccaggcgcagttaagtcccagtgcctcgtcaacttccaggtctctggtgcccacatccagtcgcgctgaatgaatgccgagcaaggtccagggtaattccgagtttaaattttcctcttcgactttcgattcatcccgtgtgactacgggtgcaccgctcataccgcgatgggttcgtgcgtctgtcagaaaatagccattgccctgaaagcgcatactgaaagaggacgcattaatcgcgcgtctggcaactggcaagtgatgcagggtgtcgtgaaagcccaggggaaagcctatgatcagcatttccgttccaatttctattctttcaatcgaatcgtgtaaatgggcaggggtgaaagcgaagtaggtagcggtatctggcaagttgttgcgctcaatttctatcactgctacatcaatatccccggcactgtctgatccctgacgccagacgctttctccgtcattaaacaggaggatggaaaacacagaagactcggcaaggttttccggattgttatggatttccagctcgattctattggggtggtgatcgctgggttcatccaccaacacatggcgactggtcaccagaaaaagtttttcatcgcgctcaaagaaaaacccgctcgctttagtgagcaggtgttcatgttcgtaggtggaaatttgcagggtgcttaacagcaggggttcaatcatgatggagaagactatgccggattttcagattattttatagcgctattttaaatgacccggacggagctgcaatactattgatgaaatggcaggaaagaaaattcatgttatgccgttgcacgaacttaggatcctgctgttgaatgtcgaaaattgtaggcaaataatagtcaatgcagtttgcttgcacatgtgttagagtgcgcgccatcagtgcagtaaagaagctgttctgatgtgaatattataaaggtcagtaaatgaagattagcttcagatttactgatgcggtattaccctccctgattcttgtgcggccctctaaaggcatgccataagcctgctttctaattttctcaacacaaccattgctgccgttacttttatgtatggcatttttctatggcgtgtcccatggtctttccatggtatgtccatgaaaagtcatggcaattgccatgctatttttccagcgcccggtagggttaacttactttttgcgacgggaaagcaataccattaattataaggcttatagttaatcagtagcctattgttacttgctataaaagcccgttaagagtcagaaattttatgagtgaaacacaacaatttaatacccttggtctaagtgattccctgttaagtgcgatacaggcacagggctatacacaaccaactccgatccaggccaaagccattccggcggtgcttgatggagaggatgttatggcagcagcacagaccggtaccggtaaaacggcggcgtttgtactgccaattttacaaaagctgagcaattcaaagcctgtcgccagtggcatggtaaaagtactgatcctggtgccaacacgtgagcttgcggctcaggtgctggaaagtgtcatcacttatggtgataacgaaaaaattaaagcctgcgctgtttttggtggcgttaatattaatccgcaattacaacgcgtacacaagggcgttgatattctggtggcaacgccgggacgtcttcaggacttgattgatcgcagggcggtttcactgcagtcactggaaatcctggtactggatgaagcagacagaatgctggatatgggttttattcatgccattcgcaagattctgaaactggttccgcagcgtcgacagaacctgatgttttctgccaccttttcgccggaaatcagaaacctggcaaaaaccatttgccacaatccggtggaaatcgagtcggcaccgcgcaattctgccgttgaaattattcatcagcagctatttgaagtgaataaagaagataaatccggtgtgctgagaagtttgctgcaaggtaccaacgaccaggccttggtgtttagcagaaccaagcacggtgctaacaagctgactaaaatccttaataaaaataacatcatgacatctgctctgcatggcaacaaaagccagaaacaacgcactgcagcgcttgatgcgtttaaacaaaaccgcatccaggtgctggttgcgactgatatagccgcgcgtggaattgatatcgatttgctgcccatggtgatcaattatgatcttccccatgtgcctgaagattatgtgcatcgtattggcagaaccggccgtgccggtgcccagggcagggcgatctcgctggttagctctgatgagcgcaaacaactgaaagccattgagcgccttatcaagcaaacgatcagtcgtggcctggtggcagagattggaagtgtccaacccgtctagtcattggcataaaaatcagtagcaactaattcgatctaattagttatcttcacagattacagcctctacacattgattgaagtaaacaatcagtgtgcagggggctgtttcatttccatcctgtctcaaaaactgaaaatatcttccttggtcggtatttccatatcctgctcaaaattctcttcccagatctgacgccagggctggccatagacatcgggcaccttgtattcaattatcgtacctggagagataggttcggcgcggccattaatgggaaaaatggtcgggatacactcggtaaatacgatggggtcaccttccctgaaactgctgagcttggtcaggtcccggacaatgcgtactggctgcagtaaagcttcagggtcatagaaaatagcttcgtggttaatgccaatgaaatttccatcactgtcatatctggattggtaaatttcgatggtctgcatttt

SEQ ID NO: 1040 - DNA, 4000 bp, Escherichia coli
  misc_feature (1)..(719): n is a, c, g, or t
  misc_feature (1987)..(1987): n is a, c, g, or t
  misc_feature (1992)..(1992): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattattattattattattattattattattattattattattattattattattattattattattataaaaaaaaaaaaaaaaaaaaaaaaaatatatatatatatatatatatataatatttctatgatttctataccttgccaagttcctaaagctaatctaccattactaattggaatatttaaactacaaccaaaaagactagatttaacatgagctggcatatcatctggaccttccatagtatgaatgtatggagcatcttctggagcaagtctatttaacatcatttgcatatccctacgaacatctggatcataattttcattaatagttaaagaagctgaactatgttgtatgaatacattggccatctttttattattattattattattaatatatatatatattaggaatgtaatttttacattttttaataaatcatttatttgttattatattatttgaaaccactttaaatgtttacaaatgaaatccatttctaatatatttttttatttttattttttttttttcaacttacaccatatttatattcactaagttcagaagaaatatgagaaagaatttcgtcggtaacaagataacaacctctatttcttggttttaaagtaatcttcttttgagtccaggaagtgttcatattgaattcttttgataaaacaacaaatagtaatagtaaaaataatactattaatttcatttactattaatttttaatttatatatatataaataataaatattttaaaaattaaaaaaaaaaaaacaataaaacaaaataaaaaagaaattataaataaaataataataataatttacctttttttaataagtttttttgtctttataaatatttaaaaaaatttttttttttttaactaaaaataaaatttttaaatatatatatatatcattactttgtggaaccaaattattattgtttataaaaaattgattttagtattatatatggttaggttttatatatccattaaagataacattcaattatttttagaaaattttattaacaaaaaaattattaataaagataaataaatgacacaataatcattcattatcattaaaactttaatcacatataataaaatattaactagtaattatattcaaatatatctacgttaatttaattctattacaaatatcgattaatatttatacgttgattatttgattattggtttattactattttttttttttaatttaaangaaanttcaaaaaaaaaaaaaaaaaaaaatccacaataaagaattatctctattctctatattataaaagccaaattaataatatgtgcgttaattcttttaactaaaattattgaattagtcaaattaatcaataacttttttatgaaatattttttaataattaaaagaaaatattaataaaagattatgaatgttaataaaaaaatatgtataatatttataggttaaaaatctattgatattctatttaaatataacacaaaaccaaataagcaataataacgatatttaaaatctacaatttttaaaaactatagctaatatattttaattttatattaaaattagattatatattatataatttttcatacttcgtatttgtattgattatatatatattttttaaatattttaaatatttatataaatattttttaaaaattttttatgattaattttaaaaaatatatgtatatttaaaccttatagtgtaaattattattattattattattactattttatcttgttaaaatataattatttaactttgtatatatttttattatattataaatattattatatatgaccaaaaaaaagtggaacaaatatttacttttcactaatatttatttaaaatgacttattttttgataatacatgatttaatatttttaaattacattcaatggaacatacatattttattatattaaattcattctttaataataattgtataaaaaagacttacaaattttttttttttttttttaaattatattattggttgttataaactatatattatatgtaataaactatttgatatttataattataataaaaatagaagtattgattaaaaatataaactaaaaatactaattttctaacaatataaaatttaaacaacaacataaaataaaaaataatttttgtataaaatcataattatatttatgcttaacaataaatttataatcatgatttgttgtttttatcaaatactaaatatgaaattatacatttaatataagcaattaattatatgtatatttatattatatttccttattataattattaaaatttaataaattttttcattatattattattagcaaatactttataacataggaaatatattgattattttacataaaaataattaaaaatgttataaatatatttcctattttaaattttaaatcatgataactattgattattataaaaataaaataattatgtcaaaaagaataaaaatttttaaagaactttagtatttgtaaaatagttaaaggttataaagttataaaatgtaaaaataaatagaggctcaaactaagaactattttaaaaatttcccaaaatttatcaaatataatttatttacttttttaatagcaatatatattattttcataataatatgcttaataaataataaataaaagttaatttatatatatatatatagactatgattaaccgctttatacgacgtgtttcatttcagtgatatcttaaactatcattaagagaggaacaactacattaatcctcttatagatgaagtcgcattagcaattatagtctatacttatcatgatgagtgaatgccaacttcatatatatgaaaaaacacactagaaggatgaaaatccctcatataaattcgcgaagtagtattgggatcgatccaaggaatcttatgtataaaacacatatattataattatttctttttattagtgtattgtgttaatttcattttaagaatttgatgatatgaaaattaatctgctaattaatatatatatatttatattaatatatatatattaatattggtatattataatatttgaaattatgacagaaaatgaaaatattaataataataaaatatgatattaaaatatttttataaatcaaatagtaattattgatattgattaaatatttacttaaaatatacaatataataattatttt

SEQ ID NO: 1041 - DNA, 4000 bp, Escherichia coli
  misc_feature (210)..(210): n is a, c, g, or t
  misc_feature (632)..(632): n is a, c, g, or t
  misc_feature (653)..(653): n is a, c, g, or t
  misc_feature (767)..(767): n is a, c, g, or t
  misc_feature (911)..(911): n is a, c, g, or t
  misc_feature (944)..(944): n is a, c, g, or t
  misc_feature (977)..(977): n is a, c, g, or t
  misc_feature (1376)..(1376): n is a, c, g, or t
  misc_feature (1988)..(1988): n is a, c, g, or t
  misc_feature (3507)..(3507): n is a, c, g, or t
  misc_feature (3566)..(3566): n is a, c, g, or t
  misc_feature (3752)..(3752): n is a, c, g, or t
tgccaatcttccacctcgcctgcagatatttgtggtctacgttgatcttttcgataattattaataaaggtggtggtaagaatcctataaagccaagcttttaaatttgttccaggttcaaattgatgaaaacttgtaaatgcctttgcgtatgtatcctggactaaatcctgtgcatcatgtggattttttgtatatctaagtgcagcnccataaagttgtgaggtaaaaactaaagcatctttttcgaatctcgctttgcgttgtgccaaactctctttatttcggtcaacaacagctggtaataaatcttcgttactcatttgggctaaggctacctcgaatggggttttagaaaaacagaaatttgttttaaatcgaccatcgtgctgacagagtgcggtcatagaatttaaaccactgaacgggttgatttattcccgcaggtgctcactgggccttcagtaaacggaagccttacacataaggcggaaggtagactggtggatatgacaaattggcccgcaccttttcgagatgggttgtctgctgcaagtaagccaattaacgcccggttaagtatccctggctcaaaatctgcaaccaaccgggcattgattttagctgcgctngctaattcaccatcaaggatnagaaaacctctcttctcccgtgataccgacttaatggtcaagggattaagaagtttaggatgcaaaattgatgaagttaaaacggatgatggatttgattaccagattacaccncaaaagttagtgggccctgctcaaatagaggttggtaatgcaggaaccgtaatgcgcttcttacctccgattgcatcccttgcttcaggattaatccactttgatggtgatgaacgatcacatgagcgaccaattgctccagtnataaaagctttggaacaacttggtatatcaatngaacacggaaataaatatcgattgccaatcacnatcaatggtgccggaaaagttaaaggtggtgaagttgagatagatgcaagtgcttctagtcagtttgtttctgcactgctactacttgcccctgcaactgagattggcattaaaataaaaaatatagggccagatttaccctcacttcctcacatccaaatgacaattcatatgcttgaagtttttggcgcacaagtagagataagcaaaaatcagtgggcagtaaagccagttacattgtcaggtcaagatttaacaattgaacctgacctttctaatgccgctccattcatggctgctgccatggtttgcggtggcagtatcgtaattaatgattggccaaaatcaaccccacaacctggagatcaattgcgtaatatttttgcacaaatgggggcnaaaattgaacttacatccactggattaaaagtttctggaagtggtgaaattaatggaattgatattgatttacatgatgtcggtgaattaacaccagctatcgcagccctagcctctctcgctaaatcacctacaactctaagaggtattggacacctacgcttacatgagactgatcgactagctgccttagctaatgaaataaataatctgggtggagctgttactgaaggacctggcgaattgttaattgagccaactaaaatggttgcctctcaaatctttaaaagttatgaagaccaccgaatggctactgctggagccattatcggtttggctgtggatggggttatggttgaaaacattgaaactacgagaaaaactctcccagattttccgggaatgtggcagatgattcttaaaggggcttaatggtcagatcaaagcgcaactgggatgaggatgatgttcgcgtcaataagtcacgccaatttggttcaagtaataaagcaagagctcgcactaaagatcgaccagattatgccaacgccgatactgcaacgattactgaggttgatcgcggtcgagtgaaatgcttaatccaaacaaaancaggcaaattattaattaccgcaatgaaagcacgagagttgggaaagaaatcagtagtagtaggagacctagtatcagtagttggtgatgtttcaggctctgatggctccttggctcgggtagtcagtgttcttcccagaaagaattcattgactagaactattgatgatcacgcaaatgatgaacgtgtaattgtttcaaatgttgatgccatggcaattgttatctcagctgcaaatcctgatccaaaaatcggtttggttgaccgtgctctagccgttgcatatgaccaaggaataaagccaataattatcatgactaagcaagatctagcagatggagatgaattcttaaaaatctataaagatctagaaataaagctatttaaaattgataaatcctcaaaccttgcaactctcaagaaagagttagctggcaagataacagtgctgctaggtcactccggagtaggtaagtccaccttagttaataatttattatctagctcgcaaaggaattcagctgagtcagataatacatctacacatcaggtcactggcgcagtaaatgaagtcactggtagagggcgccacacaacatcaggagctattgccctgccattatcttcaacctttgattcagatgagtttggttggattatagacaccccgggcgttcgctcttttggcattgcacatattaaaccttccagagttatatctgcattccctgaatttgctgaagcaatttcaaattgcaaaaaaaattgctcgcacagtgaaccctcttgtgccctaaataactggcctggctttaatgaccaaaatctcgcaagacttgcaagtttgcgcagagttttatctcttggttaagaaaagtaagagtaatctaaactctgtgagcgttgaccttaaaagtgaaaatactcggcaagtaaacctatctttggttggaatgacctgtgcctcatgtgtaagcacagttgaaaggtcacttaataaattacctggagtaagggctgcagtaaatctcgccatggagtccgcacacattattgccccaaaaaatatttcagatgcgcaattgatctctgctgttacctccgccggttatagcgcgaaggcatttaaaggtgaacgagaatcatttgaaagatccaatcgcctgggagtgagagttttactgactttcctctttactgctccaataattttgatttcgatgtttcatgattggcatgcgcaaattgataaaaacttacttcaatttattgataactttaattctttattagtaagtaataatgctgcttttgaaattgcctacccccaagcaccaatgacaacctggttgctgatagcactttcactgccggtagttttaatatttgcttggccgattcaccgcgctgcgattaagaacctacttaacccaacaatggatactttggtttcattaggttcgataatttcatttgtatggagtatttactccactttagatttccagccaaattcancgatgccagatatctatgttgaagtctcctccgctgttattttctttgtgatgttcggncgctaccttgaacatagagcaagacacaaagccggctcatcactggcagaattatttaagctttcagtttctgaagtcgagatcaaggttgaagatgagagcaaaataatacctattgatcaattacaagttggtgatatttttgtggtaaaacctggtgatcgaattgcaactgatgggcaggtnatttctggatttactactgttaataattcatttctcactggtgaagtaacaccaatagaaatttcaattggaagcttggtatttgctggatcaataaataacaatggaaatatcttggtgaaagctaccagggttggatctgaaacagaattagcaaggattaccaggatggtgcttgcagctcaatctgagaaagcacctgcccaacaattagctgaccgggtcagtagagtttttgttcccagtgt

SEQ ID NO: 1042 - DNA, 4000 bp, Escherichia coli
aggcgcagttccagcaccggatggcgtccgtcgcggatgtcgatccggccctcgtccccgatttccggtcgcacccatccgcgcacccgggccgactcggcgaaggccgcgagcacgtccagctgccccagcgccgaggccgtctcctggatggacttgaggtggtcgagcacctgttcgcgcaggcgcaggaacaggtcgtactccaatttcgtggcccgctcctcggagccgaggatcctcgactccatggccttgaggtcctgtgtgatgaagcgttcgccgttggcgatggtctgcttgcgcacgtagtcgccgggcaccttcgccaggtgggccttggtgacctcgatgtagtagccgaagaccgagttgaacccaaccttgagcgacgggatgcccgtccgggcgatctcgtcctgctgaagcttggccagccagtccttgccgccccgcgacgcggcccggagctcgtccagctcggcgctgaagccgtcgcggatcatgccgccctcgcgcaccgccagcggcggctcgtcggccaccgcccgcgacaggagctccacgaggtcgggcagggactccaggcggcggccgagggcctgcagctccgagggcgagccggacccgtcgatggcagcctccggcaacagacggccctgcgggggggcgggcgccgggccggccgcctcggcgacggcggcctggacctggggcaactgctcgagcgccagccgcagcgccagcaggtcgcgggcgttgccgctgcccaggctcagtcggctcagcgtgcgctcgaggtcgcgtacctcggtcacccgggcccggaaggcggccagggtggtcgggcggtcgagccaggcctgcacggcgtcctggcgccgccggatcggatccagggcggccagcggctgcgtgagccagtcgcgcaggcggcgcgcccccatgggcgtgacggtgaggtgcagggccccgaacagcgtggtgttcctcggggcgtcggcgtggagcggttccaggatctccaggttgcgcagcgagatggcgtccaggatgaggtagtcggccacctcgtagaaccccagccgggtcaggtgcgacacgttccgccgcaggtgggtgccgaggtagtgcagcaccgccccggcggccccgatggcggcggaacggccgcgcaggccgaagccgtcgagcgaggccacctggaaatgctcgcgcagcgtgaagacggccgtctcgggctggaagacccagtcgtcgtggggtgagagccggatgggggaatcggccagcaggcccgagagcgccttgcaggcggcgggcaggatcagctcggccgggcgcaggcgctccagttcggccaggagggcgcgggaaccctgcaactcggtgagccggaagtcgccggtggtgaggtccacgcaggccaggccgcaggtgtcccctgcaagggtgaccgaggcgaggaagttgttgcgctcggccaggagcaggcggtcgtcgaagtgggttccgggcgacaggatcgaggtcacctcgcgctgcaccagcttgccgggtcgggcctcctcggtctggtcgcagatggccaccttgcgcccggccttgagcagccggccgatgtagttggtggcggcgtggtagggcaggccgcacatgggcatgccgttacgctgcgtgagggtcagttggagcagttgggacgcatcgacggcgtcctcgaagaacatctcgtagaagtcccccagccggaagagcagcagggcgtccttcgggagttcgccccggatccggcggtattgcgccatcatcggggtcagtgtcgcttcggcggccatcgagccgaggctaggaaaacctccccgaaataaaaagaaggcaggtggtcgctggacggaaccaccggcgtcccgatgaaccgcgctgggagattgaccatcatccgcccccttgattgacatcacaacacagatgcatcagcgtatcaagcctcaagtgtccatgagaacgaccctgaccctggaaaacgacgtctacgaagccgcccagtcgatggcgcaggcctccggcaagcgcctgggcgaggtggtttcgctcctgatgcgccggggattgaaggcctccgtcgagaccgcaccggcccgttccagcttgccggtgtttcaggtggcctccggggaccccatcatccccagcaaccgcgcgcgggacctcctctccgacgaggcgccatgaaaccggccctgctcgacatcaacgtgctgctggccctggcatggcccaatcaccagcaccacgccctcgcgcaccggtggttcgcgcgcgaggcccgtcacggatgggccacctgttcgttcacccagctgggtttcgtccggctgtcctccaatcccgcctacacgccttcggccgtttcgcctcctgaggcggccgggttgctggaccggtgggtgcgccatccgcgccatgccttctgggattccgcacccgccacccgagccgccatctatgcacgagccgtggggcatcagcaggtcaacgacgcttggctcgtcgaggtggcacgccagtccgatgggcgggtggtgaccttcgatcgccggatcagcctccatgatggcgatcgctcgagggtgacggtggtctcggactgaagcccggagctgcggtcgtggtgcttgggggtggggcacttcagggcccattcgccccggttgcgccgatgggctatccttggccaagctgtcctgagaaacccgtccggagcatgccgtcatgaagaccctgagtcacaacccttgtcctgccctgatcgccgccatcgccctgggttcgggggcgattcaggcgctcggtgccgacgatccggacctcgccttgggcgtgcgcaagaccgagcccgtgagtccggccgcgcaggccgggagcttccgcctgcctcccgggttcgagatccagctggtggccaacgagcccgacatccacaagcccatgaacctcgccttcgacgcgacggggcggctctgggtcaccaccagcatcgagtacccctgggccgcgcccaccaaccgggtgggtcgggatcgggtgatgatcttcgaggacttcggcccggatggccgggcccgcaaggtcacccagttcgccggtggcctgaacatccccatcggcgtgtaccccttccgcaccgacgacaagcactggaaggcgatcgtgtggagcatcccgcacatctggctcctggaggacaccgacggcgatggcacggccgacaaacggactccgttgtacgggcccttcgaccacacccgcgacacccatggcaaccaggcctccttccgccggggtttcgatggctggctctacgcgacccacggcttcaacaacgactcgcacgtcacggcccgcgacggcagccatgtggatctgaactccggcaacacctaccgcatccggttggacggctcgcacatcgagcaccacacgcatggacaggtgaaccccttcggtctggcctgggacctgcgcggcaacctgtactccagcgactgccacagcgcgccgctctaccaactgctcgccgggggctggtatccgagcttcggcaagccccacgacggactcggcttcgcgccggtgatgctcgagcacgcccacggcagcacggccatcgacggagcggtctacgtcaacgacgacctctggccggccgagtacttggacacgctcttcatcggcaacgtgatgaccagccgattgaaccgcgaccggatcaccttcgagggctccacgcccaaggccgccgagcagccggatttcctcaccaccagcgatccgtggttccggccggtggacgccaccctcggtcccgacggcgcgctctacatcgccgacttctacaaccgcatcatcggccactacgaggtgccgctgacccatcccggccgtgaccgcgaacgcgggcgtctgtggcgcgtggtggcgaaggggccggacggca

SEQ ID NO: 1043 - DNA, 4000 bp, Escherichia coli
  misc_feature (534)..(534): n is a, c, g, or t
  misc_feature (561)..(561): n is a, c, g, or t
  misc_feature (639)..(639): n is a, c, g, or t
  misc_feature (642)..(642): n is a, c, g, or t
  misc_feature (1500)..(1500): n is a, c, g, or t
  misc_feature (2558)..(2558): n is a, c, g, or t
  misc_feature (2597)..(2597): n is a, c, g, or t
  misc_feature (3952)..(3952): n is a, c, g, or t
  misc_feature (3955)..(3955): n is a, c, g, or t
  misc_feature (3973)..(3974): n is a, c, g, or t
  misc_feature (3979)..(3979): n is a, c, g, or t
  misc_feature (3982)..(3982): n is a, c, g, or t
  misc_feature (3984)..(3984): n is a, c, g, or t
  misc_feature (3997)..(3997): n is a, c, g, or t
atgcttcaagaagcctttccaggatatgaacctcctaccacggcgctctcaatggcagaatacctattggatttcagcttaaatagagcccacttattcaatggaaaaattattgaagtttctaattctactccctaatctaactgcccaaatttaccctcataaaaatctttcatagcttgcatgagttcttcacgagtattcatcacaaaagggccttgtgcagctattggctcatctagaggcttaccgctcaatacaagcaaggtaacctcggaagtcgctttaatagtaaaattctcagcatcattagccatacgtacaaagtggtcaacatcgataacgtcaccatcattgatatgtatcgaaccttctacgactaacacccctgtattataagtcttgttaaaagagagatcaatcattcgatcagcatccaactctatacgatataattcaatagggctatgcgtataagcaggtccttgcgtagtcgcaaattgaccagcaataattttaacaacgaccccatcngaaactatgacttctggaatatcttcnttagaaaaaccttgatactttggtgcatccatcttgttcttagcgggcaaattcacccaaagttgagccatagaaaanagncctcctttagccgcaaattccttttcatgatattctttgtgaagtacccccgaagcagcagtcatccattgcacacctccttcttcaactacaccagaatttcctgcagaatcatgatgtgcaaccttacctttaaaagccaccgttactgtttcaaatcctctatgaggatgaacatcaactcctcttggagttgaggtcgcttcaaagtagaagggagcattatagtctaaaaatataaagggatccatggctttcatatccaatccataagcagagggtataaaattctgaaccctgaatccatcccccacaaaatgaggcaccctaggagagacaacgatatcaattgatctttttttcataatttaaaaatacaaaacaactcttcattagcgttgaattctcaattgcttttttttatacttttataaggtggaacaattattagaaaaataccttccaaaagctgctgtgccaactgttttcaaactcattgagcaagaagaagttcattttaaaatagtcaatgagcgaaaaactagacatggggactatagaagagcgttagatggcagacatttaatcaccataaatgccagtttaaatccttatggttttttagttacaacaattcatgaattagcacatcttattgcttacaagaactatggtagaaggatcaaacctcatggtaaagaatggaaatattgttttcagcacttgatgcttccttttttaagaccggaagtttttccagaacgcttattaccagtattagccaatcactttaaaaatcctaaagcgagttctgacaccgatgctgttttatcgatagcgttaaaacagtatgatcancaatcttcggatttaagtttcatctatgaacttccaaatggatctatattcaaaacctccaatggtcgggtatttaaaattagaaccaaacgagtaaagcgctttgaatgcgaagaactaatcagtaagaagatctacttgtttcaacccaatgctcaagtggaacttatacaataaactacttagatttattcgctaattgaccacaggcggcatcgatatcttttcctctagaccttctaacggttacagtaattctattggcctctaatgttttgatgtaattttgaatcgtttcctccgatgcttgttggtattcacctccctctatagggttgtattcaatcaaattaaccttagcgggagcgaacttacaaaaacgaaccaatgcatcaatatctttttgctgatcattaacatccttccaaactacatattcgtaggttattctattcttggttttagcataccaatattctaaagccgctctaagctcactcagcggaaacgtctcattaaaaggcatgatggtggaacgtacctcatctagagcagaatgaagtgaaacggctaaattgaactttacctcttgatctgccatttttctaatcattttaggaattcctgaagtcgataccgtaatacgttttggtgacattcctaaaccctcttcagaagttattttttcaatagccttaagcacattattgtaattcatcaatggttctcccattcccataaatacaatatttgataagggcatattttgatataatctgctttcttgatcaatagccaccacctgatcataaatctcatcagcattgagattacgcattttctttaaacgagctgtagcacagaatttacaatccaaactacatcctacttgagaagaaacacaagcagtcgttctcttcttagagggaatcaacacggattctacaataagatcgtcatgtaatcgaactgcattcttaatggttccatcaaccgatcgctgcatttgatctactttgatgtgattaatcacaaaatgcgtatctaagagtgctctngtttcttttgacagattggtcatatcttcaaaggaatgngctcctttttgccacaaccactgatatacctgatttcctctaaatgcactatctcccctagagacaaaaaagtctctaagagcatccttactcatagatcgaatatcttttttcatgttgaggctaaaaaaagcccgacattaagacgggccttaagtttttattagatgatcaacatcgcatcgccataagaataaaacttatagccattatctacagcttccttatacgcttttttcattaaatcatgtcccataaatgcggaaaccatcatcaacaatgttgacttaggggtatgaaagttagtaatcatacaattcgcaatactaaaatcgtaaggaggaaaaataaatttattagtccatcctacaaatggatttaaggtttgctccgaacttactgatgattctaatcctctcattacggtagtaccaacagcacatatacgtcttttttcacgctttgccttattgacaatttgaactgattcatcagaaatttctaattcttccgagtccattttatgtttggacaaatcttctacctcaacagggttaaaagttcctaatccaacatgaagcgttaattctgcaaaattaactcctttaatttcgagacgctttaacaagtgttttgaaaagtgaagtcctgcagtaggagcagctacagctccttcatttttagcatagatagtttgataccgttcttcatcatctggttctacctctcttttaatatattttggtaatggagtctctcctaactctctaagtttttttctgaattcagtgtaagagccatcatataaaaaacgaagggttctaccacgagaggtggtattatcgatcacctctgctactaaagaatcatcatctccaaaataaagtttgtttccgatacgaatcttacgagccggatcaacaagaacatcccacaaccgttgttcttcgtttaattctctaagcaagaatacttcaatacgagcacctgtcttctctttattcccataaagacgcgcagggaacaccttagtattattaagtaccatcacatcatcttcatcaaaatattctattagatctttaaagtacttatgttcaatagttccttgggctctattgatgaccattaaacgagcctcatcacgattctcggatgggtattctgctaaaagatcttttgggagatcaaaattaaaatgcgataatttcataatagtgactacaggttttaataaaggttgcaaatatacaacctcaattggggggttgtcaagtaaatagcgataaatctatttttttacttgaattccaagctgttccatgtcctcccaaaagtcaggaaaggacttggtnacnaccatagcatcttcaatnntaaanctngnctttaatgccaangga

SEQ ID NO: 1044 - DNA, 4000 bp, Escherichia coli
  misc_feature (1)..(1): n is a, c, g, or t
  misc_feature (4)..(4): n is a, c, g, or t
  misc_feature (6)..(10): n is a, c, g, or t
  misc_feature (13)..(13): n is a, c, g, or t
  misc_feature (17)..(17): n is a, c, g, or t
  misc_feature (20)..(20): n is a, c, g, or t
  misc_feature (22)..(22): n is a, c, g, or t
  misc_feature (25)..(25): n is a, c, g, or t
  misc_feature (27)..(28): n is a, c, g, or t
  misc_feature (30)..(30): n is a, c, g, or t
  misc_feature (32)..(32): n is a, c, g, or t
  misc_feature (35)..(35): n is a, c, g, or t
  misc_feature (38)..(42): n is a, c, g, or t
  misc_feature (46)..(46): n is a, c, g, or t
  misc_feature (48)..(49): n is a, c, g, or t
  misc_feature (51)..(51): n is a, c, g, or t
  misc_feature (54)..(54): n is a, c, g, or t
  misc_feature (56)..(56): n is a, c, g, or t
  misc_feature (58)..(63): n is a, c, g, or t
  misc_feature (65)..(67): n is a, c, g, or t
  misc_feature (71)..(71): n is a, c, g, or t
  misc_feature (74)..(74): n is a, c, g, or t
  misc_feature (77)..(84): n is a, c, g, or t
  misc_feature (86)..(86): n is a, c, g, or t
  misc_feature (89)..(92): n is a, c, g, or t
  misc_feature (94)..(94): n is a, c, g, or t
  misc_feature (97)..(97): n is a, c, g, or t
  misc_feature (99)..(99): n is a, c, g, or t
  misc_feature (101)..(105): n is a, c, g, or t
  misc_feature (107)..(110): n is a, c, g, or t
  misc_feature (112)..(113): n is a, c, g, or t
  misc_feature (115)..(115): n is a, c, g, or t
  misc_feature (117)..(118): n is a, c, g, or t
  misc_feature (120)..(120): n is a, c, g, or t
  misc_feature (122)..(122): n is a, c, g, or t
  misc_feature (124)..(124): n is a, c, g, or t
  misc_feature (126)..(127): n is a, c, g, or t
  misc_feature (129)..(129): n is a, c, g, or t
  misc_feature (134)..(134): n is a, c, g, or t
  misc_feature (136)..(136): n is a, c, g, or t
  misc_feature (139)..(139): n is a, c, g, or t
  misc_feature (141)..(144): n is a, c, g, or t
  misc_feature (147)..(150): n is a, c, g, or t
  misc_feature (152)..(155): n is a, c, g, or t
  misc_feature (157)..(157): n is a, c, g, or t
  misc_feature (160)..(160): n is a, c, g, or t
  misc_feature (163)..(163): n is a, c, g, or t
  misc_feature (165)..(166): n is a, c, g, or t
  misc_feature (169)..(169): n is a, c, g, or t
  misc_feature (171)..(172): n is a, c, g, or t
  misc_feature (174)..(177): n is a, c, g, or t
  misc_feature (179)..(180): n is a, c, g, or t
  misc_feature (183)..(183): n is a, c, g, or t
  misc_feature (186)..(186): n is a, c, g, or t
  misc_feature (188)..(192): n is a, c, g, or t
  misc_feature (196)..(196): n is a, c, g, or t
  misc_feature (199)..(199): n is a, c, g, or t
  misc_feature (202)..(204): n is a, c, g, or t
  misc_feature (206)..(206): n is a, c, g, or t
  misc_feature (209)..(209): n is a, c, g, or t
  misc_feature (211)..(211): n is a, c, g, or t
  misc_feature (214)..(214): n is a, c, g, or t
  misc_feature (218)..(218): n is a, c, g, or t
  misc_feature (220)..(220): n is a, c, g, or t
  misc_feature (223)..(223): n is a, c, g, or t
  misc_feature (225)..(225): n is a, c, g, or t
  misc_feature (228)..(228): n is a, c, g, or t
  misc_feature (230)..(230): n is a, c, g, or t
  misc_feature (232)..(232): n is a, c, g, or t
  misc_feature (234)..(237): n is a, c, g, or t
  misc_feature (241)..(241): n is a, c, g, or t
  misc_feature (244)..(245): n is a, c, g, or t
  misc_feature (247)..(247): n is a, c, g, or t
  misc_feature (250)..(250): n is a, c, g, or t
  misc_feature (252)..(252): n is a, c, g, or t
  misc_feature (256)..(257): n is a, c, g, or t
  misc_feature (259)..(260): n is a, c, g, or t
  misc_feature (262)..(263): n is a, c, g, or t
  misc_feature (265)..(267): n is a, c, g, or t
  misc_feature (269)..(271): n is a, c, g, or t
  misc_feature (273)..(273): n is a, c, g, or t
  misc_feature (275)..(276): n is a, c, g, or t
  misc_feature (278)..(282): n is a, c, g, or t
  misc_feature (286)..(286): n is a, c, g, or t
  misc_feature (288)..(288): n is a, c, g, or t
  misc_feature (291)..(291): n is a, c, g, or t
  misc_feature (294)..(296): n is a, c, g, or t
  misc_feature (298)..(300): n is a, c, g, or t
  misc_feature (302)..(306): n is a, c, g, or t
  misc_feature (308)..(309): n is a, c, g, or t
  misc_feature (312)..(313): n is a, c, g, or t
  misc_feature (316)..(316): n is a, c, g, or t
  misc_feature (318)..(318): n is a, c, g, or t
  misc_feature (322)..(326): n is a, c, g, or t
  misc_feature (329)..(329): n is a, c, g, or t
  misc_feature (331)..(334): n is a, c, g, or t
  misc_feature (337)..(340): n is a, c, g, or t
  misc_feature (343)..(343): n is a, c, g, or t
  misc_feature (346)..(350): n is a, c, g, or t
  misc_feature (353)..(353): n is a, c, g, or t
  misc_feature (355)..(355): n is a, c, g, or t
  misc_feature (357)..(359): n is a, c, g, or t
  misc_feature (363)..(363): n is a, c, g, or t
  misc_feature (365)..(367): n is a, c, g, or t
  misc_feature (369)..(369): n is a, c, g, or t
  misc_feature (371)..(375): n is a, c, g, or t
  misc_feature (378)..(379): n is a, c, g, or t
  misc_feature (382)..(382): n is a, c, g, or t
  misc_feature (385)..(389): n is a, c, g, or t
  misc_feature (392)..(394): n is a, c, g, or t
  misc_feature (396)..(396): n is a, c, g, or t
  misc_feature (398)..(398): n is a, c, g, or t
  misc_feature (400)..(400): n is a, c, g, or t
  misc_feature (403)..(403): n is a, c, g, or t
  misc_feature (406)..(406): n is a, c, g, or t
  misc_feature (408)..(411): n is a, c, g, or t
  misc_feature (414)..(419): n is a, c, g, or t
  misc_feature (422)..(424): n is a, c, g, or t
  misc_feature (426)..(426): n is a, c, g, or t
  misc_feature (429)..(429): n is a, c, g, or t
  misc_feature (434)..(435): n is a, c, g, or t
  misc_feature (438)..(440): n is a, c, g, or t
  misc_feature (442)..(443): n is a, c, g, or t
  misc_feature (445)..(445): n is a, c, g, or t
  misc_feature (447)..(448): n is a, c, g, or t
  misc_feature (451)..(451): n is a, c, g, or t
  misc_feature (456)..(458): n is a, c, g, or t
  misc_feature (460)..(460): n is a, c, g, or t
  misc_feature (462)..(463): n is a, c, g, or t
  misc_feature (467)..(468): n is a, c, g, or t
  misc_feature (470)..(470): n is a, c, g, or t
  misc_feature (474)..(474): n is a, c, g, or t
  misc_feature (478)..(478): n is a, c, g, or t
  misc_feature (480)..(481): n is a, c, g, or t
  misc_feature (485)..(485): n is a, c, g, or t
  misc_feature (487)..(487): n is a, c, g, or t
  misc_feature (489)..(489): n is a, c, g, or t
  misc_feature (491)..(491): n is a, c, g, or t
  misc_feature (494)..(494): n is a, c, g, or t
  misc_feature (496)..(496): n is a, c, g, or t
  misc_feature (498)..(499): n is a, c, g, or t
  misc_feature (504)..(506): n is a, c, g, or t
  misc_feature (509)..(509): n is a, c, g, or t
  misc_feature (512)..(512): n is a, c, g, or t
  misc_feature (514)..(514): n is a, c, g, or t
  misc_feature (517)..(524): n is a, c, g, or t
  misc_feature (528)..(528): n is a, c, g, or t
  misc_feature (530)..(535): n is a, c, g, or t
  misc_feature (537)..(539): n is a, c, g, or t
  misc_feature (541)..(541): n is a, c, g, or t
  misc_feature (543)..(543): n is a, c, g, or t
  misc_feature (545)..(545): n is a, c, g, or t
  misc_feature (552)..(552): n is a, c, g, or t
  misc_feature (557)..(557): n is a, c, g, or t
  misc_feature (560)..(560): n is a, c, g, or t
  misc_feature (562)..(562): n is a, c, g, or t
  misc_feature (567)..(568): n is a, c, g, or t
  misc_feature (570)..(573): n is a, c, g, or t
  misc_feature (577)..(577): n is a, c, g, or t
  misc_feature (579)..(580): n is a, c, g, or t
  misc_feature (583)..(583): n is a, c, g, or t
  misc_feature (587)..(589): n is a, c, g, or t
  misc_feature (592)..(592): n is a, c, g, or t
  misc_feature (594)..(596): n is a, c, g, or t
  misc_feature (598)..(598): n is a, c, g, or t
  misc_feature (604)..(604): n is a, c, g, or t
  misc_feature (607)..(607): n is a, c, g, or t
  misc_feature (609)..(610): n is a, c, g, or t
  misc_feature (612)..(614): n is a, c, g, or t
  misc_feature (618)..(618): n is a, c, g, or t
  misc_feature (620)..(621): n is a, c, g, or t
  misc_feature (623)..(624): n is a, c, g, or t
  misc_feature (628)..(628): n is a, c, g, or t
  misc_feature (630)..(630): n is a, c, g, or t
  misc_feature (633)..(635): n is a, c, g, or t
  misc_feature (637)..(648): n is a, c, g, or t
  misc_feature (650)..(653): n is a, c, g, or t
  misc_feature (655)..(656): n is a, c, g, or t
  misc_feature (664)..(665): n is a, c, g, or t
  misc_feature (667)..(667): n is a, c, g, or t
  misc_feature (669)..(669): n is a, c, g, or t
  misc_feature (672)..(674): n is a, c, g, or t
  misc_feature (676)..(676): n is a, c, g, or t
  misc_feature (678)..(678): n is a, c, g, or t
  misc_feature (682)..(682): n is a, c, g, or t
  misc_feature (688)..(688): n is a, c, g, or t
  misc_feature (693)..(694): n is a, c, g, or t
  misc_feature (697)..(697): n is a, c, g, or t
  misc_feature (699)..(701): n is a, c, g, or t
  misc_feature (705)..(709): n is a, c, g, or t
  misc_feature (712)..(712): n is a, c, g, or t
  misc_feature (716)..(716): n is a, c, g, or t
  misc_feature (719)..(719): n is a, c, g, or t
  misc_feature (721)..(722): n is a, c, g, or t
  misc_feature (724)..(724): n is a, c, g, or t
  misc_feature (728)..(728): n is a, c, g, or t
  misc_feature (737)..(739): n is a, c, g, or t
  misc_feature (741)..(741): n is a, c, g, or t
  misc_feature (743)..(744): n is a, c, g, or t
  misc_feature (749)..(750): n is a, c, g, or t
  misc_feature (752)..(752): n is a, c, g, or t
  misc_feature (756)..(758): n is a, c, g, or t
  misc_feature (761)..(761): n is a, c, g, or t
  misc_feature (764)..(764): n is a, c, g, or t
  misc_feature (767)..(768): n is a, c, g, or t
  misc_feature (771)..(772): n is a, c, g, or t
  misc_feature (774)..(777): n is a, c, g, or t
  misc_feature (782)..(782): n is a, c, g, or t
  misc_feature (785)..(785): n is a, c, g, or t
  misc_feature (787)..(788): n is a, c, g, or t
  misc_feature (790)..(790): n is a, c, g, or t
  misc_feature (793)..(794): n is a, c, g, or t
  misc_feature (796)..(798): n is a, c, g, or t
  misc_feature (802)..(802): n is a, c, g, or t
  misc_feature (805)..(805): n is a, c, g, or t
  misc_feature (809)..(809): n is a, c, g, or t
  misc_feature (814)..(815): n is a, c, g, or t
  misc_feature (817)..(817): n is a, c, g, or t
  misc_feature (820)..(820): n is a, c, g, or t
  misc_feature (825)..(825): n is a, c, g, or t
  misc_feature (832)..(832): n is a, c, g, or t
  misc_feature (835)..(835): n is a, c, g, or t
  misc_feature (837)..(837): n is a, c, g, or t
  misc_feature (839)..(839): n is a, c, g, or t
  misc_feature (841)..(841): n is a, c, g, or t
  misc_feature (843)..(843): n is a, c, g, or t
  misc_feature (845)..(846): n is a, c, g, or t
  misc_feature (848)..(848): n is a, c, g, or t
  misc_feature (851)..(851): n is a, c, g, or t
  misc_feature (854)..(855): n is a, c, g, or t
  misc_feature (857)..(857): n is a, c, g, or t
  misc_feature (859)..(861): n is a, c, g, or t
  misc_feature (863)..(865): n is a, c, g, or t
  misc_feature (867)..(871): n is a, c, g, or t
  misc_feature (874)..(874): n is a, c, g, or t
  misc_feature (876)..(876): n is a, c, g, or t
  misc_feature (878)..(879): n is a, c, g, or t
  misc_feature (884)..(887): n is a, c, g, or t
  misc_feature (890)..(890): n is a, c, g, or t
  misc_feature (892)..(892): n is a, c, g, or t
  misc_feature (895)..(895): n is a, c, g, or t
  misc_feature (898)..(898): n is a, c, g, or t
  misc_feature (901)..(901): n is a, c, g, or t
  misc_feature (903)..(903): n is a, c, g, or t
  misc_feature (905)..(908): n is a, c, g, or t
  misc_feature (911)..(912): n is a, c, g, or t
  misc_feature (914)..(917): n is a, c, g, or t
  misc_feature (919)..(919): n is a, c, g, or t
  misc_feature (921)..(921): n is a, c, g, or t
  misc_feature (923)..(925): n is a, c, g, or t
  misc_feature (927)..(927): n is a, c, g, or t
  misc_feature (929)..(929): n is a, c, g, or t
  misc_feature (931)..(932): n is a, c, g, or t
  misc_feature (936)..(938): n is a, c, g, or t
  misc_feature (940)..(940): n is a, c, g, or t
  misc_feature (942)..(943): n is a, c, g, or t
  misc_feature (945)..(945): n is a, c, g, or t
  misc_feature (947)..(948): n is a, c, g, or t
  misc_feature (950)..(951): n is a, c, g, or t
  misc_feature (953)..(953): n is a, c, g, or t
  misc_feature (955)..(955): n is a, c, g, or t
  misc_feature (957)..(957): n is a, c, g, or t
  misc_feature (959)..(959): n is a, c, g, or t
  misc_feature (962)..(962): n is a, c, g, or t
  misc_feature (964)..(965): n is a, c, g, or t
  misc_feature (968)..(971): n is a, c, g, or t
  misc_feature (975)..(977): n is a, c, g, or t
  misc_feature (979)..(980): n is a, c, g, or t
  misc_feature (983)..(985): n is a, c, g, or t
  misc_feature (988)..(988): n is a, c, g, or t
  misc_feature (990)..(991): n is a, c, g, or t
  misc_feature (993)..(993): n is a, c, g, or t
  misc_feature (995)..(995): n is a, c, g, or t
  misc_feature (997)..(997): n is a, c, g, or t
  misc_feature (1001)..(1005): n is a, c, g, or t
  misc_feature (1007)..(1007): n is a, c, g, or t
  misc_feature (1009)..(1010): n is a, c, g, or t
  misc_feature (1014)..(1014): n is a, c, g, or t
  misc_feature (1017)..(1017): n is a, c, g, or t
  misc_feature (1020)..(1021): n is a, c, g, or t
  misc_feature (1024)..(1024): n is a, c, g, or t
  misc_feature (1026)..(1026): n is a, c, g, or t
  misc_feature (1028)..(1029): n is a, c, g, or t
  misc_feature (1032)..(1032): n is a, c, g, or t
  misc_feature (1034)..(1034): n is a, c, g, or t
  misc_feature (1036)..(1036): n is a, c, g, or t
  misc_feature (1038)..(1039): n is a, c, g, or t
  misc_feature (1041)..(1041): n is a, c, g, or t
  misc_feature (1043)..(1044): n is a, c, g, or t
  misc_feature (1046)..(1048): n is a, c, g, or t
  misc_feature (1051)..(1051): n is a, c, g, or t
  misc_feature (1054)..(1054): n is a, c, g, or t
  misc_feature (1056)..(1056): n is a, c, g, or t
  misc_feature (1059)..(1059): n is a, c, g, or t
  misc_feature (1063)..(1064): n is a, c, g, or t
  misc_feature (1066)..(1066): n is a, c, g, or t
  misc_feature (1068)..(1068): n is a, c, g, or t
  misc_feature (1070)..(1070): n is a, c, g, or t
  misc_feature (1072)..(1074): n is a, c, g, or t
  misc_feature (1076)..(1082): n is a, c, g, or t
  misc_feature (1084)..(1084): n is a, c, g, or t
  misc_feature (1087)..(1087): n is a, c, g, or t
  misc_feature (1090)..(1090): n is a, c, g, or t
  misc_feature (1092)..(1092): n is a, c, g, or t
  misc_feature (1094)..(1095): n is a, c, g, or t
  misc_feature (1099)..(1100): n is a, c, g, or t
  misc_feature (1102)..(1105): n is a, c, g, or t
  misc_feature (1107)..(1107): n is a, c, g, or t
  misc_feature (1109)..(1110): n is a, c, g, or t
  misc_feature (1113)..(1113): n is a, c, g, or t
  misc_feature (1117)..(1121): n is a, c, g, or t
  misc_feature (1125)..(1125): n is a, c, g, or t
  misc_feature (1127)..(1129): n is a, c, g, or t
  misc_feature (1131)..(1133): n is a, c, g, or t
  misc_feature (1135)..(1135): n is a, c, g, or t
  misc_feature (1138)..(1138): n is a, c, g, or t
  misc_feature (1140)..(1140): n is a, c, g, or t
  misc_feature (1143)..(1144): n is a, c, g, or t
  misc_feature (1146)..(1148): n is a, c, g, or t
  misc_feature (1151)..(1151): n is a, c, g, or t
  misc_feature (1154)..(1154): n is a, c, g, or t
  misc_feature (1157)..(1157): n is a, c, g, or t
  misc_feature (1159)..(1159): n is a, c, g, or t
  misc_feature (1163)..(1163): n is a, c, g, or t
  misc_feature (1167)..(1167): n is a, c, g, or t
  misc_feature (1169)..(1169): n is a, c, g, or t
  misc_feature (1172)..(1172): n is a, c, g, or t
  misc_feature (1175)..(1175): n is a, c, g, or t
  misc_feature (1179)..(1179): n is a, c, g, or t
  misc_feature (1181)..(1182): n is a, c, g, or t
  misc_feature (1184)..(1184): n is a, c, g, or t
  misc_feature (1187)..(1188): n is a, c, g, or t
  misc_feature (1191)..(1191): n is a, c, g, or t
  misc_feature (1194)..(1194): n is a, c, g, or t
  misc_feature (1201)..(1208): n is a, c, g, or t
  misc_feature (1212)..(1215): n is a, c, g, or t
  misc_feature (1220)..(1223): n is a, c, g, or t
  misc_feature (1225)..(1227): n is a, c, g, or t
  misc_feature (1233)..(1234): n is a, c, g, or t
  misc_feature (1236)..(1236): n is a, c, g, or t
  misc_feature (1238)..(1239): n is a, c, g, or t
  misc_feature (1242)..(1243): n is a, c, g, or t
  misc_feature (1246)..(1248): n is a, c, g, or t
  misc_feature (1250)..(1255): n is a, c, g, or t
  misc_feature (1257)..(1259): n is a, c, g, or t
  misc_feature (1265)..(1265): n is a, c, g, or t
  misc_feature (1271)..(1272): n is a, c, g, or t
  misc_feature (1275)..(1275): n is a, c, g, or t
  misc_feature (1307)..(1307): n is a, c, g, or t
  misc_feature (1310)..(1310): n is a, c, g, or t
  misc_feature (1315)..(1315): n is a, c, g, or t
  misc_feature (1431)..(1431): n is a, c, g, or t
  misc_feature (1513)..(1513): n is a, c, g, or t
  misc_feature (1977)..(1977): n is a, c, g, or t
  misc_feature (1996)..(1996): n is a, c, g, or t
  misc_feature (2048)..(2048): n is a, c, g, or t
  misc_feature (2223)..(2223): n is a, c, g, or t
  misc_feature (2665)..(2665): n is a, c, g, or t
  misc_feature (2762)..(2762): n is a, c, g, or t
  misc_feature (2966)..(2966): n is a, c, g, or t
  misc_feature (2996)..(2996): n is a, c, g, or t
  misc_feature (3206)..(3206): n is a, c, g, or t
  misc_feature (3443)..(3443): n is a, c, g, or t
  misc_feature (3857)..(3857): n is a, c, g, or t
ngtntnnnnngcncctnttngnttntnncnanaanaannnnnaaananngnggntntnnnnnntnnnaaanatnttnnnnnnnnanaannnnangtntnannnnntnnnntnncncnngntntntnnanaaatntntanannnnttnnnnannnngnganaananntananncnnnnannttnttnannnnncctnttnaannntnttngnaancctntnaananccntntngnnnnaaanaanntntananaagnncnntnnannntnnntntnnannnnntttntnttnttnnntnnntnnnnntnnaannganangggnnnnnttncnnnnaannnnaanaannnnnatntntnnntatntnnngngnnnnnttnnaanaannnnnaannntntntnaanaanannnnttnnnnnnccnnnanaangggtnnaannncnntncnntanaaagnnntntnnaacnntntaanggtntnnaaananangnganangnnaaaannnaanaananaannnnnnnnttgngnnnnnntnnntncncntatatanaatanaananggtgnnannnnaaangnnccntttnnnttntnnnanttatanaananntnnnttgngnntnnaaangnaannnannnnnnnnnnnntnnnntnnaaaaaganncnanggnnntngntctntttttnttttnngtntnnntttnnnnnttntttnttngnntnaaanaaaaaaaannntnanntttgnnanagannnttnaanaannggnncnnnnaaaanaantnnanttnnannnaaanaanaaanaaaanngnaanaaaanaacacanaanancnanantnngnaanagnntngnnncnnnannnnncanangnnaaatnnnnaancnttnttnttntngnnnnttnngnnnnanantnnntntnanntttnnnangnntntnncnngnantncnaangnnttnnnnaaannncnnttnnnttntnncncnanaaannnnnangnntttnttnttnnctntnannganantntnnancnntnnnaanaananttnggcnnantngntnnncnnnnnnnanaanaanantnnaaanntnnnncncnnttnggtnnnnnaaanannnannntnaananctnnannnaanaanaangnaaanaaananttnttntttntnncnttnnctnttnttttttnnnnnnnnattnnnnaaaannnngnnntttttnntnannaannaannnannnnnnannnaaaaanaatgannttnctatccattttgagctattttcggtagggagnaantagangaaaaatagcttttttacataaaacgaatacctcgaaaagttttttcaacgacttttattgttgcaaaaacttcaaataaaaaagactttcaaatattaaataatgttatctttgnaaggtttctatatagtaatgtattaaaaaacggagaaaacattgtacctttgcaactcaaatgaccaaatggggtcattgtntacgtagaacaaaaataataaataaatataattcaataaaagtacaattatgcctacaattcaacaattggtaagaaaaggcagaaaggttcttgtagacaagagcaagtcacctgcgttggactcatgtcctcaacgtcgtggtgtgtgtgttcgtgtttatacaacaacacctaaaaagcctaattcggcaatgcgtaaagttgcccgtgttcgtttgactaatcaaaaagaagtgaactcttacattcctggagaaggacacaacttgcaagagcacagtatcgttcttgttcgtggtggtcgtgtaaaagaccttcctggtgttcgttatcacatcgttcgtggtactcttgacaccgctggagtagcaaaccgtacacaacgtcgttctaaatatggagcgaaacgtcctaaagctgctaagaagtaattctaagtaattgaaggacaagagatgaagncagagtttagaattatgantgtaatgattattgttaaactcttgactgtgaatctcaaaacaatacaaaanttttattatcgttttgctggtgaattgttaaaaacaggttgagtaaatgctcgagtgagagcgttgaagaacaataacagccccatgcagaatttttattttaaacaaaatgagaaaagcaaaaccaaagaaacgtgtgatccttccagatcccgtttacaatgaccaaaaggtntcaaaattcgtaaatcatttgatgtatgatggtaaaaagactacatcttatgaaattttctacaatgctcttaatatcgtagaggaaaagatggctaaggaagaaaagtcttctttggaaatctggaaacaagctcttgataatattactcctcaagtggaagtgaaaagtcgccgtatcggtggtgctactttccaagttccaactgaaatacgtccagaacgtaaagagagtatctctatgaaaaatatgattttatttgcacgtaaacgtggtggcaagtctatggctgaaaagttggctgcagaaattgctgatgcatataataatcaaggtggtgcttacaaacgtaaagaggatatgcatcgtatggcagaagctaaccgtgcatttgctcatttcagattctaattatataataaggtaaaaagaaaatggcaantcgcgatttaaaattgacacgtaatatcggtattatggctcacatcgatgccggtaagacaacaacttctgaacgtatccttttctatacaggtaanactcacaagattggtgaggtgcacgatggtgcagctactatggactggatggcacaagagcaagaacgtggtattactattacatctgctgctacaacttgtaactggacttggaataaccaaaacttcaagatcaacttgattgacactccaggacacgttgactttactgctgaggtagaacgttctttgcgtgtacttganggtgctgttgctacatactctgctgctganggtgttcaacctcagtctgaaactgtatggcgtcaagctgataaatataacgttcctcgtttgggttatgtaaataagatggaccgttctggtgcagacttcttcgagactgtacaacaaatgaaagacatcttaggtgctaatccttgcccaatccaaattcctattggtgcagaagagaactttaaaggtgtagttgaccttattaanatgaaggctattctttggcatgatgagacaatgggtgcagactatgacttggaagaaattccagctgaccttgttgatgaagctaacgaatggagagaaaaactaattgaatgtgcagctaactttgatgatgctcttatggagaagtatcttgaaggtgctgaaatcacagaagaagaacttatcgctgcaatccgtaaaggtacaattgcaatggaggtaactccaatggtattnggttcttcatacaagaataagggtgttcaacctctattggattatgtttgtgctttcttaccatctccaattgatacaggtgaggtaattggtactaacccagatacagaggaagaagaaggtcgtcaaccttctgaagacgctccaacatcagctcttgcatttaagatcgctactgatccattcatgggtcgtttggtgttcttccgtgtttactcaggtaaggtaactgcaggtagctatgtttacaacccacgttcaggtaaaaaagaacgtatcagccgtttgttccaaatgaactctaacaaggaaattccaatggaatcaatcgacgctggtgatatcggtgcaggtgtaggtttcaaagatatccgtacaggtgatactctttgtgatgaaactaagcctatcgtncttgaatcaatgaccttccctgatactgtgatctctattgcagtagaaccaaagagtcaagctgacgttgcaaaacttgataacggtttggctaaattggcagaagaagacccaactttcacagttcgtacagacgaacaaag

SEQ ID NO: 1045 - DNA, 4000 bp, Escherichia coli
  misc_feature (150)..(150): n is a, c, g, or t
  misc_feature (630)..(630): n is a, c, g, or t
  misc_feature (1986)..(1986): n is a, c, g, or t
  misc_feature (2364)..(2364): n is a, c, g, or t
  misc_feature (3035)..(3035): n is a, c, g, or t
  misc_feature (3542)..(3542): n is a, c, g, or t
  misc_feature (3627)..(3627): n is a, c, g, or t
  misc_feature (3816)..(3816): n is a, c, g, or t
cccacccctagagccaaagccccaccaagccatatactgcgcgtctgtgccatgagcacagccaagacacctagccaaagggctgcatcggcgaaccatgagggccattgctgacgcgatcgccccagcaccacgatgggtagggtcagngcaatggcactggctgtaaagtttttatgccccatcaaaccgggaacgaggtagggatcttccaacgcatccgaccctttggccatgaacgtgaggacatagtgtaggctgagcatcaagccaaagcccaaaatgaacgtggtgaaccgtgccctatcttcagccgaggcatgcgcccaaagccctcccagcagcagaaagcctagatagcccgtaaagcggcctgcgctgtacttccattcggccaccgaatacaaatccgtcatccacggggccacccacgcccaaagtgccaaacctaaccacaccaggacgggccatgaaagtttgtaggtggcggatgtcgtgctcgaccaggctttaagcaggagagcacaccccacgccagcaaatcccaagtggagtggccaatgacctggatccccgagctttgaaaaaaggcccacagaaggcaagatggccatgagggcacccagcccnagcgccaagtatgagtgtactgtttgaggatgcgtttccttcattccttaaaagtaaaaaaccccgtcggaaggacggggttttctttgtcgttgtaaggagaaattaattctcgtcgccgatcacttcaaagtggaagtcgaccactacatcgcggtgcaaacgaaccttcgctgtgtacttgccagcagctttgatggttccacctgcgatttggatgaacttcttgtcgatggcgtgacccatagcagccaactcctcggccacattggcgttggtgacggctccaaaaagcttaccacccttgccagacttggccgtgagcttcaactcgacgcggtgcaaggcttccgctgtcttgttggcagcttcgaccatcttcgcctctttgtgggcacgctgacggaggtcttccgccaacattttctttgcagaaggcgttgccaaaacggcaaaaccctttgggatcaaatagttgaggccataaccgttcttaacggtgaccatatcgtccttgtaaccaaggttttcaacgtcagatttcaagataacttccatggcgctgattatttaaggttgtcggctacgtaaggcatgagtcccaagtggcgtgcgcgcttgatggcttgcgccaatttgcgctggtacttcaaagaggtaccggtgaggcggcggggcaaaattttgccttgctcattcacaaaacgcaacaagaaatcaggatccttgtggtcgatgtgcttaatgccgtatttcttgaagcggcaatacttcttggtgttggtagcgtcaatagcgatcggctggagatagcggatctctgattgattgccagcgttggattccaaagtgctcatttctgtgtaggattaagcgtttttgactttggcgcgacgcttggcagcatactcaacgccgtgtttgtccagggtcacggtgaggaagcgcaagatgcgctcgtcacgcttcatttctacctcgagggtagcaatgacgggagctggagctttgaactcgaggaggttatagaacccactcttctttttgtcgatggggtatgccaacttgcggaggccccacttttcgacgttgataagctcggcaccattcgattgtaggtagccggtgtacttatcaaccgcttcccttgtctgctcttcagacaagacgggatttagaatgaaaacggtttcgtactgattcatagttaatgaaattaggggtgcaaagataggaaaaagcacctttggttataccgaaaaaaggaaaagggttttcgtgttttagggtgaaagaatcaagggacacttcacgccgtgctcgttcgttggtttcctcgttctggggtaaacctcnaattcaccccaatatgagcgcagcgtgatcggccgtttacgactcaacgcttcaccttttaacctgttttcgctagccctctagccctctagctcaatcagcaccggacagtggtcgctgccatactcttccgtcaagatgtccgtgcgggtcacacgaggcatcaggcgctccgataccacatggtagtccaatcgccatccgatgttcttcgcccgcgctcccgagcgcatgctccaccatgaaaacttcacctcctcggggtgttgggcgcgccatgaatccacaaatcccttgctcaacaggtaatccataccgtcaatttccgcttgagtataaccgggggtcttgttgtagttggacttgggattagaaagntctatttcctgatgggctacattcagatcgccacaatagacaatgggtttcttttcatcgtagttggcaagcaagttggcgatatcgcggtcccacgcttggcggttgggaattcggctcaagtcgcccttggaattggggacatacgccgtagccacgtagaaatggggaaattcggccacaataaggcgaccttctccgtcatgttcgggcaggcccacccccactttaacgctcagtggagcttctttcgaaattaatgcggtaccgctgtagcccttcttttcagccgagtgcgcatacacgtggtagcccgcgccaaaaaggacttctgccacttgttcttcggtggccttcgtctcttgaaaacacacgacatccgcatcccatgcggccaattgatccaggaggcccttggtcgcagccgcccgaattccattcacattccaggaaataattttcatgccttaaaggtacctagcccgcacagaattgccgaactttccaccatgggagttatccacaaatgccttttgggagccgccgcagtgttggccatcagttgccaaccgcgctgggtgaattcgggcagttatcagtttgccaacaatgcccaattggtgcaacgcgaatcgttgcaaatcctttcttatccaggggctatttccacngggcaatttcaacaaaacttgaccctgggagatcgagggacgcttttaacacacatcgtgtttttctccccaaaagaaggccatattcaacgctatcagctcgtgagcacgtccagcccgtcgtatgcagccaactttacagacggcctcatggaagtctatgaaggggagttgggtttgtaccccaatgaacgcctttcgctccctgctggcccgctctaccaccccgttatggccccccagtaccctttggtggtggacgccatttggaagctcaaagtgggccaagagcacttgctcaccatggtgcagccgcctaagggcaatatcagtattgcgagctactatttggcccaaaaaacggccaaagagcgcatctatttataccggaatgatagcaacgtaggcaccctcacctatcaaaaaaaacagggtcgctgggtcctcctaaaggcggaccttctcaaccaagatgtgccctatatctgggagcgaatggagcagccntagcgtttacatgtttcggcggtactgaccgcccaccgcaaacatcgcttcggtcatttgacccaaagagcaaaccttggccgcntccataatcgcctcgaagacgttgccgccggaaagggccgcaatctgaatggccgccaaggccgccgaggacttgtcccccgacgcctgctgcaaagcatttaccgtggcgatttggtcctctttttccgcttctgtcgcacgaatgacctcgcccggaatcagggtgggcgatcctttggaactcaanaaggtattcacaccgataatggggtattcccccgtgtgtttgagcatctcataatgcatggactcctcttgaatcttgccgcgctggtacatcgtttccatggcgccgaggacgccgccgcgctccgtgatgcggtcaaattccaccatcaccgcttcttcgacgagctcggtgagctcctcaa

SEQ ID NO: 1046 - DNA, 4000 bp, Escherichia coli
  misc_feature (897)..(897): n is a, c, g, or t
  misc_feature (1824)..(1824): n is a, c, g, or t
  misc_feature (1968)..(1968): n is a, c, g, or t
  misc_feature (1988)..(1989): n is a, c, g, or t
  misc_feature (3609)..(3609): n is a, c, g, or t
  misc_feature (3810)..(3810): n is a, c, g, or t
ataaagcttaaaaaacagcctcatttacaaaatttctgaaattttttaatcaagccgaaaatatggtttgttaaatagtgaaaagagttgttttctctcaaattaacgtgtattttcacccattttatgcgcagataaagatctatctaggtaataaaagccttgagtgggcatgttttactttaattttcattattttcaaaattttttaatgataaaaaactatgcaccgattaaaatttaacctttatgaagtctaattttgtcaaaaatcctctagataagttgcctgatattctcaagcgcaacttagataaaaatctatgtatttgcaacgaggttcccaagatggatgttattgatgccattgcaaacggtgccacaacagtggatgaggttagaaatatcacttatgctactagtggtaatggttgttgtacacgccaggttgtgcgtttaattgagtgtattcattcaatagaattggagaattaaacacagattaaagaggggataaaatgaaggcaatgacttgcaatcaactaggtggcgcatgtgaaaaaagagtttcacgctaatacttttgagcaaacagcacggtataaaagtatttcaagcataaggcgcatctagaagcgatggtaaaaattcaacaacttatgaaaataccagaagacacgcaaaattagcttaatcttaaaaaaagaagaattcaacatgctgcctgaaaatttagattaagcttattccaaattaggtgataacagcctttctgcttgctcgatggaaacgcctttgcgtttagcgtagtcttggacctgctcttgattaattttcgccacaccaaaatatcttgaatctttattggcaaaataccagccactaacgctagctgtnggtagcatagcatatgagcttgttagcgtcatgccggtatttttttcaacatcgagtaaatcccatagcttttctttttcactatgctcagggcacgacggatatcctggagcagggcggatgccatggtatttttcttcaatgagtttttcattgttaaaatcttcatcgctatagccccagatttctgtgcggaatttatagtgcatcatttctgcaaaagcttcagcaaaacgatcggctaccgccttaatcatgattgagttgtagtcatcatggtctgcttcataaacttcaactaatgggtctatattgatgcctgctgttactgcaaaagcacccatataatcttgcacgccactgtctttcggggcgataaaatcactcaggcaaaaattaggggtgttgccttttttatccaattgttgacgcaagtgattaagtgtcataaacacctcaccattatcattagttagctcaatatcttcattgacactatttgctggaaagatacccaccacggcgtttgcttgtaaaagtttttcatcgataacttttttgaacatgacttttgcatcgttaaacagttgtgtggcagattcacccaccacgtcatcagtgagaatatcggggaatttaccagcgagctcccaagtgcggaagaatggcacccaatcaataaatttaaagatttcatttaaatcgtagtctttaaaaacatgaacaccgagttcgttaggcttgctaatgttgtcaaatttaatgctaggcttgttatttctagcagcctccaggctgattagcttgcttttgcctttattagcacgtctgagacgcacttgttcgtactctgctttggtgttactaaccaggtcgggtttgagctcatttgatagcaatgaggtagcaacaccaacggccttagangcgtctttaacatagaacacgcctttgtcgtactctggctcaatctttacagcggtgtgtgcaattgaggtggtggcaccaccaatcattagtggtagctcaaagccttgacgtgtcatttctttggcaacagaaaccatttcntcaagcgatggcgtgatcannccagaaaggccaataatatcaacattttctttgatggctgtttctaggatggtttcagccgggaccatgacgccgagatcaataatttcataattattacacgaaagcaccacgccaacaatatttttgccaatatcatgcacatcgcctttaacggttgccatgagaattttgccctgagctctagagccacattcttgtttttctgcttcaaggaatggatctagataagctacggattttttcattactcgggcggatttcaccacttgtggcaaaaacatttttccatcgccaaacaaatcaccaacgacattcatgccgtccatgagtggaccttcaatcaccagaatagggcggcctagtttgtcaagagcttcttgagtgtcttcatcaataaattcagtaatacctttaaccaaagaatgctctaggcgtttttcaaccgtccaagtacgccactctaaatcttttttattgtctttttgttgtaactcaccagagaattttccagcaatttcaaccaagcgctcaccagcattatcatcggtattaagcaccacatcttctacagcttttttaagttctggatcaatgtcatcgtaaaccaccaactgacccgcattaacaatacccatggtcataccggctttaatagcgtggtataaaaagactgagtgaatggcttcacgcacagggttgttgcccctaaatgagaatgagacgttggatacaccgcctgatattttggcaaatggtagatttttagtgatctctcgagtggcttcgataaaatcaacaccgtagttattgtgctcttcaataccggtggctacggcaaaaatattcggatcgaaaataatatcttctggcgggaaatcaacctcattaactaaaatgttgtaagcattggtgcagatttcaattttgcgcgcttgggtgtcagcctggccttgttcatcaaaggccataacaataatggccgcaccatagcgtttgcaaagatgtgcatatttaacaaagttatctttgccttctttaagcgagatagagttaacaattgccttgccttgtgtgcattttaggccggcttcaataatttcccacttggaagaatccaccatgagtggtactttggaaatatcaggctcggaagcgatcagattaagaaagcgaatcatggctgctttgccatcaagcattccctcatccatattaatatcaaccacttgagcgccatcttcaacttgggcacgacaaatgtccagagcttcttcgtattcttcgttaagaattaagcgcttaaatttggcagagccagtgacattggcacgctcacccacgttgacaaataaagcatcatctgcaatattaaaagcctctaagccagacaggcggcattcaggcttaatggcggggatttttctaggtgctaggttttcaatcgcatcggcaatgcacttgatatgctcaggcgtagagccacaacagccacctaaaatgttaaccaaaccagattctgcccattcgctaacctgcttgcccatggtgatagcgcctagatcgtactcaccaaactcattcggcaggccagcatttgggtgagcggatacataggtnttagccacgcgtgacatttcagccacatattggcgcaacaagtcagggccgagtgcacaattaagaccaatagaaatagggtttgcgtgacgtagtgaattgtaaaaggcttcagtcatttgcccagaaagtgtacggcctgaagcatcggtaatagtgcctgaaatcatgattggaagctcaataccatcttgctcaaanacttcttgcacggcaaaaatagcagccttagcattaagcgtatcaaagatggtttcaatcaaaataatatcagcacctccttcaatcagtccacgggtagattccatataaacttcaactagttcgtcaaaggttacatttctaaagccaggatcgtttacatcgggtgaaagcgaacaagtgcgtgatg

SEQ ID NO: 1047 - DNA, 4000 bp, Escherichia coli
  misc_feature (1)..(1): n is a, c, g, or t
  misc_feature (3)..(3): n is a, c, g, or t
  misc_feature (60)..(60): n is a, c, g, or t
  misc_feature (665)..(665): n is a, c, g, or t
  misc_feature (677)..(677): n is a, c, g, or t
  misc_feature (755)..(755): n is a, c, g, or t
  misc_feature (953)..(953): n is a, c, g, or t
  misc_feature (1115)..(1115): n is a, c, g, or t
  misc_feature (1986)..(1986): n is a, c, g, or t
  misc_feature (3088)..(3088): n is a, c, g, or t
  misc_feature (3383)..(3383): n is a, c, g, or t
  misc_feature (3466)..(3466): n is a, c, g, or t
  misc_feature (3497)..(3497): n is a, c, g, or t
  misc_feature (3527)..(3527): n is a, c, g, or t
  misc_feature (3540)..(3541): n is a, c, g, or t
  misc_feature (3543)..(3543): n is a, c, g, or t
  misc_feature (3545)..(3551): n is a, c, g, or t
  misc_feature (3597)..(3597): n is a, c, g, or t
  misc_feature (3599)..(3599): n is a, c, g, or t
  misc_feature (3608)..(3609): n is a, c, g, or t
  misc_feature (3611)..(3611): n is a, c, g, or t
  misc_feature (3613)..(3614): n is a, c, g, or t
  misc_feature (3616)..(3616): n is a, c, g, or t
  misc_feature (3619)..(3620): n is a, c, g, or t
  misc_feature (3622)..(3622): n is a, c, g, or t
  misc_feature (3626)..(3626): n is a, c, g, or t
  misc_feature (3629)..(3631): n is a, c, g, or t
  misc_feature (3633)..(3633): n is a, c, g, or t
  misc_feature (3635)..(3635): n is a, c, g, or t
  misc_feature (3637)..(3637): n is a, c, g, or t
  misc_feature (3639)..(3640): n is a, c, g, or t
  misc_feature (3642)..(3642): n is a, c, g, or t
  misc_feature (3644)..(3647): n is a, c, g, or t
  misc_feature (3649)..(3656): n is a, c, g, or t
  misc_feature (3658)..(3660): n is a, c, g, or t
  misc_feature (3662)..(3664): n is a, c, g, or t
  misc_feature (3666)..(3667): n is a, c, g, or t
  misc_feature (3670)..(3671): n is a, c, g, or t
  misc_feature (3673)..(3674): n is a, c, g, or t
  misc_feature (3679)..(3682): n is a, c, g, or t
  misc_feature (3684)..(3684): n is a, c, g, or t
  misc_feature (3686)..(3686): n is a, c, g, or t
  misc_feature (3690)..(3692): n is a, c, g, or t
  misc_feature (3696)..(3697): n is a, c, g, or t
  misc_feature (3699)..(3699): n is a, c, g, or t
  misc_feature (3702)..(3702): n is a, c, g, or t
  misc_feature (3705)..(3706): n is a, c, g, or t
  misc_feature (3709)..(3710): n is a, c, g, or t
  misc_feature (3712)..(3712): n is a, c, g, or t
  misc_feature (3714)..(3715): n is a, c, g, or t
  misc_feature (3717)..(3721): n is a, c, g, or t
  misc_feature (3723)..(3727): n is a, c, g, or t
  misc_feature (3730)..(3735): n is a, c, g, or t
  misc_feature (3738)..(3739): n is a, c, g, or t
  misc_feature (3744)..(3744): n is a, c, g, or t
  misc_feature (3746)..(3746): n is a, c, g, or t
  misc_feature (3750)..(3752): n is a, c, g, or t
  misc_feature (3755)..(3756): n is a, c, g, or t
  misc_feature (3761)..(3763): n is a, c, g, or t
  misc_feature (3765)..(3770): n is a, c, g, or t
  misc_feature (3772)..(3772): n is a, c, g, or t
  misc_feature (3774)..(3776): n is a, c, g, or t
  misc_feature (3778)..(3781): n is a, c, g, or t
  misc_feature (3783)..(3783): n is a, c, g, or t
  misc_feature (3785)..(3787): n is a, c, g, or t
  misc_feature (3790)..(3790): n is a, c, g, or t
  misc_feature (3793)..(3795): n is a, c, g, or t
  misc_feature (3798)..(3799): n is a, c, g, or t
  misc_feature (3803)..(3804): n is a, c, g, or t
  misc_feature (3806)..(3808): n is a, c, g, or t
  misc_feature (3810)..(3811): n is a, c, g, or t
  misc_feature (3814)..(3815): n is a, c, g, or t
  misc_feature (3817)..(3817): n is a, c, g, or t
  misc_feature (3822)..(3823): n is a, c, g, or t
  misc_feature (3825)..(3825): n is a, c, g, or t
  misc_feature (3827)..(3827): n is a, c, g, or t
  misc_feature (3829)..(3829): n is a, c, g, or t
  misc_feature (3834)..(3834): n is a, c, g, or t
  misc_feature (3836)..(3841): n is a, c, g, or t
  misc_feature (3844)..(3845): n is a, c, g, or t
  misc_feature (3849)..(3849): n is a, c, g, or t
  misc_feature (3851)..(3851): n is a, c, g, or t
  misc_feature (3853)..(3855): n is a, c, g, or t
  misc_feature (3863)..(3863): n is a, c, g, or t
  misc_feature (3865)..(3873): n is a, c, g, or t
  misc_feature (3875)..(3875): n is a, c, g, or t
  misc_feature (3879)..(3882): n is a, c, g, or t
  misc_feature (3884)..(3884): n is a, c, g, or t
  misc_feature (3886)..(3887): n is a, c, g, or t
  misc_feature (3889)..(3889): n is a, c, g, or t
  misc_feature (3893)..(3893): n is a, c, g, or t
  misc_feature (3895)..(3898): n is a, c, g, or t
  misc_feature (3901)..(3903): n is a, c, g, or t
  misc_feature (3907)..(3907): n is a, c, g, or t
  misc_feature (3909)..(3914): n is a, c, g, or t
  misc_feature (3916)..(3920): n is a, c, g, or t
  misc_feature (3922)..(3922): n is a, c, g, or t
  misc_feature (3925)..(3925): n is a, c, g, or t
  misc_feature (3928)..(3932): n is a, c, g, or t
  misc_feature (3935)..(3936): n is a, c, g, or t
  misc_feature (3940)..(3941): n is a, c, g, or t
  misc_feature (3943)..(3943): n is a, c, g, or t
  misc_feature (3945)..(3951): n is a, c, g, or t
  misc_feature (3953)..(3954): n is a, c, g, or t
  misc_feature (3957)..(3958): n is a, c, g, or t
  misc_feature (3961)..(3962): n is a, c, g, or t
  misc_feature (3964)..(3964): n is a, c, g, or t
  misc_feature (3967)..(3967): n is a, c, g, or t
  misc_feature (3969)..(3969): n is a, c, g, or t
  misc_feature (3971)..(3971): n is a, c, g, or t
  misc_feature (3973)..(3976): n is a, c, g, or t
  misc_feature (3978)..(3980): n is a, c, g, or t
  misc_feature (3982)..(3982): n is a, c, g, or t
  misc_feature (3985)..(3985): n is a, c, g, or t
  misc_feature (3987)..(3988): n is a, c, g, or t
  misc_feature (3990)..(3992): n is a, c, g, or t
ngnccccctggtcgccgtagtcgcacctcgaaacagtttcacagtgccagccattgcttncaagcacgcggaatgctcaagccgcctctgcaacctttggcggcttttggctctggtgcaaggaaagaagattcgcggcgacccgttgagcagaatagtactggtccagttcaagcggggtctcctccgccaagatgaacgaccatccgtgtttgatgaactcgtcccatctcgtctgacggaattcaccaagctttgcgaaatcctcctccagctcttcaattcttgcgctgcgttctttgaggggtcggctcgttcctcccttcaggggacggctcgttcccccttttgcccagagttcctcagctttgtccgtctcactctcgtcgcggaatggaaagtagatggaaaggccgtggcaacgtttctctatcacggtctggttctcgataacgcacccgtcatcacgcaccaccatggcttcacgaatccttttgcatgcagaccttagatcagggacggtagtgctccgggggacttgctccaagtctttgtccaactccttgtctaagcactcgcaaaaatccaaaagatccacgaacagcccaaagacaaaatcttgggcctccttgcgcgcggaaaaaattttcttgcgcacaatgttnttggaactcgangtcagtaaggctttcgcaagctccgttaatgggcctttaatcgtatcgatctcctttagactgaggcttgaaagtgtnattcccttcactccggtgccgggcgtagcgatataatcccgaaacgcttgttggtagagtcccggaatcatcttgcagacttctttaacatcatttcttacgttgtgagctttcaagtcttccagaatcttctgataaggaaaactcgcgtccggcacatcctcttgcgacgcgatcataaaatcaacagaaccccgnagctcactagcaacctcaatcatgctcatcgagcaggcatctatcccgatgatgtctagggtattcccggatttaggatggcccgctgctaattctccttttgctagcttcgtgtttcgaagggcttccttcaggtttgagaaagtaagatatctcctgacngagccgttcgtgaccccatagcggtgcttctcagcccgcaacaactcagtgccatagcggcgcttctgagcccgcaacaactcagtgccatagcggcgcccctcagaaaacaacagctcagtgccatagtggcggtcctcagccaacaacaactcagtgccatagcggcggtcctcatccaacaacaactcagtgccatgaccccacagtatcaggcagtagtgctcggtcttggatttctccgacgcataattgatgaactctgtaagagtctctggacgtgtaatgtcgactggatgaattgttgtgaacttcgcgatttcgtcttctggcatccgactactttcgatcggtaaagtgcgttttttagcgtcaccatcaaaaaagtaaatacgtgcgtcttgaggttgtttggggtcgaattctgcttcaagttctgccaccacaacaatacccttgtgggccgcatctcgcagctgtttcaaggattcgatggcaaaatttgctaacacatcgtcggcagagatgtacaccatgatcgtccaggtcgcagattgatttgtcatatgctcctcgtgatcacaagattcagagttcatggcttggacttgtcggtttcacgccaaagcgtcggagatgcatctctgttgagagctctggagttttagcctttgtggaacgccttcacttcttaaatgccttggataggaaagtatttcagggcccgtaaaccaaagctcccgactgtccgcgggtttgcgccatggacaaaacatgctggctcgctccagcccgaacgaaattagctcgtcccaaatcctggaaacttgtccagacttggtagtgattgcggcctgacttgcaacagaantgtcgagcgtattctgcgcctaccagcttccaaaaatcaatcaaaaagggctttcgagaacactaggctcccaccttgccttatggctttaatacgggaactgagcacagaccagaacggataacgacgccttcaactggaggcggcgcatggcggggatgaatggcggcgaaatacttcaggagatgccgccatatgctagtagaaggtctcggcgccttgggggatttgtgccacaggtgagtaaattgcgagcgaatctggagaggaaaggccgccaagtagcgatagtcaacacctggccagtgtccgggttgtcgctcaggcgggaatcgcgctttgactcgtcgtgcgttaatgttccgcgtgagctaattgtcggacagatgcttggccactaccgtctagtcgagcaaatttcgaggggcggtatgggggtcgtctatcgagctcacgatgagcacctggaaagagaagttgcgctgaaggtgttggcgccagccagcgtgaatgatgccgctgcttgcagacgattccagaacgaagcactgattctttcaaaactcaatcatcccaatatcatttctatttatgattttgacgcccaggacggcatcgacttcctggtaatggaatacgtcccaggccagacactctcggcaaggctcgagaggggcccgctgacccaagacgaagtactccacatcggccgacaaatcgcggcctcagtaaaagaagcacatgaccacggcatcattcaccgggacttgaaaccccaaaacgtgctgcttacgcccaaagggcaggtgaaagtggctgactttggactggcgaagctcgcttcgccagtaatcgacccggcggcgaccactaatgtgagccgtgatcttgggctaattggaaccttgccctacatgccgccggagcagttgcgaggaaagccaacggacttccggagcgacatctattccgctggcgccgtgctctacgagttagcaacaggccgtcgcgcatttccagaaacacttgggccgcgcttgatagattcgattctgcacgaagtaccgcatccgcccagcagcctgacgcgctgggtgtcggnggcgttcgagactattgtcttgaaatgcctggagaaagaacccgagcgacgctatcaatcgtcagccgagctaggcgtggaccttcagcacctaagtacgtccacagcatcgctaccaacggagattgagaatgatgccaagagcaaagccaaagtgtgtgcggagatacttgcccagaaatacatgtttgtgaacaacgcgacgtcagactcaacttgccgtgtccgttcaattatttaaggtggaggaagggataattggctgccgaccgcgttcattcgaggcgatctggcnggcgactctctggcttcgctgatcgcacagatgcaattggccgtccggcggtcggcaagctaccgctttctccagcgagtccntatctaagcgtggtttgtcccaaatcatcantcgagagttgccaataaacttgaatgttgngccctgtttgggnngnannnnnnntcgtgaatcgctggttgggacacgacgccgcagcgaattgagaggnantcggttgcnntntnnantcnntngaantgnnntngntntnntntnnnntnnnnnnnngnnncnnngnngannannacgtnnnncngnggcnnntttnncnggnaannggnngncnncnnnnngnnnnngannnnnnggnnaggcngnaccnnnatnncgagnnngnnnnnnancnnntnnnngncnnnganttnnnccnngaanncnnngnnggnntncccgnngnantnggttncnnnnnnggnngacngngnnngcggctgncnnnnnnnnngnaaannnngncnngnaccnannnnaannnaggncnnnnnngnnnnntngcnttnnnnnttnncggnntnannnnnnntnnagnnttnntnagnantncnnnngnnngncgngnngnnngacgcccc

SEQ ID NO: 1048 - DNA, 4000 bp, Escherichia coli
  misc_feature (214)..(214): n is a, c, g, or t
  misc_feature (225)..(225): n is a, c, g, or t
  misc_feature (565)..(565): n is a, c, g, or t
  misc_feature (3320)..(3320): n is a, c, g, or t
  misc_feature (3390)..(3390): n is a, c, g, or t
  misc_feature (3643)..(3643): n is a, c, g, or t
ggacggagaacgtattttagaccttttcgcgtagttatcagtgcctcagtgttcgtcgatgtaaatggagagagacggattaatagcggcagataccaatttcgcacgagcacgacgaatccaatgaacaggttcataagcgcacctattctcttgacgttcgagaacaaccgcttgagttcgctcactggagtcacgttgatgtgcagacgcnattgcatgctntcacgttgtcacctattgtgcacaaaaatgttaaagtcagatcgtgaaggttatatcagacggcatcttccaaaatgtcttcaaaaatctaagtggcatctatcctcttctcataagtaagtaaatggccccgtcggtttggacgcaacaggtgttgctgttgtcggcgttattatagcggataaaataaacaacgaaagaatgcagcaagtcgttaaaaactttggaaactttgctttcatttcttttcaaacctccgtttgctgttctgttagctaagcgttcctcgctacacgctggatatgcaataggcaaacacagtatgtcactcaagacatangaaaacataaaaatgtatcgatgtatcgatacagtactataaagtgaatcagaaattctgtactaaatatttgtttagcgcgctgcgacttcactcgtctcgtcgtggggcccagttaaggacgacgattatggctgcgattatgccgacgaccattatcactgcgggaacggctagaccgtctaatagagcgccgcccgcaaaagcggatacgctctcattcgatgtattgtgattattcttcagcccgacaaccgatgtaagttgaatcgcgccgtactgccctataggatgaataagcgggtaagtgtcccccgtagtcgaaggagagtcgccgatgccgtttccatcgctgtctgctcctttgtaatcggagtagtaattgcctacgtagctcgaataggtgccgccgttgtaggtataagtgtacttctcggtcgagttcactaggtttccctctggacttgcaattgttgctgggttattcacgaagttgttgaggtagaagcgatttcctgacgaatagccactataaacagcgagtttagcgtttcctgagaatgtattaaaggtaaaagtgttgttatttgagtcatcacggaggcgaacggcaaactcctcatttgcattaatgctgttgttgcttagaacgttattagacgaactgagcaaggagatgccgtaaacgtggttattgctgaggacgttttgcactatggcatttgaatttgactcacgcatataaatcccgtcaccgagcgcgttaccgttccctttttcatacgtcgccacgttgccggaaaaggtatttcccgacgacccatcgaggtaaatgccatagccattattagagaggttgctggcgctcactttattgttggcggcatgctcgatgagcaccgcgtactcgttatcgtgcgcaattatatcagtcacactggactgtgatgcacctgaaaactccacaccagcgcgtccgcctgtaagcgtgagcccttctacccgtatgccgcttcctgagagcaaaaatacgtcgctagatggcacagccgcttttacagtcgttgttgccgccccgcccgatgatttaatgatgagcgatttgttgacaagcacgttctcgctatacgttcccggtggaatgaggattgtgtcgcctggttgagctgcatttactgccgcttggatcgttgtgtactgcccggtcccaacggtaatctcacctgcgcttgcaggtatgacgagccccatgagaagcgagaagagcaaaacgctgataagcgcccctgcgcgcacggcctttttcattgtcctgcgctcatgtggagagttagatcgggatcgggttctactaaagaacatttttagatgagagagatgatctaaacataagaatctttcacacgattagccctgcagccacatagctgcagcgcataaagcggccttttcttttacctgaattattatgtgtaatcatagttacatatgagcaactataaatatatatgtgggaagcggtactgcgtttaaatacagaacgtcggtgtgaagcaatgcttcgttgatcatttcgctgcgctgaagctcagaatatcaagcctgatatggatatgtgcgcagacgcgacgtcagaggacattataaatgggcagtgcagaaacaccatcagagcgctcaggtcgcctaccagagcttgacatacttcgagcatttgccatttgcttgatcgtgttctctcattttccgcccctctcaacactctacatcgacggatcagccaagctgtggtgtgccacctttggcctagcgcttttcctgtttctctctgggtttactttataccgcagcaacagcatcacaagcgttgccgatgtgcggttgttttacaaaaaacgcattatacggatttacccactttacgtgctgatcattgcggtttacgtgctgctccaagtcttgccgctcggtaattcattcctcgagaccacactggccccgacagaaatcgccgtgaatgtgatcggtttgcaagcgctcttgaatacgccctcatacaatgcgctctggtttattggattaattctgaccttttacttgatctacccggttatgatgctcgcaacctcagaaaaaaccgtcaggatcatcatcttttcgtgcgcgacgctcgcactctttgcatgcttgagaattgcatttgatatcgtcaaccttcgcctgatctattactacgtcatatttgtcggggggatccttgcgagtaaagcgcttttgacccatacacaccagtcacacttctcgactaggcgcagtcgcattgtctatctcgttggcgcgcttcccctcttaggcattgcaatggcgttttaccaacagaacctcggagaaacaggggagcttgtaaacttttatgccaatacagctaattacgtgccaaaggcgctgatttcgtttctatttatttcgtgcgcccttagtgctgcacgggtcgttaccatgacatttaagaagcgctactacgccccgctattctttatctcgtttctctcgtacagtatctacctcgttcaccccctgattctcaccgcgtgcacacgagcaacgctcgttgctccgcaactaacaggagcacaacttgatgcaatactcatatttattggcatcccagcgatagtgttagcttcatacctactccagaaaggtgctgatacgctcacgttcagtttgcgtatgcgaagaatgagtgaatacngcaatgatcctcagacgtgagctcggtgcgacgtgttatgtaatgagagttattagccgcggaccgcagngaatcaaacacttctcaactctaatgactagtgctgcctgaactcaagcgggtgatcgttaaattaaacgtgcgttacggcgtaaaaaatcaaaaaattcgcatctttttattcataatattctttttgatcatatctagagcggtttccagcgctccgcgaactgtatcgtcttgctcatcgttcaatgcgtagacaagcgacgctgttgcactcgcatcgcctatcatcccaagggccaaggcaacacttngccgcacgtctgcattgctgtccttcaaggccgacgttaagggttctattgcttgtgcctcttccagctctccgagcatctctgcggcgctctgccgaacctctgggcttttgtcattcaacctagcgattaactcatcaacttttgtcccggagctcattgttcccacattatagtaactaacgcgctgttacggccttcacacagttagataacgaggccgacccccgacaattctttacagtcgttaaggtcgcagtatattgtttttagttctcgcccaacatgcccatcggcggcatgttcatcgccgggtgacatatcctcgtcaagtattcttttaactcgtcagcggat

SEQ ID NO: 1049 - DNA, 4000 bp, Escherichia coli
  misc_feature (1979)..(1979): n is a, c, g, or t
  misc_feature (1985)..(1985): n is a, c, g, or t
  misc_feature (1992)..(1992): n is a, c, g, or t
  misc_feature (2300)..(2300): n is a, c, g, or t
  misc_feature (2303)..(2303): n is a, c, g, or t
  misc_feature (2305)..(2305): n is a, c, g, or t
  misc_feature (3018)..(3018): n is a, c, g, or t
  misc_feature (3130)..(3130): n is a, c, g, or t
  misc_feature (3138)..(3138): n is a, c, g, or t
  misc_feature (3267)..(3267): n is a, c, g, or t
  misc_feature (3370)..(3370): n is a, c, g, or t
  misc_feature (3405)..(3405): n is a, c, g, or t
  misc_feature (3612)..(3612): n is a, c, g, or t
  misc_feature (3696)..(3697): n is a, c, g, or t
  misc_feature (3701)..(3701): n is a, c, g, or t
  misc_feature (3809)..(3809): n is a, c, g, or t
  misc_feature (3813)..(3813): n is a, c, g, or t
  misc_feature (3815)..(3815): n is a, c, g, or t
  misc_feature (3818)..(3818): n is a, c, g, or t
  misc_feature (3826)..(3826): n is a, c, g, or t
  misc_feature (3830)..(3838): n is a, c, g, or t
  misc_feature (3842)..(3843): n is a, c, g, or t
  misc_feature (3849)..(3850): n is a, c, g, or t
  misc_feature (3855)..(3856): n is a, c, g, or t
  misc_feature (3858)..(3858): n is a, c, g, or t
  misc_feature (3860)..(3861): n is a, c, g, or t
  misc_feature (3864)..(3867): n is a, c, g, or t
  misc_feature (3871)..(3871): n is a, c, g, or t
  misc_feature (3874)..(3876): n is a, c, g, or t
  misc_feature (3878)..(3878): n is a, c, g, or t
  misc_feature (3880)..(3881): n is a, c, g, or t
  misc_feature (3883)..(3883): n is a, c, g, or t
  misc_feature (3886)..(3886): n is a, c, g, or t
  misc_feature (3890)..(3890): n is a, c, g, or t
  misc_feature (3894)..(3898): n is a, c, g, or t
  misc_feature (3900)..(3900): n is a, c, g, or t
  misc_feature (3904)..(3904): n is a, c, g, or t
  misc_feature (3906)..(3906): n is a, c, g, or t
  misc_feature (3908)..(3908): n is a, c, g, or t
  misc_feature (3912)..(3913): n is a, c, g, or t
  misc_feature (3968)..(3968): n is a, c, g, or t
  misc_feature (3975)..(3975): n is a, c, g, or t
  misc_feature (3987)..(3987): n is a, c, g, or t
  misc_feature (3996)..(3996): n is a, c, g, or t
  misc_feature (3999)..(3999): n is a, c, g, or t
caccccagcggcggtgaacgcttttctatcgttccgccatcccggccccatggcccgtttcgcgaagcgcgtcctttccatcgagccctctcccacggtccgcatcagcgatctcatcgccgaatcccagggccaagggaagaagatcctctccctggccatcggcgagccggatttcccgacccccgcgcacatcgtcgacgcggcgaagaaggccctcgacgacggctacacgaaatacaccgcggcccccggtatccgcgaactgcgcgaggcaatcgccgagaagtcacaaaaggagaacgggattcccgcgaaggcggagaacgtgatcgtcgcgccgacgaaacacacgctcttcatgacgttcatgtcgctcctcgatcccggggacgaagcgctgatccccgatcccggctgggtctcctacgcgccgatggcgagcctcgcgggtgcgaagcccgtgccgatccgcgcggcggacgaagacggattcgtgccttcgacggagaccgtcgcggatgcgatcaccccgcggacccggctcatcgtgctgaactcgccgtcgaatcctgccggctcggtgtactcgcggtcccagatgcgtggcctcgcggacctcgcggcggaccacgacctcaccgtcgtgagcgacgagatctacgagaagattctgtacgagggcgagcacgtctcgcccgcgtcgctggacggcatgttcgaccgcaccgtcaccgtgaacggcttctcgaagacctactcgatgacgggctggcggctgggctggctcgtcgccccgacgccgatggtccggcagatcgggaaggtgcaggaacacacgatcacctgcgcgaccgcgttcgcccagaaggccggcgtcgcagcgctccgaggtcccacggctccgttgaaggcgatggtcgacgaattccgggcgcgacgggagattgtcctcggagaactcaagaagatcgaccggctctcaacggatcgaccgagtggcgcgttctacgtgttcccgcggctcgacgtcggattgaagagcgcgtccctcgctgaacggatcctccaggaggcgaacgtcgcggtgaccccggggagcgccttcggcgaggccggggagggccacctccgtctctcgtatgccgcctctcgcgagacgatcgtcgaatgcatccgccggatcggggacgtcctcaagggcatctgacgagtcttccggcgggaacgatcgagagtgcgttcagccgtctcccggcaggagttaagtatccgcgtccgcgtttcgcagggcgagggaacgagatggcgcaagacgagcgggaggagatgccgacgatcgtgccaatggtcgcctacgaggaccccgccacggcgatcgattggttggtccgtgccttcgggttccgggaacgcaaagaccagcggatgaaggaccgcgacgggcggatcacgcacgccgagctgcgactcgggaaaggccgggtcttcttggccaccccgacaccggactaccagagcccgaagcatcaccgggagacgtgcgcggccgcgcgcaagtggtcttcggtcccatgggtcatcgacgggctgcttgtccacgtggacgatgtcgatcgtcacttcgctcgcgcgaagagcgagggcgcgaccatgctctccgatctcgaggacaacccggtcgggcggctataccgggccgaggacctcgaagggcatcggtggatgtttctcaaacctcgtccgtgatttcatccgatggccggggtgagaactagcctttcgcgccgcgtgctcgaaggagatccgcgatggccgcatggcctttctccttcgcgtcgtccaacggcgtgtgcccgccatctcggaccgcgtggacgtccgcgccgtggtccaggagcatgcggacgacgtcgagattcccgtgcaccgcggccttgtggagcgtcgtgtaattcgcctcgctcctgacgttcggnttcgcncccgccncgagcaagatccgcacgacgtccgcgtggtctcccgagacggccgcgtcgaccgccgtgttcgcgaaccgactcggtggtttgtggttcacgtcggcgccgtactcgaggaggaccttgaccgcctcgggatgaccgaagaacgccgcgaggccgagcgggtcgaagccttcctccttgttcgcctcgttgacccggacgcgagactgcccgaggatcgtcttcagccggcgggcgttcccgaccgtcgcggcctcatacaggttcagcgcgtcttccggcgtcctggcgagcagcagcttgacgacntcngncgccccgtagaaagtggcggtcaggacgagcgtgccgttcggggttttcatccggaggagcggcggatggcgatcgaggatctcctgggccttcgccaggtcgttcttctgcaccgccttgagcaagtcgtcctcgtcccccatggcctgtcccccgagagcggccgggaacgcggtcgcgcgcctatgaacgttgcgccgctcaggtgacgacctgggtctcgccgcacgaggggcacatgacctcgatcggacggcggctcgtcgacaggtcgatcggtttgccgcagcggcgacaggtgatcgacatcggcgaggtgggcgccgagcggaccggcccttcgggaggcgggggcgggacggccgctttgccgccaatcgggccgaagccgcctccggatcgcctccacatcgcgatcacggcgatcaggagcaggacgaacagcgcgctgaggacgatcgcaaagacgggggcgccgccgacgtccgtggaccagaacgaactcccggtcgggccgacctggaccgtctggaacgcgctcgccccggtgttcagttcattcgcgaacacgagcaggcctccgttcccggtgcccgcggggatcgtcaggaagagatccgcggctgggcccgtggtgatggccgtggccgaggccgacgcggacgacaaggaccagcggaactggctcgggagcgaccccgtgcctttcgcngtcagggtgaggtgcgcgtggactgtctcgcccgcgccgtacgaggtcctgtcgaagctcaagccgaggacgaagccggcggcctgggagatcgtcgcctgcgcctgggtgntgttcccncggtccgtggcggtcacgtggaacgtgtagctgcggctcgacgggttcggggtgcggaacgagaagaacgtcgcgttcgtggtgcccgacaagacgatgaccgcgttcgtgtcgtcgacctcgtacgcntacgaggggttcgtgatgacgtgcgaggagacgccgtagaaggcgctgattatctcgccagggttgtagtcgccgcggtcgaggctcagggccatgtacgccngggcgaccgtcccactctgctggccggccgcgacngttccctggccgtcgtccacggtcgcctcgaagcgcaaggtgccggtgtagccgagggcgatcggataccggaacgtggcccccgcagtcgtggtcgtgttcaggagttggaagaagaagttccggacgcgccacacgtacgtgtagttcccgggcgcgggcgtgcggtacacgatcgcctgtgcggccgcggtgtcgccgctcagntacgacgacttgtcgaggaccaccgtgacggtcatcgccgcgggctggatcggattcggagtcggcatggcgttcgcggttggnntcanggcggcgagggccagaagcccgatcacgaacgcgaatgcgagtgcacaggccctcgatagcagggcggatgacatgcggtgtcccatcccggtgtccgcagggagaancccngnggncggggcgncatnnnnnnnnncctnnttaatnntttgnncngnnggnnnnccgncgnnntncnncnggnattncggnnnnntnttcngntncggnngtggtcctggttggaaccgcaagacccacgttcaggatccgaccgcgggcgtcgncccgccnccttggaggcgngcgaacagntcnt

SEQ ID NO: 1050 - DNA, 4000 bp, Escherichia coli
  misc_feature (7)..(7): n is a, c, g, or t
  misc_feature (10)..(10): n is a, c, g, or t
  misc_feature (33)..(33): n is a, c, g, or t
  misc_feature (118)..(118): n is a, c, g, or t
  misc_feature (235)..(235): n is a, c, g, or t
  misc_feature (298)..(298): n is a, c, g, or t
  misc_feature (311)..(311): n is a, c, g, or t
  misc_feature (424)..(424): n is a, c, g, or t
  misc_feature (545)..(545): n is a, c, g, or t
  misc_feature (817)..(817): n is a, c, g, or t
  misc_feature (932)..(932): n is a, c, g, or t
  misc_feature (1112)..(1112): n is a, c, g, or t
  misc_feature (1313)..(1313): n is a, c, g, or t
  misc_feature (1322)..(1322): n is a, c, g, or t
  misc_feature (1419)..(1419): n is a, c, g, or t
  misc_feature (1799)..(1799): n is a, c, g, or t
  misc_feature (1877)..(1877): n is a, c, g, or t
  misc_feature (2004)..(2004): n is a, c, g, or t
  misc_feature (2939)..(2939): n is a, c, g, or t
  misc_feature (2963)..(2964): n is a, c, g, or t
  misc_feature (2991)..(2991): n is a, c, g, or t
  misc_feature (2995)..(2995): n is a, c, g, or t
  misc_feature (3000)..(3000): n is a, c, g, or t
  misc_feature (3003)..(3003): n is a, c, g, or t
  misc_feature (3009)..(3009): n is a, c, g, or t
  misc_feature (3013)..(3013): n is a, c, g, or t
  misc_feature (3016)..(3017): n is a, c, g, or t
  misc_feature (3019)..(3020): n is a, c, g, or t
  misc_feature (3022)..(3022): n is a, c, g, or t
  misc_feature (3024)..(3024): n is a, c, g, or t
  misc_feature (3028)..(3028): n is a, c, g, or t
  misc_feature (3030)..(3030): n is a, c, g, or t
  misc_feature (3032)..(3034): n is a, c, g, or t
  misc_feature (3037)..(3039): n is a, c, g, or t
  misc_feature (3041)..(3042): n is a, c, g, or t
  misc_feature (3044)..(3044): n is a, c, g, or t
  misc_feature (3046)..(3055): n is a, c, g, or t
  misc_feature (3058)..(3060): n is a, c, g, or t
  misc_feature (3066)..(3066): n is a, c, g, or t
  misc_feature (3068)..(3070): n is a, c, g, or t
  misc_feature (3078)..(3078): n is a, c, g, or t
  misc_feature (3083)..(3083): n is a, c, g, or t
  misc_feature (3085)..(3094): n is a, c, g, or t
  misc_feature (3097)..(3098): n is a, c, g, or t
  misc_feature (3100)..(3101): n is a, c, g, or t
  misc_feature (3106)..(3115): n is a, c, g, or t
  misc_feature (3117)..(3117): n is a, c, g, or t
  misc_feature (3119)..(3121): n is a, c, g, or t
  misc_feature (3123)..(3124): n is a, c, g, or t
  misc_feature (3128)..(3135): n is a, c, g, or t
  misc_feature (3137)..(3138): n is a, c, g, or t
  misc_feature (3141)..(3142): n is a, c, g, or t
  misc_feature (3144)..(3144): n is a, c, g, or t
  misc_feature (3146)..(3150): n is a, c, g, or t
  misc_feature (3152)..(3156): n is a, c, g, or t
  misc_feature (3158)..(3159): n is a, c, g, or t
  misc_feature (3161)..(3161): n is a, c, g, or t
  misc_feature (3163)..(3163): n is a, c, g, or t
  misc_feature (3165)..(3169): n is a, c, g, or t
  misc_feature (3171)..(3174): n is a, c, g, or t
  misc_feature (3176)..(3191): n is a, c, g, or t
  misc_feature (3193)..(3215): n is a, c, g, or t
  misc_feature (3218)..(3224): n is a, c, g, or t
  misc_feature (3226)..(3424): n is a, c, g, or t
  misc_feature (3426)..(3473): n is a, c, g, or t
  misc_feature (3475)..(3854): n is a, c, g, or t
  misc_feature (3856)..(4000): n is a, c, g, or t
ccgctcnacngaggctaagaagtaagcacttcncagccctcccccacttcatatagcaagccgggcaccctccccatctgaggatgcccggcttgtcgcttaatgaacaattcgcccnctctcacgcttatcataccaacgagcagtattctatcacctcgtagcaactaactgaataatgaagaaagtcatcctcagcctcgccctcatctccgcaggtctcttctcgagctangcctgcacggccaaggcttcgagcaacgctgcttctgcctccaccgagacgaccgcagctgcncccagcgaagaanctgctgccgacgacaaggccgcagaaggcgctatcaagcacatcgacgcagcctacctgcgcaagtacatctgggactataaggaagagccctcgaagttcgtcttcaagggnagccgtcccgctatcctcgacttctacgccgactggtgcggtccctgccgtaagctcagccccaagctcgaagctatcgctaagaagtatgcgggtaagatcgacgtctacaagatcgatntcgacaaggaagctggtctggccaatatcttcggtgtgaagagcatccctatgtgcctcttcatccctatgcagggtacgcccatccagacggtaggcgatctcactcccgatcagatcgaggagaccatcaagcagatctactccgacgctaagtaagcccagcgagtcattcgcatctacaataaaagctcatccccacaccgcctgatggcagtgtggggatgagcttttattgtagcgtccgagtgaggaagtcgcttacttcttcgnaggacgggggatgaagtcgaagcccgtgtaaggacgaagagcctcggggatgcggataccttcgggcgtctggttgttctccagcagtgctgcgacgatacggggcagagccagngcactaccattgagcgtgtgcacgagctggacaccctgctcagcgtcacgatagcggcagcgcaggcggttggcctgatagctctcgaagttcgacacagagctgacctcgagccaacgcttctgtgcagcagagaagacctcgaagtcataggtcagcgcgctggtgaagctcatatcnccaccgctcagacgcaggatgcgccagggcagctcgagcttcgtgacgagcgtctctacgtaggcgaccatctcatcgaggcgctgatagctgcgctcgggcttgtcgatgcagacgatctcgaccttgtcgaactggtggaggcggttcagaccacgcacatccttaccatacgacccagcttcgcggcggaagcaggcngagtaagcngtgttgcgtacgggcagatccttctcctcgaggatgacgtcacgatagatattcgtcacaggcacctcagccgtggggatgagatagaggttgtccnccgtagcgtggtacatctgcccttccttgtcggggagctgacccgtgccgtagccagagtcttcgttgacgacgtagggaggctgtacctcgaggtaaccagcttcacgagcattgtcgaggaagaagttgatgagcgcgcgctgcaggcgagctccataacccttatagacggggaagccagcacccgagatcttcacacccagctcgaagtcaatgaggtcatagtccttcgccagctcccagtggggctcggcggtagcatcgagtgcgggcatctcgccaccagtcttgacgcagacgttgtcctcagccgtagcgccttcgggcacgatgtcggcggggaggttaggtacagagagcaggatctcacggatcttngcttcggcctcggccttcttctcctcaaggctcttgcttgcctccttgagcagtgccacctgagagcggatgctctcngcctgctccttggcgccctgcttcatcagatcaccgatctccttagcgagggccttctgacgagagaggctggcatcgagctcctgctgagagcgacggcggatctcatcgaagttcaggacttcgntgatcgcttcgcgtgcctcgaattgcttcttgcggaggcgctcaatgaccgcctcggtattctccttgatttgcttgagtgtaagcataatgtctcgtgtggggtataatgagaggaggtcgctccctccgggctgtgtagacccttctggagcaacctccggttgacttgtctgacgtgtgctccgtcttaggcctcagccgcgatggagacgtacgagcggtcgttcttcttgcgagtgaagaccaccttaccgtcgatcagtgcatagagcgtgtggtccttaccgatacctacgcctgcacctgggtgatgctgcgtgccacgctggcggacgatgatgttaccagccttagcgtgctgaccaccgaagagctttactccgagtcgcttactttctgattcgcgtccgttcttggagctacctacaccttttttatgtgccattgtcttatgtctaaactaatgcggtgatacaattacttacgctacgatttccttgacgaggacttcgctgaactgctggcggtggccattgagcttgcgatagcccttacggcgcttcttgtggaagacaagtaccttgtcgccctttacaagaggcgtgatgatttcgcacacgaccttagcaccagccactacaggcgtacctacagtgacagcaccatccttgtctacgaggaggaccttgtcgaattctactactgcgccactctctgcacccttgacgtggtgaatgaagaggcgacggccctgttctacattgaactgctggccctgaatgtctacgatgacgtacattatcgttgataactaaaaagttagccccgtagggtgccacccgctccacggcggagggatagacttcttctcctaccctacataggaaattcggtcacaaagatacaaaaatatctgatacaacaccttgcacncccttgactttcaccgaagaaacnncctcagtccgagctcttcccctacccnacanaaggnaanatctcncccnccnnannancncccncngnnnccnnncnnancnnnnnnnnnnacnnnaagggntnnnaacctatnttggncnnnnnnnnnnccnntnntggtnnnnnnnnnnancnnnannggtnnnnnnnncnnccnntntnnnnncnnnnnannancnannnnngnnnnannnnnnnnnnnnnnnngnnnnnnnnnnnnnnnnnnnnnnnaannnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1051 - DNA, 4000 bp, Escherichia coli
  misc_feature (458)..(458): n is a, c, g, or t
  misc_feature (1431)..(1431): n is a, c, g, or t
  misc_feature (1992)..(1992): n is a, c, g, or t
  misc_feature (3354)..(3355): n is a, c, g, or t
  misc_feature (3357)..(3362): n is a, c, g, or t
  misc_feature (3364)..(3365): n is a, c, g, or t
  misc_feature (3367)..(3378): n is a, c, g, or t
  misc_feature (3380)..(3385): n is a, c, g, or t
  misc_feature (3387)..(3387): n is a, c, g, or t
  misc_feature (3389)..(3389): n is a, c, g, or t
  misc_feature (3391)..(3391): n is a, c, g, or t
  misc_feature (3394)..(3394): n is a, c, g, or t
  misc_feature (3397)..(3398): n is a, c, g, or t
  misc_feature (3401)..(3402): n is a, c, g, or t
  misc_feature (3404)..(3405): n is a, c, g, or t
  misc_feature (3410)..(3410): n is a, c, g, or t
  misc_feature (3413)..(3418): n is a, c, g, or t
  misc_feature (3420)..(3420): n is a, c, g, or t
  misc_feature (3425)..(3428): n is a, c, g, or t
  misc_feature (3430)..(3431): n is a, c, g, or t
  misc_feature (3433)..(3443): n is a, c, g, or t
  misc_feature (3445)..(3446): n is a, c, g, or t
  misc_feature (3448)..(3450): n is a, c, g, or t
  misc_feature (3453)..(3453): n is a, c, g, or t
  misc_feature (3456)..(3459): n is a, c, g, or t
  misc_feature (3461)..(3461): n is a, c, g, or t
  misc_feature (3463)..(3463): n is a, c, g, or t
  misc_feature (3465)..(3469): n is a, c, g, or t
  misc_feature (3471)..(3471): n is a, c, g, or t
  misc_feature (3473)..(3476): n is a, c, g, or t
  misc_feature (3478)..(3478): n is a, c, g, or t
  misc_feature (3480)..(3480): n is a, c, g, or t
  misc_feature (3482)..(3485): n is a, c, g, or t
  misc_feature (3487)..(3492): n is a, c, g, or t
  misc_feature (3494)..(3497): n is a, c, g, or t
  misc_feature (3502)..(3502): n is a, c, g, or t
  misc_feature (3504)..(3504): n is a, c, g, or t
  misc_feature (3507)..(3507): n is a, c, g, or t
  misc_feature (3509)..(3514): n is a, c, g, or t
  misc_feature (3517)..(3521): n is a, c, g, or t
  misc_feature (3524)..(3528): n is a, c, g, or t
  misc_feature (3530)..(3539): n is a, c, g, or t
  misc_feature (3541)..(3542): n is a, c, g, or t
  misc_feature (3544)..(3548): n is a, c, g, or t
  misc_feature (3550)..(3550): n is a, c, g, or t
  misc_feature (3552)..(3560): n is a, c, g, or t
  misc_feature (3562)..(3572): n is a, c, g, or t
  misc_feature (3574)..(3576): n is a, c, g, or t
  misc_feature (3578)..(3582): n is a, c, g, or t
  misc_feature (3587)..(3595): n is a, c, g, or t
  misc_feature (3597)..(3597): n is a, c, g, or t
  misc_feature (3599)..(3602): n is a, c, g, or t
  misc_feature (3607)..(3612): n is a, c, g, or t
  misc_feature (3614)..(3614): n is a, c, g, or t
  misc_feature (3616)..(3618): n is a, c, g, or t
  misc_feature (3620)..(3620): n is a, c, g, or t
  misc_feature (3623)..(3627): n is a, c, g, or t
  misc_feature (3629)..(3631): n is a, c, g, or t
  misc_feature (3633)..(3635): n is a, c, g, or t
  misc_feature (3637)..(3637): n is a, c, g, or t
  misc_feature (3639)..(3643): n is a, c, g, or t
  misc_feature (3645)..(3648): n is a, c, g, or t
  misc_feature (3652)..(3669): n is a, c, g, or t
  misc_feature (3671)..(3676): n is a, c, g, or t
  misc_feature (3678)..(3678): n is a, c, g, or t
  misc_feature (3680)..(3680): n is a, c, g, or t
  misc_feature (3682)..(3682): n is a, c, g, or t
  misc_feature (3685)..(3686): n is a, c, g, or t
  misc_feature (3688)..(3693): n is a, c, g, or t
  misc_feature (3695)..(3695): n is a, c, g, or t
  misc_feature (3697)..(3702): n is a, c, g, or t
  misc_feature (3704)..(3704): n is a, c, g, or t
  misc_feature (3706)..(3706): n is a, c, g, or t
  misc_feature (3708)..(3718): n is a, c, g, or t
  misc_feature (3720)..(3720): n is a, c, g, or t
  misc_feature (3722)..(3727): n is a, c, g, or t
  misc_feature (3729)..(3730): n is a, c, g, or t
  misc_feature (3734)..(3734): n is a, c, g, or t
  misc_feature (3736)..(3738): n is a, c, g, or t
  misc_feature (3742)..(3743): n is a, c, g, or t
  misc_feature (3745)..(3745): n is a, c, g, or t
  misc_feature (3748)..(3752): n is a, c, g, or t
  misc_feature (3755)..(3755): n is a, c, g, or t
  misc_feature (3757)..(3758): n is a, c, g, or t
  misc_feature (3760)..(3763): n is a, c, g, or t
  misc_feature (3765)..(3769): n is a, c, g, or t
  misc_feature (3772)..(3773): n is a, c, g, or t
  misc_feature (3775)..(3776): n is a, c, g, or t
  misc_feature (3778)..(3779): n is a, c, g, or t
  misc_feature (3781)..(3783): n is a, c, g, or t
  misc_feature (3785)..(3786): n is a, c, g, or t
  misc_feature (3791)..(3793): n is a, c, g, or t
  misc_feature (3796)..(3796): n is a, c, g, or t
  misc_feature (3798)..(3798): n is a, c, g, or t
  misc_feature (3800)..(3801): n is a, c, g, or t
  misc_feature (3803)..(3804): n is a, c, g, or t
  misc_feature (3808)..(3812): n is a, c, g, or t
  misc_feature (3814)..(3814): n is a, c, g, or t
  misc_feature (3816)..(3818): n is a, c, g, or t
  misc_feature (3820)..(3822): n is a, c, g, or t
  misc_feature (3824)..(3825): n is a, c, g, or t
  misc_feature (3827)..(3833): n is a, c, g, or t
  misc_feature (3837)..(3837): n is a, c, g, or t
  misc_feature (3839)..(3849): n is a, c, g, or t
  misc_feature (3851)..(3853): n is a, c, g, or t
  misc_feature (3855)..(3856): n is a, c, g, or t
  misc_feature (3859)..(3859): n is a, c, g, or t
  misc_feature (3861)..(3862): n is a, c, g, or t
  misc_feature (3864)..(3866): n is a, c, g, or t
  misc_feature (3869)..(3870): n is a, c, g, or t
  misc_feature (3875)..(3881): n is a, c, g, or t
  misc_feature (3883)..(3884): n is a, c, g, or t
  misc_feature (3886)..(3888): n is a, c, g, or t
  misc_feature (3890)..(3891): n is a, c, g, or t
  misc_feature (3893)..(3897): n is a, c, g, or t
  misc_feature (3901)..(3901): n is a, c, g, or t
  misc_feature (3903)..(3903): n is a, c, g, or t
  misc_feature (3905)..(3906): n is a, c, g, or t
  misc_feature (3908)..(3917): n is a, c, g, or t
  misc_feature (3920)..(3921): n is a, c, g, or t
  misc_feature (3923)..(3925): n is a, c, g, or t
  misc_feature (3928)..(3931): n is a, c, g, or t
  misc_feature (3935)..(3935): n is a, c, g, or t
  misc_feature (3937)..(3940): n is a, c, g, or t
  misc_feature (3942)..(3942): n is a, c, g, or t
  misc_feature (3945)..(3948): n is a, c, g, or t
  misc_feature (3950)..(3952): n is a, c, g, or t
  misc_feature (3954)..(3954): n is a, c, g, or t
  misc_feature (3956)..(3958): n is a, c, g, or t
  misc_feature (3961)..(3965): n is a, c, g, or t
  misc_feature (3968)..(3972): n is a, c, g, or t
  misc_feature (3980)..(3980): n is a, c, g, or t
  misc_feature (3982)..(3982): n is a, c, g, or t
  misc_feature (3985)..(3987): n is a, c, g, or t
  misc_feature (3989)..(3989): n is a, c, g, or t
  misc_feature (3991)..(3992): n is a, c, g, or t
  misc_feature (3995)..(3995): n is a, c, g, or t
  misc_feature (3999)..(4000): n is a, c, g, or t
ccgcctccaaagccgcgtctgatcatctggtgcgcgcttaccaccatacctatggactacctaccctcacgacgaactgttctaacaactatggtccgtttcaatttccagagaaactgattcctctagtgattctcaacgcgctaaacggaaaaccaattccggtatacggagacggcgcgaacatccgcgactggctgtatgtcatcgatcattgcgaagcgatacaagctgtactggagcgtggaaacattggcgccacctacaacatcggaggtgggaacgaacgcaccaaccttgaaatcgttcgtaccatctgttcactactcgacgaacttcggccaaacgatccaatcgtgccgcacgagaacttgatcacgttcgtgaaagatcgtcctggccacgatcgacggtatgccatgaacgccgcaaagattgagtctgaaataggctggcgnccgcgagagacttttgagaccgggattcgaaagacgatcaattggtacttagcaaacgaaggttgggtcgagcaagtaacgagtggcagttatcgtcagtggatggcatcgcagtactctttgtagttcaatccgaatgacactcactccggaaaataacgttcgtttcaaaggcatcatcctggctggaggctcgggcacccggttgtatcccgtcacccacgcgatcggaaaaagcttgctgccgatctacaacaagcccttgatctattacccgctctgcacgctcatgctggccggcgtccgggagattctcatcatctcgacggcccaggacactccccgaattgaacaggttttaggcgacggatcgcgcttcggtctgtcacttcggtacgccgtgcagcccaagccggaaggcatcgcccaatcgtttttaattggagagaaatttctcgacggcgcaccttgcacgctggtccttggtgacaatattttttacggccacgatcttgcaaagagcctgcgcagtgctgcttatcaaaccaatggtgcacgcatcttcgcctatcccgtgcaagacccgcagcgttacggagtagttgaatttgattcttccggccgtgccctgagcctcgaagagaaacccaagcttccaaagtcgagatatgcggttacgggcctctacttttacgaccacgaggttgtcgacatcgcgcgaacactcaagccctcagcccgcggagaattggaaatcaccgacgtcaatcggacctatttggaccgcaagaaactcaccgtcgagttgatgggccgcggcatggcttggctcgatactggaacacacgagtcgatgatggaggcgtccttgttcattcaggcaatcgagcgccgccagggactgatggtggcctgtcctgaagagatcgcctaccgctcgggctacattacagcaagcgatatcgaaaggctngcggcgaccatgcagaacagtgggtacggcgcctatctactgcagcttctgacggaacaggtgttttgaatgaaagcgacgcccgcccgcacgccttccctcgctgtcgggagaacgaagctatccggcgtcctgcggctcgagccgcgcgtcttcaccgatgaccgtgggtttttcttcgagagttataacgaagccaccatggctgaggtcgggatcgcggcgcatttcgtgcaggacaaccactcgtcctcactgaaaaatgtaatacgtggactgcactatcagattgaacaccctcaagccaagctcgttcgtgtcgtcagtggagaaattctagacgttgcggttgacttgagacgaagttcgcctacttttggacaatctctggttgagcatctctcggcggaaaacaagaaaatgttgtggatccccgtgggcttcgcccacggttttcgcgtcctgtctgagtccgcggacgtcctgtacaaagctaccgacttttatgaccctgcctcggagcgcacgatcgcctggaatgacgttgacttggccatcgantggcgaacgacttcttctccgatagtctccgcgaaagacgcgagcggcatttcctttaaagaagctccaaaattttgatttttcgaagctcgttcatcgtctcaaaatcctttatccatttgaaatggatttcagatcaaactcttcttccgccatcttcgtaatcgcttgacctatggcaatcgatgcggtggctgctggcgacggcacgttatacacgtggagcatgttctttttccgcacgaactggaagtcgtctatcagggagccatcccttttcaatgcttgcgcgcgcacgcccgatccgtccgcgaccaagtcgctcgcttgaatttccggaaccaagcgttttagcgctcgcacgaaagccctcttgttgagcgatcgatacatttcacccgccccatagcgccaatacgttcccgccaagcgccagaaacctggaaatgcgaatgtccctgccgcatcccgaacgctaatctgattccaccgatatccctctcgcttcaatgccagaaccgcgtttgggccaacgtcgacacctccgtgaattcgccgtgtaaagtgaacgccgaggaaggggaaccgcgggtcgggcacgggatagatgagcccacggaccagatgctctcgttccggaatcagatcgtagtattcgccacggaagggaacgatcgcgacttcagggcgctctcctgccaagcggctgactcggtcgctgtggagcccagcgcaattgataacatagggcacctcaatcgagcccctgttggtttcaaccactgtcgtgttatcgcgatatacgaaccccagcaccttggtcgaggtgctaatgcttccaccgttgcgcgcgatcagctccgcatacttctcgcacacctcaacatagtcgacgattcccgtcgacggaatgtgcaggcctccgagtccgccgcaatggggttcaagttcgcgaacttgttcttgagctagcaacgtcgctcccctcagaccattagcagatgctcgacccagcagcgcttgcagtcgcggaagctcgtcctgagcggtggcgacgatcaccttgccgcaaatttcgtgtttgatcccgtgctctcgacaaaaagcgatcatcgccatcgccccttgaacgcaaagcttggccttcagagaaccgggcgggtaatagattccggaatgaatgaccccgctgctgtggccgctttggtgtcgagcaacgcgatcttctttctcgaccagcagaagacgcaagtgtgggaaggatgtgcttaatgcgagtgccgtagcgagtccgacgatacccccgccgatgacgaggatgtcgcgtcgctgatcaggcatacacctagtttactcggcccnngnnnnnnannannnnnnnnnnnntnnnnnnantnanttnggnntgnntnngttcngtnnnnnnanaaaannnngnncnnnnnnnnnnngnngnnnggncgnnnngncngnnnnnantnnnntntngnnnngnnnnnntnnnnttgantngantnnnnnntcnnnnntcnnnnncnnnnnnnnnnanngnnnnnanannnnnnnnntnnnnnnnnnnngnnncnnnnntcgcnnnnnnnnntncnnnnctcgnnnnnngngnnnanttnnnnntnnngnnngncnnnnntnnnnccgnnnnnnnnnnnnnnnnnnannnnnnancngnacnngnnnnnntncnnnnnnangntnnnnnnnnnnnangnnnnnnanncgcncnnnccgnncngcnnnnngancnncnnnncnnnnntcnngnngnncnnnannttagnnnagncngnncnnctcnnnnngngnnngnnntnnannnnnnngttnannnnnnnnnnngnnnannggntnngnnnaanngaaannnnnnncnngnnnanntnnnnnctgncngnncnnnnnnnnnnganntnnnccnnnncgcncnnnncnttnnnncnnncngnnnggnnnnnttnnnnnccgaccgnancgnnncngnncgnaagnn

SEQ ID NO: 1052 - DNA, 4000 bp, Escherichia coli
  misc_feature (624)..(624): n is a, c, g, or t
  misc_feature (1987)..(1988): n is a, c, g, or t
  misc_feature (2004)..(2004): n is a, c, g, or t
  misc_feature (2241)..(2241): n is a, c, g, or t
  misc_feature (2250)..(2261): n is a, c, g, or t
  misc_feature (2263)..(2268): n is a, c, g, or t
  misc_feature (2270)..(2270): n is a, c, g, or t
  misc_feature (2273)..(2273): n is a, c, g, or t
  misc_feature (2275)..(2276): n is a, c, g, or t
  misc_feature (2278)..(2284): n is a, c, g, or t
  misc_feature (2286)..(2291): n is a, c, g, or t
  misc_feature (2294)..(2295): n is a, c, g, or t
  misc_feature (2297)..(2300): n is a, c, g, or t
  misc_feature (2302)..(2303): n is a, c, g, or t
  misc_feature (2306)..(2306): n is a, c, g, or t
  misc_feature (2308)..(2308): n is a, c, g, or t
  misc_feature (2310)..(2312): n is a, c, g, or t
  misc_feature (2314)..(2315): n is a, c, g, or t
  misc_feature (2317)..(2321): n is a, c, g, or t
  misc_feature (2323)..(2323): n is a, c, g, or t
  misc_feature (2325)..(2339): n is a, c, g, or t
  misc_feature (2341)..(2342): n is a, c, g, or t
  misc_feature (2344)..(2350): n is a, c, g, or t
  misc_feature (2352)..(2354): n is a, c, g, or t
  misc_feature (2356)..(2357): n is a, c, g, or t
  misc_feature (2361)..(2364): n is a, c, g, or t
  misc_feature (2366)..(2387): n is a, c, g, or t
  misc_feature (2389)..(2394): n is a, c, g, or t
  misc_feature (2396)..(2404): n is a, c, g, or t
  misc_feature (2406)..(2406): n is a, c, g, or t
  misc_feature (2408)..(2410): n is a, c, g, or t
  misc_feature (2412)..(2412): n is a, c, g, or t
  misc_feature (2414)..(2417): n is a, c, g, or t
  misc_feature (2419)..(2422): n is a, c, g, or t
  misc_feature (2424)..(2430): n is a, c, g, or t
  misc_feature (2432)..(2436): n is a, c, g, or t
  misc_feature (2438)..(2455): n is a, c, g, or t
  misc_feature (2458)..(2465): n is a, c, g, or t
  misc_feature (2467)..(2472): n is a, c, g, or t
  misc_feature (2475)..(2476): n is a, c, g, or t
  misc_feature (2479)..(2480): n is a, c, g, or t
  misc_feature (2485)..(2486): n is a, c, g, or t
  misc_feature (2488)..(2491): n is a, c, g, or t
  misc_feature (2493)..(2495): n is a, c, g, or t
  misc_feature (2498)..(2498): n is a, c, g, or t
  misc_feature (2500)..(2501): n is a, c, g, or t
  misc_feature (2503)..(2505): n is a, c, g, or t
  misc_feature (2507)..(2508): n is a, c, g, or t
  misc_feature (2510)..(2511): n is a, c, g, or t
  misc_feature (2515)..(2517): n is a, c, g, or t
  misc_feature (2519)..(2519): n is a, c, g, or t
  misc_feature (2521)..(2525): n is a, c, g, or t
  misc_feature (2527)..(2528): n is a, c, g, or t
  misc_feature (2530)..(2532): n is a, c, g, or t
  misc_feature (2537)..(2539): n is a, c, g, or t
  misc_feature (2544)..(2544): n is a, c, g, or t
  misc_feature (2546)..(2548): n is a, c, g, or t
  misc_feature (2550)..(2552): n is a, c, g, or t
  misc_feature (2554)..(2555): n is a, c, g, or t
  misc_feature (2557)..(2558): n is a, c, g, or t
  misc_feature (2563)..(2564): n is a, c, g, or t
  misc_feature (2566)..(2568): n is a, c, g, or t
  misc_feature (2570)..(2570): n is a, c, g, or t
  misc_feature (2572)..(2575): n is a, c, g, or t
  misc_feature (2577)..(2579): n is a, c, g, or t
  misc_feature (2582)..(2587): n is a, c, g, or t
  misc_feature (2589)..(2589): n is a, c, g, or t
  misc_feature (2592)..(2604): n is a, c, g, or t
  misc_feature (2606)..(2606): n is a, c, g, or t
  misc_feature (2608)..(2608): n is a, c, g, or t
  misc_feature (2610)..(2612): n is a, c, g, or t
  misc_feature (2614)..(2624): n is a, c, g, or t
  misc_feature (2626)..(2627): n is a, c, g, or t
  misc_feature (2629)..(2629): n is a, c, g, or t
  misc_feature (2633)..(2635): n is a, c, g, or t
  misc_feature (2637)..(2641): n is a, c, g, or t
  misc_feature (2644)..(2647): n is a, c, g, or t
  misc_feature (2650)..(2651): n is a, c, g, or t
  misc_feature (2655)..(2656): n is a, c, g, or t
  misc_feature (2663)..(2663): n is a, c, g, or t
  misc_feature (2667)..(2669): n is a, c, g, or t
  misc_feature (2671)..(2672): n is a, c, g, or t
  misc_feature (2676)..(2677): n is a, c, g, or t
  misc_feature (2680)..(2684): n is a, c, g, or t
  misc_feature (2686)..(2687): n is a, c, g, or t
  misc_feature (2689)..(2690): n is a, c, g, or t
  misc_feature (2692)..(2697): n is a, c, g, or t
  misc_feature (2701)..(2702): n is a, c, g, or t
  misc_feature (2704)..(2705): n is a, c, g, or t
  misc_feature (2707)..(2709): n is a, c, g, or t
  misc_feature (2711)..(2712): n is a, c, g, or t
  misc_feature (2715)..(2729): n is a, c, g, or t
  misc_feature (2731)..(2732): n is a, c, g, or t
  misc_feature (2734)..(2736): n is a, c, g, or t
  misc_feature (2738)..(2745): n is a, c, g, or t
  misc_feature (2747)..(2750): n is a, c, g, or t
  misc_feature (2752)..(2752): n is a, c, g, or t
  misc_feature (2754)..(2757): n is a, c, g, or t
  misc_feature (2759)..(2759): n is a, c, g, or t
  misc_feature (2762)..(2762): n is a, c, g, or t
  misc_feature (2764)..(2764): n is a, c, g, or t
  misc_feature (2767)..(2768): n is a, c, g, or t
  misc_feature (2771)..(2772): n is a, c, g, or t
  misc_feature (2774)..(2774): n is a, c, g, or t
  misc_feature (2778)..(2778): n is a, c, g, or t
  misc_feature (2780)..(2780): n is a, c, g, or t
  misc_feature (2785)..(2788): n is a, c, g, or t
  misc_feature (2790)..(2791): n is a, c, g, or t
  misc_feature (2793)..(2793): n is a, c, g, or t
  misc_feature (2797)..(2798): n is a, c, g, or t
  misc_feature (2800)..(2800): n is a, c, g, or t
  misc_feature (2802)..(2802): n is a, c, g, or t
  misc_feature (2805)..(2805): n is a, c, g, or t
  misc_feature (2807)..(2809): n is a, c, g, or t
  misc_feature (2811)..(2813): n is a, c, g, or t
  misc_feature (2816)..(2818): n is a, c, g, or t
  misc_feature (2820)..(2821): n is a, c, g, or t
  misc_feature (2823)..(2823): n is a, c, g, or t
  misc_feature (2825)..(2825): n is a, c, g, or t
  misc_feature (2828)..(2829): n is a, c, g, or t
  misc_feature (2831)..(2831): n is a, c, g, or t
  misc_feature (2833)..(2835): n is a, c, g, or t
  misc_feature (2837)..(2841): n is a, c, g, or t
  misc_feature (2844)..(2846): n is a, c, g, or t
  misc_feature (2850)..(2858): n is a, c, g, or t
  misc_feature (2860)..(2861): n is a, c, g, or t
  misc_feature (2864)..(2866): n is a, c, g, or t
  misc_feature (2869)..(2871): n is a, c, g, or t
  misc_feature (2874)..(2874): n is a, c, g, or t
  misc_feature (2879)..(2879): n is a, c, g, or t
  misc_feature (2881)..(2882): n is a, c, g, or t
  misc_feature (2884)..(2884): n is a, c, g, or t
  misc_feature (2886)..(2886): n is a, c, g, or t
  misc_feature (2888)..(2889): n is a, c, g, or t
  misc_feature (2891)..(2892): n is a, c, g, or t
  misc_feature (2894)..(2894): n is a, c, g, or t
  misc_feature (2896)..(2897): n is a, c, g, or t
  misc_feature (2899)..(2899): n is a, c, g, or t
  misc_feature (2902)..(2907): n is a, c, g, or t
  misc_feature (2910)..(2910): n is a, c, g, or t
  misc_feature (2912)..(2919): n is a, c, g, or t
  misc_feature (2924)..(2927): n is a, c, g, or t
  misc_feature (2929)..(2929): n is a, c, g, or t
  misc_feature (2931)..(2933): n is a, c, g, or t
  misc_feature (2935)..(2936): n is a, c, g, or t
  misc_feature (2938)..(2939): n is a, c, g, or t
  misc_feature (2942)..(2943): n is a, c, g, or t
  misc_feature (2945)..(2948): n is a, c, g, or t
  misc_feature (2950)..(2950): n is a, c, g, or t
  misc_feature (2952)..(2953): n is a, c, g, or t
  misc_feature (2955)..(2955): n is a, c, g, or t
  misc_feature (2957)..(2957): n is a, c, g, or t
  misc_feature (2959)..(2959): n is a, c, g, or t
  misc_feature (2961)..(2962): n is a, c, g, or t
  misc_feature (2965)..(2965): n is a, c, g, or t
  misc_feature (2968)..(2969): n is a, c, g, or t
  misc_feature (2976)..(2980): n is a, c, g, or t
  misc_feature (2982)..(2983): n is a, c, g, or t
  misc_feature (2986)..(2986): n is a, c, g, or t
  misc_feature (2991)..(2991): n is a, c, g, or t
  misc_feature (2993)..(2993): n is a, c, g, or t
  misc_feature (2997)..(2997): n is a, c, g, or t
  misc_feature (2999)..(3000): n is a, c, g, or t
  misc_feature (3004)..(3004): n is a, c, g, or t
  misc_feature (3009)..(3009): n is a, c, g, or t
  misc_feature (3011)..(3013): n is a, c, g, or t
  misc_feature (3015)..(3017): n is a, c, g, or t
  misc_feature (3019)..(3023): n is a, c, g, or t
  misc_feature (3026)..(3037): n is a, c, g, or t
  misc_feature (3039)..(3039): n is a, c, g, or t
  misc_feature (3041)..(3041): n is a, c, g, or t
  misc_feature (3044)..(3044): n is a, c, g, or t
  misc_feature (3046)..(3047): n is a, c, g, or t
  misc_feature (3050)..(3050): n is a, c, g, or t
  misc_feature (3052)..(3053): n is a, c, g, or t
  misc_feature (3056)..(3056): n is a, c, g, or t
  misc_feature (3058)..(3062): n is a, c, g, or t
  misc_feature (3065)..(3066): n is a, c, g, or t
  misc_feature (3068)..(3070): n is a, c, g, or t
  misc_feature (3074)..(3080): n is a, c, g, or t
  misc_feature (3082)..(3082): n is a, c, g, or t
  misc_feature (3085)..(3085): n is a, c, g, or t
  misc_feature (3088)..(3092): n is a, c, g, or t
  misc_feature (3096)..(3097): n is a, c, g, or t
  misc_feature (3102)..(3102): n is a, c, g, or t
  misc_feature (3107)..(3108): n is a, c, g, or t
  misc_feature (3113)..(3113): n is a, c, g, or t
  misc_feature (3115)..(3118): n is a, c, g, or t
  misc_feature (3126)..(3128): n is a, c, g, or t
  misc_feature (3130)..(3130): n is a, c, g, or t
  misc_feature (3136)..(3139): n is a, c, g, or t
  misc_feature (3141)..(3144): n is a, c, g, or t
  misc_feature (3146)..(3146): n is a, c, g, or t
  misc_feature (3150)..(3150): n is a, c, g, or t
  misc_feature (3154)..(3154): n is a, c, g, or t
  misc_feature (3157)..(3159): n is a, c, g, or t
  misc_feature (3161)..(3161): n is a, c, g, or t
  misc_feature (3167)..(3169): n is a, c, g, or t
  misc_feature (3173)..(3173): n is a, c, g, or t
  misc_feature (3176)..(3177): n is a, c, g, or t
  misc_feature (3179)..(3180): n is a, c, g, or t
  misc_feature (3182)..(3182): n is a, c, g, or t
  misc_feature (3184)..(3185): n is a, c, g, or t
  misc_feature (3187)..(3187): n is a, c, g, or t
  misc_feature (3189)..(3190): n is a, c, g, or t
  misc_feature (3192)..(3193): n is a, c, g, or t
  misc_feature (3195)..(3195): n is a, c, g, or t
  misc_feature (3197)..(3198): n is a, c, g, or t
  misc_feature (3203)..(3203): n is a, c, g, or t
  misc_feature (3207)..(3207): n is a, c, g, or t
  misc_feature (3210)..(3211): n is a, c, g, or t
  misc_feature (3213)..(3215): n is a, c, g, or t
  misc_feature (3218)..(3219): n is a, c, g, or t
  misc_feature (3223)..(3223): n is a, c, g, or t
  misc_feature (3225)..(3228): n is a, c, g, or t
  misc_feature (3232)..(3237): n is a, c, g, or t
  misc_feature (3240)..(3240): n is a, c, g, or t
  misc_feature (3243)..(3243): n is a, c, g, or t
  misc_feature (3245)..(3245): n is a, c, g, or t
  misc_feature (3248)..(3252): n is a, c, g, or t
  misc_feature (3256)..(3258): n is a, c, g, or t
  misc_feature (3261)..(3264): n is a, c, g, or t
  misc_feature (3266)..(3269): n is a, c, g, or t
  misc_feature (3271)..(3271): n is a, c, g, or t
  misc_feature (3273)..(3274): n is a, c, g, or t
  misc_feature (3279)..(3280): n is a, c, g, or t
  misc_feature (3283)..(3285): n is a, c, g, or t
  misc_feature (3287)..(3290): n is a, c, g, or t
  misc_feature (3293)..(3293): n is a, c, g, or t
  misc_feature (3296)..(3297): n is a, c, g, or t
  misc_feature (3299)..(3299): n is a, c, g, or t
  misc_feature (3304)..(3304): n is a, c, g, or t
  misc_feature (3308)..(3308): n is a, c, g, or t
  misc_feature (3310)..(3310): n is a, c, g, or t
  misc_feature (3313)..(3319): n is a, c, g, or t
  misc_feature (3321)..(3321): n is a, c, g, or t
  misc_feature (3323)..(3323): n is a, c, g, or t
  misc_feature (3325)..(3326): n is a, c, g, or t
  misc_feature (3328)..(3328): n is a, c, g, or t
  misc_feature (3330)..(3334): n is a, c, g, or t
  misc_feature (3337)..(3337): n is a, c, g, or t
  misc_feature (3339)..(3341): n is a, c, g, or t
  misc_feature (3344)..(3344): n is a, c, g, or t
  misc_feature (3346)..(3347): n is a, c, g, or t
  misc_feature (3349)..(3349): n is a, c, g, or t
  misc_feature (3353)..(3353): n is a, c, g, or t
  misc_feature (3356)..(3356): n is a, c, g, or t
  misc_feature (3358)..(3358): n is a, c, g, or t
  misc_feature (3361)..(3361): n is a, c, g, or t
  misc_feature (3364)..(3365): n is a, c, g, or t
  misc_feature (3368)..(3368): n is a, c, g, or t
  misc_feature (3370)..(3371): n is a, c, g, or t
  misc_feature (3373)..(3373): n is a, c, g, or t
  misc_feature (3375)..(3378): n is a, c, g, or t
  misc_feature (3384)..(3385): n is a, c, g, or t
  misc_feature (3387)..(3389): n is a, c, g, or t
  misc_feature (3392)..(3393): n is a, c, g, or t
  misc_feature (3395)..(3395): n is a, c, g, or t
  misc_feature (3397)..(3398): n is a, c, g, or t
  misc_feature (3400)..(3401): n is a, c, g, or t
  misc_feature (3403)..(3403): n is a, c, g, or t
  misc_feature (3405)..(3405): n is a, c, g, or t
  misc_feature (3407)..(3407): n is a, c, g, or t
  misc_feature (3411)..(3412): n is a, c, g, or t
  misc_feature (3414)..(3414): n is a, c, g, or t
  misc_feature (3418)..(3418): n is a, c, g, or t
  misc_feature (3424)..(3424): n is a, c, g, or t
  misc_feature (3433)..(3433): n is a, c, g, or t
  misc_feature (3435)..(3435): n is a, c, g, or t
  misc_feature (3447)..(3447): n is a, c, g, or t
  misc_feature (3450)..(3450): n is a, c, g, or t
  misc_feature (3455)..(3455): n is a, c, g, or t
  misc_feature (3457)..(3458): n is a, c, g, or t
  misc_feature (3464)..(3464): n is a, c, g, or t
  misc_feature (3468)..(3468): n is a, c, g, or t
  misc_feature (3472)..(3472): n is a, c, g, or t
  misc_feature (3477)..(3478): n is a, c, g, or t
  misc_feature (3480)..(3480): n is a, c, g, or t
  misc_feature (3487)..(3490): n is a, c, g, or t
  misc_feature (3495)..(3495): n is a, c, g, or t
  misc_feature (3498)..(3502): n is a, c, g, or t
  misc_feature (3504)..(3504): n is a, c, g, or t
  misc_feature (3509)..(3510): n is a, c, g, or t
  misc_feature (3512)..(3512): n is a, c, g, or t
  misc_feature (3515)..(3515): n is a, c, g, or t
  misc_feature (3517)..(3519): n is a, c, g, or t
  misc_feature (3521)..(3522): n is a, c, g, or t
  misc_feature (3532)..(3532): n is a, c, g, or t
  misc_feature (3536)..(3536): n is a, c, g, or t
  misc_feature (3541)..(3541): n is a, c, g, or t
  misc_feature (3543)..(3543): n is a, c, g, or t
  misc_feature (3549)..(3549): n is a, c, g, or t
  misc_feature (3552)..(3552): n is a, c, g, or t
  misc_feature (3554)..(3554): n is a, c, g, or t
  misc_feature (3562)..(3562): n is a, c, g, or t
  misc_feature (3573)..(3573): n is a, c, g, or t
  misc_feature (3575)..(3576): n is a, c, g, or t
  misc_feature (3578)..(3579): n is a, c, g, or t
  misc_feature (3585)..(3585): n is a, c, g, or t
  misc_feature (3588)..(3589): n is a, c, g, or t
  misc_feature (3593)..(3593): n is a, c, g, or t
  misc_feature (3595)..(3595): n is a, c, g, or t
  misc_feature (3597)..(3597): n is a, c, g, or t
  misc_feature (3599)..(3600): n is a, c, g, or t
  misc_feature (3604)..(3604): n is a, c, g, or t
  misc_feature (3609)..(3609): n is a, c, g, or t
  misc_feature (3611)..(3614): n is a, c, g, or t
  misc_feature (3617)..(3617): n is a, c, g, or t
  misc_feature (3620)..(3620): n is a, c, g, or t
  misc_feature (3629)..(3629): n is a, c, g, or t
  misc_feature (3633)..(3633): n is a, c, g, or t
  misc_feature (3639)..(3640): n is a, c, g, or t
  misc_feature (3642)..(3644): n is a, c, g, or t
  misc_feature (3650)..(3652): n is a, c, g, or t
  misc_feature (3656)..(3656): n is a, c, g, or t
  misc_feature (3658)..(3661): n is a, c, g, or t
  misc_feature (3663)..(3666): n is a, c, g, or t
  misc_feature (3668)..(3668): n is a, c, g, or t
  misc_feature (3672)..(3673): n is a, c, g, or t
  misc_feature (3677)..(3678): n is a, c, g, or t
  misc_feature (3680)..(3681): n is a, c, g, or t
  misc_feature (3683)..(3683): n is a, c, g, or t
  misc_feature (3687)..(3687): n is a, c, g, or t
  misc_feature (3690)..(3690): n is a, c, g, or t
  misc_feature (3693)..(3693): n is a, c, g, or t
  misc_feature (3696)..(3696): n is a, c, g, or t
  misc_feature (3699)..(3700): n is a, c, g, or t
  misc_feature (3704)..(3704): n is a, c, g, or t
  misc_feature (3711)..(3712): n is a, c, g, or t
  misc_feature (3714)..(3714): n is a, c, g, or t
  misc_feature (3718)..(3719): n is a, c, g, or t
  misc_feature (3721)..(3722): n is a, c, g, or t
  misc_feature (3724)..(3724): n is a, c, g, or t
  misc_feature (3729)..(3729): n is a, c, g, or t
  misc_feature (3731)..(3733): n is a, c, g, or t
  misc_feature (3736)..(3736): n is a, c, g, or t
  misc_feature (3738)..(3742): n is a, c, g, or t
  misc_feature (3744)..(3744): n is a, c, g, or t
  misc_feature (3746)..(3746): n is a, c, g, or t
  misc_feature (3748)..(3750): n is a, c, g, or t
  misc_feature (3753)..(3753): n is a, c, g, or t
  misc_feature (3760)..(3760): n is a, c, g, or t
  misc_feature (3764)..(3765): n is a, c, g, or t
  misc_feature (3768)..(3768): n is a, c, g, or t
  misc_feature (3771)..(3773): n is a, c, g, or t
  misc_feature (3775)..(3775): n is a, c, g, or t
  misc_feature (3777)..(3777): n is a, c, g, or t
  misc_feature (3779)..(3779): n is a, c, g, or t
  misc_feature (3781)..(3783): n is a, c, g, or t
  misc_feature (3786)..(3786): n is a, c, g, or t
  misc_feature (3788)..(3788): n is a, c, g, or t
  misc_feature (3792)..(3792): n is a, c, g, or t
  misc_feature (3797)..(3798): n is a, c, g, or t
  misc_feature (3801)..(3801): n is a, c, g, or t
  misc_feature (3803)..(3803): n is a, c, g, or t
  misc_feature (3813)..(3816): n is a, c, g, or t
  misc_feature (3818)..(3819): n is a, c, g, or t
  misc_feature (3824)..(3824): n is a, c, g, or t
  misc_feature (3826)..(3826): n is a, c, g, or t
  misc_feature (3828)..(3828): n is a, c, g, or t
  misc_feature (3831)..(3832): n is a, c, g, or t
  misc_feature (3834)..(3835): n is a, c, g, or t
  misc_feature (3837)..(3837): n is a, c, g, or t
  misc_feature (3845)..(3845): n is a, c, g, or t
  misc_feature (3847)..(3847): n is a, c, g, or t
  misc_feature (3849)..(3851): n is a, c, g, or t
  misc_feature (3856)..(3856): n is a, c, g, or t
  misc_feature (3860)..(3861): n is a, c, g, or t
  misc_feature (3863)..(3865): n is a, c, g, or t
  misc_feature (3867)..(3867): n is a, c, g, or t
  misc_feature (3869)..(3870): n is a, c, g, or t
  misc_feature (3873)..(3873): n is a, c, g, or t
  misc_feature (3876)..(3876): n is a, c, g, or t
  misc_feature (3879)..(3880): n is a, c, g, or t
  misc_feature (3882)..(3882): n is a, c, g, or t
  misc_feature (3884)..(3884): n is a, c, g, or t
  misc_feature (3886)..(3886): n is a, c, g, or t
  misc_feature (3890)..(3890): n is a, c, g, or t
  misc_feature (3893)..(3894): n is a, c, g, or t
  misc_feature (3898)..(3900): n is a, c, g, or t
  misc_feature (3904)..(3904): n is a, c, g, or t
  misc_feature (3907)..(3907): n is a, c, g, or t
  misc_feature (3910)..(3912): n is a, c, g, or t
  misc_feature (3914)..(3914): n is a, c, g, or t
  misc_feature (3919)..(3919): n is a, c, g, or t
  misc_feature (3921)..(3922): n is a, c, g, or t
  misc_feature (3924)..(3924): n is a, c, g, or t
  misc_feature (3928)..(3930): n is a, c, g, or t
  misc_feature (3933)..(3937): n is a, c, g, or t
  misc_feature (3939)..(3939): n is a, c, g, or t
  misc_feature (3941)..(3941): n is a, c, g, or t
  misc_feature (3944)..(3944): n is a, c, g, or t
  misc_feature (3946)..(3948): n is a, c, g, or t
  misc_feature (3951)..(3951): n is a, c, g, or t
  misc_feature (3956)..(3958): n is a, c, g, or t
  misc_feature (3960)..(3961): n is a, c, g, or t
  misc_feature (3966)..(3966): n is a, c, g, or t
  misc_feature (3970)..(3971): n is a, c, g, or t
  misc_feature (3974)..(3977): n is a, c, g, or t
  misc_feature (3985)..(3986): n is a, c, g, or t
  misc_feature (3988)..(3989): n is a, c, g, or t
  misc_feature (3991)..(3992): n is a, c, g, or t
  misc_feature (4000)..(4000): n is a, c, g, or t
agatatctttatgacacctattttatacctaataactcaactttaattttcgttggcggggtcacaatggatgaaatgatcccgaaggttgagaactattttggtggtttagagcgcaaaccggagccgacccgctactatgggcaggaacctctcccctcaggcgaaaaaagactaatatacagagataataaattaagcccccgggttgagttaagatatcaaatccccggtgttgggcatccggacaaaccccatttcgatgttatcaaagaagttatgcggaaccgacttcagaaaaatcttgatgacaaggaaattggcggaagtgttaatgtcagtacaatggttgttcataccaataattatggacttcccagttcaatccattttgcagctatctatgaagatactgaaaaacttgatgcaagtgaggaagccatgttggcagagattaaacttctttcagaagaaaatattttagatgaagaattaaaatttgcacaaaagactctgcgcacccagtggtatagagcagcctccgaccccaaccggcttaatttccatattgggcattttgaagttatggacagctggaaaaccctgaaaccttatcttgaggcnagagacaaaacgacggtagaggatgtcaaacgtttggttaaacaatatttcatccccgataatcgcaccattggtaaagtcattccgagaggagaaggtcaatgaaacatttattgaaagcatcatgcttgattttgagtttattggcgcttccactgagcacccaagttttagcgcaagacctgacccatcctcgcgatatggaaattcctaaaagcaaatttaaaaggcccgatcctgctaaataccaagtctccctggataatggtttagttgcctatgtggcaaaagaacaccaagtaccacttgtatccttgagcgcttttataaaagctggtaaaattgatggacacaaagaaggggccgctgaagccctgtctgaagccttccttaccggccctaaaaatatgtcttcaacagcctttaaagcagctttaaagcgcatgacggcggagtattcagtaacactccataataagtggatcgagattaatttgaacgttccagccgaagatttggaagaggccttcgaactttttagcgccaccgtaatatcacccaatatcacagaagcaaatattaaagctgctgcaggaaaagcgaccaaagatattaaagtggacaaaaatggagtcattattgatggctcaagcagtgtggccgttagcaaatttcatgacattattcttaaaggcaacatcttgggtaagaagctggtatcaagtgattttgaagatctttccacccatgatgtggagagcttttacactgcttatgttgtggcaggtaacatgaccattgccgtatcaggtgatattaatgaaaaggctatccgaaaaaaactgaaagctcagttttcaagtttgattaacaaaacgcctcctaaccgcaggaatgtgccaaaaataaaacgccagaaaaacaaatatcactatttccctgctgataagctccaaacatgggtggtgataggacatcctcttgcgccggtggcctttaaggatgaaaccgcttttgaggttatgaattatattcttgctggggggcatttttggaccagaatgtttattgaaaccagagacaaatatggcctgaccaatgatgccagtggatatattgaagaccaatgggacggctctgggagttacagctttcactcgtcaagccggcatgatgtcacaaaacagctttatgataatatcatgggtgtcatttatgagatacaaaaagagttggttagcgatgaggagttaatgattgctcataacgcccttgcagacggtgtttacgaaatgaagtttaaggacggaaatgccacggccagatcatttgcaattgagaaattaagatatggcaatcatcnncactcaaaatcatatnccgcgcgggttcgttctgttacgaaaaaagacgtcttaagggtcgcaaatgaatatatgcacccggatgcattccaagtgattatagtcggggaacatataaaccttcaataatagcaacactccccttattcatgaataggggctttctattcgttgtgtgagggtttggactatttgtctatttgacggaaagaatattgtaataagataagaattaaatgaaacgcctctgggncaaataaannnnnnnnnnnngnnnnnntnttnannannnnnnntnnnnnnaanntnnnnannatnantnnntnntnnnnnanannnnnnnnnnnnnnntnnannnnnnnannntnntaannnntnnnnnnnnnnnnnnnnnnnnnnannnnnngnnnnnnnnntngnnnantnnnntnnnnannnnnnntnnnnnannnnnnnnnnnnnnnnnnaannnnnnnnannnnnnaanngannaattnntnnnnannntantnntnnnanntnnattnnntntnnnnnanntnnnattgnnnttaancnnnannnanntnnaattnnannngnannnnannntannnnnnanaannnnnnnnnnnnnanantnnnannnnnnnnnnntnntnttannncnnnnncannnntgnnaaannttaatgnaatnnntnnaatnnttnnnnntnntnnannnnnnaagnntnntnnntnnaannnnnnnnnnnnnnngnnannnannnnnnnngnnnntnannnnanaananaannatnngntaangnaaatnnnntnntntatnntnantantnnncnnnaannntnnananaannantnnntnnnnngannnttannnnnnnnntnntgnnnatnnnaanaaaananntnananngnnangnnantgnnnnnnganannnnnnnntttannnnantnnntnngnnttnnannnnantnntncncnannttntannataaatnnnnncnncanggggncntttntnnttanaaaanannnannnannnnnttnnnnnnnnnnnntntnatntnntgnannaancnnnnntgnntnnnatannnnnnnanaanatnnnnntacnnaaacnaatcnnaccantnnnncttatcannnanattttnnnngnnnntntacnaatnttnnntnttgatnnnattnatnnanntnanncnannanntntnnttttnaagnacnngnnnaannggtntnnnntttnnnnnnttntgntncannnnntaannngtnnnntnnnntnannatttnnaannnannnnccnatnngnataancctnanacnnnnnnnanantnngncnnnnnttntnnntancnntngttnttngnatnaanntantnntntnnnntgtcannannnttnntnannanntntnanatanngnaatnaatatnataaatttnanattatggtggtntgngtgtngnngcctgntagnttanataanncnaaaaatnnnnacagnatnnnnnantgaanngnctntnnntnnaataaagganaatnataangnccatantananaaatgggnaaaagcacttnanncnngtaatnaanntagnangnannactntattnannnngantanaaatttacnctanattcanntnnnaaaatnnnatcnannnntnnnntnattnnctgnngnntnagtnganatnttnatnnaganaaagttnnanttcnntnngnaaatnannnggntnnnnnanancnnncanttgtaangttnnaanatnnnantncncnnnctntnttanccttnnttncntttaaggatnnnnanntatanangnatnnanngngtgcatcnancnnnccaanatanntnnntnanncgnctntgnntnananaaangannaccnnnaatnaancannnanatttntnntntcannnttnnnnncngncangnnnatnattgnnntnnttcanactnntannnnacgatttnntnntnnattattan

SEQ ID NO: 1053 - DNA, 4000 bp, Escherichia coli
  misc_feature (16)..(16): n is a, c, g, or t
  misc_feature (298)..(298): n is a, c, g, or t
  misc_feature (331)..(331): n is a, c, g, or t
  misc_feature (340)..(340): n is a, c, g, or t
  misc_feature (418)..(418): n is a, c, g, or t
  misc_feature (424)..(424): n is a, c, g, or t
  misc_feature (433)..(433): n is a, c, g, or t
  misc_feature (439)..(439): n is a, c, g, or t
  misc_feature (469)..(469): n is a, c, g, or t
  misc_feature (496)..(496): n is a, c, g, or t
  misc_feature (604)..(604): n is a, c, g, or t
  misc_feature (625)..(625): n is a, c, g, or t
  misc_feature (739)..(739): n is a, c, g, or t
  misc_feature (742)..(742): n is a, c, g, or t
  misc_feature (748)..(748): n is a, c, g, or t
  misc_feature (766)..(766): n is a, c, g, or t
  misc_feature (784)..(784): n is a, c, g, or t
  misc_feature (862)..(862): n is a, c, g, or t
  misc_feature (865)..(865): n is a, c, g, or t
  misc_feature (883)..(883): n is a, c, g, or t
  misc_feature (895)..(895): n is a, c, g, or t
  misc_feature (934)..(934): n is a, c, g, or t
  misc_feature (1156)..(1156): n is a, c, g, or t
  misc_feature (1246)..(1246): n is a, c, g, or t
  misc_feature (1279)..(1279): n is a, c, g, or t
  misc_feature (1285)..(1285): n is a, c, g, or t
  misc_feature (1288)..(1288): n is a, c, g, or t
  misc_feature (1291)..(1291): n is a, c, g, or t
  misc_feature (1366)..(1366): n is a, c, g, or t
  misc_feature (1483)..(1483): n is a, c, g, or t
  misc_feature (1549)..(1549): n is a, c, g, or t
  misc_feature (1654)..(1654): n is a, c, g, or t
  misc_feature (1669)..(1669): n is a, c, g, or t
  misc_feature (1699)..(1699): n is a, c, g, or t
  misc_feature (1711)..(1711): n is a, c, g, or t
  misc_feature (1720)..(1720): n is a, c, g, or t
  misc_feature (1726)..(1726): n is a, c, g, or t
  misc_feature (1750)..(1750): n is a, c, g, or t
  misc_feature (1783)..(1783): n is a, c, g, or t
  misc_feature (1792)..(1792): n is a, c, g, or t
  misc_feature (1849)..(1849): n is a, c, g, or t
  misc_feature (2014)..(2014): n is a, c, g, or t
  misc_feature (2838)..(2838): n is a, c, g, or t
atcacgccttcgctcnccactgaaacgtgttggtgaacggggatctggtgaatttgaagaaatcagctgggatgaagcacttgagatagcatcaacgcgacttgcaaaagttcgggcagatgatccatctaaattggcattttttactggtcgagatcagtcacagtcattcacaagtttctgggcgcaggggtttggcacgccaaactacgcagctcacggtggcttttgttcggtgaatatggcagcggctggcatatatacaatgggtggtgcattttgggaatttggtcaaccngactgggatcacactaaaatgtttatgcttttnggtgtagcngaagatcatgacagtaacccgattaaaatgggtttaggaaaattaaagaagcgtggtgccaaagtagtaggcgttaanccaatncgaacaggntacaangcagttgctgacgaatgggttggtattacnccaggtactgatggattatttatcacngctctcattcatgaattaatgaaagcggggaagattgatcttcactatcttgctcaatacacaaacgccccagttttactggacagtgatcctgcaagtgaaagcttnggattgtttttgagagataangacagcaagcctttagtaattgatttgaattctggtaaaaaagtagcctttgataaaaaaggtattaaaccagatttaaatgggtcaatccgacaagcgggaataactcacacnacngttttncataaaatggctgagacntacatggcgcctgagcangacgccgcaaatgttgctgagcagtgtggtatttcagaagaaacaattcgacgccttgccgctgaattagcgcatgtngcntttgagcaagaaattagncttccaattgantggactgatttccgtggtgaaaagcatacaaaaatgacngggcgtccagtgtctttccacgcaatgcgaggaatttccgcgcacgcgaatggttttcagacatgtcgtgctttgcatatacttcaaattattttgggaagcgtcgaagtgcctggtgggttcaggtttaaacctccatacccaaaatcatctgaaattcacccgaagccacattatggatatgcgcccaacaaaccacttgatgggccacacttaggtttnacacatggcccagaagatcttgccttaaaggaagatggaacggccgcaagaattgataaggcatttacttgggaaaacccaatgtcatcncatggattgatgcatatggttatttcaaatgcncatgcnggnganccatataaaatagatacattgtttatgtatatggcgaatatgtcttggaactcttcaatgaacacaagtggtgtnatgaagatgctgacagataaagacgaaaatggtgactacgtcattccaaacataatttactcggatgcctactcatctgaaatggtttcatatgcagatcttgttttacctgatgcnacttaccttgaacgccatgattgtatttcacttttagatcgtccaatttgtgaagctgatggtgcngcggatgccattcgctggcctgtcatagagccagatcgagacgtacgtggtttccaatcggtcttatgtgacttgggtgcacgacttggattgccaaactttacnaatgaagatggatcncaaaaatttgctgactatgctgattatatngttaatcaccanagaaagccnggaatnggcccgcttgcaggtttccgtggngatggttcagattcaggacgaggtgatgtaaancctgatcancttgataaatatattgagaatggtggtttctttgttgaacatatcaatgaagatgcntcttattataagccttggaatatggcttaccaagaatgggcagtgaagatgggattatttgatgccccctcaccatatcttttccagctttatgtggaaccaatgcgtaaattccaattggcagcagaaggccacggtgagcgacagcctccagaacatttacgngagagagttcgagagacaatgaatcctcttccagtttggagtaattcaactgataaagattacccaattcatgcgcttactcagcgtcctatggcaatgtatcattcatggggaacacaaaatgcgtggttgagacaaattcatggtgtaaatcctttatatgtcccaacaaaaatttgggaacaaaatgactttaaagatggtgattgggcaaaggtatcatcaccacatggagaaatcactgtgccagtggcacatcaagcagcattaaatgaaaataccatatggacatggaatgcaattggtaaacgtaaaggcgcttgggcattagatgaaaaggcaccagaagcaaccaaaggctttttattaaatcatataatacatgagctaatgccagcaaaaggtgatggaatgcgatgggcaaattctgatcctattaccggacaggctgcgtggtttgatttgaaagttgcaattgaaaaagtggaagcaccagctgaatgtgagccaaatataccggcccagaaatcaccggttggtaaaggccctaaaaacttaacttggaaggtgggagcatgaccgcattaccccctaaatctgatgtaaaacttggtttagtaatcgatcttgatacttgtgttggctgccacgcatgtgttgtgtcttgtaaaggttggaatactgaaaattatggagcaccgttatctgatcaagatgcttacggtgaaaatccatcaggtacctttttaaatcgtgtccactcttatgaagtacagccagaacaaggtgctgcacagacaattcacttccctaagtcatgcctncactgtgaagatgcgccttgtgtaactgtgtgcccaactggagcaagttacaaacgtgccgaggatggcattgttcttgtaaatgaagatgcatgcattgggtgtggtctttgtgcatgggcgtgcccatacggtgcgcgtgaacttgaccaagcagctggtgttatgaaaaaatgtacactttgcgttgacaggatttacaacgaaaatttacctgaagaagatcgtgaaccagcatgtgttcgaacatgtcctgcaggtgcaaggcattttggtgacttaggtgatgcagaaagtgatgtatcaaaattagttcaagagcgtggtggtatggatttaatgccagagcttggaactaagccagtaaacaaatatttacctccacgacccaaagatcaaggaaatgaaattgatattttggcgccgttattggcacctattgcgactgaaacttctggcttcctaggatggcttgatcgtactttggagaaaatctaatgcatccagcaccatccgtaattcttttctcagttttgtctggcctaggttttggcatgttggcatggttaggaattggcaagccgccaatgacgggcatgtttgcatttgtatttttctttatagcctatgccctagcagttggaggcttgttgtccgcaacattccacttaggtaatcctaaaaattcattaaaagcatttagccaatggcgaacaagttggcttagccgtgaaggttgttgtgcagttgccgcattaatgatcatgggcgtttatgcaattggagcaatattttttgaaactcattgggttattattggaggtatcggagcgatattatcaatagttacagtattcactacatcgatgatttatgcacaattaaaaacagttccaagatggaaccattggactacaccagtattatttgtgagtttgtctgtgtttggcggtgccctcatgactggccaagtgaccgtagcaatgtatggttttgttgtagttggattaatccaagtaatcgcatggtttacaagtgataatcgctttgcaaacagtggctctacaatcgaaacagccacgggtttgggtaatattggtaaagtaagaatgtttgaaccacctcacactggcaccaattatttacttaaagaaatggttta

SEQ ID NO: 1054 - DNA, 4000 bp, Escherichia coli
  misc_feature (1542)..(1542): n is a, c, g, or t
  misc_feature (1987)..(1987): n is a, c, g, or t
  misc_feature (1989)..(1989): n is a, c, g, or t
  misc_feature (1991)..(1991): n is a, c, g, or t
  misc_feature (2317)..(2317): n is a, c, g, or t
  misc_feature (2343)..(2343): n is a, c, g, or t
  misc_feature (2481)..(2481): n is a, c, g, or t
  misc_feature (2509)..(2509): n is a, c, g, or t
  misc_feature (3478)..(3478): n is a, c, g, or t
  misc_feature (3553)..(3553): n is a, c, g, or t
  misc_feature (3568)..(3568): n is a, c, g, or t
  misc_feature (3657)..(3657): n is a, c, g, or t
  misc_feature (3883)..(3883): n is a, c, g, or t
  misc_feature (3906)..(3906): n is a, c, g, or t
  misc_feature (3915)..(3915): n is a, c, g, or t
  misc_feature (3920)..(3920): n is a, c, g, or t
  misc_feature (3946)..(3946): n is a, c, g, or t
  misc_feature (3967)..(3967): n is a, c, g, or t
  misc_feature (3969)..(3969): n is a, c, g, or t
  misc_feature (3982)..(3982): n is a, c, g, or t
gcggcgttcatcggattaatctttgaagaacagattggtgctttatttgaagggcaattactacttataggtgcaatgttagccttaacaggagtattactttttctcgcagaccgtgcgagagaaacacgtaaaagcgttcagtggattgatgcatttgtggttggattggctcaagcagtggccatcttgccgggaatctctcgcagtggagcaaccatctctacctccgtcctgcttggtatagaccgtgcgaaggcagcacgattctcttttttaatggtacttcccataatcctgggtaaagcatttttagatgcaaaagatattgtcgcaggggagaccatgggtgaagaagtcagtggttccgttttaattattggtttacttgcggctttccttagtggtattgtcgcatgtaattggatggtcgcactcgtgaagcgcagccaattgaaatatttctcttattactgtttcgtggtggctgccatcgtgttgatcagtcaactcgtctaagctttgactaaagcatcaatattggcaggggaagtcctactggtggacaaacctcttaagtggactagctttcaagcagtcgcgaaaattcggtttaccctacaaaaagaattgggccttaaaaagctcaaagtaggacatgcaggtacgcttgatccgctggccacgggcttgcttattatttgcgtgggaaaaaagaccaaagagattgccagttttatgggacaagagaaggagtatattgctgaaatcacttttggtggtaccacaccttcatatgacttagaaagtgaaattgaagccacctatccaaccgagcatatttctgccgctgcgataacggaaatactcccccagtttcaaggagaaatacaacagtatccacccattttttcagcgatcaagcaaggcggtgtgcgcatgtacgaaaaagcgcgtgctggagaagaagtgattgtggagccgcgtacggttcacattgatgaaattgaaattttatcgttttcagacaatgtcttaaagcttcgtgtactttgtggtaaaggaacctacatccgctctttagcacacgacttgggtaaggcacttcattctggagcccatttgagcgcattgcgaagaacgaaaatcgggtccttcgctgccgatggcgccaagaatccgatagaatggtctgcgtattttaagtctgccttaaggggttagtctagatagttacttttccagaggttggcattgaaatttttcattctgctaaagccgtaaagcgcagtcattgcacccgtagaaaagaccatccagaagaagaagattacacgaaggtgtaaaatggtacctgtatcctttggccctcgaataagactttccgggaagagtaaggctacggccaagcaaaagccaaatacggtcttcatgagactttcgaaatctctaaaggggtatactaaagctttgcgtaaagggtgtaaatcattaccccatttggcaagtaagtaatggtatccgccgcccatcgggacgaanagtaaagggtctttgtctttctccgctaatttgaacatgcctgcaggtgcaatcattttgaatcccttaatctcgcgaccctgagccatttcaaattccttaacagcatccaaagcttcagcggggaacgtgccgttgaaacgtttggaatctaaaaaccgaagacggtagtccacacaaagctttttgatatccgtgatgtggtagattttatccgactcaagtgcgtcaaaattcaacacttcatgatcgccattagattcgaacaggtttgctaaaattcgctcgccctcagtaggagcgttgagtaatgttttaaaaccttctagaacatctaagtgaactgaagttgtgttttttgagcgtaagccgctcaatttttcatgtagattaactcccatagtattgtatttgaatgcgtccgttcaatccatgtgtggcgagnangnttaacaaatgtcggaacggcattgtttaaaattaattggttcatataaaacttgacaaagggggtttcgaaattgtatctttgcagttcttttaatattaatttttcaaagcccgtaagctatgaaaatgaaactttcacatttcgcgtatgacctgccaaaggaacttatcgcgcaagaaccgatgattcaccgcgacgatagtcgtttaatggtagttcacaaagacactggtgaaatcgaacacaagcactttcacgaagtcatcgattattttgacgatggtgacgtaatggtcctcaacaacacaaaggtatttcccgctnggatgtggggaaataaggaaaaaacnggtgcgcgcatcgaagtttttctacttcgtgagttgaattctgaaagccgtttgtgggatgtattggttgatccggcacgtaaaattagaattggtaacaagttgtattttggagaagatgattctctagttgctgangttattgataacacgacctcacgtgggngaacgctacgattcctttttgacggaagttatgaggagttccgtgcgaagttgaaggaaatgggtgaaacgcccttaccgaagtacatcgatcgcgagcctacagaagaagatagcgaacgttaccagaccatttttgcaaaagttgaaggtgcagttgcagccccagttgctggattgcatttctcaaagcaccttatgaagcgcttagaaatcaaaggggttcacttaccggagctaacgcaccatgtgggtttaggaacttttcgcccagttgaggtggaagacttaagcaaacataaaatggacagtgaacaatattcattaccgcaaggcactgcagataccattaacaaggcattagccgaaaagcgaagagtatgtgctattggtacgaccaccgtacgaaccattgagagttctttaactacaggtggacgtgtgacgggcagtgaaggttggacaaacaagttcattttcccgccctatgaggtaaaagtaccagatgcgatggtgactaatttccatcctccaggttctactttattgatgatgaacagtgcgatgttgggtcatgatttggccatgcattcgatcaacgaagccattaaggaaaagtaccgcttcctcgcttttggagatgccatgttgatcatctaatacggatcagaatacataacaaaggccctgcagtgcaaactgtggggcttattattttaggctagcaaaggattttagatagttcttggcaacatcttcccaattaaagtgtgtcttgatgcgttcgcgagaaaggcgtgcttgctctgagcggatctccatggacggacgttgggtaagtaatcgcgttaatacttcttcgtctttccataaagcacctaatcccccaagcacgctggcgttaaaaggattttcatgtgccagtaccatggatcctgaacccatagcctctaataatgcaggatttgtnccgcctacgctgtggccgtgcagataaaaggttgcccgcgtgcggagcgcattaagaatcgttttatcgtaaatngtacccgcgtaaatnatgttcggttcgggaaaggtggctttaagttttcgaccatagcgcgtagtgtaatccccaacagtaaccagggtttctccgctgtttantgcggcatccagaatttcaaatacgtggttatcgggctgtatgcgtccaatgtggaggtggaaattatcggtcggaaagtggtgacgttgtaaaagttctttggcgtctgcaggttcctctatgatttcacttccgtaagcgatagtggaaataggtactttgtatttgctgaggtagttggcaatctctggattgtcagcaattaaaagttttgagcgtttcgcngcccgtcgctcgctccattttanaaaggaagngagtngtccggcgtatttggccctttggtgntctaaaccgtccatattcgtnancgttttatgcttnggccaaagaaaggaccag

SEQ ID NO: 1055 - DNA, 4000 bp, Escherichia coli
  misc_feature (1977)..(1977): n is a, c, g, or t
  misc_feature (1985)..(1985): n is a, c, g, or t
  misc_feature (2155)..(2155): n is a, c, g, or t
  misc_feature (3925)..(3925): n is a, c, g, or t
  misc_feature (3992)..(3992): n is a, c, g, or t
gttttctatattactgaatatgcatctttagaagatatggcagcagctggaaatgcagcattagaagatgccgcatttggtgcagaaaatagaggagactattggaaatacttccataacatatgggacaatcataccgatttaggtatttttaaaaccttcgcaccagcgaataaataatctttacataaaaagggctagtatattgctagccctttcttttaattttacaggtgaatcataagccatataaaaaccttactaattcaaaaaaagaacagatagtcacaatgtttgatcgtattgccaatacatacgatcgattaaatggactcattacttttggaatggataaaacatggcgaaaacgtgtagcaaaaatgattgctgctaacaatcctgaaattatactagatgcagcaacaggtactggagctttagcaattgatttagcacgacactcttcaggaagaataataggggtcgatatttcaggagagatgctctctattggtaaagaaaaaataaaacatctagaactagatcataagattactttggaattagatgatgctgaagcattatcgttcgactctgatacattcgatgctattagtattggatttggtgtaagaaatttcgataatttaaataagggtttatctgagatatttagagtgttaaagccgggggggcaattggtcatccttgaaacatccgtcccaaaatattttccctttaaacaggggtattattttttttcgcattggatcattcccatcttagggaagatcttttcaagagataaattagcctatgaatatctatctgattctgccagtgtctttccccatggaaaaaaatttaatggaattctaaaagaaaataagtttattactattgcagatcatcctcaaatgcttggtatcgtgactatatatacagcgtttaaataactaaaaatgtgtcatcagtgtaaggaaggtttcatttccatttccaccaaactctaatagataatttctttttagtattcgaataacaggcattaacatctcattatttttatcatcaaagctatagttggtatactgacctatcaaccatactgcagttcctttatagtctgtaatttttggtgtaaacgctaatcggacactattcttagtcgattcattaaatgaagaatactctatcatgtgcattaccataaatcttctattttcccaatccgtatgaagaccaagattatacatagatttttcagaatctatatttagcccaatacttgataaggcatagatatttgcttgataattagaggcattccatcgtttgactaataaattattattcgaggcaatataggattggtcaatgtatttgtcattaaacactctaacgccagaataaaacttctttgtgaatgttttaccaaatctaatctcagttatattgggagaatcaatcaaccagattactttaccgcccttaaaaacaacgggatgggcttgtaatagggatagaaatattgctaagagaatgatacattttttcataaacgagggtatctagccaactagtttaggaatagtctttttttcaatcttattcccgtcaaaattagtataaatagcaacggtatcatatccagcatcattaataatctggattgcttcccattcatcaatttttttagatagatctatgggtatgtagatcatttgtgtgtctaaatctatattaataccatcatccttatatactttttcatttagaaaagaaagttcagatagtccttcttgaattccaaatgcacacatagcacataccattccagatacttcgataactaattcatcttttttcacttcaagattactatcttgactgtagataaatgaaaaaaagagtatcagcgctattagggttcttttcataataggaaatttacgttacaataattaaactaggtantgaaattnagttatttatcttgcctaatattacttttattttcttgttctcaactagaagaagaaagctctaatcaaatttataatgaaccagggactccattaattttaatttcaattgatggttttcgatgggattatttagacaaagcagatactccatatttagatgagcttgnggcatccggtgcaagatctgaaggacttattccttcctacccaagtaaaacattccccaaccatcttagtattgttacaggatctcatcctaataatcatggactagttgccaatagaatgtacgatgaagtctttgatgagtattattacatcggacaaggtagtacagcagcacgagatggtaaatggattaatagagagccaatttgggttacagtagaaaaccaatcccttcgagctatgactatgttttggccagcatctgatgcagaaattaagggagtacgaccatctaattggtttacatatgatgaatccattacaaatacgcaacgcatggaacagcttttaaaatggcttgatttaaaagagagtaaacgtcctacttttctagcaagttattttagcgatgtagataatgcaggtcatgcgtatgggcctgaagcagaagaaaccaaaatagctatcagcagcattgatagtgaaattggtgtattaattaacggcttaaaagatcgtggaatttttgatgaagtaaatattatgattgtctctgatcatgggatgacagagacctatactgatcaagtcatttttttagatgactatattgatatgtcaagagttgaactagttgataaaggtccgtttgcagttatgcgagtggttatggggttagttgatggtgatgctaaaccagaagtagataatttatttccattgttagaaaatgcacatcctaatatgaaagtttataaaaaaaatgaatttccagaaaatttccatatgaccgataatcgtcgtattcaagatttaactgcagtagccgatgaccattggcgcattttaacccatgatacgtttaatccaaactattttccaaaaggagatcatggttatcacccggattatgaatcaatgcatggactttttattggtcatggaccggattttaagatagattatgttggccctagatttcaaaacattcatctgtatgaaatgatgtgtaaaataatgaacatatctccttctctaaacgatggagatatcgaagcaacagctaccttcttaaaacaataagatagttaatgaaaaaagaagagccctctataagaattatcgtattccttttaactgcttggctaatcatatttactgtactattaatttcattagcattctaaatattagtcatcttaatttttactactaatcttgtatatgagaagttatgattttttgaatattcttaaaactgcaaaataatatactatcggggcaactagccaaatgagttgaggaagaattgtcaaattgtttccattaattgttataaaaactgggttataccagttttctaaaaaaacccataattttccactgcaatttaaatcaactagaaattctgagatacttccccatataatcattattaaaagtgcattactgttaaaggtataaagatagctatcactttttagaatggtattacataaaaaaataccaattagaaaaatgagactgtctaaaaaagcataattaatattgcgaactaagggaagatcaataggccaatctactaaaattaaatggaatgaatctcctgccaatgcaaaagggatttcccaagttaatccaacacatattccaataataaataatgtgataatttttttggatacatatcccattttatacaacaaaaaaaagatgataggagaagatgaaccaataataaaagcggtccacatgatttgattagcagnaagtgaaatcatttattctttaatgatagttgtgcctgcttttccttcaattgctttttgaatattngcaatatt

SEQ ID NO: 1056 - DNA, 4000 bp, Escherichia coli
  misc_feature (1)..(4): n is a, c, g, or t
  misc_feature (6)..(7): n is a, c, g, or t
  misc_feature (9)..(9): n is a, c, g, or t
  misc_feature (11)..(11): n is a, c, g, or t
  misc_feature (13)..(14): n is a, c, g, or t
  misc_feature (16)..(18): n is a, c, g, or t
  misc_feature (20)..(21): n is a, c, g, or t
  misc_feature (24)..(27): n is a, c, g, or t
  misc_feature (30)..(33): n is a, c, g, or t
  misc_feature (35)..(36): n is a, c, g, or t
  misc_feature (38)..(41): n is a, c, g, or t
  misc_feature (43)..(43): n is a, c, g, or t
  misc_feature (47)..(52): n is a, c, g, or t
  misc_feature (54)..(59): n is a, c, g, or t
  misc_feature (61)..(65): n is a, c, g, or t
  misc_feature (67)..(70): n is a, c, g, or t
  misc_feature (72)..(73): n is a, c, g, or t
  misc_feature (76)..(81): n is a, c, g, or t
  misc_feature (83)..(85): n is a, c, g, or t
  misc_feature (87)..(87): n is a, c, g, or t
  misc_feature (89)..(90): n is a, c, g, or t
  misc_feature (92)..(92): n is a, c, g, or t
  misc_feature (94)..(99): n is a, c, g, or t
  misc_feature (101)..(101): n is a, c, g, or t
  misc_feature (103)..(107): n is a, c, g, or t
  misc_feature (109)..(110): n is a, c, g, or t
  misc_feature (112)..(113): n is a, c, g, or t
  misc_feature (115)..(118): n is a, c, g, or t
  misc_feature (121)..(122): n is a, c, g, or t
  misc_feature (125)..(129): n is a, c, g, or t
  misc_feature (131)..(131): n is a, c, g, or t
  misc_feature (133)..(142): n is a, c, g, or t
  misc_feature (144)..(148): n is a, c, g, or t
  misc_feature (150)..(164): n is a, c, g, or t
  misc_feature (166)..(167): n is a, c, g, or t
  misc_feature (171)..(171): n is a, c, g, or t
  misc_feature (173)..(173): n is a, c, g, or t
  misc_feature (175)..(178): n is a, c, g, or t
  misc_feature (180)..(181): n is a, c, g, or t
  misc_feature (183)..(184): n is a, c, g, or t
  misc_feature (186)..(191): n is a, c, g, or t
  misc_feature (193)..(199): n is a, c, g, or t
  misc_feature (201)..(216): n is a, c, g, or t
  misc_feature (218)..(219): n is a, c, g, or t
  misc_feature (221)..(222): n is a, c, g, or t
  misc_feature (225)..(228): n is a, c, g, or t
  misc_feature (230)..(234): n is a, c, g, or t
  misc_feature (236)..(236): n is a, c, g, or t
  misc_feature (238)..(239): n is a, c, g, or t
  misc_feature (241)..(243): n is a, c, g, or t
  misc_feature (247)..(247): n is a, c, g, or t
  misc_feature (249)..(255): n is a, c, g, or t
  misc_feature (258)..(258): n is a, c, g, or t
  misc_feature (261)..(263): n is a, c, g, or t
  misc_feature (265)..(265): n is a, c, g, or t
  misc_feature (267)..(271): n is a, c, g, or t
  misc_feature (273)..(276): n is a, c, g, or t
  misc_feature (278)..(279): n is a, c, g, or t
  misc_feature (281)..(282): n is a, c, g, or t
  misc_feature (285)..(286): n is a, c, g, or t
  misc_feature (288)..(290): n is a, c, g, or t
  misc_feature (292)..(296): n is a, c, g, or t
  misc_feature (298)..(300): n is a, c, g, or t
  misc_feature (302)..(303): n is a, c, g, or t
  misc_feature (305)..(305): n is a, c, g, or t
  misc_feature (307)..(308): n is a, c, g, or t
  misc_feature (310)..(314): n is a, c, g, or t
  misc_feature (317)..(319): n is a, c, g, or t
  misc_feature (321)..(321): n is a, c, g, or t
  misc_feature (323)..(324): n is a, c, g, or t
  misc_feature (326)..(330): n is a, c, g, or t
  misc_feature (332)..(336): n is a, c, g, or t
  misc_feature (338)..(338): n is a, c, g, or t
  misc_feature (340)..(342): n is a, c, g, or t
  misc_feature (344)..(346): n is a, c, g, or t
  misc_feature (348)..(348): n is a, c, g, or t
  misc_feature (350)..(350): n is a, c, g, or t
  misc_feature (353)..(353): n is a, c, g, or t
  misc_feature (355)..(357): n is a, c, g, or t
  misc_feature (359)..(365): n is a, c, g, or t
  misc_feature (367)..(367): n is a, c, g, or t
  misc_feature (370)..(372): n is a, c, g, or t
  misc_feature (374)..(374): n is a, c, g, or t
  misc_feature (376)..(380): n is a, c, g, or t
  misc_feature (383)..(383): n is a, c, g, or t
  misc_feature (386)..(386): n is a, c, g, or t
  misc_feature (388)..(388): n is a, c, g, or t
  misc_feature (390)..(390): n is a, c, g, or t
  misc_feature (392)..(392): n is a, c, g, or t
  misc_feature (395)..(398): n is a, c, g, or t
  misc_feature (400)..(400): n is a, c, g, or t
  misc_feature (402)..(404): n is a, c, g, or t
  misc_feature (406)..(408): n is a, c, g, or t
  misc_feature (410)..(410): n is a, c, g, or t
  misc_feature (412)..(412): n is a, c, g, or t
  misc_feature (415)..(417): n is a, c, g, or t
  misc_feature (421)..(421): n is a, c, g, or t
  misc_feature (423)..(429): n is a, c, g, or t
  misc_feature (431)..(434): n is a, c, g, or t
  misc_feature (436)..(440): n is a, c, g, or t
  misc_feature (445)..(461): n is a, c, g, or t
  misc_feature (463)..(464): n is a, c, g, or t
  misc_feature (466)..(467): n is a, c, g, or t
  misc_feature (472)..(473): n is a, c, g, or t
  misc_feature (476)..(478): n is a, c, g, or t
  misc_feature (480)..(482): n is a, c, g, or t
  misc_feature (484)..(484): n is a, c, g, or t
  misc_feature (486)..(487): n is a, c, g, or t
  misc_feature (489)..(491): n is a, c, g, or t
  misc_feature (493)..(493): n is a, c, g, or t
  misc_feature (495)..(497): n is a, c, g, or t
  misc_feature (499)..(499): n is a, c, g, or t
  misc_feature (501)..(503): n is a, c, g, or t
  misc_feature (507)..(508): n is a, c, g, or t
  misc_feature (510)..(510): n is a, c, g, or t
  misc_feature (512)..(512): n is a, c, g, or t
  misc_feature (514)..(521): n is a, c, g, or t
  misc_feature (525)..(527): n is a, c, g, or t
  misc_feature (529)..(529): n is a, c, g, or t
  misc_feature (531)..(532): n is a, c, g, or t
  misc_feature (534)..(536): n is a, c, g, or t
  misc_feature (538)..(541): n is a, c, g, or t
  misc_feature (543)..(545): n is a, c, g, or t
  misc_feature (547)..(547): n is a, c, g, or t
  misc_feature (549)..(549): n is a, c, g, or t
  misc_feature (552)..(557): n is a, c, g, or t
  misc_feature (559)..(561): n is a, c, g, or t
  misc_feature (564)..(567): n is a, c, g, or t
  misc_feature (569)..(569): n is a, c, g, or t
  misc_feature (572)..(573): n is a, c, g, or t
  misc_feature (578)..(578): n is a, c, g, or t
  misc_feature (580)..(580): n is a, c, g, or t
  misc_feature (582)..(583): n is a, c, g, or t
  misc_feature (585)..(586): n is a, c, g, or t
  misc_feature (588)..(590): n is a, c, g, or t
  misc_feature (592)..(593): n is a, c, g, or t
  misc_feature (595)..(599): n is a, c, g, or t
  misc_feature (601)..(601): n is a, c, g, or t
  misc_feature (603)..(603): n is a, c, g, or t
  misc_feature (605)..(605): n is a, c, g, or t
  misc_feature (607)..(609): n is a, c, g, or t
  misc_feature (611)..(616): n is a, c, g, or t
  misc_feature (618)..(623): n is a, c, g, or t
  misc_feature (626)..(628): n is a, c, g, or t
  misc_feature (630)..(630): n is a, c, g, or t
  misc_feature (632)..(632): n is a, c, g, or t
  misc_feature (634)..(634): n is a, c, g, or t
  misc_feature (636)..(639): n is a, c, g, or t
  misc_feature (642)..(644): n is a, c, g, or t
  misc_feature (646)..(646): n is a, c, g, or t
  misc_feature (648)..(652): n is a, c, g, or t
  misc_feature (654)..(655): n is a, c, g, or t
  misc_feature (657)..(660): n is a, c, g, or t
  misc_feature (663)..(663): n is a, c, g, or t
  misc_feature (666)..(667): n is a, c, g, or t
  misc_feature (669)..(670): n is a, c, g, or t
  misc_feature (672)..(674): n is a, c, g, or t
  misc_feature (677)..(677): n is a, c, g, or t
  misc_feature (679)..(680): n is a, c, g, or t
  misc_feature (682)..(682): n is a, c, g, or t
  misc_feature (684)..(686): n is a, c, g, or t
  misc_feature (689)..(691): n is a, c, g, or t
  misc_feature (693)..(695): n is a, c, g, or t
  misc_feature (697)..(698): n is a, c, g, or t
  misc_feature (702)..(704): n is a, c, g, or t
  misc_feature (706)..(714): n is a, c, g, or t
  misc_feature (716)..(717): n is a, c, g, or t
  misc_feature (721)..(725): n is a, c, g, or t
  misc_feature (729)..(735): n is a, c, g, or t
  misc_feature (737)..(738): n is a, c, g, or t
  misc_feature (740)..(742): n is a, c, g, or t
  misc_feature (744)..(744): n is a, c, g, or t
  misc_feature (748)..(749): n is a, c, g, or t
  misc_feature (752)..(752): n is a, c, g, or t
  misc_feature (756)..(759): n is a, c, g, or t
  misc_feature (762)..(764): n is a, c, g, or t
  misc_feature (770)..(779): n is a, c, g, or t
  misc_feature (782)..(786): n is a, c, g, or t
  misc_feature (788)..(792): n is a, c, g, or t
  misc_feature (794)..(795): n is a, c, g, or t
  misc_feature (798)..(799): n is a, c, g, or t
  misc_feature (804)..(805): n is a, c, g, or t
  misc_feature (807)..(808): n is a, c, g, or t
  misc_feature (812)..(815): n is a, c, g, or t
  misc_feature (817)..(817): n is a, c, g, or t
  misc_feature (819)..(820): n is a, c, g, or t
  misc_feature (824)..(835): n is a, c, g, or t
  misc_feature (837)..(839): n is a, c, g, or t
  misc_feature (841)..(845): n is a, c, g, or t
  misc_feature (847)..(847): n is a, c, g, or t
  misc_feature (849)..(849): n is a, c, g, or t
  misc_feature (853)..(859): n is a, c, g, or t
  misc_feature (862)..(866): n is a, c, g, or t
  misc_feature (868)..(868): n is a, c, g, or t
  misc_feature (871)..(871): n is a, c, g, or t
  misc_feature (874)..(874): n is a, c, g, or t
  misc_feature (876)..(876): n is a, c, g, or t
  misc_feature (879)..(896): n is a, c, g, or t
  misc_feature (898)..(901): n is a, c, g, or t
  misc_feature (903)..(903): n is a, c, g, or t
  misc_feature (905)..(905): n is a, c, g, or t
  misc_feature (907)..(907): n is a, c, g, or t
  misc_feature (909)..(913): n is a, c, g, or t
  misc_feature (917)..(918): n is a, c, g, or t
  misc_feature (920)..(920): n is a, c, g, or t
  misc_feature (922)..(922): n is a, c, g, or t
  misc_feature (926)..(927): n is a, c, g, or t
  misc_feature (929)..(934): n is a, c, g, or t
  misc_feature (937)..(937): n is a, c, g, or t
  misc_feature (940)..(947): n is a, c, g, or t
  misc_feature (949)..(949): n is a, c, g, or t
  misc_feature (954)..(959): n is a, c, g, or t
  misc_feature (961)..(961): n is a, c, g, or t
  misc_feature (964)..(964): n is a, c, g, or t
  misc_feature (966)..(966): n is a, c, g, or t
  misc_feature (971)..(971): n is a, c, g, or t
  misc_feature (973)..(977): n is a, c, g, or t
  misc_feature (979)..(980): n is a, c, g, or t
  misc_feature (984)..(984): n is a, c, g, or t
  misc_feature (987)..(987): n is a, c, g, or t
  misc_feature (994)..(994): n is a, c, g, or t
  misc_feature (996)..(1001): n is a, c, g, or t
  misc_feature (1004)..(1006): n is a, c, g, or t
  misc_feature (1008)..(1008): n is a, c, g, or t
  misc_feature (1012)..(1013): n is a, c, g, or t
  misc_feature (1016)..(1020): n is a, c, g, or t
  misc_feature (1023)..(1025): n is a, c, g, or t
  misc_feature (1027)..(1028): n is a, c, g, or t
  misc_feature (1030)..(1031): n is a, c, g, or t
  misc_feature (1033)..(1033): n is a, c, g, or t
  misc_feature (1035)..(1037): n is a, c, g, or t
  misc_feature (1039)..(1040): n is a, c, g, or t
  misc_feature (1044)..(1045): n is a, c, g, or t
  misc_feature (1047)..(1048): n is a, c, g, or t
  misc_feature (1050)..(1052): n is a, c, g, or t
  misc_feature (1055)..(1057): n is a, c, g, or t
  misc_feature (1059)..(1061): n is a, c, g, or t
  misc_feature (1063)..(1063): n is a, c, g, or t
  misc_feature (1065)..(1065): n is a, c, g, or t
  misc_feature (1067)..(1067): n is a, c, g, or t
  misc_feature (1069)..(1069): n is a, c, g, or t
  misc_feature (1071)..(1073): n is a, c, g, or t
  misc_feature (1078)..(1080): n is a, c, g, or t
  misc_feature (1082)..(1084): n is a, c, g, or t
  misc_feature (1086)..(1087): n is a, c, g, or t
  misc_feature (1089)..(1092): n is a, c, g, or t
  misc_feature (1094)..(1094): n is a, c, g, or t
  misc_feature (1096)..(1096): n is a, c, g, or t
  misc_feature (1099)..(1100): n is a, c, g, or t
  misc_feature (1102)..(1107): n is a, c, g, or t
  misc_feature (1110)..(1111): n is a, c, g, or t
  misc_feature (1113)..(1116): n is a, c, g, or t
  misc_feature (1119)..(1119): n is a, c, g, or t
  misc_feature (1122)..(1124): n is a, c, g, or t
  misc_feature (1126)..(1127): n is a, c, g, or t
  misc_feature (1130)..(1137): n is a, c, g, or t
  misc_feature (1139)..(1144): n is a, c, g, or t
  misc_feature (1146)..(1147): n is a, c, g, or t
  misc_feature (1149)..(1150): n is a, c, g, or t
  misc_feature (1152)..(1153): n is a, c, g, or t
  misc_feature (1155)..(1155): n is a, c, g, or t
  misc_feature (1159)..(1161): n is a, c, g, or t
  misc_feature (1163)..(1163): n is a, c, g, or t
  misc_feature (1166)..(1166): n is a, c, g, or t
  misc_feature (1169)..(1169): n is a, c, g, or t
  misc_feature (1171)..(1174): n is a, c, g, or t
  misc_feature (1177)..(1177): n is a, c, g, or t
  misc_feature (1183)..(1183): n is a, c, g, or t
  misc_feature (1185)..(1189): n is a, c, g, or t
  misc_feature (1191)..(1193): n is a, c, g, or t
  misc_feature (1196)..(1197): n is a, c, g, or t
  misc_feature (1202)..(1204): n is a, c, g, or t
  misc_feature (1206)..(1207): n is a, c, g, or t
  misc_feature (1209)..(1210): n is a, c, g, or t
  misc_feature (1212)..(1213): n is a, c, g, or t
  misc_feature (1215)..(1216): n is a, c, g, or t
  misc_feature (1218)..(1219): n is a, c, g, or t
  misc_feature (1221)..(1223): n is a, c, g, or t
  misc_feature (1225)..(1228): n is a, c, g, or t
  misc_feature (1230)..(1231): n is a, c, g, or t
  misc_feature (1237)..(1237): n is a, c, g, or t
  misc_feature (1239)..(1240): n is a, c, g, or t
  misc_feature (1242)..(1243): n is a, c, g, or t
  misc_feature (1245)..(1246): n is a, c, g, or t
  misc_feature (1248)..(1248): n is a, c, g, or t
  misc_feature (1250)..(1250): n is a, c, g, or t
  misc_feature (1253)..(1255): n is a, c, g, or t
  misc_feature (1257)..(1261): n is a, c, g, or t
  misc_feature (1263)..(1270): n is a, c, g, or t
  misc_feature (1272)..(1273): n is a, c, g, or t
  misc_feature (1276)..(1276): n is a, c, g, or t
  misc_feature (1278)..(1279): n is a, c, g, or t
  misc_feature (1281)..(1283): n is a, c, g, or t
  misc_feature (1286)..(1287): n is a, c, g, or t
  misc_feature (1290)..(1290): n is a, c, g, or t
  misc_feature (1294)..(1294): n is a, c, g, or t
  misc_feature (1296)..(1298): n is a, c, g, or t
  misc_feature (1301)..(1302): n is a, c, g, or t
  misc_feature (1304)..(1304): n is a, c, g, or t
  misc_feature (1307)..(1310): n is a, c, g, or t
  misc_feature (1312)..(1312): n is a, c, g, or t
  misc_feature (1314)..(1314): n is a, c, g, or t
  misc_feature (1316)..(1316): n is a, c, g, or t
  misc_feature (1320)..(1321): n is a, c, g, or t
  misc_feature (1323)..(1323): n is a, c, g, or t
  misc_feature (1327)..(1328): n is a, c, g, or t
  misc_feature (1331)..(1331): n is a, c, g, or t
  misc_feature (1334)..(1340): n is a, c, g, or t
  misc_feature (1342)..(1343): n is a, c, g, or t
  misc_feature (1345)..(1347): n is a, c, g, or t
  misc_feature (1351)..(1352): n is a, c, g, or t
  misc_feature (1354)..(1357): n is a, c, g, or t
  misc_feature (1360)..(1360): n is a, c, g, or t
  misc_feature (1362)..(1369): n is a, c, g, or t
  misc_feature (1371)..(1377): n is a, c, g, or t
  misc_feature (1379)..(1381): n is a, c, g, or t
  misc_feature (1383)..(1383): n is a, c, g, or t
  misc_feature (1385)..(1385): n is a, c, g, or t
  misc_feature (1387)..(1387): n is a, c, g, or t
  misc_feature (1389)..(1389): n is a, c, g, or t
  misc_feature (1392)..(1394): n is a, c, g, or t
  misc_feature (1396)..(1398): n is a, c, g, or t
  misc_feature (1400)..(1400): n is a, c, g, or t
  misc_feature (1403)..(1405): n is a, c, g, or t
  misc_feature (1407)..(1409): n is a, c, g, or t
  misc_feature (1411)..(1411): n is a, c, g, or t
  misc_feature (1413)..(1431): n is a, c, g, or t
  misc_feature (1433)..(1434): n is a, c, g, or t
  misc_feature (1436)..(1437): n is a, c, g, or t
  misc_feature (1439)..(1442): n is a, c, g, or t
  misc_feature (1444)..(1447): n is a, c, g, or t
  misc_feature (1452)..(1457): n is a, c, g, or t
  misc_feature (1459)..(1459): n is a, c, g, or t
  misc_feature (1463)..(1463): n is a, c, g, or t
  misc_feature (1467)..(1468): n is a, c, g, or t
  misc_feature (1474)..(1474): n is a, c, g, or t
  misc_feature (1477)..(1478): n is a, c, g, or t
  misc_feature (1480)..(1481): n is a, c, g, or t
  misc_feature (1484)..(1484): n is a, c, g, or t
  misc_feature (1486)..(1487): n is a, c, g, or t
  misc_feature (1489)..(1489): n is a, c, g, or t
  misc_feature (1995)..(1995): n is a, c, g, or t
nnnntnntnantnntnnnannaannnnaannnntnntnnnnantttnnnnnntnnnnnntnnnnntnnnnannaannnnnntnnnantnntnannnnnntnannnnntnnannannnnaannaannnnntnannnnnnnnnnannnnntnnnnnnnnnnnnnnngnnaaancnannnnannannannnnnnannnnnnnannnnnnnnnnnnnnnnannannttnnnntnnnnnantnnannntttncnnnnnnnttnaannnangnnnnnannnncnnannaannannnannnnnannnanncnannannnnnaannnancnnannnnntnnnnnantnnntnnnancnaantnnncnnnnnnntnccnnntnannnnnaanttnantnanttnnnntnannnannnantnaannntttnannnnnnntnnnntnnnnnaaaannnnnnnnnnnnnnnnncnncnnttttnnttnnnannnantnntnnntnannntngnnntttnnantnannnnnnnnaaannntnannannntnnnnannntncnaannnnnngnnnttnnnntnaannttttnantnnanntnnntnntnnnnntnancntnnntnnnnnntnnnnnnaannntngnantnnnnaannnantnnnnnannannnnccnaanncnntnnnttngnnantnnnaannnannngnntttnnngnnnnnnnnnannaaannnnntttnnnnnnnannannntnaaannaantttnnnnaannntttttnnnnnnnnnnttnnnnntnnnnntnnttnnttttnncnnaaannnnantnnaaannnnnnnnnnnntnnngnnnnnantnaaannnnnnnttnnnnntnggnttnanttnnnnnnnnnnnnnnnnnnannnnantncntnnnnnaaannangnaaannannnnnnaanttnnnnnnnnanttttnnnnnnanttnanttttnannnnntnntttnaanttttttnannnnnnaannnantttnnttnnnnnaannncnntnntnannnanngggnnannannnaannntnnngncnangntnnnttttnnnannntnntnnnntnanttnntnnnnnnaanntnnnnaanttnnncnnaannnnnnnnannnnnntnnannannantttnnngnaanttnannnnaantttttnannnnnannnggnnttttnnntnntnntnntnntnntnnntnnnntnntttttnanntnntnntngnaannntnnnnnannnnnnnntnnaantnntnnnaannaantttnannnttnntnaannnntnantnaaannantttnnaanttnnnnnnntnntnnntttnncnnnnaantnnnnnnnntnnnnnnnannngntngnanttnnncnnncnttnnntnnntnannnnnnnnnnnnnnnnnnncnntnntnnnntnnnnttttnnnnnntnaaantttnntttttnaannannaantnntnaaaaaaaaaattagaatattgataaattatttatttaaattttttatagattaatttattttattgacatatcacttaatacaaagtaaaataaaatattggaaattattctttccttaaataataatacatattttattaaattattattctttattttttattttatttcattttatttttttcatttcatttcattttatttcattttattttatttattttttttttattattattatttttcccttcgacttgaatttgtattaattttttttcataaaaggatttagtttaatttataattttcatgttttaacattcattttcaatccatttttaaaattattatatatctatttgaatttgccatgttaatttattacttatatagaatatattcaaaatccttacgttaaaaattaaaaagatttccttctatttatttattaatttcaataaattatttattgacaataatttatttttttttttagtttgtaatnattaaaaaaaaaaaaaaaatttttttttacttaaaacaataaaaaataatatttacattataatctaatatatttattcatttactatatatataaatgatatatataattgtagtgtaactatacatttaattttttattattataatctgattatggttggactttattaagccaatcattttgcttaaatctttttttatttaaaattttaataaaatatgtatacattaaattacattttatgtatacagattttaatatgttatattttatattatattataaaaagttaataataataataaaataataataaaaattataaaaaataaaaaaaaaaataataattagaatttaatattagtacgtatgatatttgaataatctttataaaatattaagtatataaataatatagaagcttatcttaaaaatgataaagaagaggtcatgaaatattttgtaatagacatagatggtgatattaaactaattatcatgaataaactttatgagatacttcaattcaataaaaggaagattaatagaaatgtcaaactctttaatgcaaggcgtgcaggtatattaataggagatgaacttttagaatttcacaactatagttatcatcgaaggacatgtgataaggacttagaaccgagttggaactttaatcttcttggaaacgaatataatagtgtaacagataaaactgcagatgatgttgtaagatttatagaagaattagcaggctattataaggacaatccggaatatgaagctaatttatgctttacggaagaatgtgataattttcatttcttttgtcacaattatcatgatttcgtttgttatataaaccctaagatagacgaagtttttctctaaaaaaatggaaaagtatttgtagtaatgcttttcgcatctattgatggaagtattattaaaggatgggcagatactttagcagttaacaatataacatttaatgaaatgatagagtgaacggcagactcaattgttgaagcatatgaatgttcaattaaaaataatctaaagaaaattaagagaaaccttgagaatgcggtatatgaagttacttgctttggtaaacctgtaatttatgctgttttagataatgtatttgaaagtaatgatttacaaattagtaattaggagaaaaaactatacaataaataatctttacaatagtatcgatgattatacggaaaatcattaccattattatgaaagtcaatgttataacgaactaaatgatgattaatattatagtaataatgaagaagataacgatgattcagatggaattgttaaacccttacatgttcctctcttaaatttttcattatgttagcatctatcatgattttacaacctcatattatattttagaatttttaatatttattgaatataaagaattatttcatatgtcacttcataaaatatccatttaaattactatatatttaattctatactcaaaactattaatatttgtggatagagaaaagaaaagaaacatagaatttgtaaatatcatgtattaatatatataataatatatatcctacttaaagaggttaatcacacacgcacacgttacatctacttatatttcaaaataatagtagaatataaaacattaatttatagttaacttagaattaatatataataaattacttataaatgaaaaaaattattattaatttaaggttaattattttcccaaaaatattgcacaaatatataatatattattaaacagtgaaacacacacatatacttaattttatccgaagatactgaatagttactgcttaactagaaagcggatattcaaaggaggatgtcacaaaatactaattaacattagaataagtacatatacataaattaaatagagatgcttagaatgaaatgagcatattctacaattttaaaaagaaggacgtcatatttatgaaagaaatgctta

SEQ ID NO: 1057 - DNA, 4000 bp, Escherichia coli
  misc_feature (278)..(278): n is a, c, g, or t
  misc_feature (426)..(426): n is a, c, g, or t
  misc_feature (429)..(429): n is a, c, g, or t
  misc_feature (3452)..(3452): n is a, c, g, or t
  misc_feature (3578)..(3578): n is a, c, g, or t
  misc_feature (3581)..(3581): n is a, c, g, or t
  misc_feature (3590)..(3590): n is a, c, g, or t
  misc_feature (3593)..(3593): n is a, c, g, or t
  misc_feature (3596)..(3596): n is a, c, g, or t
  misc_feature (3599)..(3599): n is a, c, g, or t
  misc_feature (3602)..(3602): n is a, c, g, or t
  misc_feature (3611)..(3611): n is a, c, g, or t
  misc_feature (3620)..(3620): n is a, c, g, or t
  misc_feature (3623)..(3623): n is a, c, g, or t
  misc_feature (3627)..(3629): n is a, c, g, or t
  misc_feature (3631)..(3632): n is a, c, g, or t
  misc_feature (3639)..(3640): n is a, c, g, or t
  misc_feature (3642)..(3642): n is a, c, g, or t
  misc_feature (3645)..(3648): n is a, c, g, or t
  misc_feature (3650)..(3662): n is a, c, g, or t
  misc_feature (3664)..(3666): n is a, c, g, or t
  misc_feature (3670)..(3672): n is a, c, g, or t
  misc_feature (3674)..(3678): n is a, c, g, or t
  misc_feature (3681)..(3682): n is a, c, g, or t
  misc_feature (3684)..(3685): n is a, c, g, or t
  misc_feature (3687)..(3691): n is a, c, g, or t
  misc_feature (3693)..(3703): n is a, c, g, or t
  misc_feature (3705)..(3705): n is a, c, g, or t
  misc_feature (3707)..(3714): n is a, c, g, or t
  misc_feature (3716)..(3719): n is a, c, g, or t
  misc_feature (3722)..(3729): n is a, c, g, or t
  misc_feature (3731)..(3733): n is a, c, g, or t
  misc_feature (3736)..(3736): n is a, c, g, or t
  misc_feature (3738)..(3742): n is a, c, g, or t
  misc_feature (3744)..(3751): n is a, c, g, or t
  misc_feature (3753)..(3753): n is a, c, g, or t
  misc_feature (3755)..(3761): n is a, c, g, or t
  misc_feature (3763)..(3764): n is a, c, g, or t
  misc_feature (3766)..(3768): n is a, c, g, or t
  misc_feature (3770)..(3770): n is a, c, g, or t
  misc_feature (3773)..(3777): n is a, c, g, or t
  misc_feature (3779)..(3780): n is a, c, g, or t
  misc_feature (3782)..(3782): n is a, c, g, or t
  misc_feature (3784)..(3787): n is a, c, g, or t
  misc_feature (3789)..(3796): n is a, c, g, or t
  misc_feature (3800)..(3800): n is a, c, g, or t
  misc_feature (3803)..(3808): n is a, c, g, or t
  misc_feature (3810)..(3811): n is a, c, g, or t
  misc_feature (3815)..(3820): n is a, c, g, or t
  misc_feature (3822)..(3822): n is a, c, g, or t
  misc_feature (3824)..(3829): n is a, c, g, or t
  misc_feature (3831)..(3842): n is a, c, g, or t
  misc_feature (3844)..(3850): n is a, c, g, or t
  misc_feature (3852)..(3853): n is a, c, g, or t
  misc_feature (3856)..(3864): n is a, c, g, or t
  misc_feature (3867)..(3867): n is a, c, g, or t
  misc_feature (3870)..(3874): n is a, c, g, or t
  misc_feature (3876)..(3880): n is a, c, g, or t
  misc_feature (3882)..(3892): n is a, c, g, or t
  misc_feature (3896)..(3898): n is a, c, g, or t
  misc_feature (3900)..(3901): n is a, c, g, or t
  misc_feature (3903)..(3910): n is a, c, g, or t
  misc_feature (3912)..(3913): n is a, c, g, or t
  misc_feature (3915)..(3915): n is a, c, g, or t
  misc_feature (3917)..(3922): n is a, c, g, or t
  misc_feature (3925)..(3926): n is a, c, g, or t
  misc_feature (3929)..(3930): n is a, c, g, or t
  misc_feature (3932)..(3932): n is a, c, g, or t
  misc_feature (3935)..(3935): n is a, c, g, or t
  misc_feature (3937)..(3939): n is a, c, g, or t
  misc_feature (3941)..(3942): n is a, c, g, or t
  misc_feature (3944)..(3944): n is a, c, g, or t
  misc_feature (3946)..(3949): n is a, c, g, or t
  misc_feature (3952)..(3952): n is a, c, g, or t
  misc_feature (3954)..(3956): n is a, c, g, or t
  misc_feature (3958)..(3967): n is a, c, g, or t
  misc_feature (3969)..(3976): n is a, c, g, or t
  misc_feature (3979)..(3987): n is a, c, g, or t
  misc_feature (3989)..(3990): n is a, c, g, or t
  misc_feature (3992)..(3993): n is a, c, g, or t
  misc_feature (3995)..(3997): n is a, c, g, or t
  misc_feature (4000)..(4000): n is a, c, g, or t
tagtatttaaccgcaccaacaacgactagcatctcattgggagatagcgcttttgcgtttagcgttattgataataataaaattgtcagtattttgttcatggtgcacattataccacaatctatattataaatcaataatatagatttgacacacagttaattgctgtagtggcataggtaattaacactaacatcgtcttctaatttatagactttggtgaatggattgtaggtcattccaatcatgccttttagggttaatgctgagtttctagnccactcatccatctcactaggctggatgaatttatcccaatcatgagtcccttgaggcaggagtttgagaacatattctgcaccaacaatagcaaataagtaagattttggattgcggttaatggtggagaaaaacacctggccaccnggntttactagcttggcacaagctttaataatagagcttggatcaggcacgtgttctaacatttcaaggcaggtgactacgtcaaatttaccagcatgtttttcggcaaactcttctacagggattttttgataatccacatcaaggcctgattcaagcaggtgtaatttagcgacttcgagcccagcttccgccatatcaataccagtgactttggcgccttcagccgccatagactcacttaagataccaccaccacagccaacatctaaaacagctttgtcttttaatgagccattacagcgctctttaatataatttagacgaagagggttgatgtcatgtaatggcttgaactcagagtttttgtcccaccagcgtgaagccagctgggcaaacttatcaacttcgtcaaaatctacattactcatagtgcttgtactacagctaatacttcatcaacatgaccaccaacggcaaccttgtcccaagatttaaggatatcaccatcagggctaataatgaaagttgagcgaacaatacccattttttcttcaccatttcttttcttgagttgccaagcgccaaatgcttcacatagtgtgccatcttcgtcagcaattaattcaaatgggaatgattgatttgctttaaatttttcatggcttgccatgtcgtctttcgagacaccatagataacagtattggcgtcaatgaacgcttggtagttatctctaaaatcttgaccttcaagcgtacaacctgatgttgcatctttagggtagaaatacagaacaatattgcgcccctgatcatcagggatattggcgcttaaattgcttgttgctttgcagctggttgtttgaactttactcataacgatcaatgtttaatttattaaataaagggtttattttatcatagagactgaacggcttctaagacctcgttaacatggtttttaactctaactttatcccaagattttaagatatcaccattagggctaataataaaagttgagcgtacgatacccatgtattctctacccataaatttttttaactgccatacaccaaatacttcacacagcttgccatcttcatcagaaatcagttcaaacggaaacgcttgcttagctttaaatctttcatgctttttcatgtcgtctttcgagacgccatagacaactgagtttgcatcaacaaatgcttgatgattgcctctaaaatcttgcccttctgtggtgcagcccggggttgcgtctttagggtagaagtacagaacaatattacgtccttttgtgtctggaatactaacgtctaaattactagtcgcagtgcaggtaatgggttgaactttattcattgcttgtataatgtcgtgtttaaaatcttgattttatcactaccatgaagaacatccgtaatttttcaattattgcccatattgatcatggtaaatcaaccattgccgatcgatttattcagttttgtggtggtttgagtgatcgtgagatgtcatcccaagtgctagattcaatggatattgaaaaagagcgcggtatcactatcaaatcccaaagtgtgacattagattacaatgctaaaaatggtgaaacttaccagttaaattttatcgatacaccggggcacgtagatttctcttacgaagtctctcgctcactctcggcctgtgaaggtgctttgcttattgtagatgcctcccaaggggttgaggcgcaaacagtggctaattgttatactgcactcgatcaaggcttagaagtagtatcagtcttaaataaaattgacttgccagcagctgatcctgagcgagtcgtggatgaaattgaagatgttatcggtgttgaggcgcacgatgccgtgcatgctagtgcaaaatctggcattggaatcgaagacatattagagcaaattgttgagaaaatcccagcacccgaaggcaaggtcgatgcacctattaaagccttgattattgactcttggtttgacaattatctgggcgtggtgtcactggttcgtgtgattgatggtgagattaaagccaaaactaaaatcaaaatattctcaaatggtaatgaacatttggttgacgaagtgggtgtctttacgcccaaacgtaaaaaaactgaaagtttaaaagcaggcgaggttggcttcctaattgccagtattaagaatattgatggcgcgccagtaggtgatacgattaccagtgctaaaaatccagtaacagagcctttagaaggttttaagccggtacaaccaagagtatttgcaggcttatttccaatctctggtgaggattatgaaaaattccgtgatgcgttagcaaagttgcgtttgaacgatgcggcactacagtatgagcctgaaaactcggatgctctaggctttggtttccgtattggcttcttgggcttgttgcacatggagattgttcaggaacgcttagagcgtgaatacgaccttgatcttattaccacggcgcctaccgtaatttatgaaatcttagataccaaaggcaatattcatcatgtagacagcccttcaaaaatgcctgataatcaagcgattgcagaatttagagagccgattatcactgctaatattttagtaacggatgagtttgttggtgcggtaattagcctttgtgttgaaaaacgtggcatgcaaaaaagcctaacttacatgggtaggcaagtacagttagtttatgaattaccactgaatgaggtcgtgcttgatttcttcgacagactcaaatcagtgtcgcgaggctttgcttcgatggattatcagtttgaacgctatcaagaatccgacttgattcgcctagacattatgatcaatcaagagccagtggatgctttggcactcattattcaccgagaggattcagtgcgtaaaggcagagagattgccgagaaaatgaaagagctgattcctcgccaaatgtttgatgtggcgattcaggcctgtattggtgttaagattatttcncgtgccaatgtaaaagcactaagaaagaatgtaactgctaagtgttatggtggtgatgtttcacgtaagcgtaaactacttgataagcagaaaaaaggtaaaaaacgtatgcgtagtgttggtagngtngatataccncangangcnttnctagccgtnttgcatatngantaannnannagccttnncnaannnnannnnnnnnnnnnntnnnccannncnnnnntannanngnnnnntnnnnnnnnnnnantnnnnnnnntnnnncgnnnnnnnnannnatntnnnnnannnnnnnntntnnnnnnnannannnangcnnnnnannanannnntnnnnnnnnaatnagnnnnnncnnaaannnnnnancnnnnnngnnnnnnnnnnnngnnnnnnntnncgnnnnnnnnnaanaannnnntnnnnnannnnnnnnnnncaannntnncnnnnnnnncnnangnnnnnnctnnttnntnaancnnntnntntnnnnagnannnannnnnnnnnntnnnnnnnntannnnnnnnnanngnnannnagn

SEQ ID NO: 1058 - DNA, 4000 bp, Escherichia coli
  misc_feature (1688)..(1688): n is a, c, g, or t
  misc_feature (1991)..(1991): n is a, c, g, or t
  misc_feature (2006)..(2006): n is a, c, g, or t
  misc_feature (2024)..(2024): n is a, c, g, or t
  misc_feature (2039)..(2039): n is a, c, g, or t
  misc_feature (2525)..(2525): n is a, c, g, or t
  misc_feature (2677)..(2677): n is a, c, g, or t
  misc_feature (2683)..(2683): n is a, c, g, or t
  misc_feature (2717)..(2717): n is a, c, g, or t
  misc_feature (2721)..(2721): n is a, c, g, or t
  misc_feature (2725)..(2725): n is a, c, g, or t
  misc_feature (2878)..(2878): n is a, c, g, or t
  misc_feature (3244)..(3244): n is a, c, g, or t
  misc_feature (3328)..(3328): n is a, c, g, or t
  misc_feature (3471)..(3471): n is a, c, g, or t
  misc_feature (3736)..(3736): n is a, c, g, or t
  misc_feature (3739)..(3739): n is a, c, g, or t
  misc_feature (3763)..(3763): n is a, c, g, or t
  misc_feature (3805)..(3805): n is a, c, g, or t
  misc_feature (3826)..(3826): n is a, c, g, or t
  misc_feature (3874)..(3874): n is a, c, g, or t
agaaccaattgaaactgcatctgctccaagagccattgctttagcaacatctgcaccatttctaattccaccagatataattaactgaacttttctatgttggtctaaatcttgaagtgcatctacagcaggtctaatacatgctaaagttggttgacctacattttctataaatacttcttgagtagcagccgttccaccttgcattccatctaaaacaacaacatctgcaccagctttaacagcaagagcagtatcataatatggtcttgcccctgcaactttaataaatattggaactttccaacctgttatttctcttatttctaaaattttgatctttaaatcatcaggacctgtccagtcaggatgtctacatgcagacctttgatctatacccttaggtaaagttctcatttctgcaactcgatcactaattttttgacctaataacattcctccaccacctggttttgcaccttgacctataacaatttcaatggcgtctgcttttctaaggtcatcaggattcattccatatctagaaggtaaaagttgatagactaaatttttagactgacctctctcttctggtgtcattccaccatcaccagtagttgtagatgtaccagccatacttgccccacgccctaaagcttctttagctctccctgataatgcaccaaaactcattccagcaattgtaataggaatatctaactccaaaggtttttttgcataacgtgttcctaaagttacttttgtattacaggtttctctatatccttctaaaggatatctagacattgaagcaccgagaaaaagtaaatcatcaaagtgaggaagctttcttttagatcctccacctctaatatcataaattcctgttgctgctgctcttcttatttctgaatttgtatactcatcaaaagtccatgatatacgaggatgagtttttttattatctgacattattaatagcttgatacattatcgatgttaaagttatatagttttcgtgctgaaccatatctcttaaaactatctggtttaatattttttatttcacttttttttaaaagagctgaaattttatttaaatgcttcttttccatttttttttctatgcaatctgcacctaaagatttaactgatcctttgacaaaaatatcagtttcataaagactatcacccaaagcctcacctgcgtcaccacaaactaacatcgttccagattgagccataaatgcagacatgtgaccaacagaacctttaaccacgatatcaattcctttcattgaaataccacaccttgagctagcatctccatcaattacaagtaatccgccatgagcagttgcgccagcagattgtgaagcattacctttaacatgtactgttccagacatcatattttcagcaacacctgtaccaacatttccatctattgttacatgtgctttttggttcattcctgcacaataatagccaacatgacctttgattaaaactttcatttcctgatttaatccagcacataatgcatgacttccttcaggatttataatcacaaagtctctatcattttttttattatctaaattttgtaaagtattattaatttctcttaatttctttttttttaaatctaatttcattaattcccccacgagtaaacaatacctggntcaggttcaaaaatttttgcattatttacatctggtaaatgtgccatggcttgaaactctgatgctattgcaacatagttttttgtttctgctattaccgcaggtttacatgctatttcatctctaacaactgcaaagccctttctagttcctgtaataaatgtataaaaaccatctaaatctttaagacccgatgtaagcgtatcttttaaagatttattatttgataaactgttagaaacatatcctgctgcaacttcagtatcattttcagagttaaagacactaccttttttagtgagntctcttcttaaattnttatgatttgataatganccattatgaaccaancattcatcttcaccagtagagtaggggtgagatccatcagtagttattgcactttctgtagccattcttgtatgacctattccatgagtaccactaaaactatctaatttaaatttttttactacatctttaggattaccaacttgtttaaatatttctattgatcggccatacccaactatagatactttaggaaaattcgaattaattatctcaatcactttctttggctgctcaagagtttttagaattacatgatctgagatttgagtaagtttggcttttttaagttttttagatatttctttcttaaaactattaaagtttaaatcattaatacataaagaaaacttgtatagttttttactttcatctttataaatagcaaagccagcactgtctggtccacgagattccatattattaagcataccagatagcatctttcctaaatttttttcaaattttttattttttaagtagatnccaacaattccacacataaatttttttaagtttattttattaaagacagtagaaaatctttatagtagaaaatatttcctactacaatgatgataatagccgctatcactccatactttgcttttggaaaaacgacacctctcattttactnggtctnagatcttcgttattatttctatccatgattgtanaatntttntaaaaaaaaagggcgccacaattaagtagcgcccaaatttttaattgatattaccagtcggtaatattgctcttatgatcattagcgccatgtctctttcttgctaatcttgaaagtttttcactttcagatctagcagttaaaacatgccanccgatccaaaaaactacaccaagaaaaactagtaaagtttcagtggatccagcccccggataaactgctccgacaacctcttttgcacttaaatgatctatccagtttgtaactgtagccatattttttctcctttacctagttgaagaggcgaccgctttttcagcttctctatcgtcctccattatttcatagtctagtcctgctatttcaacttcacgcggtattcttaatttaccaaaagcgcttagtactctagcaataacgtaacctggtaacattccaagaactccgaacattataattgctccaaggaattgtcccagtggattgattgatgcataagttgatccgtcccacatagcnccaacactgtatccagatgaaggatagccatttaaaacaaatccacaaattacaagaccaacaaatcctgcgtaaccatgtacngctactgcaccaactgcatcatcaattttgaacttacgttcaacccagtaatgcattttgtatgctataacaacaccgatcgcaccaataagcattgcttgtatcgggtgatacaaatcattacctgcagatgcacagatgancccagctagtccacttgagtaagtccagaatggatcacctttagcgaccacgtatccagccaataatccacccgataatgacatcaggaagttataggttattccactcagggtggttggggttacatatatgtttgttgctgtccagtacgttacaccttccattccatactcaggtccaagatcaaatatcggtatattacatgccgcataaaatccccagaaaccagtatagattaaaaataatccaactgtaactagccanggntttcttggtcctatatttcttggntcaccacttgatgagaactttccaattctaggtcctaaaacnattagaacacctaaagcaaanccacccgcaattgcgtgaattactcctgatgcgtaagcgtcatgatancctaaaattttaagcatccatccatcaaagtgccatccccaagcagcatcaattacccagaagcacgaaccaattgcaattgctaaaataccaaatgcaaaagttgtaattctttcaatgattgct

SEQ ID NO: 1059 - DNA, 4000 bp, Escherichia coli
  misc_feature (672)..(672): n is a, c, g, or t
  misc_feature (708)..(708): n is a, c, g, or t
  misc_feature (990)..(990): n is a, c, g, or t
  misc_feature (1992)..(1992): n is a, c, g, or t
  misc_feature (2039)..(2039): n is a, c, g, or t
  misc_feature (2205)..(2205): n is a, c, g, or t
  misc_feature (2258)..(2258): n is a, c, g, or t
  misc_feature (2271)..(2271): n is a, c, g, or t
  misc_feature (2283)..(2283): n is a, c, g, or t
  misc_feature (2307)..(2307): n is a, c, g, or t
  misc_feature (2334)..(2334): n is a, c, g, or t
  misc_feature (2337)..(2337): n is a, c, g, or t
  misc_feature (2394)..(2394): n is a, c, g, or t
  misc_feature (2423)..(2427): n is a, c, g, or t
  misc_feature (2457)..(2457): n is a, c, g, or t
  misc_feature (2541)..(2541): n is a, c, g, or t
  misc_feature (2553)..(2553): n is a, c, g, or t
  misc_feature (2569)..(2569): n is a, c, g, or t
  misc_feature (2593)..(2593): n is a, c, g, or t
  misc_feature (2724)..(2724): n is a, c, g, or t
  misc_feature (2796)..(2796): n is a, c, g, or t
  misc_feature (2871)..(2871): n is a, c, g, or t
  misc_feature (2877)..(2877): n is a, c, g, or t
  misc_feature (2922)..(2922): n is a, c, g, or t
  misc_feature (2928)..(2928): n is a, c, g, or t
  misc_feature (2931)..(2931): n is a, c, g, or t
  misc_feature (2982)..(2982): n is a, c, g, or t
  misc_feature (2988)..(2988): n is a, c, g, or t
  misc_feature (2997)..(2997): n is a, c, g, or t
  misc_feature (3039)..(3039): n is a, c, g, or t
  misc_feature (3081)..(3081): n is a, c, g, or t
  misc_feature (3168)..(3168): n is a, c, g, or t
  misc_feature (3198)..(3198): n is a, c, g, or t
  misc_feature (3221)..(3221): n is a, c, g, or t
  misc_feature (3362)..(3362): n is a, c, g, or t
  misc_feature (3419)..(3419): n is a, c, g, or t
  misc_feature (3431)..(3431): n is a, c, g, or t
  misc_feature (3434)..(3434): n is a, c, g, or t
  misc_feature (3446)..(3446): n is a, c, g, or t
  misc_feature (3473)..(3473): n is a, c, g, or t
  misc_feature (3551)..(3551): n is a, c, g, or t
  misc_feature (3566)..(3566): n is a, c, g, or t
  misc_feature (3584)..(3584): n is a, c, g, or t
  misc_feature (3609)..(3610): n is a, c, g, or t
  misc_feature (3622)..(3622): n is a, c, g, or t
  misc_feature (3634)..(3634): n is a, c, g, or t
  misc_feature (3661)..(3667): n is a, c, g, or t
  misc_feature (3670)..(3670): n is a, c, g, or t
  misc_feature (3674)..(3676): n is a, c, g, or t
  misc_feature (3678)..(3678): n is a, c, g, or t
  misc_feature (3683)..(3685): n is a, c, g, or t
  misc_feature (3692)..(3697): n is a, c, g, or t
  misc_feature (3701)..(3705): n is a, c, g, or t
  misc_feature (3707)..(3707): n is a, c, g, or t
  misc_feature (3713)..(3721): n is a, c, g, or t
  misc_feature (3725)..(3725): n is a, c, g, or t
  misc_feature (3728)..(3729): n is a, c, g, or t
  misc_feature (3732)..(3732): n is a, c, g, or t
  misc_feature (3737)..(3739): n is a, c, g, or t
  misc_feature (3742)..(3743): n is a, c, g, or t
  misc_feature (3746)..(3746): n is a, c, g, or t
  misc_feature (3748)..(3748): n is a, c, g, or t
  misc_feature (3751)..(3786): n is a, c, g, or t
  misc_feature (3788)..(3794): n is a, c, g, or t
  misc_feature (3796)..(3825): n is a, c, g, or t
  misc_feature (3827)..(3830): n is a, c, g, or t
  misc_feature (3832)..(3838): n is a, c, g, or t
  misc_feature (3840)..(3842): n is a, c, g, or t
  misc_feature (3845)..(3847): n is a, c, g, or t
  misc_feature (3849)..(3896): n is a, c, g, or t
  misc_feature (3898)..(3908): n is a, c, g, or t
  misc_feature (3910)..(3918): n is a, c, g, or t
  misc_feature (3920)..(3922): n is a, c, g, or t
  misc_feature (3924)..(3927): n is a, c, g, or t
  misc_feature (3929)..(3941): n is a, c, g, or t
  misc_feature (3943)..(3943): n is a, c, g, or t
  misc_feature (3945)..(3946): n is a, c, g, or t
  misc_feature (3948)..(3981): n is a, c, g, or t
  misc_feature (3983)..(4000): n is a, c, g, or t
aaccactctgaaacaaagccatttactggaggtaaagctgcgatacccatgatacctataaacataccaaggcttgtccatggcatctttttagcaagaccaccaaggatgtccatattttgtgtatgagtagcgtggataactgaaccagcgcaaaggaaaagcagacctttaaatatagcgtggttaactacgtggtagcaacctgctagaaaacctactgctgcaagtgttaaatttccagctgcaacgccgtagataccagtaccaagacctagcaagatgatgcctatgttctcaactgagtggtaagcaagcaaagctttgaagtcgtgttggcaaagagcgtataaaacaccaaatagtgagctagctgcaccaagagcgagtattgtaagaccaaaatatgtgctaagtggtaggtaaagtgtaaatttaactagtgtaaatagagcaactttaatcataacgcctgacataagggctgaaacgtttgatggtgctgctgggtgagcttgtggaagccaaacgtggaatggccacataccagctttactaccaaagccgaccaagaatagtataaatacagcagcagaagcgccaaatggcatcttaacacccataaatgcgctaaattcaaagcttcctgcatagtaagctgtgataagcaanccacaggttatacaaaatgcaccgatttgtgcgatnccaagatataccataaccgctttaagtgtatttttaccgtcattgacgatgataagaaatgatgatacaagagtcataagctcccataaaacaacaaagcaaaatacattatcagcgctgattactagaagcattgaaaggatgaatgtgttaaacaaacatgcaaacacaccaacatttgctttttttatgtactcttctgcatagctcataccataaacactacttgcaaatccgatgaaaacaacgacaaagctgaagaaatttccaagtggatttagngcaaattttggcgaatacaaaaagccatccataagagcaaagctatcacttactcccatatttgcaacgaagtgacacatcgcataaaagcagcttatagcacttagtccaaaaccaactttaacagcggcttttggagcgcagtagagcaagatactaacgacggcacttacaagaaatagcatataaaccgtagtcatcttatgctccttgtccgtttaaaattttagtagcaaatttattcgctgcatcgtagtctatcctcttgccaagcttatgtttgccctcttctggatctaccattataagagcgcttgttgggcatacatcaacgcaagctggtccattttcacggccaaagcacatatcacattttactgcgatgttttttgcgcctgattgtgactctacttcaagatagtattttggctcgacagcgtaatttactgaaggcataagctctgcacttgagcttatcgcaccataagggcaagcgatcgtgcacatcttgcaacctatacaaatttcctcgtgaagctcgatgcaattatcgttaaatcgcaacgctccagttgggcatacatttgcgcaagggccatcgtcgcattgtctgcactgagtcggcataacaccgctagcttctcttaagacgcttagccttgcacgtgatagtttgccgcgttcataagcacttttaaaacatgcagccatacaggtcgcacatcctatgcagcgtttagaatcggcaatcacaaatttatgttttttcataaattcctcctaaaaaacaaggcaagaccgccctgctcactaatagagtgattgttaatcacatgaatagagatagttaaatttttatttaacatctcaaacgctccttcctgaaatttttgaaacaattctataacttctggcgattaaattccgtcagctatctgacaaattttgtatttttgaaattaaatttttattttatattagtttaagatatgctattaaacngcgttattatcgtgtgattaatcaaaaaagattaatatttcataacngataattagtaaaaagagtaaaattatcttaattaagtttaaatttaaaaattagttttttaagcttgggttaattaaatgaaactgaaatttaaaaatctaaaatataatccaacctttaaatttaaaagggttattgatggaaatttttatagtcatagttttntttatcgcttcagtttttgcttttatgaaatttgcccctgtttttggcggcanaccagatgccaanagccaaaagctnatagaggcttcgccaaattttaanggcaaagtttttataaatttagagccnacnattgatatggtaaagaaaaatccgcaagcgtctatgttaaattacgtccctcaagcnctctttccaccaaaaggcaagctaccaannnnncctttgccaaatttaaaatttgacgcaaangccctcaaaaatggcgagtttatctggcttgggcacgttagcctaatctgcaagcttgatggcaaaaccatcatcacagacccngttttgcaccgngcattccctctcccanttggcggcaagccctttgcctacnagcacgccatcaccgctagcgactacccagaggtgatcgacatcgccctcatctcgcacgaccactacgaccatcttgaccataaaacgatccttgagctaaaggataggatagccaaatttctagtgccncttggcgtcaaggctcacctcgtaaaatggggcgtggatgaaggcaaaatttacgagtttgactggtttaangagcaaaagataggaaatttaaacttcactttttgcccctcaaggcactttagcgggcgcacatttaaaagaaanaccacnctttggggcggctgggcggtagaggaggctggctttagcttttantttagnggngatggcggatatggcaagcattttaagatgataaatgagaaatttggcggntttganctagttttnatagaaaatggcgcttacagcgatggctggccttacgtgcanatgaagccagaggagtcagcgcaagcgctaaaagatcttggngcaaggcttggcgtgccggtgcattggggtaaatttgatctttcttatcacgcttgggatgagccgatcaagcgttttgaaaaggcngctacaaaacttgagctaaactacgcaacnccgatgatcggagaggttttcancgtgcaaaatccacctagaaaaaagtggtgggatgaaatttaggaataaaatttgctctaaattttaaaatccaaaaggaagtgcagatgaaaatttctgaaaatttatcaaatttaaaaaatgccatcgacaaggcagcnaaaaacgaccttgatgcaagcgctactggaagctttttgcaaaatttagaaaaagcnaacaaagagacnganaagatctacganaagcttgaaaaagagctaaagagcgangcgcagatgtttaagcagtttgacttcatgcagatgatgacaaagcttcaatacggcaacctaaaatcaagcgagcgngaagagctgataaanaaaatgagcaaaatcgcnaaagaaatttagccgtttagtgtgnntttacggcgagntaaatttggctnttttgcgtaaatttatgtggttttttnnnnnnnaantttnnnanaaaannnaaatttnnnnnnttannnnntnttaatnnnnnnnnntttnccnnatnttttnnnaannacntnttnnnnnnnnnnnnnnnnnnnnnnnnnnnnnnnnnnnnannnnnnnannnnnnnnnnnnnnnnnnnnnnnnnnnnnnannnnannnnnnnannnaannnannnnnnnnnnnnnnnnnnnnnnnnnnnnnnnnnnnnnnnnnnnnnnnnannnnnnnnnnnannnnnnnnntnnntnnnnannnnnnnnnnnnnantnnannnnnnnnnnnnnnnnnnnnnnnnnnnnnnnnnnannnnnnnnnnnnnnnnnn

SEQ ID NO: 1060 - DNA, 4000 bp, Escherichia coli
  misc_feature (90)..(90): n is a, c, g, or t
  misc_feature (450)..(450): n is a, c, g, or t
  misc_feature (1054)..(1054): n is a, c, g, or t
  misc_feature (1986)..(1986): n is a, c, g, or t
  misc_feature (1991)..(1991): n is a, c, g, or t
  misc_feature (1994)..(1994): n is a, c, g, or t
  misc_feature (2002)..(2002): n is a, c, g, or t
  misc_feature (2129)..(2129): n is a, c, g, or t
  misc_feature (2441)..(2441): n is a, c, g, or t
  misc_feature (3131)..(3131): n is a, c, g, or t
ccaatcctaaagctggaaaatatgaacatgccaacagcaacataaaacaaggacagttcctttgacagtatagcagatcctataattccncctactacagtgatcaaccacaacgcatttccaaaaaatgacatgtgcagtgattttgaatactccttatgttttgtaaaacgtgaatctaagtactgtgtagcaagtaatacagctacaacagctggcagatgataaagtatttcataattctgaatatagttattaaaactaagaaaagaaattatagacgcaatagcgatagatgcagtcagtgaaacgtagaatgatgatggatttattagcgtgaacgaataccgtttgtgaatgttttgaatgtcatttgaatctgacatgatatttatggaattaaaagcagatctataacccacgagactacaataatgcttattggcatanaaatgatgatttttggatcaatcttaaatccttttgtttcatcctcaaagaatcttagcagacctgcgctagatgctggcagtggtgcgtttttctttttatcagccatacttagtattgaaaacagaatggtaaagataaaaacttttttaattcgactttaattttgctataatatctattagcaaatcaatggattttatcaattcctgctgttttgctggcttgttttccttttcaagttgagtagataatttttcaagtttctgctctagtgtttttagagtagaaatagactttttttccttggtctgtgtttttgttggtttttgttcaggttctcttccacaatttacacacaatgcatggccatctttcataactcttacacccttacagtatggacagggctcgcttagtaaagtgccaccgctaagtatcatcttaattgctttttgtgttaaatcgtttggcaatgatataacgttaaattagtttgtaaaaaatactgggatcttgtgaatttactttattttatatcgataaggcttaataatatgttagagcatcaaatttagaaataatggcggttatttgtaatacntgtggacttcctgatgacttgtgcgcctgtggtgatcttgacaaagatagtactcatattataatacgtcttgagactcgacgttttaggaaaaagggaacaatgattgagggacttgatcctaagattaacaacctaggtaatgttgcaagagagctaaaacacaaatatgcgtgtggtggaacggcaaaagatggctatgtatttttgcagggtgatcatagagatacaattaaagatacattggtaaagcttggctttgctgaagaaacgatagaattacactgaaaaaaagtgtcatcacaaaacaaaattttacaagggctagcgataccgcacactgccttaatatcagtaattttttgtttgatggttttatcatttcccactggggcatatctggttttcaattcagaaattggagatgatgtaacatacgagtatcctatggatagcttaagcatttttcttgcaggaataggttttgaagttccagtaaaatttgagttaggagatgggtttgttgtaatatggtgtacttacttgattctctttacagctgcaatattaggtccaaaaaaaaattttgttgctgtattacaatcaatgatttctgaagggagatataaaattcaagataactatatcgttaccgtcatcaaatggttttctattttagtgattgtatcaggtagtataattagtgttcaggaatttattgggatttccgttgaacagccggaagcgccaaaccagctaatacaattttttgatatatcgcttgcaccaataatagaagagtttggttttagggttgtactgatagggctaccgctttttacgttgtattcgcacaaattatcctttaaatttcttgtaaaatcactgtggtggccatggcaaaatcttcgcaatgtaaatatgaaaaaggngttgntgntgattgtnatagtaggagtacttttcggtgcagcacatattttttcagatgaagcgtggagtactggtaaattggcacaggcaatcgctagtggaattataattggatgggtatatttcagatacggtcttgttnctgctattctaattcattgggcaacgaactatttcgttttttcttatggatatattgtagctgatatcaaccagatttctataggtgatgcattttcacattctctgctaaacacacttgagttaatgctaattgtaacaggaataatctcagttacagttttggtgttaaattatgtgtactcaaaaaggcatacgctagaagcataattcaatttttttacaaaaatcctgcttgtcattttgttttagcatgaatgcaagatcaaattcgtcatcaatatcaagcatcattctacgaatcagtgcaacngatatattttcagttttagttcttgcaacgtccatttgaaatgtgtaactgccctcatcatatcttgtctccattatgttagcaggacatctaactagtgcatttgtcccgttaaattgtctggagggaacgatgattacagatcttttataccttacaaagcctaacaagttatcgatatcggaagacgtcattataggtatatcctgtggaaagataaccgagcaatcaaatttcttatcagaaagatattggtctgctaaactgatagcatcattaacgccagattcgttatcaaaaatttctatggtatcaaattgcctaccaagctttaatgctacctcatcctttgacaccagaactattttgctaataagtttgcaattcgatactgtattaagaacttcttgcaacattagactgcatatcttttctttacactcttgctgtaagtttagtctttttttagccttagaaaatgtcttaactggaattatcgctgaagttttcaacttaggaagaatattgttttagaatggatgccgcaagtacatcttcagattgcttgtttgtcattctaatttttgtctcatgcacattgatattcaatgcctcaatttcttttgtttgcatacgatctttagtatctataactaaatttgaacagacatgtgcatacatctttgcaangcccaacgctgagacttccattccagctgcctccatgtattttccagcgggtccactaatagaagaatttccaattatagggcttatagctaccactttgtttttcttttttgccaactctttccgtatgcccttgattgctaaaattggacctatactggtgagagggttgcctggagcaataattacaagactagaatcatgaattgcatttacagcatctgggtttggacgagccttgtctgcacctttatattcaattccttcgactgaatccaggcctctatgcttaacccaaaactcttgaatgtgcattgcacccttatttgttataattctagtttcaatcgcattatcagtaactggtattaatttaatttcaattgcaaatttttcacacatccattttgtaatatcgctcagacttttgccgttttttaacatattagttctggtaagatgagtagcagtgtccctatcacctatcctaaaccatgtttcttctccaaaaatttccatctgccgtaaaaatccaaatgtatctttttttatgccccagcctttatcatgatccagtaaatcagcaagtccataagtaatggtatcaatgtcagggcagatatacatcccataaagccaataattatcccccacattggtaatcacgttaatatctgtccgatgagaagcaaaccctctcacaagtttaactgaaccggagccaccggcaagtatagtaatcaatttttttctcctagaacaatttagtagagtaatgctaccaatattactttatcatttttatggtaattttttaggtaaaattaattaactatataataagtgagatttcgtgccaagaaaaacta

SEQ ID NO: 1061 - DNA, 4000 bp, Escherichia coli
  misc_feature (336)..(336): n is a, c, g, or t
  misc_feature (338)..(338): n is a, c, g, or t
  misc_feature (345)..(345): n is a, c, g, or t
  misc_feature (353)..(353): n is a, c, g, or t
  misc_feature (517)..(517): n is a, c, g, or t
  misc_feature (526)..(526): n is a, c, g, or t
  misc_feature (2007)..(2007): n is a, c, g, or t
  misc_feature (2052)..(2052): n is a, c, g, or t
acttgatctttgtaggaattgaaaccaatatttttggatgataggagttctttgatttcttgatctctttgaattgcatagggctcgtagtcatgattgcagaacactgaatcaatttcgtgtttttttgacaaagcggaaaaaacttctttaggcctcccaatacaaacagttagtgaacttccaatttcgttaagttgcttattgatgttttctaactcctgatgaatgtaggatattcgagcatcgtctttcggaagcttattgagaatttcttgatcgaatataaaaataggaagtacctctttgtccgctattaaagcttcatacaatccncnattatcntttaatcngaggtctctcctaaaccaaaagatgttcctttttttattcattatcataggttccaaaaagtgctattaattttttttgtctgtgggcaaaaatttcttctaattttggtttgaccagaaatggatgtacaatttgacccaaaatacccataggtactttatantcaataatntcttccatctctacaccgccatcaatttttttaataaaatgtttgtggtgccagagtgcatagggtccaaaccgctgttcatctacaaaatattctccctctttcacatgcgtgatttctgtgacccattttgttttaattccaagaattggggttactatatattgaattatttgtcctgcaaacatgggtttttctgctccagaaataatattaaaactcatatactctggagtaattgtttttaaatttctagggttcgataaaaacttccaggcttcctctagggagattggtaatttttgttttctatgaaatgtatagattttcattttaattgtgaattagaatgtaaaggtttaatgatgtcgcaatacaaagccataacatgtagggtaggagtaggtatttgtaatacgaagcttttccttctttgaagaagtaataacaaatgagagctgttaataaaatgaggatgattaatccgaataaaattagatgctgattgaagaaaaaatagttccaactcacattcaaaataaaatgaacacaaaaaataaggattaattttaaacgattctgttttacaaataactgtcctaaatatactgagaaacaaatcatgatgattgtccatgcagctccaaagacccagccttcaggagtccaaggggcttgatttaagtttgtgtaccaagaggatgtaggtccattattcattaaccaacttccgatagctaaaccaccaaaattgataaacagaaataaaacagttaattttaattgtttcatttgtttatgattttgactgtaactcctcaattttttttaaaacgtcgtctgcatcctgatacttatgatcactttgacttctattaatcgattgcaatttaaatgcttcctccatcaattttttgtacaattcctgtaatttctctacctctgttttctttttgaataaaccaaacatcattttaagattttaagtgttttgtaatttttgaactcattggtgttgtaattgaataataataatcgatgagtttgccttctggagagactaaatatttttgaaaattccatttcacagaagaactttttttattatttaattctcttgaggttagccagttgtatagtgggtgttgttctttacctttcacatcaattttttcagtgattaagaaagaaacgccatagttgactttacagaattcttcaatttcgtcattgtttccgggttcttgttttccaaattgattgcaaggaaccccaataacgactaagttattcgcatgtgtattgtataatttttccaattctttatattgaggggtaaaaccacatttagatgctacatttacaaaaagcaggtgtttccctttaaaatctgataaatgaatagggttattctggagactcttaatctcaatatcatatatagtcattctttttttttaaattaaattttaaatgttacnattccgcagtctaattcaaaaatttgacctgagattgaagttgcnttatcagagattaaaaagctagccatgtcagcaacttcttttggatgtagatactttttcaaaggatgacgttctgtaatattttcgatcatacgttcattgcgtaataattttgacgccaacgtagtgtctgttacagtgggagcgatcgcattgacacgaattgagggtgctagttctgcccctaatgattttgtcaaaccttcaacagcagactttgcagctgcaacgctggcatgaaaaggcattcctaatttagcagctactgtgctaaagagtaaaatatttggatcggttcccttttttagcgagggtaggtaatgttgaattgtttttacggcaccgatgacattgatttcaaaatcatttctaaaatcatccaattttagacgtgatatcggctttagattaatgctacctggacaatagattaaggaatctattttttcaatttcaggtaactcatctgtcaaaacattacaatcaatatgtgtgagattctgatgggtaattaaaggagaagttctactcaagtttacaattaaattttcatcaatcagggatttcatgattgcatttccaattcctttacttcctcctataattaagattttattcatatgctttaaggtcttcctttcaagcgcttttcgattttttgtttaacagcagtcaagcgcttcatttgatccatgatttctggatctttttcttgtttgtatatctcgttgagctctaatattaaagctttcacctctcttgaggctataattcgatcacttgtagttttgaatgagaattttctgttctcaaattctatagccctttctaataattccatttttttttaattatattctatatttttcgaatataaatataaaagttagaaaagcaactaaaatatgaattttttatgcggttaagggttttcccttcaaacgtttttcaatcttttgtttgattgttgttagtcgtttcatgatatccataatctgggagtctttattttttttataaatctcgttcaatcccaaaattaacgatttggcttttcttgcggccatgattcggtcgctggtcgtaggaaatctcatcttttttgtttcaaactctaatgcttcgtttagtaagtccataagttaatattttaatgtgttttgcaattctactattttttcttgtgtgttaaattttccgccaaaataagaggtaacggttgaagatgtctcatctttaatccctcttgaagaaacacaaaggtgttttgcatctatgataacagcgacatcttcagtttgtaaaatttcttttaattcttctgcaatttggttggtcaatcgttcttgaacttgaggtcttttggcatagtattgcacaattcgattcaattttgacaatccaataacttttcccgaagaaatgtaagcaacatgagctttaccaataatcggaacaaaatggtgttcacagtttgaataaaaagtaatgtttttttctaccaacatttgattgtattggtatttgttatcaaacaaagcaatttttggtttgttgacaggatttaatccggaaaagatttcttctatgtacattttagcaactctcttaggagttccttttaaagaatcgtcggttaaatccaaacccattacatccataatttctgtaaataagctttctatcttgtcttttttttcttcatctgagagtttaaaagcatcttttttcatgggggtttgtaatcccgtgtaaagatggtcatctccaacttcttcaaatgataatctgtttaattcttcggtaacttcttttagttttagttctgtaatcattttgtatcttttttatgtgctgtcatagactattgtctttaagcaaagcacggtttatctttttgatatagagttatttgatattgatcgttgtctcgaacatttaaatcttc

SEQ ID NO: 1062 - DNA, 4000 bp, Escherichia coli
  misc_feature (817)..(817): n is a, c, g, or t
  misc_feature (1524)..(1525): n is a, c, g, or t
  misc_feature (1789)..(1789): n is a, c, g, or t
  misc_feature (1985)..(1985): n is a, c, g, or t
  misc_feature (1989)..(1990): n is a, c, g, or t
  misc_feature (1996)..(1996): n is a, c, g, or t
  misc_feature (3369)..(3369): n is a, c, g, or t
  misc_feature (3648)..(3648): n is a, c, g, or t
  misc_feature (3702)..(3702): n is a, c, g, or t
agaaatgctatacagccttaggatgagggcagagcttgaaggaaagcatgtatctggggcagaaagaataataaatgctgaagagattgaaaaaaccataaaagagcttttaaagaggcctaagctttatgataagatggttataaccattgaaaacattaaagatgtggagtatataccaaaggccttacctatttatagctacgattttaaaagcgtaaaagatgctcataactttgcccttagtatgcttatgaaggagggagtaaaggaagaagtagccttaaagggcttggagcttttaaagaagggtcctaatccaaagggtggcaatatgaggggtgcggtgcttatggatatggaatctggtgagaggcttgaactagaccaagagagaggcataagaactgtgcgctttgattggaaggacagaaggcttataaaaaggcttttgaaagaaaggggaataaaaaggttctaccttgagaggcttttggatgccttagctttggctacaaagaatatacactgcggggttgtggcagagctatgctggagcgatgacccagattatacaacgggctatgtggctgggaaaaacataggctatgtaaggataaaaccaatgaaagaggagggagtccccataggtggaagggtttattttgtcaaaagagaagattttgaaaacttggtagaatgccttgaaaagagagtagtcctaatagaagaattatgatattcttaaatccttatataatgcaagcttaattaactataaactctttgaattgcatttaaagatttttgtttttangattacagggaggaaattttgtaagggaggtaaaaagatgagaaaggtgttggctggaacagccctttttgcacttgcaggactttcctttgccaccaacggagacaaccttataggtgtttctccagcctcaaggggtatgggtggcataggtgtaggtatgcccgtaggacccaccgacagcatctttagaaaccccgcatggatgagccagtacaaaggctttaacctgagctttggtggaatactctttatgcctgaagtaaaggcaaaggttgattttggcggtggtccagtttccggaaaaagtaaagcagacctttttgtagtgccggaagtgggtatagttcatcagataaacaatcaattgacctttggtataggagcttttggagtctccggtatgggtgtggattataggaatcaagacccttcattctccaatatgaacacaaccttccagtttatgaggattataccagcactttcatataagataaacgatgccatttctgtttctggtgctttacatcttgcttacggctctttagatatggaagctgttggattaggcggaggtcaatcccaaacctatggcctaggcttccaacttggtgcagcttataacatgggcgactttgtatacgcaggtcttacctatcaaagcccaatttctatgacctataagagagtttttgactccgatnntgatggaacatatgaagacctcaaacttacccagcctcaagagcttgcctttggtttgggtgtaaagcccatggataacctaaaggtgggtatggatataagatggataaactggaagaatgcaaagggttataaagagttccagtggaaggaccaatgggtaattgccataggtggtgagtacaaacccatacccaagcttgccctaagggctggttataactatggaaagtctcctataaggggtggagcaaaggatcctantaatgccaacactattccaaaccttgcagcgccctttagcgattttcatatagcctacttcaacctcataggcttcccagctataacagaacagcatataacccttggtttgggctatgagtttacaaagacatttagtgtagatttggcatacaaacatgcctttaagaaaactgtaaaggctacagataatttngggnnaggttngcaaatagaagcctccaacgctcaaaacgccatatccataggcctcaactggaagttctaaaaaactccttgggagggctcttcctcccctccttaaaaggtgataagtctcatacaaaattccaaaggcttctggtagaatactctcaaaacttcttaggaggtaatcaatggagtttaggcatgtctttatatgtgttaatcaaaggcctccgggccatcccatgggttcctgtgcagaaaagggaagcagagagctataccaagcctttatggaaaaggttcagatggacccagagctttttatgagtactgctataacaccaacgggctgtcttggtccctgtgggttgggtcccaccatagtggtctacccagatgccgtttggtatggcaatgtaaaaccctccgatgtggaggagatagtgcaaagccacctcaagggtggaaagccagtagaaaggcttgtggtctcaaaagggaagccaccgggtatgttttaaaaggttgggggctatacagcccctggcactccttcttcttcaaactctatttccatcctttctgcgggtattatagtggttatggcatgcttataaacaagggtttgttgacggccatcttccataagtatagtgtataggtcaaaagaccttatccttccctgaagcctcacaccgttgataagataaatagttacctttacccttcttttccttgctgtgttcaaaaaggcctcttgcaacctgtaagccatcttttagctcctcctttccaaaaattccatagttgtctggtaaagtttttctgctaaagaaatataatactgggaattttccaaattttcaagaagttctaatgggaaaacccacaggccaccgtaggcacctacaaaggaccccaaaaggtatcctatggcgtctatgtctccacccaccataccacaggcattaacacctctccaaaaggcctcaagaggctcctctatataccttaaaaagaggaaaattgacaaaggtagggcttcaaagacaaaggtggagtttcctatttcccttatggcttcttcttcatctgcaccagaatccaaaagctttgccaccttatcaagataaaccttgtttttatcatgctttataaaggtctttaggctttcaatgagtgccagcctatccctcaaatctctcaagtcaaagctctcaaggaccaaaaaagaaataagggcagaaactatggcgcttgcatcgtaaatttctttactcctgtgtgttataaggcttacaagcctaccagcctccgcagagaggtaaggattatagtaatggaaaaggcctgttattgtgcaacgaagcacaccttctactgaagagganacaaggcctgcatcatcaaggcccacgccggaggatataaggtctatggctgttataagggtagggtcggggtatctgtggatctcttcttttcctgcccattcctttagcttactaaaaaagtgatgaggctcaaggctttttttctccactatgctttctgcaagcagtatacttatagtggtttcatccgtggtttgctctggctccaagcccaccgatggactgtgaggatgaggctccacaaagccccttacagccccaccgtaaaagcttatnacctcctcaaaaggcacatcttcaaggcttttaccaatagcatctccaagggcnccacccaaaagggttcctttaaacttttcaaggattgtatccatggttttttaaaattatacctccccggaatatatttaaaaacatggtggaaaagataaaaagcataagcaaagaagagctaaaggagctttatgataaggattttcccctgtgggcggagattaacttagagcttcttaaagaaaaggcttatgatttggtggattgggagaacctcttggaggaaatagaggatatagcaaggtcagatttaaaggcttgcaccagtcaccttgcaacgattttagaacaccta

SEQ ID NO: 1063 - DNA, 4000 bp, Escherichia coli
  misc_feature (171)..(172): n is a, c, g, or t
  misc_feature (293)..(294): n is a, c, g, or t
  misc_feature (1067)..(1067): n is a, c, g, or t
  misc_feature (1988)..(1988): n is a, c, g, or t
  misc_feature (2405)..(2405): n is a, c, g, or t
  misc_feature (2747)..(2747): n is a, c, g, or t
  misc_feature (2969)..(2969): n is a, c, g, or t
  misc_feature (2981)..(2981): n is a, c, g, or t
  misc_feature (3317)..(3317): n is a, c, g, or t
  misc_feature (3346)..(3346): n is a, c, g, or t
  misc_feature (3373)..(3373): n is a, c, g, or t
  misc_feature (3406)..(3406): n is a, c, g, or t
  misc_feature (3412)..(3412): n is a, c, g, or t
  misc_feature (3415)..(3415): n is a, c, g, or t
  misc_feature (3443)..(3443): n is a, c, g, or t
  misc_feature (3475)..(3475): n is a, c, g, or t
  misc_feature (3531)..(3531): n is a, c, g, or t
ggcgctccccggactgttgttgctgctgagccccgccctgacgccggcgtggggtgcggatgcgcccgccgccacgcactacgtcctcgatccgtccaagagcacgctggaattcaatttctcgcaggcgggcgcgcagaacaagggcaagttcaagcagctcgcggcgannttcgacttcgcccccgacaacctggcagccagcaggctcgacgtcacgatcgaggtcggctcgctggacaccggtgaccaggaacgcgatgacaccctgcgctccgcggatctgttcgcgnncagcaaattcaaacaggcgcgcttcagcgccacgcagatcgccaagaccgccaccggctacgaggccatcggcaagctcaccatccgtgacgtgacccgcgaggcgcgcgtcccttttgccctgcgtaccgccgccgagaatggcgccagcgtcgtttacatgaccggcaagaccagtgtgcgccgcctcgattacggtgtcgggcagggcgactggaaggcgacggatcaggtcggcaacgatgtcggcgtgaccttcaccctgcggtacgcgccacgctgagccgcggcattcaaagcggcgtgccgtcgcctcgggtcatcttgccgcgggcgtgcggcggactccacatgaggtccacgtcggcgtccgcgtagtacgcggtgtcctgcgggtcgcgattgctgatgacgaggtaggacgccgggcggtcgctgcggttcacgaactgatgcccatcctcggtgccggcgacgaagcccgcgcacatgccggcactgagcagctgctcgccgccgttggtgcgcagcagcagctcgccctgcagcacgtagacgaactcgtcctcgtgcgtgtgccagtgacgcatggaggattccttgccgggcagcagagtcgccacgttaaccccgatccgcgtcagccccagcgcctcccccagcctgcgcacctcacgcggtagcacgcgcgcgcggtacggttccgggtagctgctgcgcgagatggccggcaccgtctgcggatcgagagccggtttcctcagtaacatggngcgctccgggtggtggcgcggttgactcgtgccgctgccttcagggagcatgccataagctgcatgcctgaaatacttgatgacgtcggcaactgcgtcgatgcggtgctgcgccgtatagggccgcgcatcgtgctcgcgctgccgctgggtattggcaagcccaatcccctcgtcaacgagttctaccggcgcgcggcgcgtgatcgcacgctcgacctgaccatcatcacggcgctgtcgctgctgaagcccgtggcacacggggccctcgagcggcgcctggtggaaccgctcgcggaacgtatcttcggcagctatgtcgagccggagtacgcgcgcgcgctgcaggcgaatgcgttgccggcgaacattcgcgtcatcgaattcttcctcaccccgggtgcgttcctcaactgcccgccggcacagcacaactacctcagcgccaactacacgcacgtggcgcgcgaggtgctggcccggggagtcaacgtcatcgcccacctggtcgcccggcgcacgctcaacgggcagctgcagctgagcctggggtcaaatccagacgtcaccgtggatctgttgccgcggatcgagcaggcgcggcgtgaaggtcgcgacatcgtcctgatcggcgagacgcacgcgcagatgcccttcatggcaggccaagcgcagctggagccggagcgcttcgattacctcgtggaccacccgcgctacgactacgacctctttgggccgccgaacgcgccgctcagcagcgccgcgcacgccatcgggctgtatgcgagcgccctggtgcgcgacggcggcacgctgcaggtcgggatcggggagctcggggatgcgctcatctatgcgctgctgctgcgccaccagcagaacgaggcgtggcgcggcgcgctggccgcgctggcngccggccgcgccgccgaatccattggcgccagcggcggggaggcgcccttcacgcacggcctgttcgcggccagcgagctgttcgtcgaccagctgctggaactgtaccgcgcgggcgtgctgcgacggcgcgcctatgacagcctgccgatcgagcggctgctggcgggcggggagccggagcgcttcgacgcgacgctgctacccaagctgctcgccgccggcgtcgggccgctgctgaatgaggcgcagttcacggacctcaagcgccacggcgtgtttcgcgaggaggtggagttcgacggcggccgcgtgcgcgcgcgcggcgggcagtggatcaacgcggacctgagcgatgccgggagctgcgcgcgcatggcagcggagtgcctggggcgcgaactgcgcaacggccangtgctgcacgcgggattcttcctgggcccgcgcagcttctacgccgcgctgcgggagctgccggaggatgaacgcgcgcagttctccatgcgcggcgtgggctacgtcaatcagctgtatggccaggaccaggagctgcgcatgctgcagcggcgcggcgcgcgctgcatcaatacggcgatgatggtgacgctgctgggagctgccgtctcggatgcgctcgagagcggccaggtggtgagcggcgtggggggccaatacaacttcgtggcgatggcgcacgcgctgccggacgcgcgctcgatcctgtgcgtgcgcgccacgcgcacccgccacgggcanaccacgtccaacatcgtgtggagctacggtcacgagaccatcccgcggcacctgcgcgacatcgtcatcaccgaatacggcatcgcggatctgcgcggcgcaacggacgccgaagtgatcgccgcgctgctgaacgtcgccgactcgcgtttccagccgcagctgctggcgcgcgcccaggcggcgggcaagatcggcgcggattacgcgatcccgcaagcncaccgccacaancttccgcaacgcctggcccgcgcgctcgagactcaccggacgcggggattcttcagcgaatatccgtttgggaccgacctcacgacagaggagatcgcgctggcgcgcgccctgaaattcctggacgcccgcaccagctcgctcgccgcgcgcctgcgcaccgtgggcgcggcgctgctgcacggtaaaccggcggcatcccacgcggcggcactgcggcgcatgggcctcgagcgcccgcgcggcgccgccgagcgcctgcagcagcgcctggtggtactcggcctggatgcgactgcggcgccgtcgccgggcgcctgagccctcagcgcctgnccggccgtcgccgcgcgcgcttcgccggngcgcggcgcgtgaccttgcgtgccatnttggcgcgcatcttgcggctggcggccgcgcgncgcacnttngctggcttggcccggccgcgcttggatnccggggcttgcttgcgcggggtgcgcttcgcnggtcgtttcttcctggccggggccttgcgggcctttttcctggccggcggccttgncgccttggcgctgtccgtgccgcgcagctgatcgaggatcgccgggttctccagcgtcgagacgtcctgggtgatctcctcgccgcgcgccaccgacttcagcaggcgccgcatgatcttgcccgagcgcgtcttgggcaggttgtcggcaaagcggatgtcgtcgggcttggcgagggcgccgacctgttcggccacccaatcgcgcagctccttcaccagcgcgctggtgtcgccggtgggtcgctggccgcggcacacgacgaacgcgaataccgactcgcccttgatctcatgcggcttgccgacgacggcagcttccgccacccgcgggtgcgccaccagcgcggactcgacctccatcgtgcccaggcggtgaccggcgacgttcagcacgtcatcgatgcgccccatgatccacaagtagccgtccttgtcgcggcgggcgctgtcgcccgcaacatagaag

SEQ ID NO: 1064 - DNA, 4000 bp, Escherichia coli
  misc_feature (1311)..(1311): n is a, c, g, or t
ctgattggagtaaaattacagagttagttgagcatctagcaccaactggtgtaccagtacttggcaatggtgatatttggtctggattagatgcgataaacatgatctcccaaactggttgcgcaggtgttgtagttggtcgtggttgcctaggacggccctggttgtttgcagatttagttgcagcatttaatggcgagcaaagtagggtaaatccaaatttatttgaggttagaaaagttatgttgcgacatggtcaattattagttgagtactttgaaaatgaggatcgagcaatgcgtgatattagaaaacatatggcttggtatttaaaaggtttctcagttcctcgtgagattagatcaagccttggcatggtttcatccttagatgagatggagaaattactctctggggttagcgatcagccatatccgcaggcggtaggggatgcaccccgcgggcgcagcagccatggccggccagtatcactacctgatggttggcttaatgatccagatgagtttgccactatcacaatcgatgatgctatttcaggtggataaataattgtttttatttaaattaattagaagagttatctcatttgtgttactactaataattgttattccactttatatagctggaagcatttggtatacaggcagaaatagcgagctagttaaaggtgatgtaattttagtaatgggagcagcccaacttgatggccgaccaggtgatattttgctagccaggcttaagcaaagcaaagcaatatttaaattagatatggcccctcgtatctatacagttggcgcaggtgcgcctggagatcgcacaactgaggcagcagctggcagagattggttaattaaaaatggtattaccaaagccaacgttttagctattgcaaaggggcgcgataccttaagtagtacacaggcttatgcgcagcagatgaagaaagtgaagttatcctcagtaattattgttaccgatccataccattgttatcgcgcaattaaaatggcgcaggatttaaatctaaaagctatctgctccccagttatggccggacctggttcaattacaaactctagttttaagtacttaggtagagagactggtgcctatcttgcctatataactgttggcaggctggggattaagttaagtgatcgggttaatttagccagcagataggattactaaatggttttacgagcagcagctgaacaccctggctacacaccagcggatcgagaaagattttttgatgaaccagcaaagcgtggcgggcgaactgantttgctagagatcgcgccagaattattcactcatttgcactgcgccgccttgctgcaaaaactcaggttgcagttccatgggcaaccgattttccacgaaccagactttctcactcacttgagtgcgctcaagtaggacgggagttaggcgctgcacttggcgctgaccctgatttaatggagggtgcatgtttagctcatgacatcggacatccaccatttggtcataatggtgaagaggttttaaatcaattagctcactcctgtggcggctttgaaggaaatgcgcaaagtctaagattattaataagacttgaagcaaaaacagttttagtagatggtaaatctgttggtttaaatctcacccgggcatccctggatgcagctacaaagtatccctggagcagagttgttaatgctaaaaagtttggtgtctatgaggatgatcttgagatctttaattggtatcgaagtggagttgaatctggcaaaacctctatcgaggcacagatcatggattggtcagatgatgtggcatatagcgtgcatgatatggaggattcacttgtatctggtcaaatcaaattagatcaattaagtaatgatctaccaaaattatttaaggttgccaaagatatgtatctggaagatattaccgaggctgagatggtaatcgcgctcactgcgctacaaaagatctcctgttggccccgttactacgatggcacccaccgctcacttgctcgacttaaagatttagcaagccaattaataggtagatttgcccaagccgcagaggtggcaactcaagaaaaatatggtgattctaatttaaccagatatagcgcaaatttagttgtgccacgtgcgcaacgagttgaggtggcactacttaaatcaatggctggacattatgtaattaatgccgatacttcacagattcgatatggcgagcaacaaaaacttcttactgaattagttgaagcgatactagctagcgccccagcaacactagaaggcttcttcttgcaggattggcagcgggcagaaaatgatcaacaaagagttcgggtagtaatagatcaggttgcctccctgaccgatccgggggcgatagcgctgcataatcgcttaatcaacaggtgagtaattcaaactgtcggtttggaaactaggataggaagtatggccgggcgaattaaagatgaggatgtgacatacatccgcgagcactcaccaattgatgatgtagtcggtgattatgtgcaattaaaaggtgcaggtggtggccagaaaaaaggcttatgcccatttcatgatgaaaaatcgccctcatttcatgtcacccctagcaagggatatttccactgctttggttgtcaggttggtggggatgtaattgcatttattatgaagttagagcacttaacatttatagagacggttgagcgcctagctgatcgaattggttacacaattaagtatgaaacaagtggcgccagcaatagcggtccatcaattaatcgctcaagattagttgcagcaaatactgcagcctcaattttttatcaggagcagttacaacttccagccgcccaacatgggcgagatttcttaactaagcgtggatttgatcgtgatgctgctaaaaactttaatgttggctacgcccccgatgagtgggatggtttatttaaacatctaactggtaaaggctttaccagtgaagagttaaatctagctggtttagttaaagagggtacaaaaggaatgattgatcgatatcgaaaccgtttaatttggccagttaaagatatctcaggtgatgtagttggttttggtgctagaaaacttgccagtgatgaggttgataccgggcctaagtatttaaattcaccagagacgccggtttataaaaagaatcaaattctttatggtcttgatatggcaaagaaggagattgcaaaaaatcgtcaagtggtaattgttgagggttataccgatgtaatggcagctcaccttgctggtgtcaccaccgctgttgccacttgtggcaccgcctttggtgaggagcacataagaattatcagaagacttttaatggatgcggatgcatttcgcggtgaggtgatatttacctttgatggagatgccgcagggcagaaggcggcgcttcgcgcatttgaggatgatcaaaagtttgtagctcagacatttgttgcagttgagccaaatggtatggatccatgtgaacttcgccaagcccatggtgatgatgcagttcgtaacttagttgcaagaagagtgccactatttgagtttgcaattaaatcagtaattgctaattacgatataacagctgctgaaggaagagttaatgcacttaatcaggttgcgccactaattgggcggatcagagatgcctcactgcgaccagagtatgtccgcttacttgccggctggcttggtatggaggttgatattgtctcaactgcagttaaacgaagtggcaaaacaggtgaaatacaaagtgcgcccagagttaatttaacagatccagttttagtcttagagcgtgaggtattaaaggttaaattacaactgccagaacttgccagcagttgggttgatttagaagcagctgccttttcatttccactttataaccaattgcgcgtactaattgata

SEQ ID NO: 1065 - DNA, 4000 bp, Escherichia coli
  misc_feature (221)..(221): n is a, c, g, or t
  misc_feature (228)..(228): n is a, c, g, or t
  misc_feature (404)..(404): n is a, c, g, or t
  misc_feature (426)..(426): n is a, c, g, or t
  misc_feature (550)..(550): n is a, c, g, or t
  misc_feature (706)..(706): n is a, c, g, or t
  misc_feature (721)..(721): n is a, c, g, or t
  misc_feature (742)..(742): n is a, c, g, or t
  misc_feature (766)..(766): n is a, c, g, or t
  misc_feature (791)..(791): n is a, c, g, or t
  misc_feature (802)..(802): n is a, c, g, or t
  misc_feature (804)..(804): n is a, c, g, or t
  misc_feature (1132)..(1132): n is a, c, g, or t
  misc_feature (1379)..(1379): n is a, c, g, or t
  misc_feature (1581)..(1581): n is a, c, g, or t
  misc_feature (1997)..(1997): n is a, c, g, or t
  misc_feature (2710)..(2710): n is a, c, g, or t
  misc_feature (2752)..(2752): n is a, c, g, or t
  misc_feature (2870)..(2870): n is a, c, g, or t
  misc_feature (3628)..(3628): n is a, c, g, or t
  misc_feature (3642)..(3642): n is a, c, g, or t
  misc_feature (3646)..(3649): n is a, c, g, or t
  misc_feature (3695)..(3695): n is a, c, g, or t
  misc_feature (3702)..(3704): n is a, c, g, or t
  misc_feature (3708)..(3708): n is a, c, g, or t
  misc_feature (3715)..(3715): n is a, c, g, or t
  misc_feature (3718)..(3719): n is a, c, g, or t
  misc_feature (3723)..(3725): n is a, c, g, or t
  misc_feature (3728)..(3729): n is a, c, g, or t
  misc_feature (3732)..(3735): n is a, c, g, or t
  misc_feature (3738)..(3738): n is a, c, g, or t
  misc_feature (3741)..(3741): n is a, c, g, or t
  misc_feature (3747)..(3751): n is a, c, g, or t
  misc_feature (3754)..(3758): n is a, c, g, or t
  misc_feature (3762)..(3762): n is a, c, g, or t
  misc_feature (3764)..(3765): n is a, c, g, or t
  misc_feature (3771)..(3772): n is a, c, g, or t
  misc_feature (3775)..(3783): n is a, c, g, or t
  misc_feature (3786)..(3787): n is a, c, g, or t
  misc_feature (3791)..(3800): n is a, c, g, or t
  misc_feature (3804)..(3808): n is a, c, g, or t
  misc_feature (3813)..(3822): n is a, c, g, or t
  misc_feature (3825)..(3825): n is a, c, g, or t
  misc_feature (3828)..(3830): n is a, c, g, or t
  misc_feature (3835)..(3835): n is a, c, g, or t
  misc_feature (3841)..(3842): n is a, c, g, or t
  misc_feature (3848)..(3854): n is a, c, g, or t
  misc_feature (3857)..(3863): n is a, c, g, or t
  misc_feature (3868)..(3869): n is a, c, g, or t
  misc_feature (3873)..(3875): n is a, c, g, or t
  misc_feature (3878)..(3879): n is a, c, g, or t
  misc_feature (3884)..(3888): n is a, c, g, or t
  misc_feature (3891)..(3891): n is a, c, g, or t
  misc_feature (3893)..(3901): n is a, c, g, or t
  misc_feature (3904)..(3906): n is a, c, g, or t
  misc_feature (3909)..(3915): n is a, c, g, or t
  misc_feature (3920)..(3922): n is a, c, g, or t
  misc_feature (3925)..(3925): n is a, c, g, or t
  misc_feature (3930)..(3941): n is a, c, g, or t
  misc_feature (3944)..(3946): n is a, c, g, or t
  misc_feature (3949)..(3953): n is a, c, g, or t
  misc_feature (3957)..(3963): n is a, c, g, or t
  misc_feature (3966)..(3966): n is a, c, g, or t
  misc_feature (3972)..(3974): n is a, c, g, or t
  misc_feature (3977)..(3982): n is a, c, g, or t
  misc_feature (3985)..(3991): n is a, c, g, or t
  misc_feature (3994)..(3995): n is a, c, g, or t
  misc_feature (3998)..(4000): n is a, c, g, or t
tgagccactacctgattgagaaactcaccgccgcaggatacgagatgatcgaccacggccccaccgaatatgacccgctggatgattaccccagcttctgcattaacgcggctctcgcggtgaaacgtgaccgtgacgccgggcttgattctcttggcattgtgcttggcggctccggtaacggggagcagatggcggctaataaggttgagggtatccgngcagccntagcctggaaccacactacggcggcgctcgcacgcgatcataataatgcgcaagtggttgctgtgggtgggcgccagcattcaccggatgaggcgttggaaatcattaaagttttcctcagcaccccctggagcggagaggaacgccacgcccgtcgtattgggcagcttggcgantatgagcagaccgggaagatcnctggcaaacatattgacgaataaataagtcccgccccacttttgcccctaccgctaaggagaagcgcgtgcctgaaggccactctattcaccgtatagcccgccaattcaacgatgtgtttacnggggagcgggtgcgtgttactagcccgcagggccgctacgctgaaggggctgcgctggttgatggggcacgtattgcccaggcgtttgcgcacggtaagcatctttttgttgggttcgacaacgaattgacgttgaacgtgcacctggggatttanggcaactggagtttnggcggggacgaatcgttcacnggcgcctcaagtattggggcgccncgcaagattggtgagaaagaatacngtggtggggancnccccgagtattctggccctcctcagccaaaagcaactactcgctgccgtatcgtctcggagcatggttgggctgaccttgtgggccccactgtttgccgcactctcaccccggacgaggttgctgtggtgcgtgggaagctggggccagatccgctgaacgctgatgctgacccggggcagttctaccgtgccgccgctaaaagcagccgcccgatcggggtgattctcatggatcaggcagctatttccggggtgggtaatatttttcgtgccgaatcgctgtaccgccagaaaattgacccgttacgccccgggaagacactcagngatgatgagctgcgccgcctgtgggacgataataagcatctgctcaccattggtgtgcgtgtgggcagaatcattaccaccgagcagcaggatcgtcccggtatccctgaaactgaggcgtggcctgatcacgcaaactatgtgtatatgcgccacgggcagaagtgcccgcgatgcagtgccaccatccgcatggaagaaatcgccgggcgtaaactttactggtgccctgggtgccagaaataantcgtatgttcggggtggttttgggtagaacttgacagcttcaaacatatgccgctaatctaagtgagttctttggggatgtagcttaatggtaaagcctcagtcttccaaactgatgacgcgggttcgattcccgtcatcccctcactcaaagagacccaaaggtttttacctttgggtctctttgtgctttgagaagtagnttaaaaattacctgcccctggcttggggcagggacgaagccgctgatttttgctaacttgctgaaataacctgtgacaagggctaatgccgttaacgtcaaagaagcgggcgggctagatcaccagccgcaccccaaaatttccgggttccagcccggtggcacgggagatagcttctgtggctgctaaaagaataccgctaaagttagttggctgcccggctgtttctagctcaggcacgtcaacaacccacccggttccttcccggtgggcaatagcgtcatatgttttcaggttcatgcttacctccgtgtctttatatatgctagggctgagagcctcaaaacacaaggtcttaacgtgaggtttaatataaaaaccgttgtcagcggcctgttggggccgctgtggccgcncaggaacataaatatgcggcccctgttaggcatttacccaaatacccgctaaacttgtgtgttgggtatgcgaaaagtaccttacggggcgtggcgtagcttggctaacgcgcctgctttgggagcaggagatcgcaggttcgaatcctgtcgccccgacggaaataggctcacccagcgcctttttcagacaccatgagcggttcagagaacgttccgccaccgaactacttacgaggagatcaacggacgtgaagaccgccgtcgagaagctcaacccgaccctggcaaaaattgaggtcgaggttcctttcgccgagttcaagccttacctggaccgcacctacaagaaccttgccgagcagattagcgtccccggtttccgcaagggcaagctgcctaagcagctgattgagcagcgtgcgggcttcgactacattgttgaggcttctctgaatgaggctctgaacgatttttacgcccaggctcttggtgagaatgaactgtcgccgctggctcagccggaactgaacgtgcagtctcagcccaccgtgcaggagcgcgaagctgatgttaagctcaccattgaggtgactgtgcgacccgagatcgaacttcccaagtatgaggggattgaggttgaggttgatgacgttgaggtaaccgccgacgacgagaaggaagcccttgacgggctgcgtgagcgtttcggntctttgaagactgttgagcgtcccgcagcagataacgacttngtaaccattgacattgcggccgaaattgacggcgagcaggtggacgctgccaacgacctgtcataccagatcggttcgggcaccatgcttgagggtattgatgaggccctgctgggcntgtcggctggtgaggacgcaacgttcgagaccaagctttctggtggggatcacgccggtgagcaggctgttattaaggtgaagctttccgccgtgaaggagcgtgaacttcccgaagctgacgacgagttcgcccagctggcctctgagttcgacaccattgatgagctgaaggaagacattaagaagcaggtctccgaggctaaggtcgccgatcagggttcgcaggcacgcgataaggtgctggctaagctcgttgagatggttgagattccggttcctgagaaggttattgaggaccagctggagcagcacttcaacaacccgaacgctgaggctgaccacgacactgaggagcaccgcgctgaggttcgtgagaacaccaagaccgcgtttaagaacgagatggtgcttgatgctatcgccgacgccgaagaggttgaggttaaccagaacgagatgatcgagtacatcatcacgatgagctcccagtacggcatggacccgaaccagtttgctcagatgctggatggctccggccaggcgggtatgctggtgggcgaggttcgccgctccaaggctttggctgaggtgctgaagaaggctgtggtgaaggactccaagggtaacgttgtggacctgtcctcataccttgaggacaacaaggaagaagaggctaagtagcagcctcgttactcccgctggctgaacaggcctaacctcatattgtgggcgcatccaaccgctaggtttgggtgngcccacaatatttnaaannnnctggtgaagaacaagacttagcgggtggcgctggcgcggggtctgnggcttcnnngggngtaaccnttnncccnnnggnnaannnnggnaanaacccnnnnnccnnnnngggnanngggggnnttnnnnnnnnnaannaaannnnnnnnnncccnnnnnggggnnnnnnnnnnccnccnnnttaanaaaaanngggaannnnnnnggnnnnnnnccccnncccnnnggnnccggnnnnnccncnnnnnnnnnggnnnccnnnnnnnttggnnnccnggaannnnnnnnnnnnaannnccnnnnnaaannnnnnnttntttggnnnggnnnnnnggnnnnnnnttnnaannn

SEQ ID NO: 1066 - DNA, 4000 bp, Escherichia coli
  misc_feature (1066)..(1066): n is a, c, g, or t
  misc_feature (1949)..(1949): n is a, c, g, or t
  misc_feature (1981)..(1981): n is a, c, g, or t
  misc_feature (1988)..(1988): n is a, c, g, or t
  misc_feature (2007)..(2007): n is a, c, g, or t
  misc_feature (2040)..(2040): n is a, c, g, or t
  misc_feature (2666)..(2666): n is a, c, g, or t
  misc_feature (3444)..(3444): n is a, c, g, or t
  misc_feature (3572)..(3572): n is a, c, g, or t
  misc_feature (3600)..(3600): n is a, c, g, or t
  misc_feature (3798)..(3798): n is a, c, g, or t
  misc_feature (3871)..(3872): n is a, c, g, or t
gaaaaatttattccttcaaaagctatggctattccctatgaactatcaaaagtgtcagcgcaaaaagatgaaagtagaactcactcttattttgaagatggcgacgacccggatgagctactaaagctaccacaagatatcattgataccattattcagcttaactccatacatcacacagggtgtataatatttgaagcattgccaactcacctcaaaattcacaattactatacgttgctcgatcatagtcaagagcagcggtttaaaaccctgttagcaaagcttgtcaaacaaattcctaacataaaagggctaggcatatcagggtttatgaagttaccctataaagatacacgcttttttgagcacaaagcaaaattgcccgagaagtattatccgcgaaaccccaaagcagttattgaagagaacgtacaacatgtctgaaattaaactatcgtcactatttgaactcgaaacagtggaagctggcatctatcggggtcagagctgggatttaggctttagagctttatttggcgggcaggttttggggcaagcactggcggcagcctatgagacagtatcaccagacagagtggcgcactcatttcatacctacttcttattgccaggcgatactaaaaaaccggttgtttacgatgttgaaatagtacgcgacggaagaagcttttcagcgcgtcgagtgaaagcgatacaagatggcagaaatattttttacatgacggcatctttccaggtgccacaagatggtatggagcatcaaaaccccaccatgccagacgttccggcgcctgaagacgttcagtctgacatagagttttacgaagcgaacttcaacaaaattgcgcgtcctatgcaagaagcattgagctaccataaaccggtagatattcgcactgtagatgctgctaattcatatcactcagctaagcgtgagcctactcgttatatttggctaaaagcaagagacacaatggatgcgcaattagccgtgcaccaagctgcacttgcttacgcgtcagattaccactttcttagcacntcgctacagccacacggcgttgcagtgaccgataagtctcttcgaattgcaaccattgatcatgctatgtggtttcatcgcccaattagcatgaatgaatggatgttatatgcaatggaaagtccttttagtggtggttctagaggcttggttagaggtcaaatatttaaccaaagtggtgaacttattgcctcaaccatgcaagaagggttaatgagaaaagtagatgaatagggagataggcatgcgttataagttaggttcagaaacacctgatgttcataaaagcgtatttattgcgccgggcgcccacgttattggtaatgttgaactgaaaaaaggcgctagcgtctggttcaatgccgtaatacgcggggatatggacaagataacagtgggtgaaaacactaatatacaagacggtagtgtgcttcatacagacgcgggtattccactagctcttggtaccggtgtaactgttgggcacaaagtcatgcttcacgggtgtgaaattggcgattattcgctggtgggcatcaatgctgttgtgctgaacggcgctaaaattggcaagtattgtattattggcgcgaacgcactaatcaccgaaaacatggaaattcccgattacagtttagttgttggctcacccggaaaagtaatcagaagtttcgatagtagcgtagagcctaaactacaagcgtcggcggcgcattatgttgagaacgctaaaaactatctagcgtcactaacgttaataaacgagtagtatcttttaacttaactttcgcgtaccccataaaaaatgcccagaacaaacgttccgggcctaggggaatggctcattgctgagccgtgcgctaacttttactgggagagttanaacaaaatcttccaaacagaatttaattatanaatacgnctggatattttttaaacantttttgtgtgaattttatcttacacaccttaanttaggctaattgtagtactaaacctatgcttatcaagtgactacaatctggtcggatgtgcttcgctcaacggctatttcactacccatttgctatctacttttatttagcgcttcttacttagtgttctatatatacgatttagaatctataaccaatttcccattcatgttatttatcttgggaacaggtggttgttcctttttattaacattgtagtatgtcgaaagttatcgtaactatggattacgatattaatattataaacacgccttacatcgctaagaggatggattatgcaatcgctatctacttttattccccctgaacgcaccttgatgggacctggaccgtccgacgttaaccctcgcatactgaatgctatggcaaggccaacacttggtcatttagacccgttgttcattgaattaatggaccaaaccaaacaactacttcagtacgcttttaaaaccgagaatgcgttaacaatgccaatttccgcgcctggttcggcgggaatggaagcgtgttttgtgaaccttgtagagccaggcgataaagtcctggtttgcataaacggcgtgtttggcatgcgcatggtcgaaaatgttgaacgctgtggcggngtagcgataaccgtcaacaatacatggggcgagcaaaccgatttaaatgcagtagaagatgcgttaaaagcagaccctgctatcaaggtacttgctttcgtacacgccgaaacgtccactggcgtacgtaatgaagcccaggcactttgtgctctcgctaaacagtacgactgcctaagtatcgttgatgccgttacttcgttaggtggtattgagttagatgtagacggttgggaaattgatgcaatttattcaggttcacaaaaatgtttgagctgcgttccaggtatttcacctgtttcatttagtgaaagagcagtgaacgttatacagaaccggaaaaccaaagtacaaagctggtttttagatatgaaccttattgttggctattgggggcaaggcgctaagcgcgcttatcaccacacggcaccagtaaatagtatgtatgccatgtatgaagcgcttcttattttaagagaagagggattagaaaatgcgtggaagcgccatgccaatggccatgctaagctggctgctggtctacatgatttaggattagatttaaccgtagatagcaactaccgtttacctcagttaaacgtagtaaaaattccagaaggcatagacgatgcttcggttcgcaagcaactgttggaagacttcaacctagaaataggcgctggcttgggtgaacacgcaggcaaagtatggcgcattggtttaatgggatacgcgtgcaagccgcgtaacatcgaccactgccttgctgcgcttcganctgtattaaagtaaagccccaatgcacaggcttttgtctcgtaagcttaagcgtcggtgttcacccgcttgtgaacaccgacgctaggaccagttggttgcctaaggggcaactattttcatcgcttnccggcgcccttaccgtataaaaactacntttcaccgacgtatcagataacctagctcatattcagtgttactatgcggttagcccgagtattcataaactattcagttataaacgcttatccttggtatttagtaatcattgtcatttaagtctgatgagacctaagatgattacattaaataacaccatcaataaggaaaccctatgaaacgactttcgcttaanaaaaatgcaataccttcaaaagcgcttatagcatcagcgttcttggcgttattaacgccatttgtctgtgcgnncgccgccgagagcgctagcataagtgtacaaggggtaggtgccatagaggtgacgcccaacgcttactctgtaacgcttgttgtggaagagcagggcaacacggtaggcaaactcaatacccagctcg

SEQ ID NO: 1067 - DNA, 4000 bp, Escherichia coli
  misc_feature (1)..(1): n is a, c, g, or t
  misc_feature (3)..(7): n is a, c, g, or t
  misc_feature (9)..(10): n is a, c, g, or t
  misc_feature (14)..(14): n is a, c, g, or t
  misc_feature (16)..(16): n is a, c, g, or t
  misc_feature (19)..(23): n is a, c, g, or t
  misc_feature (26)..(26): n is a, c, g, or t
  misc_feature (28)..(28): n is a, c, g, or t
  misc_feature (30)..(31): n is a, c, g, or t
  misc_feature (33)..(34): n is a, c, g, or t
  misc_feature (36)..(38): n is a, c, g, or t
  misc_feature (40)..(46): n is a, c, g, or t
  misc_feature (50)..(50): n is a, c, g, or t
  misc_feature (52)..(53): n is a, c, g, or t
  misc_feature (55)..(56): n is a, c, g, or t
  misc_feature (59)..(61): n is a, c, g, or t
  misc_feature (64)..(68): n is a, c, g, or t
  misc_feature (70)..(70): n is a, c, g, or t
  misc_feature (73)..(73): n is a, c, g, or t
  misc_feature (76)..(77): n is a, c, g, or t
  misc_feature (80)..(86): n is a, c, g, or t
  misc_feature (88)..(88): n is a, c, g, or t
  misc_feature (90)..(97): n is a, c, g, or t
  misc_feature (100)..(101): n is a, c, g, or t
  misc_feature (103)..(107): n is a, c, g, or t
  misc_feature (110)..(110): n is a, c, g, or t
  misc_feature (112)..(112): n is a, c, g, or t
  misc_feature (115)..(121): n is a, c, g, or t
  misc_feature (123)..(124): n is a, c, g, or t
  misc_feature (126)..(126): n is a, c, g, or t
  misc_feature (128)..(130): n is a, c, g, or t
  misc_feature (132)..(133): n is a, c, g, or t
  misc_feature (135)..(136): n is a, c, g, or t
  misc_feature (139)..(139): n is a, c, g, or t
  misc_feature (141)..(142): n is a, c, g, or t
  misc_feature (144)..(149): n is a, c, g, or t
  misc_feature (151)..(151): n is a, c, g, or t
  misc_feature (153)..(155): n is a, c, g, or t
  misc_feature (157)..(160): n is a, c, g, or t
  misc_feature (164)..(168): n is a, c, g, or t
  misc_feature (170)..(172): n is a, c, g, or t
  misc_feature (175)..(175): n is a, c, g, or t
  misc_feature (178)..(189): n is a, c, g, or t
  misc_feature (191)..(195): n is a, c, g, or t
  misc_feature (197)..(200): n is a, c, g, or t
  misc_feature (203)..(204): n is a, c, g, or t
  misc_feature (206)..(210): n is a, c, g, or t
  misc_feature (212)..(212): n is a, c, g, or t
  misc_feature (215)..(216): n is a, c, g, or t
  misc_feature (218)..(221): n is a, c, g, or t
  misc_feature (223)..(223): n is a, c, g, or t
  misc_feature (226)..(231): n is a, c, g, or t
  misc_feature (233)..(233): n is a, c, g, or t
  misc_feature (235)..(235): n is a, c, g, or t
  misc_feature (237)..(240): n is a, c, g, or t
  misc_feature (242)..(242): n is a, c, g, or t
  misc_feature (244)..(251): n is a, c, g, or t
  misc_feature (255)..(256): n is a, c, g, or t
  misc_feature (259)..(263): n is a, c, g, or t
  misc_feature (266)..(268): n is a, c, g, or t
  misc_feature (272)..(274): n is a, c, g, or t
  misc_feature (276)..(281): n is a, c, g, or t
  misc_feature (283)..(283): n is a, c, g, or t
  misc_feature (285)..(287): n is a, c, g, or t
  misc_feature (289)..(289): n is a, c, g, or t
  misc_feature (291)..(293): n is a, c, g, or t
  misc_feature (297)..(303): n is a, c, g, or t
  misc_feature (305)..(306): n is a, c, g, or t
  misc_feature (308)..(310): n is a, c, g, or t
  misc_feature (313)..(314): n is a, c, g, or t
  misc_feature (317)..(317): n is a, c, g, or t
  misc_feature (319)..(326): n is a, c, g, or t
  misc_feature (328)..(331): n is a, c, g, or t
  misc_feature (334)..(340): n is a, c, g, or t
  misc_feature (342)..(350): n is a, c, g, or t
  misc_feature (354)..(357): n is a, c, g, or t
  misc_feature (359)..(364): n is a, c, g, or t
  misc_feature (368)..(368): n is a, c, g, or t
  misc_feature (371)..(375): n is a, c, g, or t
  misc_feature (379)..(382): n is a, c, g, or t
  misc_feature (386)..(386): n is a, c, g, or t
  misc_feature (388)..(389): n is a, c, g, or t
  misc_feature (391)..(391): n is a, c, g, or t
  misc_feature (393)..(394): n is a, c, g, or t
  misc_feature (396)..(396): n is a, c, g, or t
  misc_feature (398)..(398): n is a, c, g, or t
  misc_feature (400)..(406): n is a, c, g, or t
  misc_feature (409)..(413): n is a, c, g, or t
  misc_feature (416)..(419): n is a, c, g, or t
  misc_feature (421)..(422): n is a, c, g, or t
  misc_feature (424)..(426): n is a, c, g, or t
  misc_feature (428)..(428): n is a, c, g, or t
  misc_feature (430)..(433): n is a, c, g, or t
  misc_feature (435)..(436): n is a, c, g, or t
  misc_feature (439)..(442): n is a, c, g, or t
  misc_feature (444)..(444): n is a, c, g, or t
  misc_feature (446)..(446): n is a, c, g, or t
  misc_feature (448)..(448): n is a, c, g, or t
  misc_feature (450)..(453): n is a, c, g, or t
  misc_feature (455)..(460): n is a, c, g, or t
  misc_feature (462)..(463): n is a, c, g, or t
  misc_feature (474)..(474): n is a, c, g, or t
  misc_feature (642)..(642): n is a, c, g, or t
  misc_feature (810)..(810): n is a, c, g, or t
  misc_feature (897)..(897): n is a, c, g, or t
  misc_feature (903)..(903): n is a, c, g, or t
  misc_feature (924)..(924): n is a, c, g, or t
  misc_feature (1041)..(1041): n is a, c, g, or t
  misc_feature (1116)..(1116): n is a, c, g, or t
  misc_feature (1206)..(1206): n is a, c, g, or t
  misc_feature (1209)..(1209): n is a, c, g, or t
  misc_feature (1221)..(1221): n is a, c, g, or t
  misc_feature (1310)..(1310): n is a, c, g, or t
  misc_feature (1419)..(1419): n is a, c, g, or t
  misc_feature (1464)..(1464): n is a, c, g, or t
  misc_feature (1515)..(1515): n is a, c, g, or t
  misc_feature (1533)..(1533): n is a, c, g, or t
  misc_feature (1551)..(1551): n is a, c, g, or t
  misc_feature (1611)..(1611): n is a, c, g, or t
  misc_feature (1689)..(1689): n is a, c, g, or t
  misc_feature (1695)..(1695): n is a, c, g, or t
  misc_feature (1734)..(1734): n is a, c, g, or t
  misc_feature (1794)..(1794): n is a, c, g, or t
  misc_feature (1803)..(1803): n is a, c, g, or t
  misc_feature (1812)..(1812): n is a, c, g, or t
  misc_feature (1866)..(1866): n is a, c, g, or t
  misc_feature (1875)..(1875): n is a, c, g, or t
  misc_feature (1878)..(1878): n is a, c, g, or t
  misc_feature (1881)..(1881): n is a, c, g, or t
  misc_feature (1949)..(1949): n is a, c, g, or t
  misc_feature (1968)..(1968): n is a, c, g, or t
  misc_feature (2692)..(2692): n is a, c, g, or t
  misc_feature (2698)..(2698): n is a, c, g, or t
  misc_feature (2793)..(2793): n is a, c, g, or t
  misc_feature (2822)..(2822): n is a, c, g, or t
  misc_feature (2828)..(2828): n is a, c, g, or t
  misc_feature (2870)..(2870): n is a, c, g, or t
  misc_feature (2954)..(2954): n is a, c, g, or t
  misc_feature (2963)..(2963): n is a, c, g, or t
  misc_feature (2966)..(2966): n is a, c, g, or t
  misc_feature (2987)..(2987): n is a, c, g, or t
  misc_feature (2996)..(2996): n is a, c, g, or t
  misc_feature (3032)..(3032): n is a, c, g, or t
  misc_feature (3053)..(3053): n is a, c, g, or t
  misc_feature (3095)..(3095): n is a, c, g, or t
  misc_feature (3137)..(3137): n is a, c, g, or t
  misc_feature (3161)..(3161): n is a, c, g, or t
  misc_feature (3164)..(3164): n is a, c, g, or t
  misc_feature (3173)..(3173): n is a, c, g, or t
  misc_feature (3185)..(3185): n is a, c, g, or t
  misc_feature (3215)..(3215): n is a, c, g, or t
  misc_feature (3230)..(3230): n is a, c, g, or t
  misc_feature (3281)..(3281): n is a, c, g, or t
  misc_feature (3302)..(3302): n is a, c, g, or t
  misc_feature (3341)..(3341): n is a, c, g, or t
  misc_feature (3353)..(3353): n is a, c, g, or t
  misc_feature (3404)..(3404): n is a, c, g, or t
  misc_feature (3464)..(3464): n is a, c, g, or t
  misc_feature (3533)..(3533): n is a, c, g, or t
  misc_feature (3584)..(3584): n is a, c, g, or t
  misc_feature (3593)..(3593): n is a, c, g, or t
  misc_feature (3617)..(3617): n is a, c, g, or t
  misc_feature (3650)..(3650): n is a, c, g, or t
  misc_feature (3695)..(3695): n is a, c, g, or t
  misc_feature (3713)..(3713): n is a, c, g, or t
  misc_feature (3722)..(3722): n is a, c, g, or t
  misc_feature (3770)..(3770): n is a, c, g, or t
  misc_feature (3785)..(3785): n is a, c, g, or t
  misc_feature (3797)..(3797): n is a, c, g, or t
  misc_feature (3858)..(3858): n is a, c, g, or t
  misc_feature (3863)..(3863): n is a, c, g, or t
  misc_feature (3881)..(3881): n is a, c, g, or t
  misc_feature (3920)..(3920): n is a, c, g, or t
  misc_feature (3947)..(3947): n is a, c, g, or t
  misc_feature (3977)..(3977): n is a, c, g, or t
  misc_feature (3992)..(3992): n is a, c, g, or t
  misc_feature (3995)..(3995): n is a, c, g, or t
ntnnnnntnnaaancnaannnnnttncngnntnntnnnannnnnnnaaantnncnnaannnttnnnnncnaanttnnaannnnnnncnannnnnnnnaanntnnnnnttnanttnnnnnnnanncnannntnnannaantnntnnnnnngnannntnnnnaaannnnngnnnaanttnnnnnnnnnnnncnnnnncnnnnccnncnnnnncnaannannnnanttnnnnnntnancnnnntnannnnnnnngggnnttnnnnnccnnnaaannntnnnnnngntnnngntnnnaaannnnnnncnncnnnggnnaantnnnnnnnntnnnnttnnnnnnnannnnnnnnnaaannnncnnnnnncccnaannnnncccnnnnaaantnncnanngntnannnnnnnccnnnnnaannnngnngnnnantnnnnannccnnnnantnantnnnntnnnnnntnntccaaaaaacnaaaaataatcggtgcattatagcggtaacttaatgttttgtcagtaaatggtgtttacgaacacccaagagcaccaatacgcctaaataaacgaccgcagccagtccaattaaccaaaccaaccaatagatacgcattaaaaatgtcatggctgcccattcttgaatngacgggcagttataccaaaccaaaccgcccatggctaaggctgcacctaaaactttcagaaaaaagaccgcacttttacgtgaaaaatggtatacatcctctttagctaaaccacgataaagcaaataagcatttaaggttgctgacatggcagaagcaatcgctaancccacataactaaatggaatcgccaatacgttaaagcccatattgctcaccatggcgatgatcccgattttcacgggcgttttggtntcttgncgtgcgtaatagccattagcnaggatcttaatcagcataaagctaagcaaaccggcattgaatgcccataaagaataagaggctgcatgcacatctgttaaggtaaaactgccacgcataaacaataccagtaacatnggttgggctaacacggcaataccaatcgcggcaggcacgccgagtaataaaatcattcgtacgccccagtccatngtgttgcgaaaatcaaccgcactttgggaagaattatcttctcgattcacatgatggcgagcaagcgtcggtaaaatcacagtggaaatngcnataccaaatagnccaagtggaaactctaatagacgatcagaataataaagccaactaatagatcccgtcattaagaaactggcaatgaccgtatcaagcancaagttgatttgacttacggaaaccccgaacaaggcaggaatcatcaatcgacggattttggctaccccttcatcatgccatgcccattttggttttacgagcaagccngctttcttcaagaaagggatttggaataaaaattgtaataaaccncctaagaagatcccgatagcaagggcaagatcaggattgtctaatcttggngcgaggaaaagtgcggtngcaatcatggcgatattnagtaaaacaggcgaaaacgacatcacgccaaatttgcctatcgtatttaaaatcgcgccngaaagtgccacaaaggtgacaaaccataaataaggaaaagtaatttttaagagtaaagacgcttgttcaaatttgtgngcatcnggtccgtcatttagccaatcggtaaaccagcccatcccnaagatcgccgccacaacaggtgatcccaccatagcaagcaaggtgacaatactgactaanccgcctagngtacccganactttcccgataaattctcgcgttttagaaagatcgcccgatttttgatattcngctaatacnggnacnaaagcctgagaaaatgccccttccgcaaataaacgacgtaaaaagtttgggatacggttagcgaatanaaacacgtctgccgccgcncctgcaccgattaaatgggcaatcaccacatcgcggactaaacctaacacacgggacactaatgtcatcccactcacgataatgccggattttaaaagtcgtttactcaaaataggggtctcttcaaaaaaatttgccttaattgtatagaatttttgtttttacgctatattccaacgaaaaaaactgataaaatcctgcccacatcgtttgtgtgagccaatagaaagcgctttttttaaataacgatgcttactttcggttgtgtctcaccgaaatcaacacaaattattcattgacaaaagtataaaaaatcggcatattctacgcccttattttgtcataatcatctaacagaaattttaggagtttgaccttggctaatatcaagtcagcaaaaaaacgcgcggttcaatctgaaaaacgccgccaacacaacgcaagccaacgctctatgatgcgtacttacatcaaaaaagtatatgctcaagtagcagcaggtgaaaaagcagcagctgaagcagcattcgttgaaatgcaaaaagttgttgaccgtatggcttctaaaggcttaatccacgctaacaaagcagcaaaccacaaagctaaattagctgctcaaatcaaaaaattagcgtaattaaagcattaaaacagcttaaaaataaaaccgcactttggtgcggtttttgtttgccgtaaaccgtcctgccacaaacgcccnataacnagcttgcattcccccctttaacctgtaaactaccccacaacttaaaaattaatcataaaataaacaataaatgaccaaaaaatcttttaaaaaancggatccgaattatcaaaaagaattagcnaaatanggtaatccgatcccaagcagagactacattctgcaaattatncgtgaaaataatgccccgatgagtcgggaagaaattctgaccgcactttcaattaaaagtgacgaacaacaagaagccatgcgncgccgcttncgngccatggaaaatgatggacanttagttttnactaaacgtaaacgctatgccttgcctgaaaaattngatttattcaaaggcatggtnattggccatcgcgaaggctatggctttttacaagtcgaaggnaaaaaagaggatctctttattcctaatcaccaaatgcaacgngtaatgcatggtgattttgtattngcncaacctgcnggcttggatcgncgtggtcgtcgtgaagtccgtattgttcgngtacttgaaagtcgnaaaaaacaaattgtcggccgtttcttcttagaaaatggttttagctatgtngtgcctgatgatagccgtatnggacgagatattttagtccctaatgaacaccgcaatggngcccgaatgggncaagttgtcgtggttgaattgcaagaacgatctgcctcctttactcaaccngttggcatcatcaccgaaattctgggtgacaatatggcaaaagggatggaagtggagatngcccttcgtaatcatgacattcctcaccaattcccaagtgcggtcgaaaaatacgttaaaaaattcacngaagaagtgcctgaagaagcaaaaaaaggccgtgtggatttacgcaatctnccactggtnaccattgatggcgaagatgcacgngattttgatgatgccgtatattgcgaaaaaagnggtaaaggctggaaactttgggtggcaattgccgatgtcagctantatgtgcgtttacgttcngcattaganactgaagcttataaccgaggtaactccgtttacttcccaaatcgtgtngtgccaatgctgccngagattttatcnaacggattgtgttcactgaatccacaagttgatcgcttgtgtatggtgtgtgaaatgcacntttcngccaaaggtaaactcacngactatcgtttttatgaagcggtaatgaattctcatgcncgtttaacctatacgaaagtcgcggcnattttagacggcgatgatgagctccgcacncgttatcaagggctngtnccaca

SEQ ID NO: 1068 - DNA, 4000 bp, Escherichia coli
  misc_feature (1)..(1): n is a, c, g, or t
  misc_feature (3)..(4): n is a, c, g, or t
  misc_feature (6)..(13): n is a, c, g, or t
  misc_feature (15)..(15): n is a, c, g, or t
  misc_feature (17)..(23): n is a, c, g, or t
  misc_feature (25)..(25): n is a, c, g, or t
  misc_feature (27)..(29): n is a, c, g, or t
  misc_feature (31)..(32): n is a, c, g, or t
  misc_feature (34)..(40): n is a, c, g, or t
  misc_feature (42)..(44): n is a, c, g, or t
  misc_feature (46)..(48): n is a, c, g, or t
  misc_feature (50)..(54): n is a, c, g, or t
  misc_feature (56)..(56): n is a, c, g, or t
  misc_feature (58)..(58): n is a, c, g, or t
  misc_feature (60)..(63): n is a, c, g, or t
  misc_feature (65)..(70): n is a, c, g, or t
  misc_feature (72)..(74): n is a, c, g, or t
  misc_feature (76)..(76): n is a, c, g, or t
  misc_feature (78)..(79): n is a, c, g, or t
  misc_feature (81)..(84): n is a, c, g, or t
  misc_feature (89)..(96): n is a, c, g, or t
  misc_feature (98)..(102): n is a, c, g, or t
  misc_feature (104)..(105): n is a, c, g, or t
  misc_feature (107)..(107): n is a, c, g, or t
  misc_feature (109)..(109): n is a, c, g, or t
  misc_feature (112)..(117): n is a, c, g, or t
  misc_feature (119)..(131): n is a, c, g, or t
  misc_feature (133)..(133): n is a, c, g, or t
  misc_feature (135)..(143): n is a, c, g, or t
  misc_feature (145)..(145): n is a, c, g, or t
  misc_feature (147)..(163): n is a, c, g, or t
  misc_feature (167)..(167): n is a, c, g, or t
  misc_feature (171)..(174): n is a, c, g, or t
  misc_feature (176)..(179): n is a, c, g, or t
  misc_feature (181)..(181): n is a, c, g, or t
  misc_feature (183)..(183): n is a, c, g, or t
  misc_feature (186)..(192): n is a, c, g, or t
  misc_feature (194)..(195): n is a, c, g, or t
  misc_feature (197)..(204): n is a, c, g, or t
  misc_feature (206)..(210): n is a, c, g, or t
  misc_feature (212)..(212): n is a, c, g, or t
  misc_feature (214)..(217): n is a, c, g, or t
  misc_feature (219)..(220): n is a, c, g, or t
  misc_feature (222)..(223): n is a, c, g, or t
  misc_feature (225)..(228): n is a, c, g, or t
  misc_feature (230)..(231): n is a, c, g, or t
  misc_feature (233)..(236): n is a, c, g, or t
  misc_feature (238)..(239): n is a, c, g, or t
  misc_feature (243)..(249): n is a, c, g, or t
  misc_feature (251)..(252): n is a, c, g, or t
  misc_feature (254)..(256): n is a, c, g, or t
  misc_feature (258)..(264): n is a, c, g, or t
  misc_feature (266)..(267): n is a, c, g, or t
  misc_feature (269)..(274): n is a, c, g, or t
  misc_feature (276)..(277): n is a, c, g, or t
  misc_feature (280)..(286): n is a, c, g, or t
  misc_feature (288)..(290): n is a, c, g, or t
  misc_feature (292)..(300): n is a, c, g, or t
  misc_feature (303)..(306): n is a, c, g, or t
  misc_feature (308)..(310): n is a, c, g, or t
  misc_feature (312)..(312): n is a, c, g, or t
  misc_feature (314)..(322): n is a, c, g, or t
  misc_feature (324)..(326): n is a, c, g, or t
  misc_feature (328)..(333): n is a, c, g, or t
  misc_feature (335)..(337): n is a, c, g, or t
  misc_feature (339)..(339): n is a, c, g, or t
  misc_feature (341)..(344): n is a, c, g, or t
  misc_feature (346)..(346): n is a, c, g, or t
  misc_feature (350)..(353): n is a, c, g, or t
  misc_feature (355)..(355): n is a, c, g, or t
  misc_feature (357)..(373): n is a, c, g, or t
  misc_feature (375)..(380): n is a, c, g, or t
  misc_feature (382)..(382): n is a, c, g, or t
  misc_feature (384)..(384): n is a, c, g, or t
  misc_feature (386)..(386): n is a, c, g, or t
  misc_feature (388)..(389): n is a, c, g, or t
  misc_feature (391)..(391): n is a, c, g, or t
  misc_feature (393)..(394): n is a, c, g, or t
  misc_feature (396)..(397): n is a, c, g, or t
  misc_feature (400)..(402): n is a, c, g, or t
  misc_feature (404)..(414): n is a, c, g, or t
  misc_feature (416)..(422): n is a, c, g, or t
  misc_feature (424)..(424): n is a, c, g, or t
  misc_feature (426)..(429): n is a, c, g, or t
  misc_feature (431)..(433): n is a, c, g, or t
  misc_feature (435)..(473): n is a, c, g, or t
  misc_feature (475)..(476): n is a, c, g, or t
  misc_feature (479)..(482): n is a, c, g, or t
  misc_feature (484)..(484): n is a, c, g, or t
  misc_feature (486)..(497): n is a, c, g, or t
  misc_feature (499)..(503): n is a, c, g, or t
  misc_feature (505)..(505): n is a, c, g, or t
  misc_feature (507)..(518): n is a, c, g, or t
  misc_feature (520)..(527): n is a, c, g, or t
  misc_feature (529)..(530): n is a, c, g, or t
  misc_feature (532)..(542): n is a, c, g, or t
  misc_feature (545)..(551): n is a, c, g, or t
  misc_feature (553)..(561): n is a, c, g, or t
  misc_feature (563)..(563): n is a, c, g, or t
  misc_feature (565)..(573): n is a, c, g, or t
  misc_feature (575)..(575): n is a, c, g, or t
  misc_feature (577)..(581): n is a, c, g, or t
  misc_feature (583)..(588): n is a, c, g, or t
  misc_feature (590)..(593): n is a, c, g, or t
  misc_feature (595)..(598): n is a, c, g, or t
  misc_feature (601)..(605): n is a, c, g, or t
  misc_feature (608)..(610): n is a, c, g, or t
  misc_feature (612)..(616): n is a, c, g, or t
  misc_feature (619)..(625): n is a, c, g, or t
  misc_feature (628)..(629): n is a, c, g, or t
  misc_feature (631)..(636): n is a, c, g, or t
  misc_feature (638)..(640): n is a, c, g, or t
  misc_feature (643)..(647): n is a, c, g, or t
  misc_feature (650)..(651): n is a, c, g, or t
  misc_feature (653)..(658): n is a, c, g, or t
  misc_feature (661)..(662): n is a, c, g, or t
  misc_feature (664)..(666): n is a, c, g, or t
  misc_feature (669)..(673): n is a, c, g, or t
  misc_feature (677)..(683): n is a, c, g, or t
  misc_feature (685)..(695): n is a, c, g, or t
  misc_feature (697)..(702): n is a, c, g, or t
  misc_feature (705)..(705): n is a, c, g, or t
  misc_feature (707)..(707): n is a, c, g, or t
  misc_feature (709)..(714): n is a, c, g, or t
  misc_feature (716)..(721): n is a, c, g, or t
  misc_feature (723)..(726): n is a, c, g, or t
  misc_feature (728)..(738): n is a, c, g, or t
  misc_feature (740)..(743): n is a, c, g, or t
  misc_feature (745)..(749): n is a, c, g, or t
  misc_feature (751)..(754): n is a, c, g, or t
  misc_feature (756)..(759): n is a, c, g, or t
  misc_feature (761)..(761): n is a, c, g, or t
  misc_feature (763)..(764): n is a, c, g, or t
  misc_feature (767)..(767): n is a, c, g, or t
  misc_feature (769)..(774): n is a, c, g, or t
  misc_feature (776)..(790): n is a, c, g, or t
  misc_feature (792)..(811): n is a, c, g, or t
  misc_feature (813)..(813): n is a, c, g, or t
  misc_feature (815)..(816): n is a, c, g, or t
  misc_feature (818)..(819): n is a, c, g, or t
  misc_feature (821)..(821): n is a, c, g, or t
  misc_feature (824)..(825): n is a, c, g, or t
  misc_feature (827)..(831): n is a, c, g, or t
  misc_feature (834)..(835): n is a, c, g, or t
  misc_feature (837)..(845): n is a, c, g, or t
  misc_feature (847)..(855): n is a, c, g, or t
  misc_feature (858)..(859): n is a, c, g, or t
  misc_feature (861)..(865): n is a, c, g, or t
  misc_feature (867)..(868): n is a, c, g, or t
  misc_feature (870)..(880): n is a, c, g, or t
  misc_feature (882)..(885): n is a, c, g, or t
  misc_feature (887)..(889): n is a, c, g, or t
  misc_feature (891)..(892): n is a, c, g, or t
  misc_feature (894)..(903): n is a, c, g, or t
  misc_feature (905)..(951): n is a, c, g, or t
  misc_feature (953)..(978): n is a, c, g, or t
  misc_feature (980)..(1004): n is a, c, g, or t
  misc_feature (1006)..(1037): n is a, c, g, or t
  misc_feature (1039)..(1042): n is a, c, g, or t
  misc_feature (1044)..(1052): n is a, c, g, or t
  misc_feature (1054)..(1077): n is a, c, g, or t
  misc_feature (1079)..(1083): n is a, c, g, or t
  misc_feature (1085)..(1089): n is a, c, g, or t
  misc_feature (1091)..(1094): n is a, c, g, or t
  misc_feature (1096)..(1096): n is a, c, g, or t
  misc_feature (1098)..(1099): n is a, c, g, or t
  misc_feature (1101)..(1102): n is a, c, g, or t
  misc_feature (1104)..(1104): n is a, c, g, or t
  misc_feature (1106)..(1106): n is a, c, g, or t
  misc_feature (1112)..(1115): n is a, c, g, or t
  misc_feature (1117)..(1117): n is a, c, g, or t
  misc_feature (1119)..(1119): n is a, c, g, or t
  misc_feature (1122)..(1125): n is a, c, g, or t
  misc_feature (1127)..(1127): n is a, c, g, or t
  misc_feature (1132)..(1142): n is a, c, g, or t
  misc_feature (1144)..(1148): n is a, c, g, or t
  misc_feature (1153)..(1153): n is a, c, g, or t
  misc_feature (1155)..(1158): n is a, c, g, or t
  misc_feature (1160)..(1161): n is a, c, g, or t
  misc_feature (1164)..(1166): n is a, c, g, or t
  misc_feature (1168)..(1173): n is a, c, g, or t
  misc_feature (1176)..(1182): n is a, c, g, or t
  misc_feature (1185)..(1188): n is a, c, g, or t
  misc_feature (1190)..(1196): n is a, c, g, or t
  misc_feature (1198)..(1203): n is a, c, g, or t
  misc_feature (1205)..(1205): n is a, c, g, or t
  misc_feature (1207)..(1211): n is a, c, g, or t
  misc_feature (1213)..(1215): n is a, c, g, or t
  misc_feature (1217)..(1224): n is a, c, g, or t
  misc_feature (1226)..(1226): n is a, c, g, or t
  misc_feature (1228)..(1232): n is a, c, g, or t
  misc_feature (1234)..(1234): n is a, c, g, or t
  misc_feature (1238)..(1240): n is a, c, g, or t
  misc_feature (1245)..(1245): n is a, c, g, or t
  misc_feature (1248)..(1256): n is a, c, g, or t
  misc_feature (1260)..(1265): n is a, c, g, or t
  misc_feature (1267)..(1269): n is a, c, g, or t
  misc_feature (1271)..(1271): n is a, c, g, or t
  misc_feature (1273)..(1277): n is a, c, g, or t
  misc_feature (1279)..(1284): n is a, c, g, or t
  misc_feature (1286)..(1295): n is a, c, g, or t
  misc_feature (1297)..(1302): n is a, c, g, or t
  misc_feature (1304)..(1313): n is a, c, g, or t
  misc_feature (1315)..(1327): n is a, c, g, or t
  misc_feature (1329)..(1329): n is a, c, g, or t
  misc_feature (1332)..(1338): n is a, c, g, or t
  misc_feature (1340)..(1340): n is a, c, g, or t
  misc_feature (1342)..(1344): n is a, c, g, or t
  misc_feature (1346)..(1347): n is a, c, g, or t
  misc_feature (1349)..(1349): n is a, c, g, or t
  misc_feature (1351)..(1354): n is a, c, g, or t
  misc_feature (1357)..(1358): n is a, c, g, or t
  misc_feature (1362)..(1363): n is a, c, g, or t
  misc_feature (1367)..(1367): n is a, c, g, or t
  misc_feature (1371)..(1373): n is a, c, g, or t
  misc_feature (1396)..(1396): n is a, c, g, or t
  misc_feature (1985)..(1985): n is a, c, g, or t
  misc_feature (1990)..(1990): n is a, c, g, or t
  misc_feature (1995)..(1995): n is a, c, g, or t
  misc_feature (2005)..(2005): n is a, c, g, or t
  misc_feature (2012)..(2012): n is a, c, g, or t
  misc_feature (2223)..(2224): n is a, c, g, or t
  misc_feature (2229)..(2231): n is a, c, g, or t
  misc_feature (2234)..(2234): n is a, c, g, or t
  misc_feature (2237)..(2238): n is a, c, g, or t
  misc_feature (2246)..(2248): n is a, c, g, or t
  misc_feature (2254)..(2254): n is a, c, g, or t
  misc_feature (2259)..(2259): n is a, c, g, or t
  misc_feature (2261)..(2264): n is a, c, g, or t
  misc_feature (2268)..(2275): n is a, c, g, or t
  misc_feature (2280)..(2280): n is a, c, g, or t
  misc_feature (2283)..(2283): n is a, c, g, or t
  misc_feature (2285)..(2287): n is a, c, g, or t
  misc_feature (2292)..(2292): n is a, c, g, or t
  misc_feature (2296)..(2296): n is a, c, g, or t
  misc_feature (2299)..(2299): n is a, c, g, or t
  misc_feature (2301)..(2301): n is a, c, g, or t
  misc_feature (2303)..(2303): n is a, c, g, or t
  misc_feature (2307)..(2307): n is a, c, g, or t
  misc_feature (2309)..(2309): n is a, c, g, or t
  misc_feature (2311)..(2313): n is a, c, g, or t
  misc_feature (2315)..(2316): n is a, c, g, or t
  misc_feature (2319)..(2319): n is a, c, g, or t
  misc_feature (2322)..(2322): n is a, c, g, or t
  misc_feature (2325)..(2325): n is a, c, g, or t
  misc_feature (2327)..(2329): n is a, c, g, or t
  misc_feature (2331)..(2331): n is a, c, g, or t
  misc_feature (2364)..(4000): n is a, c, g, or t
ntnnannnnnnnnanannnnnnnanannnannannnnnnnannnannnannnnnananannnnannnnnnannnanannannnnataannnnnnnnannnnnannananaannnnnnannnnnnnnnnnnnanannnnnnnnnanannnnnnnnnnnnnnnnnaaanaaannnnannnnantnaannnnnnnannannnnnnnnannnnnanannnnanntnnannnnannannnnannaaannnnnnnannannnannnnnnnannannnnnnannaannnnnnnannnannnnnnnnnaannnnannnanannnnnnnnnannnannnnnnannnantnnnnantaannnnanannnnnnnnnnnnnnnnnannnnnnanananannananntnnaannnannnnnnnnnnnannnnnnnantnnnnannnannnnnnnnnnnnnnnnnnnnnnnnnnnnnnnnnnnnnnntnnatnnnnanannnnnnnnnnnnannnnnantnnnnnnnnnnnnannnnnnnnannannnnnnnnnnnaannnnnnnannnnnnnnnanannnnnnnnnanannnnnannnnnnannnnannnnaannnnnaannnannnnnaannnnnnnaannannnnnnannnaannnnnaannannnnnnaannannnaannnnnaatnnnnnnnannnnnnnnnnnannnnnnatnanannnnnnannnnnnannnnannnnnnnnnnnannnnannnnnannnnannnnanannaanannnnnnannnnnnnnnnnnnnnannnnnnnnnnnnnnnnnnnnanannannanaannannnnnaannannnnnnnnnannnnnnnnnaannannnnnannannnnnnnnnnnannnnannnannannnnnnnnnntnnnnnnnnnnnnnnnnnnnnnnnnnnnnnnnnnnnnnnnnnnnnnnnannnnnnnnnnnnnnnnnnnnnnnnnntnnnnnnnnnnnnnnnnnnnnnnnnntnnnnnnnnnnnnnnnnnnnnnnnnnnnnnnnntnnnnannnnnnnnnannnnnnnnnnnnnnnnnnnnnnnnannnnnannnnnannnnanannannananaaaaannnnananaannnnanaaaannnnnnnnnnnannnnnaaaanannnnannaannnannnnnnaannnnnnnatnnnntnnnnnnntnnnnnntnannnnntnnntnnnnnnnncntnnnnntnattnnnttaanaannnnnnnnntaannnnnntnnntntnnnnnannnnnntnnnnnnnnnnannnnnnannnnnnnnnntnnnnnnnnnnnnnanaannnnnnnanannnannanannnnaannaaannaaanaaannnaaaaaaaaaaaaaaaaaaaaaanaaaaaaaaaaaaaaaaaaaaaaaaaaaaattaaaatattaaaaaatgcaataaagcggactatctactaggaatcgaaattgaaggaaataatttcaattacactattttacaaacacaactaattaatgacattttacaaaaaattcaaagtaacaaatattagaaaaacaaaacaaaacaaaacaaaaaaaaaaaaacaccatgttcaggaattaataaattattaaccaacaaaataagaaattttatataaaagtgccgtaggatcacttacatatttagcacattataccagaccagacatagcttatgtcacaaggtaaagttgcaagacattccgaaaatcctacaatggataactggaaacgaaagtaataaatattttaaaatacctaaactataaaaaagattacaaaatcaccatataaaggttaaagtgaaatactagcttatacagactcggattatgttgatgaattaaacaacatgtacagtaacaaaggtaatggaaatagtgaataaaatttttaaactaacccaaccataataggatacaaaatggtttttttttttttttttaaccacanaaaanacaanaattataaanaaaaaanaaaaaataaaaaaataaaataaaataaaataaaataaagtaaaataaaaggcacgacttataactagaggatttcaataaaatttccttggaacaggataggacttggctttgtgggtgaaaaaaaaaaatttattcacctaccatgaaaatatatgaaatataatacatactaaaaaaaaaaaaaaaaaaaaaaaaaaaaaaaaaaaaannaaaannnaanaannaaaaaatnnnaaaaanaaaanannnnaaannnnnnnnaatanaanannnaaaangatnaanangnagananannnannaanaantanannnanaattaattaattaattaattaattaataaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1069 - DNA, 4000 bp, Escherichia coli
ttctcgaactccttagcgaacttgttgatctgctgcatgatctcagcagccgttcgttcggtatgaaaactgtcggtcgcctggcgaatcacgacgaggaaggcgtagagcgtgagcggtgagcacagcaccaccttgcgttcgagtgcccagtcgatcaacgtcgggtctgcctcgtggacaaaccccgagatgctctcgttcggcacaaacatcaacacgtagtcgaccgcgtcgtcggtgctttggtcgatgtagtcgcgtttggcgagtgcttcaacatggctgcgcaccgcacgaacgaattcgcttctggtggtcgcgcgtgtggtgtcgtcgtcagcggcgagatgtgcggcatagcgatcaaggggaaacttcacatccatgaagagcacccggtcgggcggcatggaaaaggtgaagtcgggacggccaccagcggcggtggtgtcttgtttggagtaattgatgccctcaacgaaaccggcagcccggatcatgtcctcggcaagtcgctcaccccactgcccgcgtttttgtgaacttgacagcacttcgttgaggttctgggtgcgttgtgacagggcggtgacggcatcactgacactggagaaatggccggtggtcatttcgcggagccgttgcaactcctgggcgagatcattgatgcgttgccccatatcggtctggacgttgcgcagggtgtggtcgaggacttctgcccgttggccaagttgttcaccgctttgcgcggtgaccatttcggtaacgatgcgggtggtttcggcacggtcggctgcggcgcgttcgtgcagttcacccatggcatcgcgaagtgcctcggcgttcgccaactgcacttgggcgatgagcgccgaggtatcaatgggggcctgaggtgcggcgacggggttgtccgccgggcgttgcaggcggctaacgaccacggtggcaacggctgctgcggccacagcagcgagcacggcgacgagaagggtgtccatatgccaaccctaaacgcggggtgtggcagcacctgtgacgttgacggctcggcgggtggccacgggcggctacggtgccggcatgatcaaacttactgtgtcctacgccgctggcgacgacgtcaccttcgaccacgactactacgcggccacgcacgttccgatgtgcaacgaggcgttcaatccggtgcgcaccgaaatcgagcgcggtgtggacggaccggctgtggccgccgtgtcgttctacttcgactcggctgaggacatgcaggccgctatggcgtcagagcgcatgggcgacatcatgggtgacatcgtgaactacacgaatgccacaccgtcgatgcagatatccgacgtcgtcggctgaaccaactcggctgaaccaacgacgttggcggctcacatctcgaggccgcagttccccataatcatcatcaactcgccgaacatggccatgccggtggcgtcgtcaacttcttcgccgaggaaacttgccaccatcacctcgcggaccgactcgctcgctgtgaacgcctcggacatgcaggtggcctgctcggcggtcatgccctcgctcatgtccgggtcaccgagcagcatgtcgactgcagagatgcattcaccatcaaggagcagatcggccaggccgtttgcttgatcatcgttgaggctcatatcggcgagcatctcgtcgtcgctgaggtccaacgcgtcggcggtgaggccggcagcgatcaactcttctgcgccaatcgcgttgacgaaacgggtagcgaaacactcggcctcagtggcgtcgaggcccatctcggcatcggcagcgaattccaccgccagcgcgtcaatcagtggggccgccagctccgaggattccgatgaggagcccgaggactcatcgtcaccaccgcatgcggcgagcgtgaacgaggtcgcagctaccaccgcaaggctgatgaaggaacgagcacgtgtcattaactcatcatgtcacaccgacgcgtgccagtcggcgaggtcacatctcgaggccgcaggttcccatcatcatcaacatttcaccgaacatcgccataccggtggcgtcgtcgatctcttcgccgagcaggttggccacagccacggcgcggatggtgtcgctgccagtaaacgcatcggccatacatgaggcctgttcctcggtcatgtcctcggaagcttcagggtcgcccatcatcatgtcgacaaacgagatgcactcgccgtcgaggagcagcgtggccaaatcgtcagcctgcgattcggaaatatcaaacggcgtgccttcatcgccgaacacatcgagcgccatcgaatcgggcgtgactcctgcggcttcaagtttgtcaacgccgaggatgttcaccattcggccagcaaagcactctgcctgctcctgattcattgccatttcagggtcggcttccagcgcagccgcggccgctgcgacgaacggtgcagcgtcggcagaaggggcagaggaatcgtcgtcaccgccacaggcggctaggccgaatgaggttgcggtcacaacagcgagagaaatgagggtacgtccacgtgtcatagcgtcatcatttcatggtgtacgtacttgagggtggtcttttatatgtgcacgtctcgtacctgccatcgagacggggaaacgcggtgctcggccagtcaccgaacaacgtcgctcggttagtgtccggccatggcattcaagctcggatacgcagttggctattggtcttcgggtccgcccgagggcgcgctggagggcattaaagaagccgaacgactcggtttcgactcggtgtggtcagccgaggcctacggttctgatgcactcacgcccttggcgtggtggggcgcggcaaccgagcgtgtgcaactgggcaccggcatcgtgcagatgtcggctcgcacaccttctgccaccgcgatggcagcgatcaccatggatcacctgtcgaacggtcggttcatcctcggcctcggtgtgtcgggtcctcaggtggtggaaggctggtacggccagtcataccgacgccccctcgaacgcactcgtgagtacatcgaggtggtgcgcaagatcgtcgcccgcgatgccccagtgacctatcagggcaaccaagtgcagatgccctacggcggcgacgacgcgaccggtctcgggaagccactgcgttccacagtgcatccgctgcgtaatcacattccgatttatctaggtgcggaaggcccgaagaacgtgtcgcttgctgccgagatctgcgacggatggctacccctgttcttctcgccaaaagaagacgccttctaccgcgagcgtctcgcggagggatttgcagcctcgggcgaggagaacaaggccgagcgcttcgaagttgccgccccaatgctggtcgtgccgggcgaggacgccgagaaatgtgccgacatggtgcggcccatgctcgcgctctacgccgggggtatgggcgcccgcggcgcgaacttccacttcgatgtgtttgcccgtatggggtacgaagatgtcgcactcaaagtgcaggatctgtacctcgagggcaaaaaggacgaagcggccgcggcaatcccattgaagatggtggaagacgtcgcactcgtcgggccaccggagaagattcgtgacgagatccctcgctgggaggacacctgcctgaccacagtgctgctcagcggaccggcgaagttccttccgatgctcgccgaactcttctcctgatcacgccgcaccactcacgggcagcccagcccgtggagggtcgcgcactcacgacacagccatgcggtgccctctggggtgctccaacgctgcgccagtgttgacccgcacgacatgcagtccggatccccggctgtgctgttggacgcgccggttgtgctcacggcggtatccagggcgttgctcaccggacgttgctgcacgccgtcgaccgtagcgcggcacccacagcgatgcg

SEQ ID NO: 1070 - DNA, 4000 bp, Escherichia coli
  misc_feature (154)..(154): n is a, c, g, or t
tccaaaacccatttcttcaatagatgcgccttctggttcagccccaacatttgaatcagggccagctccgtgacctttaccaaaggtgtgacctcctgcaacaagtgcaacagtctcctcgtcattcattgccatgcgtccaaaagtttccctnatatcaacagcactttttaacggatcaggctctccatcaggaccctgaggattaacataaattaaacccatttgaactgccccaagaggattagctaaatcccttactccactgtatctctcattagtgagccactctttttcagcgccccaattgatatcttcttcaggagcccaaatgtctggacggcctcctccaaatccaaaggtttttcctcccattgattcaatggcaacattaccagccaggatcaataaatctgcccaactaatttgttttccgtattttttcttaattggccaaagaagccttctagccttgtctaagtttccgttatcaggccaactgttaagaggtgcaaatctttgagcgcctgtacccccgccacctcttccatctccaatacgatatgtgccggcagcatgccatgtcattctgataaaaaatggtccgtaatggccataatctgctggccaccaatcttgcgaatccgtcattagatcgtttaaatcttttttaagagaatcataatcaagctttttaaattcttcagcataatcaaaatcaccgtccataggatcgcctttttgatcatgttggtgaagaatgctcaggtttaattggttaggccaccaatccttattagatgttccagtcgagctatttgaagataggcttccgtgcatcactggacatttactttctgtttcgttactcatagtttaattccaaattaatgttaaatttttaccgcaaaagctgtggtatcaaatagcttacagatattatatgtattggtaaatatataaaaaaagaatgttatattcgattttataaatgataataaaagccaagttatgcttactcttaaacaaattgattatgctttagcggttgcaaggaatctacattttaaaaaagctgccgaggaatgttttatttcaccctcaacccttagcaatgccattactgaattagaggctcaattgggcgtaaaaatttttgaaagaagcaataagaaagttatcgtaacaaatcttgggcaggagatattagacaaagcaagaaaaataaaattagaagtccacaatattcatgaacttgctcagcataactcagagggtctcagccactctttatcaattggtattattcccacaattagtccatattttcttccaattgttctgcctaaacttcaaaaggaattctctaatctgaaattaaagatagaggaaggtcaatctcaaattcttactaatagggtgaaggaaggtgatttggatatggctattctagctttaccatatgatgttcaaggcctcctaagctttaaattttgggaagaggactttttctgggtttcacatagactaaataagaatgctggaaaatctgaaatcaaagcatctgaactagagcattcagaactgatgcttcttgaagatggtcattgcttaaaagatcatattttagacgcatgtaatatttcctctccatctcaatattccctcaaagcttcaagtttaaatacacttattcaattagtgaaaggtaaaatgggaacaactttggttccgaaaatggctttaaaagaattggtcggaaacaaaaaagacttatctatttctcatttagctgagcctggaccgcatcgtgaaattgctttgatagctagaccaaattatgcaggaatggaaagtgttgagctgcttatagatttctttggtaaatccttaaaagaattcgatcaagtttaattctgctcagggagatctaagctatctgtttttttccatttgagtgaaaaagttcgtgagataaacttagtagcctccccccttatctcaatcacatcagagtaaataatacccatgtctaatttataaggtttgtcatcttgatcaaacatgtggcttgcaatgcaatatgtttctcccttataaatattttcctcccattcaccttgaacattcatcacttgatgcattgtgcttttataattttcaagttgctgcattgctgctataaaattttctaaaccaataatctcaaactcacctagcattgaaaattcatcccacataatagagctcaatgaagaaaattttctttgatcaataatggatgcataaagattggataactttgttgggacaaggtctttgttcatgatttttttacctctgaaatcagtttaagtaccttgtaaatatcatcaggcgcttgaacgaagttgattggaaaaacttctatttcatccaaaccagctgccatagatttttccaattcattcaatgttaaatctatattaggaactccgctatcatcaacacatgtgggaagttggcctcgaatccttggttggtcctgcctaccctcattaacaaaagcttcaactaagatatcttttccctgggaaatgaaatctctacttgtttttattggaatccatccatgcccaaccttagcaattctttgtgcattttcatgtgtcatttttaacccgaataataatggcaaatcttgaccttgagcaggtttaggatggcaccaaatatcatcaaaatgaaagtgctttccatgaaaggaaattgggctatcttgccaaagagacttgcatatatctaaagtttcccaaaatatttcagcacgatcttcaaaattaactcccgcggtatcaaattcttctttttgccaacccaaacctactccaagctctaatctacctttagatatagcatctaaagtagcggctgtcttagcaagtaatgcagggtttcttaatggtgcaattaaaattgcagttgccaatttaattttagttgtgtgggaagcaatcatggttagcaatgataagggctcataccatggggcttcagatggcagggggaattttccaaatggatatttatgaaggttttttcccattaccacatgatctgtaacactcacagagtcaaagcctaactcttcacccatttgagaaatttcaatataagatgaaatatctcctccataaaagttttccaaaccgaaaagacctaacactagcttcatagaactatccatttattatttatttgattgtacgaatattttttatctaatgcacttgggctggaatcagaaaaaaaacccatcactgcccaagtcagcaaaaaacttttaaattctagggtcatataggagtgtgttttaactataaaggaattaagattaacacatgacaaatatagatcagctaattaataccttaactttagatgaaaaagtttccctgctaagcggttttaattcttggtataccaacaagattgataaaaaaaatattcccagtattaaaatgtcagatggtcctaatggggttagaggtgactcaaattctggtaagacttcagcatgttttccatgcgcaatatccttgggttccacatgggatcttgagttaattaaaaatattggtgttgctttgggcgaagaagcgcaagcaaaagatgtagatgttctgttgggtccaaccataaatattcataggcatcctttaggtgggagacactttgaaagtttctctgaagatccatttttaactggaaaaattgcaaccaattatgttcaaggcgttcaatctaaaaacgtcgcagcgtgtttaaaacattttgttgggaatgatactgaatatgaacgtcatgcaatcagctcaaatatagatgcgcaaactctaagagaggtttatttgctcccatttgaaatgggcatcaaagaaggtaatgcaaaagttgtgatgagtgcgtataacaaattaaataatatattttgcagttctcatcaagaattgctgattaa

SEQ ID NO: 1071 - DNA, 4000 bp, Escherichia coli
  misc_feature (738)..(738): n is a, c, g, or t
  misc_feature (2873)..(2873): n is a, c, g, or t
tatttaaattaggatattttttttgtgcagattccattattggtgtccactctgacatagctaaggttgtttgtgcaagtaatgctactttttcactggatatgtttatttcttttaaatcatcttcgttctcgactaaaaacattgagtcaggtgctacacctaaagctccaagtgcctcatcatgatttttatgacctacgtaaataatttgttgtcctgcttcactaaacttctttgcctcatgatgcaccttagttactagtggacacaccgcattgacttgaatggatgagagagaattaaattcattttctattttcggtgaagttccatgagctgatagcattacaattgcattttttggaagttcttcaggggactcaataaatttaatatttttagttttaaaacgttctacaatccaatcgttatggacaatttcatgataacaataaatagtttcatcatagattttcaacatccatgtcagtgctttaattgccatctccacaccagcgcaaaagccccttggagtaactaaataaagattgtttaccatatcagtaggatagctatatttaaattatgactaaaaacaatatcgatgaagttttattaattgggctaccaaactctggtaagtcttcattggttaatgcattgtccagaaaaaaagtatcaataattggttctacaccaaatacaacgcgagataaagtctctacaacaattaanagaaatgataaagtttttaatatctctgatttacctggatacctagaagacccagatgaattaaatgaaaagtttcaaaataaactaaaagcctatcttaatgatgcaaaattaatcatgtttgtaatagacgtgcacaccacaaattattctggattagataaaatacacagccttctacaaaagaatataaataaagaacaaaaagtcataacagtctttaataaatgtgaaaactttaaaaagtttgaactgaatacagagttatacaaatacatttacgattcagactattatgtctcatctattcataaattgggtactgaagaattaatggaggcacttacaaaaagcatgtcatctaatacggattcgattaaaaatacctacaaatcaatagcaataattggaaagccaaactcgggtaagtccacattgtttaataagctcttgaatgaggaaagagcaattgtttcaagtatttcgggtaccacaagagatagattagaagaaacaatcaagttcgattcggattcttataatattattgacaccgctggtgtgccacgtaaaaaacaaaaaaaccagatagatagatacgcatcatctttagcagttggtcaattagaaaattctgtaatagcttttcttgttgtagatgcaaaacagggaataaattttgaagatatgagattaattagtgaatgcattgaaaacaaagtaacaccaatattaattatgaataagtgggatctgttaaaagaagaagagaaactttttataaacaaaaacattgcttcattgctaaagaaatattcatggttaaagattttaagaatttcagctcttaatggtaaaggcgtaaaaaatctcaatactgtaatttacgagttacaaaaacagctttcaactcgtattacaactcatgaattaaatatacttttcagagaaatttggacaaaaaaaccacctcatccattcagaggaaggagagcgaagttaaaatatgtgacacagtacgatgtttaccctccttcttttagttttattttaagtggtagagtcccaattaattatcaaaactttatagataatagactacgagacacatataattttgacaatatatgtttgaacataaaatttaaaaattaacatggaaaactttggcttcaaaataggagtattcttgtttgggttctatctgatattgaggttatttcagtttttaatcaacttagtcatttaagagaaaatacaacctatttataataaaatcagacttttagattgaaatgcctataaatacacctaatattaatacatccacacttacgtgtggattttgtatacaaaaggagaaaaattgagtaatttcaaaggatccagaagttggcgccttatcttacttttctcagtttttgcattagttgtggttgcctgcggaggcgacacagcagaagaagaagttgctgtcgatgagacagaaacaactgaagctcctgctacaactgctgcggcagctgaagaagcagctccatcaggacctgatggtgtttataagatggcgatcttctcagatccacaaacacaaaattactggaattatcttgatacagaaacagatgtgtggacacaatacgtgatgtccggacaagctgtgtcattattctctatttcatatcctaactaccagttagttacaggtatcgcagacgaacttgttgagacctcaactaacaacggtgacggaacatggacttatagtgttcctataacagaaggatataaatggagtgatggttcagacctcacagccaacgatatggtatttacatataataccgcaaaagatcttggcctcttaagtaactgggaaacaaactacccacaaggtagtggaacagacccagctgctgagggatatgcacagggtattttaaccctcgttgctagtgatgcttacactgtagagataactctaaactttgatgccgggttagcttcatggcagtatcaaattgcacaagcaccaatacttccagaaagttattgggcgcaatatgctactgacagagaaacccttttagcagcctcaggagctgacgctccagtagctagcgctttcgtctacnacaaagtagaacaaggtgctttttacacatgggcatatgatgctaatacaatgtgggatggtggaaccaccacaatttataagagtggtaccacagtcgaatgggataatggaaaagctccagcaatcaacaattcatttggtgatacaactggcgattcattctcatacacagcaggaccttatgtaggaactgttgagttcacattatatggtgatcaagatgctgcttatcttgcattccaaaatggcgaagttgatttcgttcttaacccattaggtgttaagagaaatctttttgaccaattatccagagttccaggtgtcgaaactgtttccaacttaggtaacggtatgcgatacatggcattcaacactagggttttccctggaagcgacaaatcttttagacaagctgttgcatgtatttctgataaagaattcgtgttaaacaacattcttcaaggtgttgctgtaaatatggatggtcaaatgcctgaagcgttaacagcttgggttgcacctgtaacaggtgtccttgctgattgtgctggccttaatgctgaagaaagattcaacaaatcagttgaaattcttcaagcaggtggttggacagcttcagactggggttcccatgctggtggtgctgaaagagcagtcgctccaacaggaattaaaggaccaggaggagaaacacctccgtcagacatgttgctatatgcaccaggtgctggttacgatccattgagatcaacaatgtccttatttattgctgattggatgcaacaacttggacttgacgtaacagcgagacctaccggtttcaatgttattgttgacaaggtgttcacaccagagacttgtgaggattggtatttctacatgcttggttggggtttaagtgcattccctaatcaccctggagatttcttcaattccaagaacgacacatgcgaaggtggctataacacacctggttttaacaacgcagaatttgacgcattagatgctgaattccaagctgctaaaacaatcagtgatgctattgtcctatcgcaaaaaatggaagctatattatttgaagaaatgccatatttggtattattcaacgtacctacattagaggta

SEQ ID NO: 1072 - DNA, 4000 bp, Escherichia coli
  misc_feature (489)..(489): n is a, c, g, or t
  misc_feature (1611)..(1611): n is a, c, g, or t
  misc_feature (1986)..(1986): n is a, c, g, or t
  misc_feature (2037)..(2037): n is a, c, g, or t
  misc_feature (3769)..(3769): n is a, c, g, or t
  misc_feature (3801)..(3801): n is a, c, g, or t
cgtacttaccggggtacatgaacgaaatatctccattgtaggtgtagtcggactgggtgctgtgactggtttgctttcattttcttctctgctcaaatggatgttaactcgattccaacaccaaacgcttgcggtactagttggttttatgttaggggccctacccaagatttggccttggaaatatccttccgatcgagctatggatatagtaaccccctggaattttcctctagaaagccaatggcctatggctctttgcttgatgttgctaggtattttcttaattttagggttagagcgtttggcccaaaagccagatgctgcataacatgaaagcgcctgctgagctaaaatctcatattttcacttttcttaaaggcttaaccatgggtgcggccaacaaggttcccggtgtatctggtggaattgtcgcctttgtttgggggttttacgaacgattcatctcgtcgctaaaaaaaatggatntacatgctttcactctattaaggcatgggaaattcaaggaatttaagcagtatactgattttgtctttttaggctatttagtcatgggcatgatattcagctatttcagtgtctccaaaatcttggattactttctaaaaaccagagagctttacgtctggtcggtgttttttggcatgatcataggttcggtgtattatatatccaagagttttggcggatggaacagcagaaacagaagttttggactcctgggactcatcctaggtatcagcatcagctttttaagtcctgcgcaagaaaacgaccactggctctttgttttcttctgtggtatgatcagtgtttccgggatgacattacctggactatccggatcatttatactcatgctgatgggcaactatgtgcttttactggttgaatcagtcaatgcattgtttgacacattgactgaaatagcacaattagagtttgggtttatacacgataccgctcggctagacgccttgttcaccctgggtgtcttcacccttggatcagtggtaggattgattactctttctcactttattggctatttactcaaacgctttcacgatcaaacaacggcttccatcattggatttatcacaggatccctaggtgttgtttggccatggaaagaggctgattacctttatgacgctgcgggaaatgtggtcaccgacagttatttgcaacccgtagtcattcaatttactcgatacataccaaaactaaacgacgctctaaacctctgggccctggtgtttatcttatccggaatcgcattactcgtatttttagaacgctatggagcccaaaaaaaatagatatggccttttaggcagaaacatctcctattcattttcccggggatatttcacccagaaatttgaatcagaaggattaaccgattacagctacgaaaactttgatttgcccgatctttcctcactgcgctcacaagtgttcgacgatgcttccatcaagggtattaatgttaccataccctacaaaacagaggtaattccccaactcgatgaactcagaggagccgcagacgaaattcaagcagtgaatactattgcccgtgagggngatcgtttgatcggctacaatacggatgtaatcggctttaaaaactcgttgcttccccacttaaaaagccaccacaaacaagcacttattctcggaaccggtggtgcgtcaaaagcggtggcctacgtattagcacagttaaacatccactatcagtgggtgtctcgcaccccagatcaaggacaaattgcgtatcgagatatcgatgaaaagatcgcagggagccacctgctcgtgatacaatgcagtcctttgggtacctaccccaacatcgagcaaaaacctgaatttccctaccgctatctaaccgaacggcatttgttgtttgatttgatctacaatccagaaattactgcttttatgaaggctggtatntcccaaggcgcacaagcagtcaacgggtatcagatgttggtagaacaagcngaagaagcttggcgtatttggtcaaaataacgccctgaaaatagacaaagtaattagccttcaattttttggaatttgttgggtagttagtatcttactgaccggtattaaccatgaaacaccactgatatgtcagaagagaaagcgccagaacaacagaatactcctcaagaagttacgagtcctgttgatgcgcatttgcacgaaatcgaccactccaatgctgcagatgcagagcttgacaagcatcaagacaagcaccaaataccctttttggactattccaatatggcgctggagaatttagtgggagaattacaacgcttggtgaaaaatgaatctgtctcattgatcaaaagacacgttgacgctataaaaaattcatttgaccaacaatttcaagcattatttgactcaaaaaaagaggagtatctagcgcaaggcggtgttgagatggattttaaattcagcagcgtagataagcgtcagtttaatgaagtatataaagagtatcgcgaaaagagagctgactactatcaacgtcaagaaatacagctgaaaaacaacttagcgcatcgttgggagttgattgagcgcctcaaaggattaatctccatggaggaggatatcaataccacatacaacaattttaaagtgatattagcggaatggaaaaatgccggtccgattccacgggataaatacaacgatgtttggcgtacgtatcaccaccatatggagatcttttatgatttcctcaatttgaatcgcgagttacgggatcttgatttcaaacacaatctagaggaaaaactaaaactggtagaacgcgctgaagagttggcggagcaaaccgatattcatcaagcttttcaagagttacaggtgctacacaaaatctggaaagaggatttgggccccgtagacaaggaacacagaaatgagatttgggatcgtttcagcaaagctacaaaaacaattcacgacaagagacaagcttactttgcctctttagacaaagacctcgaagttaatcttcacgctaaagaggagattctcgaaaaaatcaaacagctgacactccaggccccaacttcccataaggaaatccaaaaccagataaaatctatggagtcattacgccaatcctttatggaaattggcaaagtgcccagcaaacaaagcgataaaatttggagaagtttcaaagaactaagcagaacattcaataagaataaaaacaacttctttaaaaacatcaaaaaagatcaaaacgatcacctaacgcaaaaaagagctctgttagaaatagcccaggggttggttgaagctgaaattaacgaggcgaatacggcagaactcaaacgcattcaggcagcttggaaagaggttgggcatgtgccgagaaaattctcagatgcgctatggaaagacttcaaatccgcatgtaatgcatatttcgaacgccttcaagcgcataagaaaacacaacagtccccatcagcagatagacaaacacgaagagggcatacgccttctgcgccagctcaacaatcagagcgctctatcattcggaaaaaaatggaagaggagcaggataagatacgtcagctagaaaataacctagcattttttagtcatgtccccgaggataatcctgtggttaaagatgttcagaaaaagatcgatctactacacaaacagctggacgcgttaaaagaacaactcaaanaaatcaatattcaggagcatcaacagaaaaangcagcgcaagaagctgaagaatctaccgaagctcaggaagagtccgctgaataaaaaaaagcctccagttggaggctttttttattcaatataccagagggctacttagccacgtttactgctcgagtttcgcggattacggtaacctttacctgaccgggataagtcatgtctgtttggattttttgagagatttcaa

SEQ ID NO: 1073 - DNA, 4000 bp, Escherichia coli
  misc_feature (1096)..(1096): n is a, c, g, or t
  misc_feature (1963)..(1963): n is a, c, g, or t
  misc_feature (1969)..(1969): n is a, c, g, or t
  misc_feature (1977)..(1977): n is a, c, g, or t
  misc_feature (1981)..(1981): n is a, c, g, or t
  misc_feature (1986)..(1986): n is a, c, g, or t
  misc_feature (1991)..(1991): n is a, c, g, or t
  misc_feature (2841)..(2842): n is a, c, g, or t
  misc_feature (2844)..(2844): n is a, c, g, or t
  misc_feature (2884)..(4000): n is a, c, g, or t
atttaattcttttattttaagtataatatataaaaaaaattattagtacatgattatatttatataataatctatttatttattatgattattattaccattatctatattttgatttattttcatatcagatatttccatatcattttcagcacttttttggtcattattatctggaatatttctatattgattttttaattgttgttgtatttgttgtagttgttgttgctgttgctgttgctgttgttgcttttgattattattcatttgatgatgatgatgatgttgagcttttctttcacgtgctttacgttcttctctttgtaacatttcatacaataaccaatatgtacttcttattggatgtggacgacttggatctgcttcaacaaatgctttaattacatcttcacgtttatatccaaaatgtgaaagtcttttaatgatatcttgatctaataatttttcatctctaattacaggacgaataggcatataatttgatggtggatgactataaccttcattaacccatctatgatgcattacttcatcaagtgttgctcttttgtgaggatcaactgtaattaatcttgaaatcaaatgtctagcatcttattaaataaatttaattaaataataataaaaaataaaaaaaaaaaagattttaacgaaaatgttatttttataaaatatataattattaaatttatatatttatattctacctggcattaaataatctggaacagtatatgttccactagcaatttttttatataattctttcatattagcatcatcaaaaggcaaatgaccacataataatgcaaataagataacccctaaaatttattattatatttaaaatgaaaatatttcatttaataattaattattaatatattaaataattaatttcattctagtttatttatatgatataaagtagaaatccatacctaaactccacatatcaacttctggaccttcatattttttacctaaaatcatttcaggggcagcataaaatggagatctaatttatttaattttattcatttttttttttttttatttttatttatttttnttttattttttattatcgaaattattattacatatatacatatatattatttttattatttgactatttattaactataattcttttcttagttaatttttattattatttcatgaatattatttacccacaaaacgtatcaagataaccattttcgatataagtatttccaaaaccaaaatcaataattttaattgattttgtttcatccaataataaattttctggttttaaatctctatgaataacactattctaaaagtaaaaatatatataattcattatgttttaaatataataaagaaatattaatatattaaacaatattattatcataattaaaaatataaatatattatatatgttatatcaaataaaagtaataatatattataatatagttatattatatatataataataataatgtaaaaaattatttttttttcctcaattttcaatattaaccttatgacagtaatctacagcactcagaaccattctaaagaaggctcttgcttctttttctttaactcttttatgggccacaatataatcaaaaagttcacctccaactgcatattccattactatatagatacattctgttgtttcaataacatcatatactttaacaatatgaggatggtaaagtaatttcaaaaaacgaatttcacgttgtaatcttgcaatttgtttttgtgattgtaactgagatttttcaataatttttacagcaaccttatataatataataggatttcaatattgagagataaattaatgtaaataaatatgcattttattaatatttattcaataaaaatttgttaattaattactatattttttttttttttttttttntttttntatatatntaanttttntaaantgtaaaatatatataaaaatataaaaatataaagatataaagatataaagatatatattactttttcattagttttcatatgtatacccaattttacttttccataagttccttggcctattgttttttcaagtctataatcaccaaccataagatttgcattttcggacatgattattcaattattaaaattacttttgaatgttatttcgttgaaattaaaaatttttctcaatataatatttgagctttaaatataataatatatatatttagataataataataataataaaattattataataataattataataatttataataacattaattttatcaatttattggaatatttattagttaaattaattatgatatagtcatatatatatattttttttaaaattaataatatatttaattataataatattatttacctctaatttcaatggttatctatttatattgattattattttttattatcagtactattattaaatattagtattgatattattattaatactattattaatcttattattaatcttattattattattattattattattttaaaataaaataatattacatttaatattaaatgtattatttattttttatattactgaacaaaaattttatacactataaggaataaaagttaagaaaggaagagaacaataaaaaatataataataatggtgatgataattataataactttttttatattatttaaatataattattataattgaatttaaaaataattctgtagtttttttcttttgttttatgcttttttttttttttttttttttttttttttttnnanaataaaaattattatatatttattataattaatataaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1074 - DNA, 4000 bp, Escherichia coli
  misc_feature (1)..(1): n is a, c, g, or t
  misc_feature (4)..(4): n is a, c, g, or t
  misc_feature (6)..(6): n is a, c, g, or t
  misc_feature (8)..(9): n is a, c, g, or t
  misc_feature (13)..(15): n is a, c, g, or t
  misc_feature (18)..(21): n is a, c, g, or t
  misc_feature (23)..(23): n is a, c, g, or t
  misc_feature (26)..(28): n is a, c, g, or t
  misc_feature (32)..(36): n is a, c, g, or t
  misc_feature (38)..(38): n is a, c, g, or t
  misc_feature (42)..(43): n is a, c, g, or t
  misc_feature (47)..(47): n is a, c, g, or t
  misc_feature (49)..(49): n is a, c, g, or t
  misc_feature (51)..(51): n is a, c, g, or t
  misc_feature (53)..(53): n is a, c, g, or t
  misc_feature (56)..(57): n is a, c, g, or t
  misc_feature (59)..(61): n is a, c, g, or t
  misc_feature (64)..(66): n is a, c, g, or t
  misc_feature (68)..(69): n is a, c, g, or t
  misc_feature (73)..(73): n is a, c, g, or t
  misc_feature (77)..(77): n is a, c, g, or t
  misc_feature (79)..(83): n is a, c, g, or t
  misc_feature (85)..(90): n is a, c, g, or t
  misc_feature (92)..(94): n is a, c, g, or t
  misc_feature (97)..(98): n is a, c, g, or t
  misc_feature (102)..(104): n is a, c, g, or t
  misc_feature (107)..(108): n is a, c, g, or t
  misc_feature (110)..(113): n is a, c, g, or t
  misc_feature (115)..(118): n is a, c, g, or t
  misc_feature (121)..(122): n is a, c, g, or t
  misc_feature (125)..(129): n is a, c, g, or t
  misc_feature (132)..(132): n is a, c, g, or t
  misc_feature (134)..(134): n is a, c, g, or t
  misc_feature (136)..(138): n is a, c, g, or t
  misc_feature (140)..(140): n is a, c, g, or t
  misc_feature (142)..(145): n is a, c, g, or t
  misc_feature (147)..(147): n is a, c, g, or t
  misc_feature (149)..(151): n is a, c, g, or t
  misc_feature (154)..(156): n is a, c, g, or t
  misc_feature (159)..(160): n is a, c, g, or t
  misc_feature (163)..(163): n is a, c, g, or t
  misc_feature (169)..(170): n is a, c, g, or t
  misc_feature (172)..(173): n is a, c, g, or t
  misc_feature (178)..(178): n is a, c, g, or t
  misc_feature (180)..(183): n is a, c, g, or t
  misc_feature (187)..(188): n is a, c, g, or t
  misc_feature (190)..(190): n is a, c, g, or t
  misc_feature (193)..(195): n is a, c, g, or t
  misc_feature (199)..(199): n is a, c, g, or t
  misc_feature (203)..(203): n is a, c, g, or t
  misc_feature (205)..(206): n is a, c, g, or t
  misc_feature (211)..(212): n is a, c, g, or t
  misc_feature (214)..(217): n is a, c, g, or t
  misc_feature (219)..(222): n is a, c, g, or t
  misc_feature (226)..(226): n is a, c, g, or t
  misc_feature (228)..(229): n is a, c, g, or t
  misc_feature (234)..(236): n is a, c, g, or t
  misc_feature (238)..(238): n is a, c, g, or t
  misc_feature (240)..(240): n is a, c, g, or t
  misc_feature (243)..(251): n is a, c, g, or t
  misc_feature (259)..(260): n is a, c, g, or t
  misc_feature (262)..(263): n is a, c, g, or t
  misc_feature (265)..(272): n is a, c, g, or t
  misc_feature (279)..(279): n is a, c, g, or t
  misc_feature (281)..(282): n is a, c, g, or t
  misc_feature (284)..(287): n is a, c, g, or t
  misc_feature (289)..(292): n is a, c, g, or t
  misc_feature (294)..(295): n is a, c, g, or t
  misc_feature (298)..(300): n is a, c, g, or t
  misc_feature (303)..(305): n is a, c, g, or t
  misc_feature (311)..(311): n is a, c, g, or t
  misc_feature (317)..(318): n is a, c, g, or t
  misc_feature (320)..(322): n is a, c, g, or t
  misc_feature (324)..(324): n is a, c, g, or t
  misc_feature (328)..(328): n is a, c, g, or t
  misc_feature (330)..(330): n is a, c, g, or t
  misc_feature (334)..(334): n is a, c, g, or t
  misc_feature (338)..(338): n is a, c, g, or t
  misc_feature (340)..(341): n is a, c, g, or t
  misc_feature (343)..(345): n is a, c, g, or t
  misc_feature (347)..(347): n is a, c, g, or t
  misc_feature (349)..(349): n is a, c, g, or t
  misc_feature (352)..(353): n is a, c, g, or t
  misc_feature (355)..(356): n is a, c, g, or t
  misc_feature (359)..(359): n is a, c, g, or t
  misc_feature (361)..(361): n is a, c, g, or t
  misc_feature (363)..(363): n is a, c, g, or t
  misc_feature (365)..(365): n is a, c, g, or t
  misc_feature (367)..(367): n is a, c, g, or t
  misc_feature (369)..(373): n is a, c, g, or t
  misc_feature (375)..(375): n is a, c, g, or t
  misc_feature (380)..(389): n is a, c, g, or t
  misc_feature (391)..(392): n is a, c, g, or t
  misc_feature (394)..(394): n is a, c, g, or t
  misc_feature (399)..(399): n is a, c, g, or t
  misc_feature (401)..(402): n is a, c, g, or t
  misc_feature (404)..(412): n is a, c, g, or t
  misc_feature (414)..(415): n is a, c, g, or t
  misc_feature (419)..(419): n is a, c, g, or t
  misc_feature (421)..(423): n is a, c, g, or t
  misc_feature (425)..(426): n is a, c, g, or t
  misc_feature (428)..(428): n is a, c, g, or t
  misc_feature (432)..(433): n is a, c, g, or t
  misc_feature (437)..(438): n is a, c, g, or t
  misc_feature (440)..(440): n is a, c, g, or t
  misc_feature (442)..(443): n is a, c, g, or t
  misc_feature (445)..(445): n is a, c, g, or t
  misc_feature (447)..(447): n is a, c, g, or t
  misc_feature (449)..(449): n is a, c, g, or t
  misc_feature (488)..(488): n is a, c, g, or t
  misc_feature (491)..(492): n is a, c, g, or t
  misc_feature (524)..(524): n is a, c, g, or t
  misc_feature (527)..(527): n is a, c, g, or t
  misc_feature (611)..(617): n is a, c, g, or t
  misc_feature (620)..(622): n is a, c, g, or t
  misc_feature (725)..(725): n is a, c, g, or t
  misc_feature (881)..(881): n is a, c, g, or t
  misc_feature (902)..(902): n is a, c, g, or t
  misc_feature (941)..(941): n is a, c, g, or t
  misc_feature (1196)..(1196): n is a, c, g, or t
  misc_feature (1733)..(1733): n is a, c, g, or t
naancngnnaaannngcnnnntngcnnncctnnnnnanaaannatcnancnantcnncnnnccnnntnnttgnaccnannnnntnnnnnnannnttnnttgnnnagnngnnnnannnnaannccnnnnncantnannncnannnnancnnnttnnnggnntanccaggnntnnaaaancnnnngatnnanctnnnggtnaaantnnagggnnannnntnnnnccantnnaaatnnntngntannnnnnnnngtttttgnnanntnnnnnnnnccctttngnntnnnncnnnnannccnnnggnnngcaaancagggnncnnntngaantnaggntttntnntnnnantnaanntnnatncnancnancnnnnncnttggnnnnnnnnnnanngngccancnnannnnnnnnncnntaantnnncnncnaaannaatnncnannantngnatgccatcattgtgtgcttgttttaatttttcaagctcnggnngtaaccaattaccaattcgatcatcctcatangcnccatagggagcacccatcggaactagtaagtcatactcattaaagtttggaaaggtggtggtgatatttggagagtcgtaattnnnnnnnggnnnaatcaaaaacctttcaatctcatacccatgtttttcaagtgatcgccagattggcccaccgagtgagatgtgatcatgttcaatgaataaggcgcgcattggnctaccttacgccaaaaatttaggtactctgattaaaagaatttgttaaactgatctcaaaactgcagtgaccttacctagaattaccgcatcatctgctggtattggtaggtaatcatcattttcaggcaatagccagaagtggccatcttttttngaccaagtctttacagttgcntcaccatcaatcatggcggcaacaacctcacccttctcngctgatttttgggcacgaataaccacataatcaccatcgcagatggcaacatcaatcatggagtcaccttttatctgcaacataaatagctcacctttaccaacaattgattctggaagtggcattacctcttcaactatttgctctgccaaaattggattacctgcagcgatctttcctaccaatggaattaatctagttttatcttgcggggcagcatgtccatcctcacctggcagggtgatctcaatggcncggcctctggcagcatctcgtctgatccagcctttttcttcaagaatttgcagttgataggtgacggatgcggtggaggcaagacctgcggcctggccaatctcacgcatagagggtggatacccctggttctcaactgcacgcttaataactgagaggatctttatctgccttggggtgagcccattgtcatcagctgggccatcaggcagctctgagactccctttttgcttgggtttttagccatatcagaagggtagcaggggagggtgaaaaaatcaaacatttgttcgatttaaactggacaatgtcagtggcctagtgtttaatactctatagaacaggtgttcgaatcccctcgaacccagttatcttaggagaaaagcatgaaggcaagacaggctaagcgattagcaagaacagttttatcagtatcgttatcggtagtaattgccgctggtttttcatccatctcatcagctagggataattcaaccgctgctgcagtagatgttaaaagcaagtatctgcaggtngttgttatgccaggtgagtccctgtggtcgattgctgcgatggtggccgagaagggccagatcgcatctgtggtggccgacattgtggaggtcaatcagttaaagagtgctgatgtggctgctggcagtaagttgctagttcctcaagagtaaggctgttcacaaactctagcctcgtttgccacttgttcatcaactcacttactaaagttttagcgtaattgttttattagtcatattggctggcttagatttccatctcactattgaaaggtagagatgcgcaaaatatctagtttatcaatcacacttgctttagtaactacgcagttactaacaattaatctagtttcaccagcaaatgctgctgagccaaagacaccagtaaccctaactttaatgcacaacaatgatggtgaatcctcattgggagcagatgcaatatataaaaccaaatccggtgatttaaaggtcggcagtacctcagcttttgccacagtctttgatcgtgagatcgcagatgctaggcaaatgggaaatgcagttttatctgtctatgcaggtgactcatttttaccaagtaaaaatatgatttgtagtgagccaggtgatcccaagtcacaaaagccggtattagatgcggtagctcaggcgcagatgccatacgatgttcatattctgggcaaccatgagtttgattatggcaccggatttttatctcgatatatcaaagcatttggtgcaaatggcaagcgtaagcacccatttatctcaggcaatttagattttagtaaaaactctgatcttaaatcaatggttggtaaaaacactctaagcagtggggcaattgccaatggcaaggttttaggaagaagttatgttcacaccgatccagttactaaacatagatttggtgtggtctcagctgtcacttggggacttagaactatctctagcccaggttcagttaaattaaccacaaatgatttgcaatcaactgccaaagcggtgcaggcacagattgataccctgcaacgaatgggtattaataagatcatcttggtaagccatctacaagcggccagcaatgataaagagctagttgcgctgttaaaaggtgttgatatcgcagttgctggtggtggcgatgagctgctacaaaactcagcaattgaagatgcggttgagttaattccaggtgagtctaccccggttggtgaatacccaaccatgctggcagataaagctggcaatgaggtaccacttgtgactactagtggaaattacaaatacctaggtcgagcagatttattctttgatgaaaaaggtaatttagatgcagtaaatccacttacctcatatccgcgcagagtagttccagtcagcacagtttcaaccgctgctggcataaccgatgcggttacaccaaaggagagcattgtaaaatcagttgataccccattaactgcatgcttagcaggatttaccgcaccaattgcagctagcaatacagtctttaataccgatcgtggcagcgccactgtcttaggtgttagaactgcggaaacaaatggcggtaacttagttgctgatgcatttgtttatagctacaaccaacgttatgaaaaagcaggcctaccaaaaccttcaacgactacaccattagtgggagttcaaaacggtggcggaattagacaaaacccagcgatcgtacttcctgttaccggcaaggttggtgagattacccgcggtaatacatttgatcttctgccatttggaaacaccttggtagcagttactaatgtcagccctaaggagttgaaggagatctttgaaagatcttgttcaatctcaacttcaggaggcggtcaattcctgcagatatctggcatgaaggtagtttgcctaagaaatggtacggctcaggtggtatcaactcctgcctctggcgccactgttggcagcatcaccaccgaaggtacaagagttaaatccataacactcaccgatggccgcgccatcgtaagtaatggcgccttagtagcaggtgctccttcggtaactatggtcaccaataacttcactgcagatggtggcgataattatccagcgctagctgccttgaagaaatcagcatttggtattgattacgaggtctcactttatgagtacctacgtaccttcccagcaggagctgctggcttggcaacaattccagatactgatgctaggtataaagcattaacaggtgagggcagatttacctg

SEQ ID NO: 1075 - DNA, 4000 bp, Escherichia coli
  misc_feature (4)..(4): n is a, c, g, or t
  misc_feature (7)..(8): n is a, c, g, or t
  misc_feature (10)..(10): n is a, c, g, or t
  misc_feature (19)..(19): n is a, c, g, or t
  misc_feature (23)..(25): n is a, c, g, or t
  misc_feature (34)..(34): n is a, c, g, or t
  misc_feature (37)..(37): n is a, c, g, or t
  misc_feature (46)..(46): n is a, c, g, or t
  misc_feature (49)..(49): n is a, c, g, or t
  misc_feature (52)..(52): n is a, c, g, or t
  misc_feature (58)..(58): n is a, c, g, or t
  misc_feature (61)..(61): n is a, c, g, or t
  misc_feature (64)..(64): n is a, c, g, or t
  misc_feature (73)..(74): n is a, c, g, or t
  misc_feature (76)..(76): n is a, c, g, or t
  misc_feature (82)..(82): n is a, c, g, or t
  misc_feature (88)..(88): n is a, c, g, or t
  misc_feature (94)..(94): n is a, c, g, or t
  misc_feature (100)..(100): n is a, c, g, or t
  misc_feature (104)..(104): n is a, c, g, or t
  misc_feature (106)..(106): n is a, c, g, or t
  misc_feature (108)..(108): n is a, c, g, or t
  misc_feature (113)..(113): n is a, c, g, or t
  misc_feature (115)..(115): n is a, c, g, or t
  misc_feature (118)..(118): n is a, c, g, or t
  misc_feature (121)..(121): n is a, c, g, or t
  misc_feature (124)..(124): n is a, c, g, or t
  misc_feature (127)..(127): n is a, c, g, or t
  misc_feature (130)..(130): n is a, c, g, or t
  misc_feature (136)..(136): n is a, c, g, or t
  misc_feature (148)..(148): n is a, c, g, or t
  misc_feature (154)..(154): n is a, c, g, or t
  misc_feature (160)..(160): n is a, c, g, or t
  misc_feature (169)..(169): n is a, c, g, or t
  misc_feature (172)..(172): n is a, c, g, or t
  misc_feature (178)..(179): n is a, c, g, or t
  misc_feature (181)..(184): n is a, c, g, or t
  misc_feature (188)..(191): n is a, c, g, or t
  misc_feature (193)..(193): n is a, c, g, or t
  misc_feature (199)..(199): n is a, c, g, or t
  misc_feature (211)..(211): n is a, c, g, or t
  misc_feature (214)..(215): n is a, c, g, or t
  misc_feature (217)..(217): n is a, c, g, or t
  misc_feature (220)..(220): n is a, c, g, or t
  misc_feature (226)..(226): n is a, c, g, or t
  misc_feature (229)..(230): n is a, c, g, or t
  misc_feature (232)..(232): n is a, c, g, or t
  misc_feature (234)..(234): n is a, c, g, or t
  misc_feature (236)..(236): n is a, c, g, or t
  misc_feature (238)..(239): n is a, c, g, or t
  misc_feature (244)..(245): n is a, c, g, or t
  misc_feature (249)..(250): n is a, c, g, or t
  misc_feature (298)..(298): n is a, c, g, or t
  misc_feature (385)..(385): n is a, c, g, or t
  misc_feature (400)..(400): n is a, c, g, or t
  misc_feature (412)..(412): n is a, c, g, or t
  misc_feature (508)..(508): n is a, c, g, or t
  misc_feature (897)..(897): n is a, c, g, or t
  misc_feature (990)..(990): n is a, c, g, or t
  misc_feature (1029)..(1029): n is a, c, g, or t
  misc_feature (1053)..(1053): n is a, c, g, or t
  misc_feature (1074)..(1074): n is a, c, g, or t
  misc_feature (1143)..(1143): n is a, c, g, or t
  misc_feature (1195)..(1195): n is a, c, g, or t
  misc_feature (1341)..(1341): n is a, c, g, or t
  misc_feature (1344)..(1344): n is a, c, g, or t
  misc_feature (1376)..(1376): n is a, c, g, or t
  misc_feature (1387)..(1387): n is a, c, g, or t
  misc_feature (1407)..(1407): n is a, c, g, or t
  misc_feature (1433)..(1433): n is a, c, g, or t
  misc_feature (1494)..(1494): n is a, c, g, or t
  misc_feature (1539)..(1539): n is a, c, g, or t
  misc_feature (1698)..(1698): n is a, c, g, or t
  misc_feature (1728)..(1728): n is a, c, g, or t
  misc_feature (1737)..(1737): n is a, c, g, or t
  misc_feature (1786)..(1786): n is a, c, g, or t
  misc_feature (1960)..(1960): n is a, c, g, or t
  misc_feature (1971)..(1971): n is a, c, g, or t
  misc_feature (1981)..(1981): n is a, c, g, or t
  misc_feature (1986)..(1986): n is a, c, g, or t
  misc_feature (1988)..(1988): n is a, c, g, or t
  misc_feature (1991)..(1992): n is a, c, g, or t
  misc_feature (2118)..(2118): n is a, c, g, or t
  misc_feature (2172)..(2172): n is a, c, g, or t
  misc_feature (2189)..(2189): n is a, c, g, or t
  misc_feature (2191)..(2192): n is a, c, g, or t
  misc_feature (2195)..(2195): n is a, c, g, or t
  misc_feature (2207)..(2207): n is a, c, g, or t
  misc_feature (2216)..(2216): n is a, c, g, or t
  misc_feature (2219)..(2219): n is a, c, g, or t
  misc_feature (2224)..(2225): n is a, c, g, or t
  misc_feature (2241)..(2241): n is a, c, g, or t
  misc_feature (2254)..(2255): n is a, c, g, or t
  misc_feature (2259)..(2259): n is a, c, g, or t
  misc_feature (2271)..(2271): n is a, c, g, or t
  misc_feature (2297)..(2297): n is a, c, g, or t
  misc_feature (2303)..(2303): n is a, c, g, or t
  misc_feature (2306)..(2306): n is a, c, g, or t
  misc_feature (2318)..(2318): n is a, c, g, or t
  misc_feature (2321)..(2321): n is a, c, g, or t
  misc_feature (2324)..(2324): n is a, c, g, or t
  misc_feature (2343)..(2343): n is a, c, g, or t
  misc_feature (2348)..(2348): n is a, c, g, or t
  misc_feature (2357)..(2357): n is a, c, g, or t
  misc_feature (2363)..(2363): n is a, c, g, or t
  misc_feature (2384)..(2384): n is a, c, g, or t
  misc_feature (2414)..(2414): n is a, c, g, or t
  misc_feature (2417)..(2417): n is a, c, g, or t
  misc_feature (2429)..(2429): n is a, c, g, or t
  misc_feature (2438)..(2438): n is a, c, g, or t
  misc_feature (2456)..(2456): n is a, c, g, or t
  misc_feature (2471)..(2471): n is a, c, g, or t
  misc_feature (2492)..(2492): n is a, c, g, or t
  misc_feature (2495)..(2495): n is a, c, g, or t
  misc_feature (2501)..(2501): n is a, c, g, or t
  misc_feature (2510)..(2510): n is a, c, g, or t
  misc_feature (2528)..(2528): n is a, c, g, or t
  misc_feature (2540)..(2540): n is a, c, g, or t
  misc_feature (2543)..(2543): n is a, c, g, or t
  misc_feature (2546)..(2546): n is a, c, g, or t
  misc_feature (2759)..(2759): n is a, c, g, or t
  misc_feature (2925)..(2925): n is a, c, g, or t
  misc_feature (3017)..(3017): n is a, c, g, or t
  misc_feature (3143)..(3143): n is a, c, g, or t
  misc_feature (3482)..(3482): n is a, c, g, or t
  misc_feature (3739)..(3739): n is a, c, g, or t
  misc_feature (3742)..(3742): n is a, c, g, or t
  misc_feature (3842)..(3842): n is a, c, g, or t
  misc_feature (3844)..(3844): n is a, c, g, or t
tgtnaanntntgtattganaatnnngatgtactngcntttgatctngcnggnccagangtnggnttttctgcnntnaatcancaagangcaatngaaatngctnancnaaatnanatnaanatnacnctncatgcngattgggaagtncctganggtatncatgaagtnatnttaganntnnnntcannnngnataggncatggttcacanatnntnaangattanaannanantnannatggnntaanntttaaaaaccttgcagcaaagttcgtacacgaaaacaacattccactngaattatgtccaacttcaaatatgcaatgtggatcttgtaattcaatatcagaacaccctttcaaaaaactttatgatgatgggttnaatgtcactattaanacagacaatagncttatgagcaacataactatgtcacaagaggtaaacaatcttgttgaaagttttacttttactcaagatgaaatactacaaataacaaaaaatacnatagaagctggatttgtagatagtaaaaaaagagagaaattactgagtagtttttaatttgtattcaattaattgaatcaagtgtaatttcaaccatagtttttaaaccgatttcacgttcttctgatgacatttgcaaattcttctcaattacatccgagacagtcgcaacagctaaagctttagcaccatactctgctgcaacgccatatagtcctgcagcttccatttcaaccgccaggattcccattcgtttcatgatttcaaatgtttcttttctaggatcataaaaaagatcaccagaaaatatattacctacatgcacagttctagacatagactgagcagtatttacaaaattttgtactaattcccatgaagcagttgcngagaagtcagcgttaaaaaatcttgctctgtttacacctgaatctgtagatgctccaacacctacaacaatatcaccaagttcaagatgttcngctattgaacctgaacttccaactcttattaaggacttnactttatattcagtaattaactcnttagcgtatattgatatgganggtatacccatccctgttcccataactgaaatacgacttcctttatattcaccagtaaatccaagaatnttacggacgtttgttacttccttagttttttgaaaaaaagtatctgcaatanatttagctctcagaggatcgccaggtagcagtattgtttcagcgaatgcattattttcggcattaatatgtggtgttaccattttgtaattctaacatttattgatctacaaaaggtaatttaagtagaatttaagtatgcaatantcnaaacaagaacaatatctaatgagcaaagatgnccaactcaagnaaattattatttctaataancatattaagataacaagacccactgnaaattattacgattcgctcattaatctggtaataagtcaatttatatcaagatcagcagcnatatctatatcaaataaattattactaagttttaatgccaacatntttaaagaagagttttttgaaaacctaacttatcaacaaatacatagacttggattaactaaaaataaagccaagtctataaaagatattacataccattttattaatgaggacttccgtaaaaaaataacatctttacctatgaaggagtttgatagntactttttatcaatctatggcttaggaccntggagtttnaatatgtttaagttattctcccttggtgatgaagatatcttttcatctnacgatgcagctttaaggcgagctatggaaacaagtggcatgcttaaattaggatcagaccataaagactttgatttgcatgcaatgaagtggaaaccctttagatctacagcttcattacatctttggcgatccttagattaattctttcacaattgcacaaagattgcttttngtggtataatntttaaatganaaatnanaannttgtgcaagtggtgagttacatatatatgtagtgccttttcgcaatcgtttgaaatccgggcacttgcccggtttttttattttaggaaggaaaataatgaaagaccaaacaaacacagatacgantaataacaatattaagaagacaaaagctgacttgtatgagagtttctacgatgnagaatagttttcttganannganaaattacaaaangattggganacnaatgnnagatggaaaggaatancaagaaactatanntctnatgaagtaattngaatacgtaattctgtagaaattaancatacnctngctgaaaacggngcnaanaaactttttactgctttangtaanaaagatgantggatntctgctctcggcgcattatcnggaaatcaggcagtacaaatggttaaagcnggnttaaaagctatntaccttagnggatggcaagtagctgcngactcaaatcttggngagacaacctatccagaccantcnctttanccaagtaanagtgctcctactcttgcnaaaagaataaanaangcncttttaagagctgaacaagtagatcgggttgaaggtaaagatgatattgattatattgttccgatagtagctgatggggaagcagggtttggtggaacattaaacgtgttcgaactaactaaaaaatttattgaagctggtgcctccgctgtacatttcgaagaccaattagctgctgaaaaaaaatgtggccatatgggaggaaaagtattngtgccaactagtcaacatattagaacgttaacttctgcaagattagcagccgatactttaggtgttccaaccttaataattgctagaactgatgctcttgcagccaatcttataacaagtgatattgatgattcagacagtcatttcgtgttaggggaaagaactncagaaggattttttaagataaaaaatggtccagaggcagcaataagtaggggtcttgcgtacgcaccatattctgatttaatttggtgtganacaggccagccagatataggatttgcaaaggagtttgccgatgctattcatgctaagtatcccgataaacttttagcatataattgttctccttcttttaattggaaaaaatcattatctgatgangaaatatccacatttcaggaacaattaagttcattcggatataaatttcaatttataactcttgcaggatttcacgcattaaatacatctatgtttgaattagcatctaagtataagggtggaaacatgagtgcctatgttgaattacagcaaaaagagtttggcttagaaaaagatggttttacttctgtgaaacatcaaagagaagttggtgccggatattttgacactgtttctacaattattagtggtggggatgcatctacacttgcactttctggttccactgaagaggaacaattttaatgttcgaaataaatcacaaccaaaatacaaaancattacttactgatgagtttctatcttttttagaaaagtttatcaatagtttcgaagatgagagacaaatgctactcattaagaggttagaaactcaaaaattaatttcaaatggtggaaaatttacatttccagaagattcaacgataagagatggagaatggaaagttgtaccacctcctgatgatgtactcaatagaaatgttgaaattacaggacctgtagatagaaaaatgatcattaatgcattgaattcnggntcagacgtttttatggctgattttgaagactctacttcaccaacgtgggaaaatatacttaacgggcacctcaatctgattgatgctaataacagatcantntcctttgaaaacaaagagaatggaaaaaaatacgaactaaaccaaaattctgcaacttcattattcgttaggcctcgaggtttacatttaaatgaacaaaatgttacttatatgggtaaggaagtgtctgcttcactgtttgatttttgcctatat

SEQ ID NO: 1076 - DNA, 4000 bp, Escherichia coli
  misc_feature (1)..(2): n is a, c, g, or t
  misc_feature (7)..(8): n is a, c, g, or t
  misc_feature (14)..(14): n is a, c, g, or t
  misc_feature (16)..(16): n is a, c, g, or t
  misc_feature (18)..(22): n is a, c, g, or t
  misc_feature (25)..(27): n is a, c, g, or t
  misc_feature (30)..(32): n is a, c, g, or t
  misc_feature (34)..(35): n is a, c, g, or t
  misc_feature (40)..(40): n is a, c, g, or t
  misc_feature (43)..(44): n is a, c, g, or t
  misc_feature (47)..(49): n is a, c, g, or t
  misc_feature (52)..(52): n is a, c, g, or t
  misc_feature (55)..(57): n is a, c, g, or t
  misc_feature (62)..(62): n is a, c, g, or t
  misc_feature (815)..(815): n is a, c, g, or t
  misc_feature (854)..(854): n is a, c, g, or t
  misc_feature (1007)..(1007): n is a, c, g, or t
  misc_feature (1617)..(1617): n is a, c, g, or t
  misc_feature (1684)..(1684): n is a, c, g, or t
  misc_feature (1840)..(1840): n is a, c, g, or t
  misc_feature (2637)..(2637): n is a, c, g, or t
  misc_feature (2696)..(2696): n is a, c, g, or t
  misc_feature (2704)..(2704): n is a, c, g, or t
nnaaagnnggtgcngngnnnnncannnttnnncnngaggnganntcnnngtntcnnnggagnggcgtgcctgaatttcaatgctcggcgcttggatccggcgacgacggcggcacgggcttcggttgccgtccaggaatttgtttttggcgaaggagcttcgtaaagtatgtccgctgcagccccaacgcttcggccgccctggtctggttccagtcgtttttcttcaacgcgtcctcgagcacccaacgactgtatgcctccatcatcgcgtgataaccggttgcgtcgcctggccgctgctgaatcccttctgcctgaccgggagcagtgccaccgacaccagacgcaagaccggcgccggctgcatccgagagacataaatgctcgggttcgatcgttttccccggggtcaaaatgtaggcacgcgtcagcacattctccaattcccgaatattccccggccatcggtactgcgaaagcgtgcgccctgcggcttcgctcagggtacagtgtttgctgaggccgaactttcccgctcgaccgaggacatactcggcaagggccgggatatcgtcaatgcggtcacgcagcggcggcagggtcacggagatgacggccaggcgatagaacagatcctctcggaaggagccctggtgaatggcctgcttcagatccttattggtggcggcgaggaaccggacgtccgtgtggaccgactgggtgccgccgactcgataaaacgtttgatcctgcagaacccgcagcaagtggctttgcagcgataaggacatgtcgccgatctcatcaagaaanaccgtcccgccttcagcaatctcgatctttcccgcttcncgtttcacggccccggtaaaggctcccttttcatggccgaacagttcgttctcgaggaggtccttcggaatcgctgcgcaattgacggccacaaacggtttgtccctccgcggactccaaccgtggatggcgcgtgcgacgacctctttgccngtgccggtctctcccaggatcagcacagtgacgttcgagacggcggcctgcttggccaaggccagctgagccgtgaatttcgcgttggtgcccaccatgccgccatagcgcgcatccaattcttgcttgaggacgccgacttgccggcgaagggcgatggcctccagcgccttattgatgacgacggagatgtggtcgccggtgaacggtttggtaatgaaatcgatggcgccgagctgcatggccttgacggcgagttcgatcgtaccgaaggcggtcagcatcacgatcggcggcatcaacgccccgccagcgtccggggccgcatgtttcccaatcgaatcatggatctgctgaaggatctcaaggccggaaaaaaccggaagctgaatgtccagaaggacgaggtcgggctgttcggtttgtatgatacgcagggccgccttgccatcgctggccgtcactggctcgtgccccatccacgtcacgcggttttcgagcgcgaggacgatatccggatcgtcgtcgacaatgagtatacgtgcacgcatgggagagcctcctaatcggcgtctgtggtcgtaccgggagagacgatttgaggcgacgnctgtcctgggacgctgtcaggcgccgtgcagggcaaggtgaaatagaagcgcgaacccgaccccagngcactttcgacccagatatgtcccttatgcatcgtgataaagctcttcgtgatgaagagtcccagttgggcgccctgcgatgtgggcatcgtggaagggactttcgagaattcgtcgaagactcggtgaagttgatcggggggaatcccgcagccngtgtccctcacacaggtttgcatcatgccatcggggagcgcctcgagctcgagcgtaatctgtcctccggatggcgtgaacttcacggcattgccgataagattccagaggatctgctccagcttgtcgcggtctgcataaatcatcggagggtgctcgggcgattcaatgcgaatgtccacgttcttctccgcggccacggtgcgcaggctttcgacgacccgcgtcgcgctttgattgagacagagaggctccagtcgaagaatttccttcttgaggtccaatcgcgaccaatccaacagttggttgatgattcttgtgagccgattcaagttgtacccgatgcggtcgagataggtcttctgacggtcggacaggacgccggcaacgccgtcagccatgttgtccgcgaagctgcggatggcggtcatcggggtgcgcaattcatgcgaggcgacggagacgaacatcgtgcgacgccggtcatgctcctgaagctgttgattggcctgggacaattccagcgttcgctcttggatgcgctgctccagatgctgtgtgagttgcgccaaattggcataagtgcgggcgttgtcgatcgccgtggccacgtggctcgcgatggtcatcaagatgtggaggtcctcttcggagcagggcagcacaccgcggtcgccagcaataaagccgagcgtctggctatggctctgcaacggcacacacacgaaggattggacgtccacgcggcgcatcagctcgagagtcgtcggattgatccgatgggcgaccatattcanatcgcgagccagaactggtttcgcatggatgaagaggtcggccagaatcgtgtcatcgnccttgatngggatacttaaaaagcgggcggcctcggcgatctcatccgagacccctgccacctgtgcgatgtagccgacgtcccgatcctcatcacggagcatgaggagcatccgtgagaatcccaagttcgatctcagcaactgcaggacggtatccatcagttcatggagatccagggtgctcgtaatggccgcgctggtctgatggacggcggtcaattgggtgatctgcttgcggatggtctccagattggaggaaatggccgcgccgcgttcacgcaacgcggccgtcatggcattaaaggtttgcgtcaactggccgacttcatcggtcgtcgttgcgggaatgggcgccggcgattcgccttccgtaagctgccgggcgaccgcggccagccgtcgcaacggggtggtaatgcgcaacgtcaggaagtgcgcgcccaggatgccggcgctgatcagcagggtcgtcagaatcagcacgttgcggatcatctcgaagagcgcgtgcttgacgctggcatccgtgagaccgatctgcacgacaccctgcaccaggtacggcgccgcgcttttcctcgattggattcgttcttccatttcgagcagcagcggggacagtgacggatcggttgccggttttcggaggactggcatggcaaaatcgtacagcttgtcggtcagcgacgagaggatccaaatcggatttgggatgcctccatccggaaccagaattttgttttgcgacagggccacgggcgtgatgcgcggcgtggacgtcggctcgcggtacagttcttcagcgatcgcctcatcgggataaaaccggcgctcctgcgtgaaggtcacgcttcccaacgactcgtgaacgatcttgttctgctgtgcgaggatgatgtggtccgcgccgcggaccactacatacaccacgtcatcgatggccatcaggctctccacgaattgctgcagcgtcgcccggtcttccgcgatcaaccctccatagcggaattggccgttattcaccacgctggtgaggagaatcgtgcccaattgattgaggttctcggtcatcgaaacgcgtcgtacctcgatgaagtaccaactgagcgctgaagaggtcagaatgaggatcaagctgaagaagacgacgaacttcgtgcgaatactcgcaagcttccccaggcccgacagttgcagagtcgattgtggactggtcataggcatcaataggtctcgtcgatcaggtgattgacgtctttgggaaactcgatgccgagaaaccgcgccgtcttcagattcacag

SEQ ID NO: 1077 - DNA, 4000 bp, Escherichia coli
  misc_feature (25)..(25): n is a, c, g, or t
  misc_feature (245)..(245): n is a, c, g, or t
  misc_feature (369)..(369): n is a, c, g, or t
  misc_feature (664)..(664): n is a, c, g, or t
  misc_feature (1294)..(1294): n is a, c, g, or t
  misc_feature (1989)..(1989): n is a, c, g, or t
  misc_feature (1994)..(1995): n is a, c, g, or t
  misc_feature (2058)..(2058): n is a, c, g, or t
ttcgcaaaatcatcgaagtcagccnggctgatttacaacaagacatcggtggtgtcagcctaggtgaggccctgatggagcctacccgtatttatgtaaaagccttattaacactatttaagcaagtggatgtaaaagccttatctcatatcacaggtggtggtttacttgagaatattccgcgggttttacctgcaaatagtgttgctgtaattgagactcagtcttggcagcagcccgctgtntttaagtggttgcaaagccaaggtaatgtgaccgacactgaaatgtaccgtacctttaattgcggtgtgggcatggtcattgtggtaaccgaagaagaccaagcccaagcactatccaccctgnctgaagcaggtgaaagtccttgggtaataggtcatattcaacaaaatgacggctcccaagatgctgttttaatgcgctaaacccgtctttggacacgctcatgcatgaacaatcattacaacaagtaccgcgtcttgtggtccttatttcaggtggcggtagtaacttacaagcgctcattgatgctatttctatgggctcaattgatgcgaccattgaattagtcatcagcaacaaagttgatgctttgggtttagctagagctcataaagctggcatagaaactcgagtcatnaatcacctagagtttggtagccgcgaggcctttgacaaggaactcacacacgccattgatgacaagcaacccgatttggtagtcctcgctggttttatgcgaatttttacgcctcaattcacccatcattaccatggccgcatgcttaacatccacccttcgttgctgccacagtttaaaggcattaatactcatgagcgggccatagaagcagaggttgctgagcatggcgccagtgtgcattttgtttctagtgaacttgatgggggtcctatggtcttacaagcatcagtgagcgtactaagtctggattcacctaaagttttagcggctcgggtcttagtgcaagaacacttaatttaccccattgccattaaatggttctgtgagggccggttaaagctgcaaaataacgctgtgttaatggatggtcagctattgccagaacaaggcatacaatttcagtcctgacttaaatgtgctcgattaataatgcaaggaaatgcaatgctaaatattaccaacaaattgtgtaagctccccagcgcctttagcctgatgctcatcttgttatggagtcacagcagcctagctcagttaagaccttttcaagcgatttataccagccantgggatttaggtattagcctatctggccaagcagaacgcagtctaattaagaatgatgatggaagctaccgactcacgactgctgcgagtgcgatggtagcttctttgaccgaatccagcctgtttcaatttattgatgatcaaattgagcctgatcactatacctaccaacgcaaagttttaaacaaaacacgagatgtagaggttaaatttgactggcctaataagaaagttaagaacactgctgggggttccgattggttgatggatattgtaccgggcacactcgataaacaaagtgtgcaactgctcctgcagctggatttagccgccactcctgtcattaatggtaaaacgtacgcttaccaagtagccgatggtggtgagcttaaaatctatcagtttattgctgatggcgaagacctgattgaaactccccttggcaattacaagtctttgcgcattaaacgagatcgaggtgaaggttcagatcgagaaacttggatctggtttgcacccgatctagattacagtatcgtgcgtattatccaaaaagaagcagacgggaaaagctaccaaatcgatttacagcagctgacttggcttgatggttagcgtaaattcaggcgtgaacagcttgcgcaaaacttggtaaagcagttcgcacctaagcgcaaatttagttaaactacagnctaannatagctgttacgtaaggatatatcttggcctcttcaaatcgttttgcggtctttatcatagcngctgctgcctctgtaggcagtcatgccagtcaattccaagagcttttccaattggcacaggccaatgatcccagttatatcgctgcccaacatacgcttaattctaaattagaaattattcctcaagcgaacagcgcattcatgccagagattagtggcagcgtgaacgaaagccaatccttaaatgctggagctaacatccatacctatggggttaaagtagcgctgcctctgaggctagatgcgttttatagcctcaaagtagcagagaaaatggctgctggggcgcgcattaactttgaaaaaacacatcaagatcttattttctctgtgattaatcgttatgttgctgtgatcaaacagcagcaccaaatgtcttcaagtttggcggaagtcaccgctgtggaacagcgtttaaaacaaacacaacagcaagttgatctgggtatcagtagcatcatagaactgcaggatgtgaaagctaactttcaacaattgcaggtgaacttattgcaggttcaacaagacttaagcttagcccgtgccaaccttgagaatctaactaatcagacactacccccaaagcttcctgctctagccagcagcttcaatgctgctagtttggtcgctattgattctttggaaaactggtttgagctagcacaaaataataacttagacattgcccacaacaagttggccgttcagcaggcctaccataactaccaagttaaggatgtgggtttatacccaaaagccagtatcagcatgtcacaaaactacagcagcagcactggtactagccagttctttgcagtgggtgtaacgggcactttctttgacggtggtttgaatcaatctcagactaacgaagctaaagaagcttggtatgccagccaacaacaaggccaagctctgcttaaaacgacgcaacaagaaattaggcgttggcaccaagctttagatacaagtcgtcaacagattcaagccctagcgcagttgaacaaggctgtgcaggcctcattagacggaaaaaatacagaatataccttaggtttgagagacattagcgatattttggacgcagaaaaattagttttttcggctcaacgcagttgggataatgcaagacttgacttagtgttaaatcaattacgcttaaaacgagccagtggtttgttaaatggtagcgacttagctcaactggaccagtggtttaactaatttcagagatcagttcagccactttggcgttaggattttgttgtaaaatcgccaaaaggtctaacaaggttttaatagccaagcgtggattaaggtaatattgcgcgccatatatcgtgcgacattgaagcataaattgccataagcccatatcgtcaatcagatagttgttagcttcaccgtaggcctgcagatggcgtaacttttgcaacaactcatccatttctgtttcttgcagcggttgtaactcaatcacaggtccagatacatcgatcaaacctgcttgcgccagacgattgaatgcaagcctactcttcagagctggcatgctataaaggcctttcttctcatcataaacaaattcaggggtacctaaaaatacgaagcccataccatggacttgaccttgcaagcagtcattaacaatattaagaatttcattaaagttattgatacgagtctgcttgtggcttaattcatgcaatgccaccatctcgtctaaacagatgagtaagccgggataacctgccatacgcacgaattggcagagcatttttaaaccactgaaaaaattacgatagtctataatactgcgcacgcccaaagcagctttagcgtcagtcaaattagtaaactcacctcttagccaccttaatgctgtgctttttaatatatcgtcttgctgttccaaagcatggcagtaacgctgaatgactgt

SEQ ID NO: 1078 - DNA, 4000 bp, Escherichia coli
  misc_feature (17)..(17): n is a, c, g, or t
  misc_feature (102)..(103): n is a, c, g, or t
  misc_feature (105)..(109): n is a, c, g, or t
  misc_feature (111)..(117): n is a, c, g, or t
  misc_feature (120)..(120): n is a, c, g, or t
  misc_feature (122)..(124): n is a, c, g, or t
  misc_feature (126)..(127): n is a, c, g, or t
  misc_feature (129)..(130): n is a, c, g, or t
  misc_feature (132)..(142): n is a, c, g, or t
  misc_feature (144)..(145): n is a, c, g, or t
  misc_feature (147)..(147): n is a, c, g, or t
  misc_feature (149)..(149): n is a, c, g, or t
  misc_feature (153)..(153): n is a, c, g, or t
  misc_feature (155)..(155): n is a, c, g, or t
  misc_feature (158)..(158): n is a, c, g, or t
  misc_feature (160)..(167): n is a, c, g, or t
  misc_feature (169)..(170): n is a, c, g, or t
  misc_feature (173)..(177): n is a, c, g, or t
  misc_feature (179)..(179): n is a, c, g, or t
  misc_feature (182)..(182): n is a, c, g, or t
  misc_feature (184)..(184): n is a, c, g, or t
  misc_feature (190)..(190): n is a, c, g, or t
  misc_feature (193)..(193): n is a, c, g, or t
  misc_feature (196)..(196): n is a, c, g, or t
  misc_feature (198)..(198): n is a, c, g, or t
  misc_feature (201)..(201): n is a, c, g, or t
  misc_feature (203)..(205): n is a, c, g, or t
  misc_feature (207)..(207): n is a, c, g, or t
  misc_feature (210)..(211): n is a, c, g, or t
  misc_feature (213)..(214): n is a, c, g, or t
  misc_feature (216)..(216): n is a, c, g, or t
  misc_feature (218)..(218): n is a, c, g, or t
  misc_feature (220)..(220): n is a, c, g, or t
  misc_feature (222)..(223): n is a, c, g, or t
  misc_feature (225)..(230): n is a, c, g, or t
  misc_feature (232)..(232): n is a, c, g, or t
  misc_feature (234)..(234): n is a, c, g, or t
  misc_feature (237)..(237): n is a, c, g, or t
  misc_feature (239)..(241): n is a, c, g, or t
  misc_feature (244)..(244): n is a, c, g, or t
  misc_feature (247)..(247): n is a, c, g, or t
  misc_feature (249)..(252): n is a, c, g, or t
  misc_feature (256)..(258): n is a, c, g, or t
  misc_feature (260)..(262): n is a, c, g, or t
  misc_feature (265)..(269): n is a, c, g, or t
  misc_feature (271)..(272): n is a, c, g, or t
  misc_feature (274)..(276): n is a, c, g, or t
  misc_feature (278)..(278): n is a, c, g, or t
  misc_feature (280)..(282): n is a, c, g, or t
  misc_feature (284)..(284): n is a, c, g, or t
  misc_feature (289)..(290): n is a, c, g, or t
  misc_feature (292)..(292): n is a, c, g, or t
  misc_feature (294)..(295): n is a, c, g, or t
  misc_feature (299)..(302): n is a, c, g, or t
  misc_feature (304)..(307): n is a, c, g, or t
  misc_feature (309)..(309): n is a, c, g, or t
  misc_feature (311)..(313): n is a, c, g, or t
  misc_feature (315)..(315): n is a, c, g, or t
  misc_feature (317)..(317): n is a, c, g, or t
  misc_feature (319)..(319): n is a, c, g, or t
  misc_feature (322)..(322): n is a, c, g, or t
  misc_feature (324)..(324): n is a, c, g, or t
  misc_feature (326)..(328): n is a, c, g, or t
  misc_feature (330)..(330): n is a, c, g, or t
  misc_feature (332)..(335): n is a, c, g, or t
  misc_feature (337)..(338): n is a, c, g, or t
  misc_feature (340)..(341): n is a, c, g, or t
  misc_feature (345)..(345): n is a, c, g, or t
  misc_feature (347)..(348): n is a, c, g, or t
  misc_feature (350)..(350): n is a, c, g, or t
  misc_feature (352)..(355): n is a, c, g, or t
  misc_feature (357)..(360): n is a, c, g, or t
  misc_feature (362)..(365): n is a, c, g, or t
  misc_feature (367)..(370): n is a, c, g, or t
  misc_feature (374)..(375): n is a, c, g, or t
  misc_feature (379)..(380): n is a, c, g, or t
  misc_feature (382)..(383): n is a, c, g, or t
  misc_feature (389)..(395): n is a, c, g, or t
  misc_feature (397)..(397): n is a, c, g, or t
  misc_feature (400)..(401): n is a, c, g, or t
  misc_feature (403)..(403): n is a, c, g, or t
  misc_feature (406)..(406): n is a, c, g, or t
  misc_feature (408)..(409): n is a, c, g, or t
  misc_feature (412)..(413): n is a, c, g, or t
  misc_feature (415)..(415): n is a, c, g, or t
  misc_feature (417)..(418): n is a, c, g, or t
  misc_feature (420)..(420): n is a, c, g, or t
  misc_feature (422)..(422): n is a, c, g, or t
  misc_feature (424)..(428): n is a, c, g, or t
  misc_feature (430)..(435): n is a, c, g, or t
  misc_feature (437)..(437): n is a, c, g, or t
  misc_feature (439)..(440): n is a, c, g, or t
  misc_feature (443)..(445): n is a, c, g, or t
  misc_feature (448)..(448): n is a, c, g, or t
  misc_feature (450)..(450): n is a, c, g, or t
  misc_feature (452)..(453): n is a, c, g, or t
  misc_feature (456)..(457): n is a, c, g, or t
  misc_feature (459)..(460): n is a, c, g, or t
  misc_feature (466)..(466): n is a, c, g, or t
  misc_feature (470)..(472): n is a, c, g, or t
  misc_feature (474)..(474): n is a, c, g, or t
  misc_feature (477)..(478): n is a, c, g, or t
  misc_feature (482)..(482): n is a, c, g, or t
  misc_feature (485)..(485): n is a, c, g, or t
  misc_feature (488)..(488): n is a, c, g, or t
  misc_feature (490)..(492): n is a, c, g, or t
  misc_feature (494)..(494): n is a, c, g, or t
  misc_feature (497)..(499): n is a, c, g, or t
  misc_feature (501)..(503): n is a, c, g, or t
  misc_feature (505)..(505): n is a, c, g, or t
  misc_feature (508)..(509): n is a, c, g, or t
  misc_feature (512)..(514): n is a, c, g, or t
  misc_feature (516)..(516): n is a, c, g, or t
  misc_feature (518)..(519): n is a, c, g, or t
  misc_feature (521)..(524): n is a, c, g, or t
  misc_feature (528)..(528): n is a, c, g, or t
  misc_feature (530)..(531): n is a, c, g, or t
  misc_feature (533)..(538): n is a, c, g, or t
  misc_feature (540)..(540): n is a, c, g, or t
  misc_feature (544)..(544): n is a, c, g, or t
  misc_feature (546)..(547): n is a, c, g, or t
  misc_feature (550)..(551): n is a, c, g, or t
  misc_feature (553)..(553): n is a, c, g, or t
  misc_feature (555)..(555): n is a, c, g, or t
  misc_feature (557)..(558): n is a, c, g, or t
  misc_feature (560)..(560): n is a, c, g, or t
  misc_feature (562)..(562): n is a, c, g, or t
  misc_feature (564)..(565): n is a, c, g, or t
  misc_feature (567)..(567): n is a, c, g, or t
  misc_feature (571)..(572): n is a, c, g, or t
  misc_feature (576)..(577): n is a, c, g, or t
  misc_feature (579)..(579): n is a, c, g, or t
  misc_feature (582)..(584): n is a, c, g, or t
  misc_feature (586)..(586): n is a, c, g, or t
  misc_feature (588)..(590): n is a, c, g, or t
  misc_feature (592)..(593): n is a, c, g, or t
  misc_feature (595)..(595): n is a, c, g, or t
  misc_feature (597)..(597): n is a, c, g, or t
  misc_feature (599)..(600): n is a, c, g, or t
  misc_feature (604)..(605): n is a, c, g, or t
  misc_feature (607)..(611): n is a, c, g, or t
  misc_feature (613)..(613): n is a, c, g, or t
  misc_feature (617)..(618): n is a, c, g, or t
  misc_feature (620)..(620): n is a, c, g, or t
  misc_feature (622)..(622): n is a, c, g, or t
  misc_feature (625)..(625): n is a, c, g, or t
  misc_feature (627)..(627): n is a, c, g, or t
  misc_feature (630)..(630): n is a, c, g, or t
  misc_feature (632)..(632): n is a, c, g, or t
  misc_feature (635)..(637): n is a, c, g, or t
  misc_feature (641)..(641): n is a, c, g, or t
  misc_feature (643)..(644): n is a, c, g, or t
  misc_feature (648)..(651): n is a, c, g, or t
  misc_feature (653)..(653): n is a, c, g, or t
  misc_feature (656)..(657): n is a, c, g, or t
  misc_feature (660)..(661): n is a, c, g, or t
  misc_feature (665)..(667): n is a, c, g, or t
  misc_feature (669)..(670): n is a, c, g, or t
  misc_feature (675)..(675): n is a, c, g, or t
  misc_feature (677)..(678): n is a, c, g, or t
  misc_feature (680)..(680): n is a, c, g, or t
  misc_feature (683)..(684): n is a, c, g, or t
  misc_feature (687)..(687): n is a, c, g, or t
  misc_feature (689)..(689): n is a, c, g, or t
  misc_feature (691)..(691): n is a, c, g, or t
  misc_feature (693)..(693): n is a, c, g, or t
  misc_feature (695)..(696): n is a, c, g, or t
  misc_feature (699)..(702): n is a, c, g, or t
  misc_feature (704)..(704): n is a, c, g, or t
  misc_feature (707)..(707): n is a, c, g, or t
  misc_feature (711)..(711): n is a, c, g, or t
  misc_feature (713)..(714): n is a, c, g, or t
  misc_feature (717)..(718): n is a, c, g, or t
  misc_feature (721)..(721): n is a, c, g, or t
  misc_feature (723)..(723): n is a, c, g, or t
  misc_feature (726)..(726): n is a, c, g, or t
  misc_feature (728)..(728): n is a, c, g, or t
  misc_feature (730)..(730): n is a, c, g, or t
  misc_feature (732)..(735): n is a, c, g, or t
  misc_feature (737)..(738): n is a, c, g, or t
  misc_feature (740)..(740): n is a, c, g, or t
  misc_feature (742)..(743): n is a, c, g, or t
  misc_feature (747)..(747): n is a, c, g, or t
  misc_feature (749)..(749): n is a, c, g, or t
  misc_feature (753)..(753): n is a, c, g, or t
  misc_feature (756)..(760): n is a, c, g, or t
  misc_feature (763)..(763): n is a, c, g, or t
  misc_feature (769)..(769): n is a, c, g, or t
  misc_feature (771)..(774): n is a, c, g, or t
  misc_feature (776)..(776): n is a, c, g, or t
  misc_feature (778)..(779): n is a, c, g, or t
  misc_feature (781)..(781): n is a, c, g, or t
  misc_feature (783)..(783): n is a, c, g, or t
  misc_feature (787)..(789): n is a, c, g, or t
  misc_feature (794)..(794): n is a, c, g, or t
  misc_feature (798)..(798): n is a, c, g, or t
  misc_feature (802)..(802): n is a, c, g, or t
  misc_feature (806)..(806): n is a, c, g, or t
  misc_feature (1346)..(1346): n is a, c, g, or t
  misc_feature (1940)..(1940): n is a, c, g, or t
  misc_feature (1946)..(1946): n is a, c, g, or t
  misc_feature (1988)..(1988): n is a, c, g, or t
  misc_feature (1991)..(1991): n is a, c, g, or t
  misc_feature (2804)..(2804): n is a, c, g, or t
  misc_feature (3161)..(3161): n is a, c, g, or t
  misc_feature (3743)..(3743): n is a, c, g, or t
ccctcgacctgcacggnacgctcgacacgcggctgctcgggttcactggtgtcagccgacaacggctcgaagcgtggcgcctgcatggccggcgcaggcgcnntnnnnncnnnnnnntgngnnngnncnngnnnnnnnnnnncnnangnaagngnggngnnnnnnnncnnttnnnnncntananggaganaangcncnggngnnntnccnntnnancncncnnannnnnntncnaanannnggnaangnnnntttnnntnnnccnnnnngnncnnnangnnntngggcnnananncgcnnnncnnnncncnnncncntnccncntnnngngnnnnanncnntgtntnnantnnnngnnnngnnnntnnnncgcnnaaanncnnaacacnnnnnnncnaanntnccncnnacnngnanncncntnnnnncnnnnnngngnnaannnggngncnnttnnannggcgcncccnnngnttnnccanaanaancnnnangcnnngnnngnaannccnnngntnngnnnncccncnnannnnnngnaaangnnttnncncnanntntntnnanaaanncccnngnggnnngngnnnanncntntnnaaanncnnnnntnaacnncncntgngnatntntcnnntttnanncccnnnntngcnnagnncctnnncnnggggngnncnccnnttncncncnannttnnnntncgngggngnnccnntcncntangntntnnnncnntntnnccananaaanggnnnnncanatatanannnntnanntntnaagnnnttatntttntttncctnttattttttcatccatgcagggctggttggaaattgacctggctcgatagcttctctacaatcgccggtctcttaaaagggggccattccggcccgcaatggatcaccaggtaaacgcaccatgaaacgcactttccagcccagcaccatcaagcgcgctcgtactcacggtttccgtgcacgtatggccaccaagaacggtcgtcaggttctgtcgcgtcgtcgcgccaaaggccgtaagcgtctgaccgtctgatatcggaacaggtagtgagtcggggcttcggccgggaaaagcgtctgctgactccccgccaattcaaggcagtcttcgactccccttccggtaaggtgcctggcaggaacgtcctgctgttggcacgcgagaacgatctgcaacacccccgccttgggctggtgatcggcaagaaaagcgtcaagctctcggtcgaacgtaaccgcatcaagcggcagatacgtgagaccttccgccatcaccagtcggatctggtgggctgggacatcgtgatcatcgcccgnaagggattggctgatctggacaatcccgaactggcgaagcaattcgccaagctctggaagcgactgtcacgcagcccatccaagaccgccgtcgaacctggagccgccaacagcacccatgcgtaaattggccatcgcttcgatcagggtctaccagtacgccatcagtccgatgatggccagtcactgccgtttctatccaagctgctcctgctatgcactcgaggccatcgaaactcatggcctgttgcgtggcggctggctgagcctgcgcaggttggggcgctgccatccgtggaatcccggtggctacgatcccgtgccttctcataacacttccaattcatctccgatggccgagtaaccatggatatcaaacgctcgatactgctcgtcgctctagcagtcgttgcctacctgatggttcttcaatggaatcaggactacggtcaggcagccctgccgaccgaaaccgcgcaaagccagccgggcgtaccggctcttccggatagccccgcggccaacagcgaaggcaccgctggcgatgtgcccgcggttgccggccagcaacaggccagcgccctgccggctaangcgccnagcagccagctgattcgtgtgcgcagcgacgtgcttgacgtngcnatcgatccgcgcggtggcgacatcgtcgaactgcatctgccgcagtacccgcgtcgtcaggatcgtcccgatgtgccgttccaactgttcgagcgtagtggcgagcgagtctatgaagcacaaagcggcctgatcggcgacggcccggacaaggccagcgggcgtcctcagtacagcagtgagaaaagcgagtaccaactggccgaaggtcaggatcaggtggtcgtcgatctgaaatacaatgctgatggcgtcaactacatcaagcgtttcaccctcgagcgcggtaactatgcgctgaaggtgaactacctgatcgacaaccagagcggtcaaccctggaccggttacctgttcggtcagctcaagcgcgacaacagcggcgatccctcctcaagcaccgccactggcaccgctacctaccttggcgctgcgctgtggaccaaggacgagccgtatcgtaaggtctccatgggcgacatggatgaaagcaacctgcgtgaaagcgtgcagggtggctggatcgcctggctgcaacattatttcgtcaccgcctggattcctcagccgggcgataccaaccaggtgcagacgcgcaaggatagccagggcaactacatcatcggcttcaccggccccgccgttaccgtacctgccggcgcgcagggcgagacaggcgccacgctgtatgccggcccgaagagccaggacaagctggaagaactgtcccccggtctgcgtctgaccgtcgactacggcatcctctggttcatcgctcagccgatcttctggctgctggaaaacatccacgcnctgctgggcaactggggctggtcgatcatcgttctgaccatcgtcatcaagctcgccttcttcccgctctccgcggccagctaccggtcgatggcgcgcatgcgtgcggtgtcgccgaaaatgcaggcgctgaaggaacagcatggcgacgaccgccagaagatgtcccaggcgatgatggagctgtacaagaaggaaaagatcaatccgctgggcggctgcctgccgatcctggtgcagatgccggtattcctggccctgtactgggtcctgctggaaagcgtcgagatgcgccaggcgccctggatgttctggatcaccgacctttcgatcaaagacccgttcttcatcctgccnatcatcatgggcgtgaccatgttcatccagcagcagctgaacccgacgccgccggatccgatgcaggcgcgagtgatgaagctgctgccggtgatcttcaccttcttcttcctctggttccctgccggtctggtgctgtactgggtggtcaacaacgtcctgtccatcgcccagcagtggtacattacccgcaagatcgaggccgcggcgaagcccgcctgacgcctcaaccgccaatgcagaacgccccttgattggggcgttctgctatctgccgtccagaaaggaggccgcatgaatccagttcgcgacaccattgccgccgtcgctaccgcgccggggcgcggaggagtaggcatcgttcgggtatcagggccacggtccaaggctatcgccattaccctgaccggccgtgagccaacgccgcgccacgcacattacggtgcatttcacgcagacgacggcgaggtgatcgacgaaggcctgctactgttctttccgggaccgcattcgttcaccggtgaggacgtactcgaactgcaggggcatggcggcccggttgtcatggatatgctgctgcancgctgcgtcgagctcggcgttcgtctggctcggccaggcgaattcagtgaacgcgcattccttaacgacaagctcgatctggcccaggccgaggcgatcgccgaccttatcgaagcgagttcggcgcaggccgcgcgcaatgcggtgcgttcgctacagggcgaattctctcgccgcgtgcatcagttgaccgaaagattgattcagctgcgtatctatgtcgaagcggcgatcgattttcccgaagaagagatcga

SEQ ID NO: 1079 - DNA, 4000 bp, Escherichia coli
  misc_feature (597)..(597): n is a, c, g, or t
  misc_feature (600)..(600): n is a, c, g, or t
  misc_feature (1567)..(1567): n is a, c, g, or t
  misc_feature (1607)..(1607): n is a, c, g, or t
  misc_feature (3092)..(3092): n is a, c, g, or t
  misc_feature (3105)..(3105): n is a, c, g, or t
  misc_feature (3349)..(3349): n is a, c, g, or t
tttgcaggtggatgaggtggatatgctgacagtggtgctgattggctcgtcaaattcgcggctggcgcagttgggcgaagggcctcgtatgtttaccccgcgcggctatgcgcgcaagattgatggggatttggcccccatgaaagaaggaaacggcagatgacagtgtttttcatcggagcggggcccggggatcctgaacttttgaccctgaaagctgcgcggatcattggtgcatgtcccgtatgcctttatgccgggtctttggtgcccgaggaggttgtggcctgcgcgcccaaagatgcgcgcgttctggatacggcgcccatgacattagatgagacccatgcggaaattctggccgcccatgccaaagggcaggatgtggcgcgggtgcattctggggatccgtcgctctatggcgcgattgcggagcaaattcgccgcctgcgcgccgatggcattgactatgaaattattcccggcgtgcccgcctataccgccgttgcggccgccctggggcaagagttgacgattcctgagattgcccagtcgattgttttgacgcgcatgtcgatgaagtcgacctccatgccngcnggggagacccttgagaattttgccatctctggcgcaacgctcgccattcacctcgcgattcgcaatatgcgtgagattgaacgggttttaatcccgcattacggggccgattgcccggtcgtggtcgcttaccgggccagttggcccgatcagatcatcatccgcggcactctgagcgatattcgcaagaaagtgcgggatgcgaaaatcacccgaacggccttgatcttggtggggcctgcgctgaaggaacagcaagattttgtggattctgcgctctatcatccagatatggaacatgtgctgcgcaatcgcaaaactccggcggcttgagcgccttcaaaaaacgcttcacattttagtgactgccttgaccgtcgcggttttcccgcgcaggctattggttaaggagatgttaaaatgacaacatttttgccgaaagaagtggcggagggtttggaagcggctcgcaagcaggcgctgcggaagaagagccgattgcgggtgcaggccggcacggagatttttacggttctgaaatattgggacagcggattttcagtggatctgcaagatgcgccgcagttgcgcggtctcgtggacctctacgacggcagccgccatctgtatcaatgtttgatcgtcgcctctgaggaagagggcggggagatgcgctatgagttcaagcgcaacacccgtgccgttgacagcgcgccgctggactttgagcgggatgccaataagcctgtggccttgattggccgcagttaaccgggccggcggctactggagatccgaaaaagcctcctgcatggctgcaaccgcccgctcgacattggcgcgctgcgtgccgatgttaaagcgcaggaagctttcgccacctgtgccgaaggttggcccgtggttgacggcgattttggcccgtttttgcacccggtcaatggcctcctgtaaagacatgcccgtnccagagacatccacccaagccagataggtggcctcaagangcatggatgttaagccgggaatggcattgatcccagcgtcgaaaatcttgcggtttccatcgagatagaccagcaattcatccacccattgcgccccttctggcgaataggccgcggtaatcatatgcaggccaaaggaatttggggacagtccgagcgcctgcatccgtttggcaaaacgcgcgcgcaaatttggatcttcaatgatcacattgcccgaatgcccccctgcaatattgaaggtcttgctggccgcagtcatcataatcaagcgatctgaaattccgtcaatcagtgccatggctgtgtgtttcgcgccgaaggtcagatcgtggtgaatctcatcactgaccaaaagcagatcatgtttgatgcaaaattctgccacctgttgaagttccgcgcggctccatacccgcccgccaggattatgcggcgagcaaaggatgaccattttcgcatggggcggcagggcggcgtcatagctgtcgaaatccatctcatagcggccattgttttgcaccagtggcaattcgatcacctcgcggtcattggcgcggatcactttggcgaaggaatgatagaccggggtgaatagaaccacgccgtcgcctggctctgtgaatgtatccacacaaagcgccgtgccattcaccagcccatgggtggtgaaaataccgccgcggggcacctcccagccgtgacggtgtttcatccaccaggcaatcgcgtcgagatatttgctgtcatcgccaaaatagccgtatatcccatgctctgtaagcctggccagactgtctgccaccgcttgtggcggacgaaaatccatatccgccacccacattgccaaaccatcgtcgggcgacacgccatagagcggctccatcatatcccatttggaggagtgggtgttgcggcggtcaatctgggtgtcaaaggtcatggaaaatcctaatattttcgcgtaagattactgtgaaaaggccaaagatcaagcgctgggaagggcccggcacgcaaattgcggcaagaatctttgatgcggcaattgcgctgcgggtcggcattgaatatcacaccgctatgacaatacgccccataataatccatcccgatccgcgcttgaaaaagacggcggcgcccgtggctgaggtgacccccgcgattgagcgtttggctgaggatatgcttgaaaccatgtatgatgcaccgggcatcggactggctgcgccgcaaatcggcgtgatgagccgcgtgttcgttatggattgcgtgaaagaggaaggggccgcaccggcgccgatggttcttatgaatccggtcatcacctgggtctctgaggcgttgagcacctatgaagagggctgcctgtccattccagagcaatatggcgaggtggaacggcctgcagagattgatatgcaatggctgggcctggacgggaaaacccatacacaaagattcgatgggctttgggccacttgngcgcagcatgagntggatcacctaaacggcaagctgttcattgattacctcaaaccgatgcgccgccaacttatcacccgcaagatgcagaaactcaaacgtgagcaggcccggtcatgagccgaagcattgtgccttggccgcacccttgtttgcgacgacttgcggacccgattgagaaaatcaccccggaaattgaagagatttggcgcgatatgattgcggtgatggaagcgatgcctggcgttggtttggcngcgccgcaattgggcattgggttgcgcttggcggtggtggatgcctcttcggcgcgcggtgaggttctgcgcatggccaatcccgaggtactgcacgtatctgccaagcttgagatgggcgaagaggccagccctaatctgccctatgtctccgcgcagatcaaacgcccgcgcggcgtgacggtgcgctatatggacgaagctggcgcttggcaggaaaaagatctggttggcctctgggcccgctcgatgctccatcaggtcgatcacctcaatgggcggatgtattttgacaatctctccaagctcaagcgcgacatgctgatcaaaaaggctcgaaaactatgcgcgtagttttcatgggcacgcccgatttttcggtcgccgctttgcgggccttggccgaggctggccatgagatcgcagccgtctacagccaaccgccgcgtaaatccggccgggggcaaaaacgtcgtccgtcgccggtgcaagcctatgccgagtgccaaggatggacggtctttacacccaaaaacttccatgatccggctgagctggccaattttgcggctcttgaggcggatatcgccgtggtggtggcttacgggttgatcttgccacaagcgcttttggatgccccgcgctttggat

SEQ ID NO: 1080 - DNA, 4000 bp, Escherichia coli
  misc_feature (1)..(3): n is a, c, g, or t
  misc_feature (6)..(13): n is a, c, g, or t
  misc_feature (15)..(18): n is a, c, g, or t
  misc_feature (20)..(20): n is a, c, g, or t
  misc_feature (22)..(36): n is a, c, g, or t
  misc_feature (38)..(38): n is a, c, g, or t
  misc_feature (40)..(44): n is a, c, g, or t
  misc_feature (46)..(47): n is a, c, g, or t
  misc_feature (49)..(49): n is a, c, g, or t
  misc_feature (51)..(53): n is a, c, g, or t
  misc_feature (55)..(63): n is a, c, g, or t
  misc_feature (65)..(102): n is a, c, g, or t
  misc_feature (104)..(113): n is a, c, g, or t
  misc_feature (115)..(116): n is a, c, g, or t
  misc_feature (119)..(128): n is a, c, g, or t
  misc_feature (130)..(130): n is a, c, g, or t
  misc_feature (132)..(132): n is a, c, g, or t
  misc_feature (134)..(135): n is a, c, g, or t
  misc_feature (137)..(152): n is a, c, g, or t
  misc_feature (154)..(164): n is a, c, g, or t
  misc_feature (166)..(166): n is a, c, g, or t
  misc_feature (168)..(174): n is a, c, g, or t
  misc_feature (176)..(176): n is a, c, g, or t
  misc_feature (178)..(178): n is a, c, g, or t
  misc_feature (180)..(182): n is a, c, g, or t
  misc_feature (184)..(185): n is a, c, g, or t
  misc_feature (187)..(194): n is a, c, g, or t
  misc_feature (196)..(210): n is a, c, g, or t
  misc_feature (212)..(215): n is a, c, g, or t
  misc_feature (217)..(221): n is a, c, g, or t
  misc_feature (223)..(242): n is a, c, g, or t
  misc_feature (246)..(250): n is a, c, g, or t
  misc_feature (253)..(266): n is a, c, g, or t
  misc_feature (269)..(272): n is a, c, g, or t
  misc_feature (275)..(280): n is a, c, g, or t
  misc_feature (283)..(295): n is a, c, g, or t
  misc_feature (298)..(298): n is a, c, g, or t
  misc_feature (300)..(303): n is a, c, g, or t
  misc_feature (305)..(310): n is a, c, g, or t
  misc_feature (312)..(312): n is a, c, g, or t
  misc_feature (314)..(326): n is a, c, g, or t
  misc_feature (329)..(338): n is a, c, g, or t
  misc_feature (340)..(340): n is a, c, g, or t
  misc_feature (343)..(347): n is a, c, g, or t
  misc_feature (349)..(364): n is a, c, g, or t
  misc_feature (366)..(369): n is a, c, g, or t
  misc_feature (371)..(371): n is a, c, g, or t
  misc_feature (374)..(383): n is a, c, g, or t
  misc_feature (385)..(386): n is a, c, g, or t
  misc_feature (389)..(389): n is a, c, g, or t
  misc_feature (391)..(397): n is a, c, g, or t
  misc_feature (399)..(402): n is a, c, g, or t
  misc_feature (404)..(408): n is a, c, g, or t
  misc_feature (410)..(413): n is a, c, g, or t
  misc_feature (415)..(415): n is a, c, g, or t
  misc_feature (417)..(421): n is a, c, g, or t
  misc_feature (423)..(425): n is a, c, g, or t
  misc_feature (427)..(430): n is a, c, g, or t
  misc_feature (433)..(436): n is a, c, g, or t
  misc_feature (438)..(438): n is a, c, g, or t
  misc_feature (440)..(440): n is a, c, g, or t
  misc_feature (442)..(449): n is a, c, g, or t
  misc_feature (451)..(453): n is a, c, g, or t
  misc_feature (455)..(457): n is a, c, g, or t
  misc_feature (460)..(464): n is a, c, g, or t
  misc_feature (467)..(472): n is a, c, g, or t
  misc_feature (474)..(482): n is a, c, g, or t
  misc_feature (484)..(488): n is a, c, g, or t
  misc_feature (490)..(492): n is a, c, g, or t
  misc_feature (494)..(496): n is a, c, g, or t
  misc_feature (498)..(498): n is a, c, g, or t
  misc_feature (500)..(517): n is a, c, g, or t
  misc_feature (519)..(521): n is a, c, g, or t
  misc_feature (523)..(523): n is a, c, g, or t
  misc_feature (526)..(533): n is a, c, g, or t
  misc_feature (535)..(537): n is a, c, g, or t
  misc_feature (539)..(540): n is a, c, g, or t
  misc_feature (542)..(542): n is a, c, g, or t
  misc_feature (544)..(546): n is a, c, g, or t
  misc_feature (549)..(549): n is a, c, g, or t
  misc_feature (551)..(551): n is a, c, g, or t
  misc_feature (553)..(553): n is a, c, g, or t
  misc_feature (555)..(561): n is a, c, g, or t
  misc_feature (563)..(567): n is a, c, g, or t
  misc_feature (569)..(574): n is a, c, g, or t
  misc_feature (576)..(580): n is a, c, g, or t
  misc_feature (582)..(587): n is a, c, g, or t
  misc_feature (589)..(589): n is a, c, g, or t
  misc_feature (591)..(595): n is a, c, g, or t
  misc_feature (597)..(628): n is a, c, g, or t
  misc_feature (630)..(635): n is a, c, g, or t
  misc_feature (637)..(655): n is a, c, g, or t
  misc_feature (657)..(702): n is a, c, g, or t
  misc_feature (705)..(706): n is a, c, g, or t
  misc_feature (709)..(714): n is a, c, g, or t
  misc_feature (716)..(730): n is a, c, g, or t
  misc_feature (732)..(732): n is a, c, g, or t
  misc_feature (734)..(736): n is a, c, g, or t
  misc_feature (738)..(743): n is a, c, g, or t
  misc_feature (746)..(790): n is a, c, g, or t
  misc_feature (792)..(824): n is a, c, g, or t
  misc_feature (826)..(829): n is a, c, g, or t
  misc_feature (831)..(833): n is a, c, g, or t
  misc_feature (835)..(837): n is a, c, g, or t
  misc_feature (839)..(843): n is a, c, g, or t
  misc_feature (846)..(866): n is a, c, g, or t
  misc_feature (868)..(870): n is a, c, g, or t
  misc_feature (872)..(906): n is a, c, g, or t
  misc_feature (908)..(908): n is a, c, g, or t
  misc_feature (910)..(925): n is a, c, g, or t
  misc_feature (927)..(936): n is a, c, g, or t
  misc_feature (938)..(938): n is a, c, g, or t
  misc_feature (940)..(941): n is a, c, g, or t
  misc_feature (943)..(955): n is a, c, g, or t
  misc_feature (957)..(957): n is a, c, g, or t
  misc_feature (959)..(971): n is a, c, g, or t
  misc_feature (973)..(974): n is a, c, g, or t
  misc_feature (976)..(980): n is a, c, g, or t
  misc_feature (982)..(982): n is a, c, g, or t
  misc_feature (984)..(992): n is a, c, g, or t
  misc_feature (994)..(998): n is a, c, g, or t
  misc_feature (1000)..(1013): n is a, c, g, or t
  misc_feature (1015)..(1016): n is a, c, g, or t
  misc_feature (1018)..(1018): n is a, c, g, or t
  misc_feature (1020)..(1024): n is a, c, g, or t
  misc_feature (1026)..(1027): n is a, c, g, or t
  misc_feature (1029)..(1031): n is a, c, g, or t
  misc_feature (1033)..(1033): n is a, c, g, or t
  misc_feature (1035)..(1039): n is a, c, g, or t
  misc_feature (1042)..(1046): n is a, c, g, or t
  misc_feature (1048)..(1062): n is a, c, g, or t
  misc_feature (1064)..(1066): n is a, c, g, or t
  misc_feature (1068)..(1088): n is a, c, g, or t
  misc_feature (1090)..(1098): n is a, c, g, or t
  misc_feature (1100)..(1111): n is a, c, g, or t
  misc_feature (1113)..(1121): n is a, c, g, or t
  misc_feature (1123)..(1125): n is a, c, g, or t
  misc_feature (1127)..(1127): n is a, c, g, or t
  misc_feature (1129)..(1129): n is a, c, g, or t
  misc_feature (1131)..(1146): n is a, c, g, or t
  misc_feature (1148)..(1156): n is a, c, g, or t
  misc_feature (1158)..(1166): n is a, c, g, or t
  misc_feature (1168)..(1172): n is a, c, g, or t
  misc_feature (1174)..(1175): n is a, c, g, or t
  misc_feature (1177)..(1188): n is a, c, g, or t
  misc_feature (1190)..(1221): n is a, c, g, or t
  misc_feature (1223)..(1238): n is a, c, g, or t
  misc_feature (1241)..(1269): n is a, c, g, or t
  misc_feature (1271)..(1279): n is a, c, g, or t
  misc_feature (1281)..(1286): n is a, c, g, or t
  misc_feature (1288)..(1301): n is a, c, g, or t
  misc_feature (1303)..(1318): n is a, c, g, or t
  misc_feature (1320)..(1354): n is a, c, g, or t
  misc_feature (1356)..(1358): n is a, c, g, or t
  misc_feature (1360)..(1388): n is a, c, g, or t
  misc_feature (1390)..(1400): n is a, c, g, or t
  misc_feature (1402)..(1404): n is a, c, g, or t
  misc_feature (1406)..(1413): n is a, c, g, or t
  misc_feature (1415)..(1431): n is a, c, g, or t
  misc_feature (1433)..(1440): n is a, c, g, or t
  misc_feature (1442)..(1445): n is a, c, g, or t
  misc_feature (1447)..(1448): n is a, c, g, or t
  misc_feature (1450)..(1474): n is a, c, g, or t
  misc_feature (1476)..(1504): n is a, c, g, or t
  misc_feature (1506)..(1507): n is a, c, g, or t
  misc_feature (1509)..(1511): n is a, c, g, or t
  misc_feature (1513)..(1533): n is a, c, g, or t
  misc_feature (1535)..(1538): n is a, c, g, or t
  misc_feature (1540)..(1541): n is a, c, g, or t
  misc_feature (1544)..(1546): n is a, c, g, or t
  misc_feature (1548)..(1560): n is a, c, g, or t
  misc_feature (1562)..(1567): n is a, c, g, or t
  misc_feature (1570)..(1572): n is a, c, g, or t
  misc_feature (1574)..(1576): n is a, c, g, or t
  misc_feature (1578)..(1579): n is a, c, g, or t
  misc_feature (1581)..(1583): n is a, c, g, or t
  misc_feature (1585)..(1585): n is a, c, g, or t
  misc_feature (1587)..(1592): n is a, c, g, or t
  misc_feature (1594)..(1608): n is a, c, g, or t
  misc_feature (1611)..(1624): n is a, c, g, or t
  misc_feature (1626)..(1626): n is a, c, g, or t
  misc_feature (1629)..(1633): n is a, c, g, or t
  misc_feature (1635)..(1635): n is a, c, g, or t
  misc_feature (1637)..(1638): n is a, c, g, or t
  misc_feature (1640)..(1640): n is a, c, g, or t
  misc_feature (1644)..(1644): n is a, c, g, or t
  misc_feature (1646)..(1649): n is a, c, g, or t
  misc_feature (1651)..(1652): n is a, c, g, or t
  misc_feature (1654)..(1656): n is a, c, g, or t
  misc_feature (1658)..(1662): n is a, c, g, or t
  misc_feature (1664)..(1685): n is a, c, g, or t
  misc_feature (1687)..(1691): n is a, c, g, or t
  misc_feature (1694)..(1699): n is a, c, g, or t
  misc_feature (1701)..(1704): n is a, c, g, or t
  misc_feature (1706)..(1706): n is a, c, g, or t
  misc_feature (1708)..(1708): n is a, c, g, or t
  misc_feature (1710)..(1710): n is a, c, g, or t
  misc_feature (1712)..(1713): n is a, c, g, or t
  misc_feature (1717)..(1718): n is a, c, g, or t
  misc_feature (1720)..(1754): n is a, c, g, or t
  misc_feature (1756)..(1757): n is a, c, g, or t
  misc_feature (1761)..(1761): n is a, c, g, or t
  misc_feature (1763)..(1764): n is a, c, g, or t
  misc_feature (1766)..(1767): n is a, c, g, or t
  misc_feature (1775)..(1775): n is a, c, g, or t
  misc_feature (1777)..(1777): n is a, c, g, or t
  misc_feature (1779)..(1779): n is a, c, g, or t
  misc_feature (1783)..(1783): n is a, c, g, or t
  misc_feature (1787)..(1794): n is a, c, g, or t
  misc_feature (1796)..(1802): n is a, c, g, or t
  misc_feature (1804)..(1804): n is a, c, g, or t
  misc_feature (1807)..(1811): n is a, c, g, or t
  misc_feature (1813)..(1823): n is a, c, g, or t
  misc_feature (1827)..(1827): n is a, c, g, or t
  misc_feature (1830)..(1830): n is a, c, g, or t
  misc_feature (1833)..(1833): n is a, c, g, or t
  misc_feature (1841)..(1841): n is a, c, g, or t
  misc_feature (1843)..(1843): n is a, c, g, or t
  misc_feature (1845)..(1845): n is a, c, g, or t
  misc_feature (1849)..(1849): n is a, c, g, or t
  misc_feature (1853)..(1854): n is a, c, g, or t
  misc_feature (1856)..(1863): n is a, c, g, or t
  misc_feature (1865)..(1865): n is a, c, g, or t
  misc_feature (1867)..(1870): n is a, c, g, or t
  misc_feature (1872)..(1873): n is a, c, g, or t
  misc_feature (1875)..(1888): n is a, c, g, or t
  misc_feature (1921)..(1921): n is a, c, g, or t
  misc_feature (1923)..(1934): n is a, c, g, or t
  misc_feature (1936)..(1954): n is a, c, g, or t
  misc_feature (1958)..(1958): n is a, c, g, or t
  misc_feature (1961)..(1961): n is a, c, g, or t
  misc_feature (1964)..(1968): n is a, c, g, or t
  misc_feature (1972)..(1976): n is a, c, g, or t
  misc_feature (1980)..(1984): n is a, c, g, or t
  misc_feature (1986)..(1996): n is a, c, g, or t
  misc_feature (1998)..(2014): n is a, c, g, or t
  misc_feature (2016)..(2019): n is a, c, g, or t
  misc_feature (2132)..(2132): n is a, c, g, or t
  misc_feature (3542)..(3542): n is a, c, g, or t
  misc_feature (3809)..(3809): n is a, c, g, or t
nnncannnnnnnnannnncntnnnnnnnnnnnnnnncntnnnnnanncnannnannnnnnnnnannnnnnnnnnnnnnnnnnnnnnnnnnnnnnnnnnnnnntnnnnnnnnnntnnacnnnnnnnnnnangntnncnnnnnnnnnnnnnnnntnnnnnnnnnnntnannnnnnntnanannnannannnnnnnnannnnnnnnnnnnnnncnnnnannnnntnnnnnnnnnnnnnnnnnnnnaaannnnnaannnnnnnnnnnnnnaannnntannnnnnatnnnnnnnnnnnnnctnannnnannnnnnancnnnnnnnnnnnnnagnnnnnnnnnnanttnnnnnannnnnnnnnnnnnnnntnnnngnttnnnnnnnnnnanncangnnnnnnntnnnngnnnnnannnntnannnnntnnntnnnnatnnnntntnannnnnnnnannncnnnagnnnnnaannnnnnannnnnnnnntnnnnnannntnnntnannnnnnnnnnnnnnnnnnannnanagnnnnnnnntnnntnntntnnnttnananannnnnnnannnnntnnnnnncnnnnnannnnnncnannnnntnnnnnnnnnnnnnnnnnnnnnnnnnnnnnnnnannnnnnannnnnnnnnnnnnnnnnnngnnnnnnnnnnnnnnnnnnnnnnnnnnnnnnnnnnnnnnnnnnnnnnttnncannnnnnannnnnnnnnnnnnnnancnnnannnnnnttnnnnnnnnnnnnnnnnnnnnnnnnnnnnnnnnnnnnnnnnnnnnnannnnnnnnnnnnnnnnnnnnnnnnnnnnnnnnnannnnannntnnncnnnnncannnnnnnnnnnnnnnnnnnnntnnntnnnnnnnnnnnnnnnnnnnnnnnnnnnnnnnnnnncnannnnnnnnnnnnnnnnannnnnnnnnntntnnannnnnnnnnnnnntntnnnnnnnnnnnnnannannnnnanannnnnnnnnannnnnannnnnnnnnnnnnnannantnnnnnanntnnnanannnnnaannnnnannnnnnnnnnnnnnntnnnannnnnnnnnnnnnnnnnnnnntnnnnnnnnntnnnnnnnnnnnnannnnnnnnnannntntnannnnnnnnnnnnnnnnannnnnnnnngnnnnnnnnntnnnnncnncnnnnnnnnnnnngnnnnnnnnnnnnnnnnnnnnnnnnnnnnnnnnannnnnnnnnnnnnnnnccnnnnnnnnnnnnnnnnnnnnnnnnnnnnntnnnnnnnnntnnnnnntnnnnnnnnnnnnnnannnnnnnnnnnnnnnngnnnnnnnnnnnnnnnnnnnnnnnnnnnnnnnnnnnannntnnnnnnnnnnnnnnnnnnnnnnnnnnnnngnnnnnnnnnnntnnngnnnnnnnnannnnnnnnnnnnnnnnnannnnnnnnannnncnnannnnnnnnnnnnnnnnnnnnnnnnntnnnnnnnnnnnnnnnnnnnnnnnnnnnnnanncnnncnnnnnnnnnnnnnnnnnnnnntnnnntnnatnnncnnnnnnnnnnnnntnnnnnncannncnnncnncnnngngnnnnnngnnnnnnnnnnnnnnnttnnnnnnnnnnnnnntnttnnnnncnanncncccncnnnngnngnnncnnnnnannnnnnnnnnnnnnnnnnnnnngnnnnnttnnnnnncnnnncncncncnngggnngnnnnnnnnnnnnnnnnnnnnnnnnnnnnnnnnnnnanntttnanncnncacacccncncngggngtgnnnnnnnnannnnnnnantannnnnannnnnnnnnnntttnaanccncacacccncncngggngtgnnannnnnnnntntnnnntnntnnnnnnnnnnnnnngtttcaatccacacacccacgcagggtgtgacnannnnnnnnnnnnannnnnnnnnnnnnnnnnnntttnaanccnnnnncccnnnnngggnnnnncnnnnnnnnnnntnnnnnnnnnnnnnnnnntnnnngtttcaatccacacacccacgcagggtgtgactctatatctaataacatattataaatcagcaaatttaatccactgttatgcgaatcatcattattattcaacttcataacnaagaaatactttacaaataatttaatctactgattattaacacatgcgaagatactactttttttgtaacacaccacattcgcattatattataagagcctcctcaagtttatacgccgtttcaacacctattacttccaccctcttattctcatttttactaagaatataaaaacgaacactatcaagagacatatcaataatatccctaactctcccttttagaagagaatattgcgcttccgtcactacacactcaaagactgagttctgcaccctctgtccataatccagacaagccttggccacacatcgtaaacggcgagccccctctttgcttgtagtatccacatcgtaagtcacaagaatgtacataattaaaaatcattttataagaaataccggataatcgtcaatatcctgcctgatataccttgccattaacatagcctgcacataaggcagaagccctatttcaactttttcattaagataaggatgaattatcacttcccttttccttgcctgccatgcagtaataaaagtctttttccctttatctgtcataacaaccccattatcaccttggaacaagaagtcttttactgaaatctgtcttttattaatcaacgacaaaataaaacggtcgccaaggtaagcacgtaactcttccatcatatctaaggccaacgatgtgcgccccggacggagtgtatggagaaacccgacgtatggatcaaggccaacagtttcgagagcggccgcaacatcattggctatcaacgtatatgcaaaagacaacatggcattcaccgcatccttgggaggacgacgattgcgaccatgaaatgggaaatcagtcttctgattaagtatcaagattggcaatacctcaaaataggcattcgaagccatcccctcataaccaattaattccgtcttatcttgagccttcaaagcatcacgcttggcacgttccaatacttgcaccgccctattaatgtcttcattctcaccataatcacgaatatatctcctcaatatattgcgatagttttgaatcttaccaccaatcatcaacctaaccacatgcaacgaccaagatgcatcgtccgacaattggtactgctttttgcgtaacagaacattccctttcgtagcaccttgaaccctgctgataaatctgccttgtggagaaagaaatgtgagtgatataccattgtcactacacaatttcatcacaccgggacttgcgcccatatatccgaacgtaacgatgccctctatatttatgacaggaatacgaaacacctcctcctgctgaacagatataacgacattcagcccatccttactaagatacgcttccggtgtcgtcacatacaaagtattcaatagttttctcatagntacagatttttagtaaggtaattatctaccgaagtacaattatttaccatttccggcatgcagatatctttcagcgagcacttgtcacaatgtttcccatattcagccttcgggataaccgctttactaaatatatcgtgcatatcccgggcacattgtctgactatatttcgcagctcctccgttatatccacattaacccgatggcgaagctccccataaaagaaagagccgtatggtatatggatagcatacatttcttctatncacatgatttgtgctgccaactgcacttcatccacctcgtttcttttcggtttgccatgcttatactccacagcaaccggttgccatcgccccggatagttgggatgcaaaatcgtattttcaaaagatgaggaaggaagtaactctatggcatcagagattccatagagtccaagttcacgcgaagcgat

SEQ ID NO: 1081 - DNA, 4000 bp, Escherichia coli
  misc_feature (3)..(3): n is a, c, g, or t
  misc_feature (8)..(12): n is a, c, g, or t
  misc_feature (15)..(15): n is a, c, g, or t
  misc_feature (17)..(19): n is a, c, g, or t
  misc_feature (21)..(22): n is a, c, g, or t
  misc_feature (24)..(26): n is a, c, g, or t
  misc_feature (28)..(30): n is a, c, g, or t
  misc_feature (32)..(34): n is a, c, g, or t
  misc_feature (36)..(43): n is a, c, g, or t
  misc_feature (45)..(45): n is a, c, g, or t
  misc_feature (48)..(56): n is a, c, g, or t
  misc_feature (58)..(60): n is a, c, g, or t
  misc_feature (63)..(64): n is a, c, g, or t
  misc_feature (66)..(67): n is a, c, g, or t
  misc_feature (71)..(71): n is a, c, g, or t
  misc_feature (73)..(73): n is a, c, g, or t
  misc_feature (75)..(76): n is a, c, g, or t
  misc_feature (78)..(82): n is a, c, g, or t
  misc_feature (84)..(84): n is a, c, g, or t
  misc_feature (90)..(97): n is a, c, g, or t
  misc_feature (99)..(103): n is a, c, g, or t
  misc_feature (107)..(111): n is a, c, g, or t
  misc_feature (113)..(119): n is a, c, g, or t
  misc_feature (121)..(121): n is a, c, g, or t
  misc_feature (123)..(129): n is a, c, g, or t
  misc_feature (131)..(132): n is a, c, g, or t
  misc_feature (134)..(136): n is a, c, g, or t
  misc_feature (138)..(145): n is a, c, g, or t
  misc_feature (147)..(150): n is a, c, g, or t
  misc_feature (152)..(163): n is a, c, g, or t
  misc_feature (165)..(165): n is a, c, g, or t
  misc_feature (167)..(169): n is a, c, g, or t
  misc_feature (171)..(171): n is a, c, g, or t
  misc_feature (173)..(178): n is a, c, g, or t
  misc_feature (181)..(183): n is a, c, g, or t
  misc_feature (187)..(191): n is a, c, g, or t
  misc_feature (194)..(200): n is a, c, g, or t
  misc_feature (203)..(216): n is a, c, g, or t
  misc_feature (218)..(220): n is a, c, g, or t
  misc_feature (222)..(228): n is a, c, g, or t
  misc_feature (230)..(230): n is a, c, g, or t
  misc_feature (233)..(236): n is a, c, g, or t
  misc_feature (238)..(239): n is a, c, g, or t
  misc_feature (241)..(245): n is a, c, g, or t
  misc_feature (247)..(253): n is a, c, g, or t
  misc_feature (255)..(255): n is a, c, g, or t
  misc_feature (257)..(257): n is a, c, g, or t
  misc_feature (259)..(260): n is a, c, g, or t
  misc_feature (263)..(264): n is a, c, g, or t
  misc_feature (266)..(267): n is a, c, g, or t
  misc_feature (270)..(270): n is a, c, g, or t
  misc_feature (272)..(275): n is a, c, g, or t
  misc_feature (278)..(285): n is a, c, g, or t
  misc_feature (287)..(288): n is a, c, g, or t
  misc_feature (290)..(295): n is a, c, g, or t
  misc_feature (298)..(299): n is a, c, g, or t
  misc_feature (301)..(301): n is a, c, g, or t
  misc_feature (303)..(305): n is a, c, g, or t
  misc_feature (307)..(308): n is a, c, g, or t
  misc_feature (310)..(310): n is a, c, g, or t
  misc_feature (312)..(314): n is a, c, g, or t
  misc_feature (316)..(318): n is a, c, g, or t
  misc_feature (321)..(322): n is a, c, g, or t
  misc_feature (324)..(324): n is a, c, g, or t
  misc_feature (326)..(327): n is a, c, g, or t
  misc_feature (331)..(333): n is a, c, g, or t
  misc_feature (335)..(335): n is a, c, g, or t
  misc_feature (337)..(337): n is a, c, g, or t
  misc_feature (339)..(339): n is a, c, g, or t
  misc_feature (341)..(348): n is a, c, g, or t
  misc_feature (350)..(358): n is a, c, g, or t
  misc_feature (360)..(364): n is a, c, g, or t
  misc_feature (367)..(371): n is a, c, g, or t
  misc_feature (373)..(374): n is a, c, g, or t
  misc_feature (376)..(382): n is a, c, g, or t
  misc_feature (384)..(384): n is a, c, g, or t
  misc_feature (386)..(395): n is a, c, g, or t
  misc_feature (397)..(404): n is a, c, g, or t
  misc_feature (406)..(407): n is a, c, g, or t
  misc_feature (409)..(410): n is a, c, g, or t
  misc_feature (412)..(413): n is a, c, g, or t
  misc_feature (415)..(415): n is a, c, g, or t
  misc_feature (418)..(422): n is a, c, g, or t
  misc_feature (425)..(426): n is a, c, g, or t
  misc_feature (436)..(437): n is a, c, g, or t
  misc_feature (439)..(446): n is a, c, g, or t
  misc_feature (449)..(454): n is a, c, g, or t
  misc_feature (457)..(459): n is a, c, g, or t
  misc_feature (462)..(463): n is a, c, g, or t
  misc_feature (465)..(466): n is a, c, g, or t
  misc_feature (468)..(468): n is a, c, g, or t
  misc_feature (470)..(470): n is a, c, g, or t
  misc_feature (472)..(479): n is a, c, g, or t
  misc_feature (481)..(482): n is a, c, g, or t
  misc_feature (484)..(484): n is a, c, g, or t
  misc_feature (486)..(487): n is a, c, g, or t
  misc_feature (489)..(491): n is a, c, g, or t
  misc_feature (493)..(495): n is a, c, g, or t
  misc_feature (497)..(497): n is a, c, g, or t
  misc_feature (499)..(499): n is a, c, g, or t
  misc_feature (501)..(504): n is a, c, g, or t
  misc_feature (507)..(509): n is a, c, g, or t
  misc_feature (511)..(511): n is a, c, g, or t
  misc_feature (513)..(513): n is a, c, g, or t
  misc_feature (516)..(519): n is a, c, g, or t
  misc_feature (521)..(522): n is a, c, g, or t
  misc_feature (524)..(529): n is a, c, g, or t
  misc_feature (531)..(535): n is a, c, g, or t
  misc_feature (538)..(542): n is a, c, g, or t
  misc_feature (544)..(545): n is a, c, g, or t
  misc_feature (547)..(552): n is a, c, g, or t
  misc_feature (556)..(556): n is a, c, g, or t
  misc_feature (559)..(560): n is a, c, g, or t
  misc_feature (562)..(562): n is a, c, g, or t
  misc_feature (565)..(575): n is a, c, g, or t
  misc_feature (577)..(578): n is a, c, g, or t
  misc_feature (580)..(582): n is a, c, g, or t
  misc_feature (585)..(586): n is a, c, g, or t
  misc_feature (590)..(592): n is a, c, g, or t
  misc_feature (594)..(594): n is a, c, g, or t
  misc_feature (596)..(609): n is a, c, g, or t
  misc_feature (614)..(614): n is a, c, g, or t
  misc_feature (617)..(617): n is a, c, g, or t
  misc_feature (619)..(619): n is a, c, g, or t
  misc_feature (621)..(632): n is a, c, g, or t
  misc_feature (634)..(644): n is a, c, g, or t
  misc_feature (646)..(647): n is a, c, g, or t
  misc_feature (649)..(650): n is a, c, g, or t
  misc_feature (653)..(660): n is a, c, g, or t
  misc_feature (662)..(662): n is a, c, g, or t
  misc_feature (664)..(665): n is a, c, g, or t
  misc_feature (667)..(667): n is a, c, g, or t
  misc_feature (670)..(671): n is a, c, g, or t
  misc_feature (674)..(678): n is a, c, g, or t
  misc_feature (680)..(682): n is a, c, g, or t
  misc_feature (684)..(685): n is a, c, g, or t
  misc_feature (687)..(687): n is a, c, g, or t
  misc_feature (689)..(689): n is a, c, g, or t
  misc_feature (691)..(691): n is a, c, g, or t
  misc_feature (694)..(702): n is a, c, g, or t
  misc_feature (704)..(707): n is a, c, g, or t
  misc_feature (711)..(711): n is a, c, g, or t
  misc_feature (714)..(717): n is a, c, g, or t
  misc_feature (720)..(724): n is a, c, g, or t
  misc_feature (726)..(727): n is a, c, g, or t
  misc_feature (730)..(730): n is a, c, g, or t
  misc_feature (732)..(732): n is a, c, g, or t
  misc_feature (735)..(746): n is a, c, g, or t
  misc_feature (748)..(749): n is a, c, g, or t
  misc_feature (751)..(751): n is a, c, g, or t
  misc_feature (753)..(753): n is a, c, g, or t
  misc_feature (755)..(756): n is a, c, g, or t
  misc_feature (759)..(763): n is a, c, g, or t
  misc_feature (766)..(766): n is a, c, g, or t
  misc_feature (768)..(769): n is a, c, g, or t
  misc_feature (772)..(775): n is a, c, g, or t
  misc_feature (777)..(778): n is a, c, g, or t
  misc_feature (781)..(782): n is a, c, g, or t
  misc_feature (784)..(787): n is a, c, g, or t
  misc_feature (789)..(792): n is a, c, g, or t
  misc_feature (794)..(795): n is a, c, g, or t
  misc_feature (797)..(803): n is a, c, g, or t
  misc_feature (805)..(808): n is a, c, g, or t
  misc_feature (810)..(812): n is a, c, g, or t
  misc_feature (816)..(816): n is a, c, g, or t
  misc_feature (818)..(821): n is a, c, g, or t
  misc_feature (823)..(825): n is a, c, g, or t
  misc_feature (827)..(829): n is a, c, g, or t
  misc_feature (832)..(833): n is a, c, g, or t
  misc_feature (835)..(836): n is a, c, g, or t
  misc_feature (838)..(838): n is a, c, g, or t
  misc_feature (841)..(844): n is a, c, g, or t
  misc_feature (846)..(846): n is a, c, g, or t
  misc_feature (851)..(852): n is a, c, g, or t
  misc_feature (854)..(861): n is a, c, g, or t
  misc_feature (864)..(864): n is a, c, g, or t
  misc_feature (866)..(867): n is a, c, g, or t
  misc_feature (869)..(879): n is a, c, g, or t
  misc_feature (881)..(882): n is a, c, g, or t
  misc_feature (884)..(891): n is a, c, g, or t
  misc_feature (893)..(897): n is a, c, g, or t
  misc_feature (899)..(901): n is a, c, g, or t
  misc_feature (903)..(905): n is a, c, g, or t
  misc_feature (907)..(909): n is a, c, g, or t
  misc_feature (912)..(914): n is a, c, g, or t
  misc_feature (916)..(921): n is a, c, g, or t
  misc_feature (924)..(924): n is a, c, g, or t
  misc_feature (926)..(930): n is a, c, g, or t
  misc_feature (932)..(936): n is a, c, g, or t
  misc_feature (939)..(941): n is a, c, g, or t
  misc_feature (943)..(943): n is a, c, g, or t
  misc_feature (945)..(950): n is a, c, g, or t
  misc_feature (952)..(956): n is a, c, g, or t
  misc_feature (958)..(959): n is a, c, g, or t
  misc_feature (961)..(966): n is a, c, g, or t
  misc_feature (969)..(969): n is a, c, g, or t
  misc_feature (971)..(971): n is a, c, g, or t
  misc_feature (973)..(973): n is a, c, g, or t
  misc_feature (975)..(975): n is a, c, g, or t
  misc_feature (978)..(979): n is a, c, g, or t
  misc_feature (981)..(981): n is a, c, g, or t
  misc_feature (985)..(985): n is a, c, g, or t
  misc_feature (988)..(989): n is a, c, g, or t
  misc_feature (991)..(994): n is a, c, g, or t
  misc_feature (996)..(1005): n is a, c, g, or t
  misc_feature (1009)..(1013): n is a, c, g, or t
  misc_feature (1015)..(1017): n is a, c, g, or t
  misc_feature (1019)..(1019): n is a, c, g, or t
  misc_feature (1021)..(1025): n is a, c, g, or t
  misc_feature (1027)..(1029): n is a, c, g, or t
  misc_feature (1032)..(1032): n is a, c, g, or t
  misc_feature (1036)..(1036): n is a, c, g, or t
  misc_feature (1038)..(1039): n is a, c, g, or t
  misc_feature (1041)..(1043): n is a, c, g, or t
  misc_feature (1046)..(1051): n is a, c, g, or t
  misc_feature (1053)..(1054): n is a, c, g, or t
  misc_feature (1056)..(1057): n is a, c, g, or t
  misc_feature (1059)..(1064): n is a, c, g, or t
  misc_feature (1066)..(1068): n is a, c, g, or t
  misc_feature (1070)..(1070): n is a, c, g, or t
  misc_feature (1072)..(1073): n is a, c, g, or t
  misc_feature (1077)..(1078): n is a, c, g, or t
  misc_feature (1080)..(1085): n is a, c, g, or t
  misc_feature (1088)..(1092): n is a, c, g, or t
  misc_feature (1094)..(1100): n is a, c, g, or t
  misc_feature (1103)..(1114): n is a, c, g, or t
  misc_feature (1116)..(1116): n is a, c, g, or t
  misc_feature (1118)..(1119): n is a, c, g, or t
  misc_feature (1121)..(1121): n is a, c, g, or t
  misc_feature (1126)..(1127): n is a, c, g, or t
  misc_feature (1129)..(1132): n is a, c, g, or t
  misc_feature (1134)..(1137): n is a, c, g, or t
  misc_feature (1139)..(1139): n is a, c, g, or t
  misc_feature (1141)..(1142): n is a, c, g, or t
  misc_feature (1147)..(1151): n is a, c, g, or t
  misc_feature (1153)..(1153): n is a, c, g, or t
  misc_feature (1155)..(1164): n is a, c, g, or t
  misc_feature (1166)..(1168): n is a, c, g, or t
  misc_feature (1170)..(1170): n is a, c, g, or t
  misc_feature (1172)..(1172): n is a, c, g, or t
  misc_feature (1174)..(1183): n is a, c, g, or t
  misc_feature (1185)..(1188): n is a, c, g, or t
  misc_feature (1190)..(1191): n is a, c, g, or t
  misc_feature (1196)..(1196): n is a, c, g, or t
  misc_feature (1198)..(1199): n is a, c, g, or t
  misc_feature (1202)..(1202): n is a, c, g, or t
  misc_feature (1205)..(1205): n is a, c, g, or t
  misc_feature (1208)..(1209): n is a, c, g, or t
  misc_feature (1212)..(1215): n is a, c, g, or t
  misc_feature (1217)..(1218): n is a, c, g, or t
  misc_feature (1225)..(1229): n is a, c, g, or t
  misc_feature (1231)..(1235): n is a, c, g, or t
  misc_feature (1237)..(1237): n is a, c, g, or t
  misc_feature (1239)..(1242): n is a, c, g, or t
  misc_feature (1244)..(1246): n is a, c, g, or t
  misc_feature (1248)..(1249): n is a, c, g, or t
  misc_feature (1253)..(1253): n is a, c, g, or t
  misc_feature (1258)..(1262): n is a, c, g, or t
  misc_feature (1265)..(1265): n is a, c, g, or t
  misc_feature (1268)..(1268): n is a, c, g, or t
  misc_feature (1271)..(1271): n is a, c, g, or t
  misc_feature (1274)..(1276): n is a, c, g, or t
  misc_feature (1278)..(1279): n is a, c, g, or t
  misc_feature (1281)..(1281): n is a, c, g, or t
  misc_feature (1283)..(1284): n is a, c, g, or t
  misc_feature (1286)..(1288): n is a, c, g, or t
  misc_feature (1290)..(1299): n is a, c, g, or t
  misc_feature (1301)..(1301): n is a, c, g, or t
  misc_feature (1303)..(1305): n is a, c, g, or t
  misc_feature (1308)..(1309): n is a, c, g, or t
  misc_feature (1311)..(1313): n is a, c, g, or t
  misc_feature (1316)..(1317): n is a, c, g, or t
  misc_feature (1320)..(1320): n is a, c, g, or t
  misc_feature (1322)..(1322): n is a, c, g, or t
  misc_feature (1324)..(1326): n is a, c, g, or t
  misc_feature (1329)..(1331): n is a, c, g, or t
  misc_feature (1333)..(1333): n is a, c, g, or t
  misc_feature (1336)..(1336): n is a, c, g, or t
  misc_feature (1339)..(1340): n is a, c, g, or t
  misc_feature (1342)..(1349): n is a, c, g, or t
  misc_feature (1352)..(1353): n is a, c, g, or t
  misc_feature (1358)..(1359): n is a, c, g, or t
  misc_feature (1366)..(1366): n is a, c, g, or t
  misc_feature (1370)..(1370): n is a, c, g, or t
  misc_feature (1372)..(1372): n is a, c, g, or t
  misc_feature (1374)..(1375): n is a, c, g, or t
  misc_feature (1378)..(1381): n is a, c, g, or t
  misc_feature (1383)..(1385): n is a, c, g, or t
  misc_feature (1810)..(1810): n is a, c, g, or t
  misc_feature (1992)..(1992): n is a, c, g, or t
  misc_feature (2307)..(2307): n is a, c, g, or t
  misc_feature (2310)..(2310): n is a, c, g, or t
  misc_feature (2316)..(2316): n is a, c, g, or t
  misc_feature (2577)..(2577): n is a, c, g, or t
  misc_feature (2634)..(2634): n is a, c, g, or t
  misc_feature (2655)..(2655): n is a, c, g, or t
  misc_feature (2678)..(2679): n is a, c, g, or t
  misc_feature (2931)..(2931): n is a, c, g, or t
  misc_feature (2937)..(2937): n is a, c, g, or t
  misc_feature (3066)..(3066): n is a, c, g, or t
  misc_feature (3108)..(3108): n is a, c, g, or t
  misc_feature (3121)..(3121): n is a, c, g, or t
  misc_feature (3141)..(3141): n is a, c, g, or t
  misc_feature (3189)..(3189): n is a, c, g, or t
  misc_feature (3199)..(3199): n is a, c, g, or t
  misc_feature (3201)..(3201): n is a, c, g, or t
  misc_feature (3234)..(3234): n is a, c, g, or t
  misc_feature (3279)..(3279): n is a, c, g, or t
  misc_feature (3285)..(3285): n is a, c, g, or t
  misc_feature (3288)..(3288): n is a, c, g, or t
  misc_feature (3291)..(3291): n is a, c, g, or t
  misc_feature (3294)..(3294): n is a, c, g, or t
  misc_feature (3300)..(3300): n is a, c, g, or t
  misc_feature (3304)..(3304): n is a, c, g, or t
  misc_feature (3450)..(3450): n is a, c, g, or t
  misc_feature (3453)..(3453): n is a, c, g, or t
  misc_feature (3501)..(3501): n is a, c, g, or t
  misc_feature (3525)..(3525): n is a, c, g, or t
  misc_feature (3561)..(3561): n is a, c, g, or t
  misc_feature (3594)..(3594): n is a, c, g, or t
  misc_feature (3648)..(3648): n is a, c, g, or t
  misc_feature (3705)..(3705): n is a, c, g, or t
  misc_feature (3792)..(3792): n is a, c, g, or t
  misc_feature (3807)..(3807): n is a, c, g, or t
  misc_feature (3816)..(3816): n is a, c, g, or t
  misc_feature (3981)..(3981): n is a, c, g, or t
gangaagnnnnnagnannntnntnnncnnnannnannnnnnnntngtnnnnnnnnntnnnaannannttgntngnngnnnnntntttttnnnnnnnntnnnnnaagnnnnnannnnnnntntnnnnnnngnngnnnannnnnnnnannnnannnnnnnnnnnnantnnncntnnnnnncannntggnnnnntcnnnnnnntannnnnnnnnnnnnngnnnannnnnnnanaannnntnntnnnnnannnnnnntngnannaannannaantnnnnaannnnnnnncnncnnnnnntgnngnannnannangnnntnnntcnncngnngaannnantnancnnnnnnnngnnnnnnnnncnnnnnaannnnnannannnnnnnanannnnnnnnnnannnnnnnnannannannancannnnntgnngaagaagatnntnnnnnnnntgnnnnnnttnnngannannangnannnnnnnntnntnannannnannnantnannnnttnnngnangannnnannannnnnntnnnnngtnnnnnannannnnnngaanaannantannnnnnnnnnntnntnnnttnnatgnnngnannnnnnnnnnnnnngaagnagnangnnnnnnnnnnnncnnnnnnnnnnnanntnntcnnnnnnnngnannanaannacnnnnntnnntnnancnancannnnnnnnnannnnaatnaannnnttnnnnnannaanangannnnnnnnnnnnannanananntgnnnnnatnannaannnngnngtnntnnnngnnnntnntnnnnnnnannnntnnnttcntnnnntnnnannnaannannanaannnngnaaaannannnnnnnnttntnntnnnnnnnnnnnannannnnnnnntnnnnnannnannnannnagnnnannnnnntgntnnnnnannnnnaannntntnnnnnnannnnntnnannnnnnacnanangncgnngntgtngtnntnnnngnnnnnnnnnnctannnnncnnnanannnnntnnnagnagcngnngnnnaannnnnntnnanntnnnnnnannngntnnttgnngnnnnnnatnnnnnannnnnnntannnnnnnnnnnnantnntnatcannannnnannnntnannaagannnnntnannnnnnnnnntnnntncnannnnnnnnnnannnntnntacanannatnatnatnnatnnnntnntgatgannnnntnnnnngngnnnntnnncnncaanaaaannnnnganaanaanttnnntnntntnntnnncnnnnnnnnnncntnnntgnngnnnttnnaananannnacnnnangangannannnnnnnnaannattannacaaaanaagnantnnttnnnngnnncaaaataaaaacgcggttcttagagccacgttttttatttctgaatggaattgacagccttagcgagtcttgacttctgacgagcagcatagttgttattcttgatatgagatacaactgccttgtctaagcacttatttgctgtgttgtaagcagcagtagcagcttcaacgtccttagcttctacagctaaaagaaccttcttgattgctgtctttagttcgctcttctgtccagccttcgcattctgtcttttcagattagttagtgcgcgcttcttctgtgacttgatatttgccatgagtacacctcctgtccacttattagcattaggattatatcaaagtgaagtgtaaaatgcaatgaaaaccccaaaaaagtagggtataatatcacggtggaggtatgagagatgaaacagacangaattatattttttggtacaacagaatttgcaagcggtatattacagaccttaatcgatgaaggatataacgttgtagccgttgtttcccaaccagataaaccggttggtagaaaacataccatccagatgacaccaacacatgctttagcagatcaatatcagattccagtgattcaaccngatctcttaaaggaacatgtggatgatgtattacgatatgaaccagagttaatcttaacttgtgcatatggacaatttgtaccagtacgcattctagaatatccacgtcttggttgtattaatgtacatccatcacttttaccaaagtatcgtggaggtgcaccaatccatcatgcagttatgggtggtgaaacagaaactggtgtaagtctcatccagatgacaaaagccatggatgcaggagatatctatgctagagttacaacaccacttggtaaagatgaaacgatggcagaattaaaccagcgtttactngtnttaagnaagcaattagtgaaagagaatttagaagactatattgcagggaagctagtgggagaaccacaggatgatagtaaagtaatccttggattaaatattacaaaggaagaagagaaagtacagtttgcagtggaagatgtacaaactctatataaccacattcgtggtttaattgattggccaatgccatatggtgtggttgatggaaagcgtatcaagttctgcaaagttagaatgagaaaagaagaccatcaatcaaaaccnggagaaatcttaggttttaagaatcatgcgatggaagtcgcaagcattggtggcatnattgaagtttatgaactacanccagaaggcaagagcagaatganngcagatgcttatgccaatggtgtaggtagaaatatgatagggaaggtatttgagtaaatggatcaaaagcatatacgaaatttctgtattattgcccatatcgaccatggtaaatcgacattggcagaccgtattcttgaaatgacagaaacggtaaaagaacgtgatatgaaagctcagcttctggatgaaatggatctagaaagagaacgtggtatcacaattaagttgaatgcagtacagctaagctanaccgcnaaagatggacaggagtatctctttaacttgattgatacaccaggtcacgtcgactttacatacgaagtatcacgctcactagcggcttgtgagggtgcgattttagtcgttgactctacacaaggtgtncaagcacaaacactcgcaaatacctatcttgcgctagataanaatctagaaattntacctgtcattaataaagtngatatgatgaatgcacaacctgatgtgacaatccgtgagattgaaganatcattggtntngattgtagtaatgcgccactcatctctgcacgnagtggattaaacgttgataaagttttagaacagattgtatctcanatcccngcnccnagnggaaangaanatgcaccattacaagcattagtatttgactcattctatgacccataccgtggaatcatcgcattaattcgtatccgtgagggtagtctttctgttggtgataagattcgctttatggcaacaggcgcagaatatgaagtactagangtnggtattcgtaatccacgtgaagtaaagatgaatacattaatgtgtggngacgtaggttggtttgcggcttcnatcaagtccatccaagatgtacgtgttggtgatacngttacgaaagtagataatccagcagagaaaccnttatctggatatcgtaagttaaacccaatggtatattgtggtctatatccaacngatgcggcaaagtatggtgacttacgtgaagcgttagataaactacagttaaatgangcatccttgcaatatgaaccagaaacatcccaagcattaggctttggttatcgttgtggattcttaggacttctacacatggatgtnatccaggaacgtttngaaagagantataacctcgatctaatcgcaactgcaccatctgttatctatcatgtctacctaacggatgggtcaatgattgaaattgataaccctgcaagaatgccagatgcggctagaattgaccgtgtcgaagagccatatgtaaaagcaagtattatggtacctgacacntatatcggtgccatcatgg

SEQ ID NO: 1082 - DNA, 4000 bp, Escherichia coli
  misc_feature (93)..(93): n is a, c, g, or t
  misc_feature (591)..(591): n is a, c, g, or t
  misc_feature (615)..(615): n is a, c, g, or t
  misc_feature (657)..(657): n is a, c, g, or t
  misc_feature (711)..(711): n is a, c, g, or t
  misc_feature (1041)..(1041): n is a, c, g, or t
  misc_feature (1083)..(1083): n is a, c, g, or t
  misc_feature (1119)..(1119): n is a, c, g, or t
  misc_feature (2004)..(2004): n is a, c, g, or t
  misc_feature (2476)..(2476): n is a, c, g, or t
  misc_feature (2537)..(2537): n is a, c, g, or t
  misc_feature (2621)..(2621): n is a, c, g, or t
  misc_feature (2624)..(2624): n is a, c, g, or t
  misc_feature (3017)..(3017): n is a, c, g, or t
  misc_feature (3038)..(3038): n is a, c, g, or t
  misc_feature (3116)..(3116): n is a, c, g, or t
  misc_feature (3337)..(3337): n is a, c, g, or t
  misc_feature (3353)..(3353): n is a, c, g, or t
  misc_feature (3539)..(3539): n is a, c, g, or t
  misc_feature (3601)..(3601): n is a, c, g, or t
  misc_feature (3608)..(3608): n is a, c, g, or t
  misc_feature (3794)..(3794): n is a, c, g, or t
  misc_feature (3809)..(3809): n is a, c, g, or t
ccatacttaagcattgctaaacgatcgatccctaccccaaaagcatatccttggtattttgatgggtctacttttgcattttttaaaacattnggatgaaccattccacatcctaaaatttctaaccatttgtcaccttggcctatggttattttaccattcttaagttcgtaaccaatatctacctctgctgaaggctcggtaaaaggaaagtggctaggcctaaatctcatttttatttcatccacttcaaaaaatttttttaaaaaataatcaagacaacctcgtagatcagccattgttacattttgatctacatataagccctctaattggtgaaacattggagtatgtgtttgatcactatcacatcgatatgttcttccgggtgctataattttaaaaggaggtttgccattcaacatggtgcgtatttgaactggagatgtatgagttctcagtaaaagatttttactttcatctagatagaaagtgtcatgcatatctctggctggatgatttggtggagtattgagcgctgtgaaattattatactcgttttctacatctggaccctctgctaccgaaaancctaattcagcaaatatcgaagtnagttcatcgatcacctgtgatactggatgaacttttccttgnggtctgttagttcctggtaaggttacatcaactgtttgatcttgtaattttttntctaattcttcttgatcaaattgattagttaaattttgaaatttatctaaaaccttactttttaaaatatttatttctgatgcaaattctttttttttatctttttcaattgttgcaaggtcttgaaaaagttttgataatttccctttttttcctaaaatttctattttaaaattttctaattcagttttgcttttaatattagcaaaaccactaaatatttcttgttctaatgtagataagtcggtcatctaaaaaattaaaatttgaatttaatttagatgtagttgtaccttttttacgatggatttaaaagcttcaggattgtgntaagcaatatcagctaaaacttttctatcaattttaattttngatttcacaagaccattaataaatttagaataagtnaatccttcagctcgtacacctgcattaattctttgaatccataaagatctgaaaattcttttgtttcttcttctatcgcgatacgcatattgtaaagatttttctactgcttgcttagcaactcgaattgtattttttcgtcttcctctaaaacctttagcttgcttataaacttttttatgtttctggtgacttgcctgacctcttttaactcttgccataatttatcctcttacactgtaaggcatgtaagacttaattatttttgagtcttgtttggaaagaactgttgtgcctctaagttttctaatttgtgcgtttgttcttttaatcatgccatgtctttttccagcttgaggagcttttacttttcctttagctgtaaatttaaatcttttctttgctgaacttttagttttaagttttcccataaaaatgtagcagggttatacaaacattgtgttttgaaaacaataaaaatgtgggacttataaagcttgtattattaaggtcatttgtcgaccttccattttggcatgctgctctaccttacctacttcttttgtgtcttctgtaattcttctaactaagtcataagcagccttcaaatactccatttcacgtcctttaaatttaattgtgaatttaaccttgtcgccagctgtcaaaaatttctgtgcatttttaattttaaaatcataatcatgcttgtcagttactggacgtaatttaatttcttttaagtttataactttttgtttttttttcgcttgattagcttttttttgcaattcatatttatattttccactatccataattttacatacgggtggtttagtattgggagcaatttcaattaaatccaatccgacttcctgagcnctattaattgcttcgccgactggaacaatacctatgttctctccttcatgaccaataagctggacttccgtcgctctaatattttcattagtgcgaggacctctatctcttggttttcgattgtattgaaaattcttattaataaaaatacctcttaaaattttggagcttgagactcttgagataagcttgataaaatttcactaaacttagcagtttgttgatcttcttttcctaatcttctcaatgtaatagttttgtcttgaacttcttttgaaccgcaaatcattaagacgggaactttggccaaagagtgttctctaattttgtaattaattttttcatttcttaaatcgataataggtcttattgaatttttttcaagctgatttaacatttcttttgcatattcgtgatgctcttcattgattggaagtatagcaacttgaactggggacaaccaaaatggtancttaccagcatagtgttcaattaaaattcctgtaaatctttctaaagaaccaaataatgcncggtgcaacatcactggagtttttttcttaccttctttatctatatacgttgagcctaatcttcctggtaagtttaaatctacntgnaaagttccacattgccagtctctaccgatagcatcccttaaaacaaattcaattttaggaccataaaaagctccctctcctttattgagcgtatagtcaacattcgatgcttttattgcttctaataaagccttttcggcctgatcccacacagcatcatcacctactcttttttctggtcgatctgcatattttagagaaacattttcaaatccaaatgatttataaatatctaaaattagctttgtaactttgacagactcttctgttatttgttcttctgtacaaaaaatatgtgcatcatcctgggtaaaagatcttacacgcatcaaaccatgtaatgctcccgaaggctcatatctatgaacttttccaaattcagataactttagnggtaaatctttataacttttnagtccctgattataaacttggcaatgcccaggacagttcattggcttaattgcaaatgttctctcatccggagtaacngtagtgtacatatattcttgaaacttttcccaatgacctgatttttcccataagcctctatcaataatttctggggtattcacctccatatatcctgcttccagttgtttctttctcataaaatcaactaaagtttgaaatagtgtccaacctttttgatgccaaaatacagcaccaggactttcttcttgaaaatgaaacaagtccatagtcttacctanttttctatgatctcgnttctcagcttcctccaaattatgcaaatatagatccaaatctttttttgacttccagcaagttccataaattctttgtagcattacattgttagagtctcctctccagtacgcgccagctactttcattaatttaaatgccttaccaattctaccaatgcttggtaaatgaggtcctctacataantcatgccaatctccatggaaataaattgatatttcctcattgccaggaattgcatctatcanctcagcnttgtaactctctccaatacttttaaaatgatctattgctttttttctttcccaaacttctcttcttgtttgtggatcttgatcaattatttccatcatttttttttcaatttttgataggtcttcgtctgtaaaaggttcctctcgagcaaaatcgtaataaaaaccattctcaatgacaggaccnatcgtaacttgagtncctggatataattgctgaactgccatggccatcacatgagctgaatcgtgtctcaataattctaatgcataatcatcatctagagtaataattttaaccttggaatctttgctaatttctacagataagtctttatattcatcatttacttgaatggctaaagcctttttggctagtgagatacttatgtc

SEQ ID NO: 1083 - DNA, 4000 bp, Escherichia coli
  misc_feature (113)..(113): n is a, c, g, or t
  misc_feature (501)..(501): n is a, c, g, or t
  misc_feature (856)..(856): n is a, c, g, or t
  misc_feature (1224)..(1224): n is a, c, g, or t
  misc_feature (1229)..(1229): n is a, c, g, or t
  misc_feature (1586)..(1586): n is a, c, g, or t
  misc_feature (1793)..(1793): n is a, c, g, or t
  misc_feature (1984)..(1985): n is a, c, g, or t
  misc_feature (1987)..(1988): n is a, c, g, or t
  misc_feature (1993)..(1994): n is a, c, g, or t
  misc_feature (2059)..(2059): n is a, c, g, or t
gtcgcgtggcgtttcgtagatttgtttgtagcgttgagattcacgtcactcgcccgcgcgcgccgcgcgatcgcgctcgagttcggactcgcgcggtcgatttcatccatcgnacgcgctcgctcgcgcgtctcccgtcgctcgacgcgcggcgctcgcgcgtcggcaccgcgcaccagtcgccgggggaactttcgaaagcgtcgacagctgacggctatttcgccacgcacgcgcgcgctcgacgtcatgggcgagaatctctcgcccgaaaccgtcaatagcatcatgcgtcaactgaaagatttgatgcagagccccgcggaggggatcagggtgcgagtgaacgaggagaacgtgacggatgtcttcgccgagctcgacggtcccgcggacacgccgttcgaaggcgggacgtttaagatgaagctcgcgctgccggcggattacccgaacaatccgccgaagggattctttacgacaaaaatatttcatccgaanattcgtcagccgagcggggagatttgtgtgaacacgctcaagcgtgactggcaaccgacgcacggactgcggcacatattgatggtgattcgatgcttgctcatagaaccgtttccggagagcgctctgaacgaagaggctggaaagcttttactcgaggattacgaagagtattttaggcgcgcgaagatgtacaccaatattcacgccaaacccgaaacgggcaaggcggaggacgcggcgagcgcgtcggcggcgagcggcggggagaagaagttggacaaaaagaaggacaagaagaagagcttgcgccgtctttagcaaaagcgtatcgcgcgcgcggtagcagatgaangaacgtcgttgttgtgagcgaagctttgattacaacgaataaaaattgcgttccgtcgctcacctttcttctatctgatgcatcgttaagtcatccgtcgcgttagttgagcttcgcatcctgcgtgtcgccggtgaatcgcgcagaagacgaaccgtcgttaccgtcgttaccccacgccacgtaatccttcttcgtcttgagcttttccgtgaacgacccctcgatcttcaagccggcgtcgtcgccgccgatgacgatgtcgatgactccgtactgcttcgcctcgagcggcgacatgtagcgatcgcgatcggtgtcttcgtctatcttcttaacgtcttgtccggtgtggaacgccatgagtntgttnaagttggccttgtggtgcatgatttccttcgcttggatttcgatgtccacggcgctcccttgcgccccgccgagcggctggtgaatcatgatgcgcgcgttcggcatcgacatgcggcgacccttctccccgctcgcgagcaagaacgcccccatggacgccgcgagtccaaggcacaccgtgctcacgggcgctcggcaaaactgcatcgcgtcgtaaatccccatccccgccgtcacgctccctcccggagagttgatgaagagtttaatctccttcgtcggatcttgctgatcgagcagcagcaactgcgagatcaccgcatcggcgttaaaatcatcgacctgcgagccgagnaacacgattcggttcctcagcaagctatcgaacggcgacccgctttggtctcgcggcaccaccggccccgcgcgcgcgcccggcgccccgctcgcgttcaccgcgtcgtaaatctctctctgcgcctcgttcacgccgtcgacgtacgcgatttcgttcgggttctcgtagaacgcccctcccgcgcgcgcgacgcgcgtcgcgcgnccgcgcccgtccgcgcgccgcgcgcgcgataaacctagcctcgatcgcgtcgcccgcgtcgtcgcgtcgcgtcgcgtcgcgcttccgcgcggcgccgtcgtcgtcgcgcgcgtcacgagtcccatcatgcgttcgctcgcgtcgtcggtcgcgtcgcgcgcgtgtgcggcgcgcgcgcggtcgacgcgccnngnncgcgnncgcgcgcctggtcggtcggtatgcgcaaacagtgcggatgcgtttttcgacgcgtcccgacgtcncgacggccgcgcggcgtcggcacaccgcgatgcgaagcgtcgcgcgcgcgttgacgtgcgcgcgcgcgacgcgaggcgcgacgaccgcgacgatcgcgacgaccgcgcgcgcgccggtcgccgagcgacgacgcgggacgacgagacgcgcgggacgcgtcgacgcgggacgacgacgcgggacgcgcgcgatggcggtgagcggacgcgcgcacgcgccggcgaacgcggacccgatggcgggcgtcgacgtcgcggcgaacgggacggcgtggcgagacgcggcggtggacgcggtggtgtgggcggtgcgagaggaggacgtcggcgcggagacgggggcgctggagtgcgacgcgctgcgggcgttcgacgcggcgtcggggggggcggtgcgagcgatgatcgaggagggagagtttaagggaaaggttgggacgtccgcgttctcgagggcgatcgcggggacggcgaaacacgtcggcgtggtcggcgtggggaagaggggggaggcgacgacgagcgcgatgttgacgctgggatccgcggcggcggcgcaagcgcaaaagagcaagtgcaagacgctcgggattaagggtgcggacggattcgaaaacgcggtcgcggctggggcgtacttgggcgcgacggaggatcagaggtttaagtccaagccgcaggcgaagacgctcgaatccgtgtcgttgttggacgtctccgcggatgtctccgagggtaaggcgcgcgcggtgggcgtgcagttgaccaaagatctcgtcgccgcaccgccgaacgtggtgacgccgaccgcgatggcggaagtcgccaagtccatcgccgccgcgcatccggattgcatgagcgtgaaaattttggaaaaggctgattgcgaaaagctgggcatgggatccttcttgggcgtctccgaagcctcggacgaaccgccgaagtttatccacctcacgtacaagggtgctgggagcgacttgaagaaagtggctgtcgtcggtaaggggctgacgtttgactccggcggctacaacttgaaggcgggcgcggggtcgatgattgagatgatgaagtttgacatgggcggttccggagccacgctcggcgccgcgaaaatcatcgcgcagacgaagccagcgggcgtcgaatgtcacttcatcatcgcgtcgtgcgaaaacatgatcggttctcgcggcttgcgccctggcgacatcttaaccgcgtccaacggcaagaccatcgaggtgaacaacaccgacgctgaaggtcgtctgacgctcgccgacgccttggtgtacgccgacaagacgtgcggtgcgaccgccatcgttgactgcgccactctcaccggcgccatcatcgtcgcgctcggcaacgacatcgccggtctcttttccccgaaggacgccgccgccaagcgcgtcgaagacgccgccaaggcggcgggagaagatctctggcgtatgcccatgcccgattccatgtggtctatcatgaaatctgaaatcgccgacatgaagaacaccggctctcgcggcggcggttccatcaccgccgcgctcttcttgaagcaattcgtcgacgagagcgtcgagtggagccacgtggatttggccggaccggtgtgggacgacaagaagggcggtgccaccggttacggcgcagcgcttttcgccgcgtgggtgtcgtcctttaagaagtaagtgattcctttaattaaactgtccaaccataaaaatttaacgcgtcgccgaatagtcttttctgcatcagagcgcgacgttcgccgtcatgcgtcgcgcgacgtcgaccgcgagcgcgcggctgctggttctgacgttcttcgcgatcgcgtcgagcgtcgccgtcgccgccgcggcgtcgtacgagacgcgctcgacgcgcgcgccgcgacgcgcgtccagctcgtcc

SEQ ID NO: 1084 - DNA, 4000 bp, Escherichia coli
  misc_feature (292)..(292): n is a, c, g, or t
  misc_feature (373)..(373): n is a, c, g, or t
  misc_feature (457)..(457): n is a, c, g, or t
  misc_feature (544)..(544): n is a, c, g, or t
  misc_feature (550)..(550): n is a, c, g, or t
  misc_feature (637)..(637): n is a, c, g, or t
agacatggtggttgtggtttctaccggtgaagtatccacttggggtagcggccgtacccgccgtgaagctgagctgggtatgaccggtggcgacgacgtcgagctcaccgctgccggcgtactcgaactggcctggggtatgggcctgctgacctggcaggactcgcctaaggccggctggtacgacaccgatggcaacctggttgacgaggctgacattctctcgcgttaccgcgacgaggtagtgggccgttgcggtatccgcgaattcgttgacgaccagctgatcgcnccggtggcagatgaagaggttgaggtttaccttgaccgcgacatctccttcaacgtcgctgacgaggctaccgcccgcacnatcgctgaatctgacccggcacacaccctgatcagtgaagacagcgaaagtggcgagtggatcgtgacccgcctggctggttcnctggcccgcgtaccgcgccgcgccgcgctgagccgcaccgtgggtggccagttcccgcgtgacttcgacccgcagcgttggggtatnccggcntccatgaccgagtctttggaccggatcgcctcttggaacctggttaccgccgttgaggccttcctcaacgctggtttcagccccgcngagttgctgcaggctgtgcacccggccgatgtggcctccactcagggcaccggttttggtggtatggagtcgatgcgcaagatgttcgttggtcgcttcctcaacgaggaacgccccagtgacattctgcaggaggccctgcctaacgttgtggccgcacacgtaatgcagtcctttatcggtggttatggttctatggtgcagccggttagcgcctgcgcaaccgcagccgtatccattgaagaaggctgggacaagatcgctctgggtaaggcccaggtggtggttgccggtgctatcgatgacatctcggttgagtccgtggtcggcttcggtaacatgaacgccaccgctgaggcagctgccatgaaggctaagggcatcagcccgcgtcacttctcacgtgctaacgaccgtcgtcgcggcggcttcgtggaagcccaaggtggcggtaccgtcatcctggcccgtggtgacgtagctgccaagctggggctgccggttgcggcggtacttggtttcgtctcctcttacgccgacggcgcccacacctccatcccggccccgggcctgggtgctttggctgcgggccgtggcggtagcaactcgcgtctggctaagtctttggccaagctgggcgttgaggctgacgacatcgccgtggtttccaagcacgacacctccaccggtgctaacgaccccaacgagtctgaactgcacacccgcctggccaaggcacttggccgtagcgagggcaacccgctggtagcggtctctcagaagaccatcactggtcacgctaagggtggtgccgcagtgttccaggtggccggtttgaccgaaatcctggctaccggtgtggctcccggtaacgcctcgctggactgcgtggacatcaagctcaagaaggacagcttctggatctggccgcgtaaggctatgcgtctggctggccgtggcggcgaaagcggccgcgtgcccggtgctggtccgatccgtgcgggcttggctacctcgctgggcttcgggcacgtatctggcctgctggccatggtgcaccccggtgctttcgaatctgccctgcgtaaggctggcggccagcaggccgtcgacgcctggctggctagcgccaacgcccgcctggctgccggtacgcgccgccgccgcgccggcatgatcggccgcgtggccctgttcgagcagatcgatggccgtcgcctgggtgaagaaaccgaaacccgcgacccgcacgaggttgaggcagccatgctgcttgaccccgaggcccgcttgggtgccgacggtgtttaccacgctggtgagtaatagctagcgcttaaggtggggggtggatcctttaaggatccaccccccaccgctgtttttggcgtcatggctagctaagctaggggagtggatatgcctaaaattgttactcctaaagctactggtcagtgtccagtgggagtgggggttgacctagtgcagatagatgcttttgctcagcaactgtctgagcctggcactagttttagtcagcgagcttttagccctcgtgagctacgccaagcccaggcacgggtgcgagctagaggggctgagccaaactggcaggagctagctccacacctggctgcgcgttgggcagccaaagaagcttttgttaaggcctggtccactgccttggtggaacttaaaggcgccgccgcacctcaaccgctaagcctggaaagttttaactgggatcaggttgaagtactgctagatgagcagctacgcccccagctagcactacgcggccaggtggcccaagcagttagccaaagtgtgggggagcctagctggctggtgtcactaagccatgagggtaactgggctagcgccgtcgtaattgctgctctaacagcgtaaaaaatttagctaaccggcttaaacctaagttgttgaggccttagacctaggtttatagttggcatgtaaaacgtgctccggggtcggtgaaattccgagccggcggttatagtccgcgacccaccggtacctactggtggttgagctggtgaaattccagcaccgacggttaaagtccggatgggaggaagcacgcgggtttacttatatttaggtgacctgcaggcgctgtgcgcgcgcatccttgtattccccggcgcttaccgggaggaaacttccgccgtcttcggaaggaattagatgcgagcttacaggccctggctagcaattacgctaggtgtagtggttttagtcttctggcagctaatttctgtatctggagctgtggctgagtattttttgccagcccccacccacatcattgattcgctaattacctcaattggccacgccaatatgcttggttacgcctgggttactctgcgtgaagcgattttgggttgtatgttggcttttgcgggggctttacccttagcattggcgctatttcactggccactgttttcgcaaactgtgctgccttatgtggccgcaagtcaagcgattccggctattgcgattgcgcctttgctggtgttgtgggttggttacggtttgttcccggtagtgctgctatgtgcctttatggtgtttttcccaatcactatctctattttgctggggctaaggtcaatcaatcgtgatgtgatcgaggcggcccggcttgatggggcgggtggtttcaaaatgattatctatatggaactgccgctagctactccggcaattttggcaggtttgcgtaccggcatgacactgtcaattaccggtgcggtagtaggggagatgaccatggggggcacgggattgggcatggttttagcatcccagcgcgacgccgtaaataccgcaggtctatttgccaccatcgtggtgttgtcagttatggccaccgctttgcacggtttgattcatgcctgcgaaaagcgttcgcgcacaatcgccgcaattcaaagttaggaaacaccatgatttcacgtcgccaagcagttagcctactgggtttagcagcagggggcgtagccctaggggcttgctcctcaggtactgccagcaaatctaagaccggggctcagcccttaactattggtctgacctacacccccaacatccagttcgcacccttctatttggcacaggccaataagcaatacgcagacagtgtcaagctgcgccaccatggggcccaggaaggcctgtttgatgcgctgagcgccggcagcgaagacctggttattgctggcgccgacgaagccgctgtggcctgctctaacggttcaaacctggtggttgtgggcggctactaccacagctatgcggtatgcattatggtgccggccaactcctctatca

SEQ ID NO: 1085 - DNA, 4000 bp, Escherichia coli
  misc_feature (526)..(526): n is a, c, g, or t
  misc_feature (535)..(535): n is a, c, g, or t
  misc_feature (544)..(544): n is a, c, g, or t
  misc_feature (556)..(556): n is a, c, g, or t
  misc_feature (606)..(606): n is a, c, g, or t
  misc_feature (613)..(613): n is a, c, g, or t
  misc_feature (619)..(619): n is a, c, g, or t
  misc_feature (625)..(625): n is a, c, g, or t
  misc_feature (634)..(636): n is a, c, g, or t
  misc_feature (643)..(643): n is a, c, g, or t
  misc_feature (646)..(646): n is a, c, g, or t
  misc_feature (1976)..(1976): n is a, c, g, or t
  misc_feature (1985)..(1986): n is a, c, g, or t
  misc_feature (2001)..(2001): n is a, c, g, or t
  misc_feature (3677)..(3677): n is a, c, g, or t
  misc_feature (3807)..(3807): n is a, c, g, or t
ttagacagttccttacagtcagtcatcgtcagtgcattaagcttctttgcagcaacatttggtgttggattatactccagtatcgatatgatcagttccttatgtatgcttcttgcaagaggtgccctgatcagtctgatcgtcgtagcatttattctgccggcaatgtttatggtatttgataaattgatctgtgcaacaagtgcaggtttccgttataaaaaagattcatcagttcagtaaaatagaggaggaaaaaaagatgaaattaccggaattaaagaaaaaatttacaaagaaatatgtgattcgtattatcgcaggtgtgctggttgtcggaatggttggaacaggcgtttccacagcaaacgtatttgcagcaaagaccgcacaggagagcactgagagtacagagagtaccgaaaaagacagcaaaaaatcagatacaaaagattccgatgctgagagcaaattaaaagatgcattagatgacagtatcaaattcagcgagaaagagattggcaangaagaaacngtatatgtncttgcagacagnaccggaaaagagcgcaaagtgatcgtttccgatcatctgatcaatgatgnaaataangatacnatcgangatgcttcnnncttaaanganatcgaaaatgtaaaaggtgatgagacattcaaacaggatggcagcaaactgacctggcaggcagacggcaacgatatttattatcagggaacctccacaaaagagacaccggtatcccagacaattacctattctttggatggtaaggaagtaaagccggaagaacttgcaggaaaatcaggaaaagtaacgatccgttttgattacaccaacaatgagacggtaaaaacaaagatcgacggaaaagaggaagaaatctatgtcccatttgctgcgatcagcggaatggtattagatgacagcttttctaatgtaaaagttaccaatggtaaagtaatctccgatggcaaaaataatattgtagtcggatatgcacttccgggattaaaagagagcttagatgtggatgattctgattttgacggagatgtatcgatcccggattacgtggaagtaactgcagatgtggagaatttctcattaagcaccacaatgacagttgtgatgaatgcaacaaactttatcagcaaagacggagatgcagatctttctgaagttgatgatatgttagatactttaacagatgcaacagatcagttaaaagatggttccggtgagctcgcagacggtgtagatactttaaaatccaagatgggtgagtttaaagacggtgtcggaacattaaagaacggtatcaaagattatacggatggagcttctactttatccacaggaatcggaacattaaagagtggtgtggataccttagcaggaagtgtaccaacactgatcagtggtgtgggaaccttaaaagatggttcagcaagtgcagcaaaaggagcatcttccttaaaagacggagcaggaaccttaaagaaaggtgccaaggatgtatctaccggagccaatacattgtccaaaggtgcaagtgatctttccaccggagccaatacactttccaccggagtgaatgatctttctaccggagcagatacgttatccactggagcttctgatttgtctactggagcagacactttagctgccggagcttccagtctgaatacaggtgtccagacacttgcgaaaggagtaaaagatttaaatactgctgtcaacggcggtgaaacaacgcttgcaggcggagcatctgcagtcagtgcaggtgtggatacattagttggaaaattgggagatatggcagcaactttacagactaaaaaagatcagatcaatgccaatttacaggcaaatggtacatccattgaaaatgcacaggctacgatcgaatcattaaagagcgcacagtcaaatctgatgaacggaattnccatgtacnntgcagatcctacaantgcaacagcaatttttacgcaggtggggcaggcacttggcggtgtttcaatcaacagtgtaaatgatgcaatgactgtagcggtaagcctgtcagacaagatcgcagcaatcggtcaggctcagggagctgtttcagctatcgatgaagcagctagtcagatttctgatccgacaacacaggcacagcttacagcacttcaggctggtgcgaaacaggtggcagatggagcagcgcaggcatccggtgcaatcagtactatggctggaaaaatggatgatctgactagtggttctggtcaggtggcacagggagcaagtgatcttgcaacaggagcaggaaccttaaagaaaggagcaagtgatcttgcaacaggagcaaccaagttaaagaagggtgccggagaccttgcaacaggagcaggaaccttaaagaaaggagcaggtgatcttgcaacaggagcaggtcaggtggcagatggagcaacgactctgcacaaaggagcgtctgatctgtctgacggtttaaatactttagacggtggtatcggacagttgaaagagaaagccggatcacttgcaacaggagctgagcagttaaagagcggcacagaccagcttgcaagcggggcatccacacttgtttctaataatgaaaaattaaacgatggtgcaggcactttaagtgatggtacggatgcgatcattgatggtgtgggagaactttctgacggagcacataaacttgcagatggaatcactgagttcagcgaggatggaatcgatgagatcatcaattcctacaatggcgatatcgagccgcttgttgaccgtatccaggctgtattagatgccggtgctgattaccagacttatactgacattgcagatggcgtgaacggaagtgttaaatttattatcaaaacggatgcggtaaaagcagaagactaaagaaccgcttttaggaggagtaagatgaatgcgttggagaatctgctgatcatagcaggcatatcgctggatatatttgcagccatggagtgtcagggatcactggtagcaaagatcgacaaaaaacagcttgtcaaactgtgtgcactgattgctgcatggcagatggcagcgctgttcgtcggaagctacctgtcaggacttttgtaccgtaacaccataacgcacaatgaaaaagtgaccgggtttgtcattgcagcagccatctttttctgcctgggagtgcggctggttgcaaaagccataaaaaatgagcgcattgtagagcactgtgaacagaagcttggatggaaacagttactggcgattgcggcagttaccagcatttataccctgctgaccggcattgcatttggctttctgggaacaaatcttcttgtcatgctcctgatgatcgcaggacttacgatcgcggttgttgtgaccggtatctataccggatatcaccttggatttgagcataagacaaaagcatatattgcgggagcaattcttctgtggattgcagggatagacgttattgtaagacatattttgcggtagataatagattgtacgcttttgtgcaatttgacagacctaaaattgaaaaccaccttttgacacccgaatctatgaagaaaagaaaatccggtttcacactgtcaggtaaaaatctggcagcggngaaccggatttttttgtacgttgcaacaaggttttttcttcgctataatgaaaaaaatggaggcagaaaacagatgaagattttacttacggcgatcaatgccaaatatatacattccaaccttgccgtntataatctgcgtgcatatgccgcacattacgcaaaaggcatggctgattccgatacagtagagatcggggaatatacgatcaacaaccagatggaggatattttagagggaatctacaaggcgaagccggatgttcttatgttttcctgttatatctggaatattgcatttgtggaggaactggcggaagaat

SEQ ID NO: 1086 - DNA, 4000 bp, Escherichia coli
  misc_feature (1949)..(1949): n is a, c, g, or t
  misc_feature (1956)..(1957): n is a, c, g, or t
  misc_feature (1959)..(1959): n is a, c, g, or t
  misc_feature (1961)..(1965): n is a, c, g, or t
  misc_feature (1967)..(1967): n is a, c, g, or t
  misc_feature (1972)..(1972): n is a, c, g, or t
  misc_feature (1986)..(1986): n is a, c, g, or t
  misc_feature (2185)..(2185): n is a, c, g, or t
  misc_feature (2196)..(2199): n is a, c, g, or t
  misc_feature (2201)..(2203): n is a, c, g, or t
  misc_feature (2305)..(2306): n is a, c, g, or t
  misc_feature (2315)..(2317): n is a, c, g, or t
  misc_feature (2336)..(2339): n is a, c, g, or t
  misc_feature (2341)..(2343): n is a, c, g, or t
  misc_feature (2345)..(2350): n is a, c, g, or t
  misc_feature (2352)..(2353): n is a, c, g, or t
  misc_feature (2356)..(2358): n is a, c, g, or t
  misc_feature (2360)..(2364): n is a, c, g, or t
  misc_feature (2366)..(2367): n is a, c, g, or t
  misc_feature (2369)..(2377): n is a, c, g, or t
  misc_feature (2379)..(2381): n is a, c, g, or t
  misc_feature (2383)..(2386): n is a, c, g, or t
  misc_feature (2388)..(2389): n is a, c, g, or t
  misc_feature (2391)..(2396): n is a, c, g, or t
  misc_feature (2400)..(2400): n is a, c, g, or t
  misc_feature (2404)..(2404): n is a, c, g, or t
  misc_feature (2406)..(2406): n is a, c, g, or t
  misc_feature (2409)..(2410): n is a, c, g, or t
  misc_feature (2414)..(2415): n is a, c, g, or t
  misc_feature (2418)..(2423): n is a, c, g, or t
  misc_feature (2425)..(2425): n is a, c, g, or t
  misc_feature (2433)..(2435): n is a, c, g, or t
  misc_feature (2437)..(2437): n is a, c, g, or t
  misc_feature (2440)..(2440): n is a, c, g, or t
  misc_feature (2442)..(2443): n is a, c, g, or t
  misc_feature (2446)..(2448): n is a, c, g, or t
  misc_feature (2451)..(2452): n is a, c, g, or t
  misc_feature (2459)..(2459): n is a, c, g, or t
  misc_feature (2468)..(2468): n is a, c, g, or t
  misc_feature (2471)..(2471): n is a, c, g, or t
  misc_feature (2480)..(2480): n is a, c, g, or t
  misc_feature (2485)..(2486): n is a, c, g, or t
  misc_feature (2488)..(2491): n is a, c, g, or t
  misc_feature (2493)..(2505): n is a, c, g, or t
  misc_feature (2507)..(2509): n is a, c, g, or t
  misc_feature (2511)..(2514): n is a, c, g, or t
  misc_feature (2518)..(2521): n is a, c, g, or t
  misc_feature (2523)..(2523): n is a, c, g, or t
  misc_feature (2525)..(2530): n is a, c, g, or t
  misc_feature (2532)..(2535): n is a, c, g, or t
  misc_feature (2538)..(2544): n is a, c, g, or t
  misc_feature (2546)..(2547): n is a, c, g, or t
  misc_feature (2550)..(2550): n is a, c, g, or t
  misc_feature (2552)..(2553): n is a, c, g, or t
  misc_feature (2555)..(2560): n is a, c, g, or t
  misc_feature (2563)..(2568): n is a, c, g, or t
  misc_feature (2570)..(2571): n is a, c, g, or t
  misc_feature (2573)..(2575): n is a, c, g, or t
  misc_feature (2578)..(2578): n is a, c, g, or t
  misc_feature (2580)..(2588): n is a, c, g, or t
  misc_feature (2590)..(2593): n is a, c, g, or t
  misc_feature (2597)..(2606): n is a, c, g, or t
  misc_feature (2608)..(2616): n is a, c, g, or t
  misc_feature (2619)..(2620): n is a, c, g, or t
  misc_feature (2622)..(2624): n is a, c, g, or t
  misc_feature (2627)..(2636): n is a, c, g, or t
  misc_feature (2639)..(2642): n is a, c, g, or t
  misc_feature (2644)..(2645): n is a, c, g, or t
  misc_feature (2647)..(2648): n is a, c, g, or t
  misc_feature (2650)..(2653): n is a, c, g, or t
  misc_feature (2659)..(2665): n is a, c, g, or t
  misc_feature (2668)..(2671): n is a, c, g, or t
  misc_feature (2673)..(2674): n is a, c, g, or t
  misc_feature (2676)..(2676): n is a, c, g, or t
  misc_feature (2678)..(2678): n is a, c, g, or t
  misc_feature (2680)..(2680): n is a, c, g, or t
  misc_feature (2682)..(2685): n is a, c, g, or t
  misc_feature (2688)..(2693): n is a, c, g, or t
  misc_feature (2695)..(2695): n is a, c, g, or t
  misc_feature (2697)..(2697): n is a, c, g, or t
  misc_feature (2699)..(2705): n is a, c, g, or t
  misc_feature (2707)..(2707): n is a, c, g, or t
  misc_feature (2710)..(2710): n is a, c, g, or t
  misc_feature (2712)..(2714): n is a, c, g, or t
  misc_feature (2716)..(2716): n is a, c, g, or t
  misc_feature (2719)..(2723): n is a, c, g, or t
  misc_feature (2727)..(2727): n is a, c, g, or t
  misc_feature (2729)..(2732): n is a, c, g, or t
  misc_feature (2734)..(2734): n is a, c, g, or t
  misc_feature (2736)..(2737): n is a, c, g, or t
  misc_feature (2740)..(2747): n is a, c, g, or t
  misc_feature (2749)..(2753): n is a, c, g, or t
  misc_feature (2755)..(2756): n is a, c, g, or t
  misc_feature (2759)..(2760): n is a, c, g, or t
  misc_feature (2763)..(2763): n is a, c, g, or t
  misc_feature (2765)..(2766): n is a, c, g, or t
  misc_feature (2768)..(2769): n is a, c, g, or t
  misc_feature (2771)..(2773): n is a, c, g, or t
  misc_feature (2775)..(2775): n is a, c, g, or t
  misc_feature (2779)..(2779): n is a, c, g, or t
  misc_feature (2782)..(2784): n is a, c, g, or t
  misc_feature (2786)..(2786): n is a, c, g, or t
  misc_feature (2788)..(2794): n is a, c, g, or t
  misc_feature (2796)..(2797): n is a, c, g, or t
  misc_feature (2799)..(2800): n is a, c, g, or t
  misc_feature (2802)..(2802): n is a, c, g, or t
  misc_feature (2805)..(2809): n is a, c, g, or t
  misc_feature (2812)..(2812): n is a, c, g, or t
  misc_feature (2814)..(2822): n is a, c, g, or t
  misc_feature (2824)..(2826): n is a, c, g, or t
  misc_feature (2828)..(2831): n is a, c, g, or t
  misc_feature (2834)..(2835): n is a, c, g, or t
  misc_feature (2837)..(2837): n is a, c, g, or t
  misc_feature (2839)..(2843): n is a, c, g, or t
  misc_feature (2846)..(2849): n is a, c, g, or t
  misc_feature (2851)..(2855): n is a, c, g, or t
  misc_feature (2858)..(2859): n is a, c, g, or t
  misc_feature (2861)..(2865): n is a, c, g, or t
  misc_feature (2867)..(2867): n is a, c, g, or t
  misc_feature (2870)..(2871): n is a, c, g, or t
  misc_feature (2873)..(2873): n is a, c, g, or t
  misc_feature (2877)..(2878): n is a, c, g, or t
  misc_feature (2880)..(2882): n is a, c, g, or t
  misc_feature (2887)..(2887): n is a, c, g, or t
  misc_feature (2889)..(2889): n is a, c, g, or t
  misc_feature (2891)..(2893): n is a, c, g, or t
  misc_feature (2895)..(2895): n is a, c, g, or t
  misc_feature (2897)..(2903): n is a, c, g, or t
  misc_feature (2905)..(2905): n is a, c, g, or t
  misc_feature (2911)..(2912): n is a, c, g, or t
  misc_feature (2914)..(2915): n is a, c, g, or t
  misc_feature (2917)..(2917): n is a, c, g, or t
  misc_feature (2919)..(2919): n is a, c, g, or t
  misc_feature (2921)..(2927): n is a, c, g, or t
  misc_feature (2929)..(2932): n is a, c, g, or t
  misc_feature (2935)..(2935): n is a, c, g, or t
  misc_feature (2937)..(2937): n is a, c, g, or t
  misc_feature (2941)..(2941): n is a, c, g, or t
  misc_feature (2944)..(2953): n is a, c, g, or t
  misc_feature (2956)..(2958): n is a, c, g, or t
  misc_feature (2960)..(2961): n is a, c, g, or t
  misc_feature (2963)..(2963): n is a, c, g, or t
  misc_feature (2968)..(2968): n is a, c, g, or t
  misc_feature (2971)..(2974): n is a, c, g, or t
  misc_feature (2976)..(2976): n is a, c, g, or t
  misc_feature (2978)..(2978): n is a, c, g, or t
  misc_feature (2981)..(2984): n is a, c, g, or t
  misc_feature (2986)..(2986): n is a, c, g, or t
  misc_feature (2990)..(2993): n is a, c, g, or t
  misc_feature (2997)..(3003): n is a, c, g, or t
  misc_feature (3008)..(3008): n is a, c, g, or t
  misc_feature (3010)..(3012): n is a, c, g, or t
  misc_feature (3017)..(3018): n is a, c, g, or t
  misc_feature (3021)..(3023): n is a, c, g, or t
  misc_feature (3025)..(3032): n is a, c, g, or t
  misc_feature (3035)..(3038): n is a, c, g, or t
  misc_feature (3044)..(3045): n is a, c, g, or t
  misc_feature (3047)..(3052): n is a, c, g, or t
  misc_feature (3055)..(3056): n is a, c, g, or t
  misc_feature (3058)..(3058): n is a, c, g, or t
  misc_feature (3061)..(3063): n is a, c, g, or t
  misc_feature (3066)..(3067): n is a, c, g, or t
  misc_feature (3071)..(3071): n is a, c, g, or t
  misc_feature (3074)..(3074): n is a, c, g, or t
  misc_feature (3077)..(3077): n is a, c, g, or t
  misc_feature (3080)..(3080): n is a, c, g, or t
  misc_feature (3082)..(3082): n is a, c, g, or t
  misc_feature (3085)..(3085): n is a, c, g, or t
  misc_feature (3087)..(3088): n is a, c, g, or t
  misc_feature (3092)..(3092): n is a, c, g, or t
  misc_feature (3095)..(3098): n is a, c, g, or t
  misc_feature (3100)..(3100): n is a, c, g, or t
  misc_feature (3102)..(3103): n is a, c, g, or t
  misc_feature (3106)..(3109): n is a, c, g, or t
  misc_feature (3112)..(3114): n is a, c, g, or t
  misc_feature (3117)..(3117): n is a, c, g, or t
  misc_feature (3122)..(3123): n is a, c, g, or t
  misc_feature (3127)..(3129): n is a, c, g, or t
  misc_feature (3132)..(3133): n is a, c, g, or t
  misc_feature (3137)..(3137): n is a, c, g, or t
  misc_feature (3141)..(3141): n is a, c, g, or t
  misc_feature (3144)..(3144): n is a, c, g, or t
  misc_feature (3146)..(3147): n is a, c, g, or t
  misc_feature (3150)..(3151): n is a, c, g, or t
  misc_feature (3153)..(3155): n is a, c, g, or t
  misc_feature (3158)..(3158): n is a, c, g, or t
  misc_feature (3161)..(3162): n is a, c, g, or t
  misc_feature (3165)..(3165): n is a, c, g, or t
  misc_feature (3168)..(3169): n is a, c, g, or t
  misc_feature (3172)..(3172): n is a, c, g, or t
  misc_feature (3174)..(3179): n is a, c, g, or t
  misc_feature (3181)..(3182): n is a, c, g, or t
  misc_feature (3184)..(3186): n is a, c, g, or t
  misc_feature (3188)..(3192): n is a, c, g, or t
  misc_feature (3194)..(3194): n is a, c, g, or t
  misc_feature (3197)..(3197): n is a, c, g, or t
  misc_feature (3201)..(3202): n is a, c, g, or t
  misc_feature (3205)..(3206): n is a, c, g, or t
  misc_feature (3208)..(3210): n is a, c, g, or t
  misc_feature (3213)..(3213): n is a, c, g, or t
  misc_feature (3215)..(3217): n is a, c, g, or t
  misc_feature (3220)..(3220): n is a, c, g, or t
  misc_feature (3227)..(3228): n is a, c, g, or t
  misc_feature (3230)..(3230): n is a, c, g, or t
  misc_feature (3235)..(3240): n is a, c, g, or t
  misc_feature (3242)..(3242): n is a, c, g, or t
  misc_feature (3244)..(3246): n is a, c, g, or t
  misc_feature (3249)..(3249): n is a, c, g, or t
  misc_feature (3253)..(3253): n is a, c, g, or t
  misc_feature (3256)..(3257): n is a, c, g, or t
  misc_feature (3260)..(3260): n is a, c, g, or t
  misc_feature (3262)..(3269): n is a, c, g, or t
  misc_feature (3272)..(3274): n is a, c, g, or t
  misc_feature (3278)..(3280): n is a, c, g, or t
  misc_feature (3282)..(3283): n is a, c, g, or t
  misc_feature (3285)..(3287): n is a, c, g, or t
  misc_feature (3289)..(3290): n is a, c, g, or t
  misc_feature (3292)..(3294): n is a, c, g, or t
  misc_feature (3297)..(3297): n is a, c, g, or t
  misc_feature (3299)..(3299): n is a, c, g, or t
  misc_feature (3301)..(3302): n is a, c, g, or t
  misc_feature (3306)..(3307): n is a, c, g, or t
  misc_feature (3309)..(3309): n is a, c, g, or t
  misc_feature (3311)..(3312): n is a, c, g, or t
  misc_feature (3314)..(3315): n is a, c, g, or t
  misc_feature (3321)..(3321): n is a, c, g, or t
  misc_feature (3323)..(3323): n is a, c, g, or t
  misc_feature (3325)..(3325): n is a, c, g, or t
  misc_feature (3328)..(3328): n is a, c, g, or t
  misc_feature (3331)..(3331): n is a, c, g, or t
  misc_feature (3333)..(3334): n is a, c, g, or t
  misc_feature (3336)..(3337): n is a, c, g, or t
  misc_feature (3340)..(3340): n is a, c, g, or t
  misc_feature (3342)..(3343): n is a, c, g, or t
  misc_feature (3346)..(3349): n is a, c, g, or t
  misc_feature (3353)..(3353): n is a, c, g, or t
  misc_feature (3355)..(3356): n is a, c, g, or t
  misc_feature (3358)..(3359): n is a, c, g, or t
  misc_feature (3362)..(3362): n is a, c, g, or t
  misc_feature (3364)..(3364): n is a, c, g, or t
  misc_feature (3366)..(3366): n is a, c, g, or t
  misc_feature (3370)..(3373): n is a, c, g, or t
  misc_feature (3375)..(3377): n is a, c, g, or t
  misc_feature (3379)..(3380): n is a, c, g, or t
  misc_feature (3382)..(3382): n is a, c, g, or t
  misc_feature (3385)..(3385): n is a, c, g, or t
  misc_feature (3389)..(3389): n is a, c, g, or t
  misc_feature (3392)..(3393): n is a, c, g, or t
  misc_feature (3396)..(3399): n is a, c, g, or t
  misc_feature (3401)..(3401): n is a, c, g, or t
  misc_feature (3404)..(3404): n is a, c, g, or t
  misc_feature (3407)..(3407): n is a, c, g, or t
  misc_feature (3411)..(3411): n is a, c, g, or t
  misc_feature (3415)..(3415): n is a, c, g, or t
  misc_feature (3417)..(3417): n is a, c, g, or t
  misc_feature (3420)..(3420): n is a, c, g, or t
  misc_feature (3422)..(3422): n is a, c, g, or t
  misc_feature (3424)..(3433): n is a, c, g, or t
  misc_feature (3435)..(3438): n is a, c, g, or t
  misc_feature (3440)..(3446): n is a, c, g, or t
  misc_feature (3448)..(3449): n is a, c, g, or t
  misc_feature (3452)..(3453): n is a, c, g, or t
  misc_feature (3459)..(3461): n is a, c, g, or t
  misc_feature (3463)..(3463): n is a, c, g, or t
  misc_feature (3465)..(3466): n is a, c, g, or t
  misc_feature (3470)..(3470): n is a, c, g, or t
  misc_feature (3474)..(3474): n is a, c, g, or t
  misc_feature (3477)..(3484): n is a, c, g, or t
  misc_feature (3487)..(3488): n is a, c, g, or t
  misc_feature (3491)..(3496): n is a, c, g, or t
  misc_feature (3499)..(3501): n is a, c, g, or t
  misc_feature (3503)..(3506): n is a, c, g, or t
  misc_feature (3509)..(3509): n is a, c, g, or t
  misc_feature (3511)..(3512): n is a, c, g, or t
  misc_feature (3514)..(3516): n is a, c, g, or t
  misc_feature (3518)..(3519): n is a, c, g, or t
  misc_feature (3521)..(3522): n is a, c, g, or t
  misc_feature (3524)..(3526): n is a, c, g, or t
  misc_feature (3530)..(3535): n is a, c, g, or t
  misc_feature (3538)..(3542): n is a, c, g, or t
  misc_feature (3546)..(3546): n is a, c, g, or t
  misc_feature (3548)..(3548): n is a, c, g, or t
  misc_feature (3553)..(3553): n is a, c, g, or t
  misc_feature (3558)..(3559): n is a, c, g, or t
  misc_feature (3562)..(3562): n is a, c, g, or t
  misc_feature (3564)..(3564): n is a, c, g, or t
  misc_feature (3566)..(3567): n is a, c, g, or t
  misc_feature (3576)..(3576): n is a, c, g, or t
  misc_feature (3578)..(3580): n is a, c, g, or t
  misc_feature (3582)..(3582): n is a, c, g, or t
  misc_feature (3585)..(3586): n is a, c, g, or t
  misc_feature (3589)..(3591): n is a, c, g, or t
  misc_feature (3593)..(3593): n is a, c, g, or t
  misc_feature (3596)..(3597): n is a, c, g, or t
  misc_feature (3599)..(3603): n is a, c, g, or t
  misc_feature (3605)..(3607): n is a, c, g, or t
  misc_feature (3609)..(3614): n is a, c, g, or t
  misc_feature (3616)..(3617): n is a, c, g, or t
  misc_feature (3619)..(3621): n is a, c, g, or t
  misc_feature (3624)..(3624): n is a, c, g, or t
  misc_feature (3628)..(3629): n is a, c, g, or t
  misc_feature (3631)..(3631): n is a, c, g, or t
  misc_feature (3636)..(3638): n is a, c, g, or t
  misc_feature (3640)..(3643): n is a, c, g, or t
  misc_feature (3648)..(3662): n is a, c, g, or t
  misc_feature (3664)..(3664): n is a, c, g, or t
  misc_feature (3666)..(3666): n is a, c, g, or t
  misc_feature (3671)..(3685): n is a, c, g, or t
  misc_feature (3689)..(3689): n is a, c, g, or t
  misc_feature (3692)..(3695): n is a, c, g, or t
  misc_feature (3698)..(3698): n is a, c, g, or t
  misc_feature (3700)..(3704): n is a, c, g, or t
  misc_feature (3708)..(3709): n is a, c, g, or t
  misc_feature (3711)..(3711): n is a, c, g, or t
  misc_feature (3715)..(3715): n is a, c, g, or t
  misc_feature (3717)..(3717): n is a, c, g, or t
  misc_feature (3719)..(3719): n is a, c, g, or t
  misc_feature (3722)..(3723): n is a, c, g, or t
  misc_feature (3727)..(3732): n is a, c, g, or t
  misc_feature (3734)..(3737): n is a, c, g, or t
  misc_feature (3741)..(3741): n is a, c, g, or t
  misc_feature (3744)..(3745): n is a, c, g, or t
  misc_feature (3748)..(3751): n is a, c, g, or t
  misc_feature (3754)..(3756): n is a, c, g, or t
  misc_feature (3758)..(3758): n is a, c, g, or t
  misc_feature (3760)..(3760): n is a, c, g, or t
  misc_feature (3762)..(3762): n is a, c, g, or t
  misc_feature (3768)..(3769): n is a, c, g, or t
  misc_feature (3771)..(3773): n is a, c, g, or t
  misc_feature (3775)..(3775): n is a, c, g, or t
  misc_feature (3777)..(3777): n is a, c, g, or t
  misc_feature (3781)..(3781): n is a, c, g, or t
  misc_feature (3785)..(3785): n is a, c, g, or t
  misc_feature (3787)..(3788): n is a, c, g, or t
  misc_feature (3791)..(3794): n is a, c, g, or t
  misc_feature (3797)..(3798): n is a, c, g, or t
  misc_feature (3801)..(3801): n is a, c, g, or t
  misc_feature (3804)..(3808): n is a, c, g, or t
  misc_feature (3810)..(3815): n is a, c, g, or t
  misc_feature (3817)..(3818): n is a, c, g, or t
  misc_feature (3821)..(3826): n is a, c, g, or t
  misc_feature (3828)..(3832): n is a, c, g, or t
  misc_feature (3834)..(3836): n is a, c, g, or t
  misc_feature (3838)..(3838): n is a, c, g, or t
  misc_feature (3840)..(3840): n is a, c, g, or t
  misc_feature (3843)..(3843): n is a, c, g, or t
  misc_feature (3845)..(3846): n is a, c, g, or t
  misc_feature (3850)..(3850): n is a, c, g, or t
  misc_feature (3854)..(3856): n is a, c, g, or t
  misc_feature (3860)..(3863): n is a, c, g, or t
  misc_feature (3865)..(3868): n is a, c, g, or t
  misc_feature (3870)..(3871): n is a, c, g, or t
  misc_feature (3874)..(3876): n is a, c, g, or t
  misc_feature (3878)..(3881): n is a, c, g, or t
  misc_feature (3883)..(3893): n is a, c, g, or t
  misc_feature (3895)..(3897): n is a, c, g, or t
  misc_feature (3899)..(3900): n is a, c, g, or t
  misc_feature (3904)..(3913): n is a, c, g, or t
  misc_feature (3917)..(3917): n is a, c, g, or t
  misc_feature (3919)..(3919): n is a, c, g, or t
  misc_feature (3921)..(3923): n is a, c, g, or t
  misc_feature (3926)..(3927): n is a, c, g, or t
  misc_feature (3931)..(3931): n is a, c, g, or t
  misc_feature (3934)..(3934): n is a, c, g, or t
  misc_feature (3937)..(3941): n is a, c, g, or t
  misc_feature (3944)..(3945): n is a, c, g, or t
  misc_feature (3947)..(3950): n is a, c, g, or t
  misc_feature (3955)..(3958): n is a, c, g, or t
  misc_feature (3960)..(3962): n is a, c, g, or t
  misc_feature (3964)..(3966): n is a, c, g, or t
  misc_feature (3968)..(3969): n is a, c, g, or t
  misc_feature (3972)..(3975): n is a, c, g, or t
  misc_feature (3977)..(3978): n is a, c, g, or t
  misc_feature (3981)..(3981): n is a, c, g, or t
  misc_feature (3983)..(3988): n is a, c, g, or t
  misc_feature (3991)..(3996): n is a, c, g, or t
  misc_feature (3998)..(4000): n is a, c, g, or t
gtagtgcctcggatgttttccgatgggggtagagcactggatggatgcgggggtcgcgagatctaccaattctaaccaaactccgaataccatcgagttagtccgggagacagacggcgggtgctaaggtccgtcgtcaaaagggaaacagccctaacctacagctaaggtccccaaatcatatctaagtggtgaagcatgtgggatttccaaaacaaccaggaggttggcttagaagcagccatcctttaaagaaagcgtaacagctcactggtctaaataagagatcctgcggcgaaaatgtaacggggctaaagatatgtaccgaagcttagggtgtgcaatttattgcatgcggtagcggagcgttccgtaggccgatgaagcgatctggtaatgggtcgtggaggtatcggaagtgcgaatgcagacatgagtagcgataggagggtgagacaccctcccgccgaaagaccaagggttcctgcttaaagctaatctgagcagggtaagccggcccctaagacgagcccgaagggggtagtcgatgggaaccacgttaatattcgtgggcctggtggtgtgtgacggatctcgtgagttgtatctccttattggattggaggtgcttcgaagaggttccaggaaatagccccaccgtatagaccgtacccgaaaccgacacaggtggtcaggtagagtataccaaggcgtttgagagaagtatcctgaaggaactcggcaaattgcctccgtaccttcggaagaaggaggccctcacattgcgcaagcagtatgagggggcacaggccagggggtagcgactgtttagcaaaaacacaggactctgctaagtcggcttcaagacgacgtatagggtctgacgcctgcccggtgctggaaggttaagaggaggagtgcaagctccgaattgaagccccagtaaacggcggccgtaactataacggtcctaaggtagcgaaattccttgtcgggtaagttccgacctgcacgaatggcgtaacgacttccccactgtctccaggatatgctcagcgaaattgaattctccgtgaagatgcggagtacccgcggttagacggaaagaccccgtgcacctttactgcagcttcagagtggcattaggaaagaactgtgtagaataggtgggaggctttgaaacttgggcgccagtccgagtggagccgaaatgtgaaataccaccctgttgttttctgatgtctaacctcgcaccgttatccggtgcagggaccctctgtggcgggtagtttgactggggcggtcgcctcctaaagagtaacggaggcgcgcgatggtaggctcaggacggttggaaaccgtctgttagagtgcaatggcataagcctgcctgactgcgagactgacgagtcgagcagagacgaaagtcggtcatagtgatccggtggtccctcgtggaagggccatcgctcaacggataaaaggtacgccggggataacaggctgatgattcccaagagctcatatcgacggaatcgtttggcacctcgatgtcggctcatcacatcctggggctggagcaggtcccaagggtttggctgttcgccaattaaagtggtacgtgagctgggttcagaacgtcgcgagacagtttggtccctatctgccgtgggcgtcgaaatttgagaggagttgaccctagtacgagaggaccgggttgaacatacctctggtgtacctgtcgtggcgccagccgcgcagcagggtagctatgtatggacgggataaccgctgaaagcatctaagcgggaagcctccctcgagattagatttcatcgagtcgtagtagaccactacgttgataggttgggtgtggaagcgcagtaatgcgtgaagctaaccaatcctaattactcttttcgcgcttgaagtcccaccatcaatgacantgctganntntnnnnnangtcgntggcggatgattanatcgcaaccagataaatattccctgcacgggcatcgattataacccaaattcacttgttagtgagcgcctgcttcattgcttggtgaccatagcgtttgtgacccacccgatcccatcccgaactcggccgtgaaaccaaactgcgccgatggtactaccgcttaagcgttggaagagtagggcgtcgccaggcattgnagccggcgctnnnnannnaagtgcattggaagaacccattcataattcaaaaggcggaccgctgtcgttcattcgacggatgtccgccttttttcgtttttgccccgttgaaatacaggnnattttggtnnngcgggatggagcagcccgnnnncnnntnnnnnncnnaannngnnnnncnnannnnnnnnncnnncnnnngnnannnnnnttcnttgntngcnngggnnggnnnnnncnggtagctnnncnggntnntannntgnnggtcgtnggttcaaanccnactcccgcnaccannannnnannnnnnnnnnnnngnnntnnnntgtnnnntntnnnnnnannnntgnnnnnnntnnggncnntnnnnnnttnnnnnngnnannnagngnnnnnnnnngnnnntttnnnnnnnnnngnnnnnnnnntgnngnnnaannnnnnnnnnatnnnngnngnncnnnnggtttnnnnnnntcnnnnanncngncnannnngtnnnnnntntncnnnnnnngnagncnnngnctnnnnntccncnnnngnanncannnnnnnnannnnncnnatnnctncnncnntnnntngccnccnnntnannnnnnncnncnnangcnnnnnccntnnnnnnnnngnnncnnnngcnnangnnnnnatnnnncnnnnngcnntnnnnnancanngnccgnntnnncttgncncnnngngnnnnnnnantccggnngnncncntnnnnnnngnnnncgngntacnaannnnnnnnnnaannncnnantgcgnagnnnntnantannnncncgannnnccannnnnnnggcgncnnntctgnngannntnnnnnnnntgnnnncaaggnncnnnnnnccnncngcnnnaanntcancgncgngcntnacnanntgcngannnngntnntcnnnncgnnnttnagccnnttcnnntannccgncgcntcngnnggnncnnnatntanngcnttnnccntnnnnnnanncnnngnnnnntncancgcnntgnntnnnatngnnncgnatccggnntnaacannnnnngntnnncantctncgnnccncnnnnnnnncgnnntgannngnntnnntnngnnntcnancnntcanngncnncnngccatntncngtnagngnngnnccngnnaannnngatncnntnnccnangncggnnnngnnngnncnggntttnttnncannnncngtnganttgnacgngnagngntnnnnnnnnnnannnncnnnnnnngnnaanncgagcnnngntnnttcncacntcnnnnnnnnagnnccnnnnnntcnnncnnnncantnncnnncnncnncnnngccnnnnnnttnnnnngcancntgtgnctgannaangncnncgtcggtcngnnntnccnntannntntcnncnnnnntnnngnnnnnngnngnnncanagcnncnatgcnnngnnnnctcgnnnnnnnnnnnnnnngntngagcnnnnnnnnnnnnnnngccngannnnccngnnnnnaganncngcangncnggnnttgnnnnnnannnnttcntcnncannnnccnnnancngncgtcgnnannncncntatncttnanngcnnnnacnncgnttnnnnntnnnnnntnntcnnnnnntnnnnncnnngncngcntnnatgncacnnnaaannnngnnnntnngtnnncnnnntnnnnnnnnnnntnnngnnaacnnnnnnnnnnatgngngnnnccnngccngcncannnnnctnntnnnnagcgnnnngnnncnnnannggnnnnanncgncnnnnnngtnnnnnnannn

SEQ ID NO: 1087 - DNA, 4000 bp, Escherichia coli
  misc_feature (108)..(108): n is a, c, g, or t
  misc_feature (307)..(307): n is a, c, g, or t
  misc_feature (617)..(617): n is a, c, g, or t
  misc_feature (776)..(776): n is a, c, g, or t
  misc_feature (2257)..(2257): n is a, c, g, or t
  misc_feature (2520)..(2520): n is a, c, g, or t
  misc_feature (2829)..(2829): n is a, c, g, or t
  misc_feature (2837)..(2837): n is a, c, g, or t
  misc_feature (2960)..(2960): n is a, c, g, or t
  misc_feature (3011)..(3011): n is a, c, g, or t
  misc_feature (3110)..(3110): n is a, c, g, or t
  misc_feature (3119)..(3119): n is a, c, g, or t
  misc_feature (3182)..(3182): n is a, c, g, or t
  misc_feature (3199)..(3199): n is a, c, g, or t
  misc_feature (3201)..(3201): n is a, c, g, or t
  misc_feature (3395)..(3395): n is a, c, g, or t
  misc_feature (3443)..(3443): n is a, c, g, or t
  misc_feature (3705)..(3705): n is a, c, g, or t
aaaacctgggatacgcagggcgtcgacaagcacgaacccgggccgggtatccagcgcggccaccgcacgccgcatgccggaaacgttggcgtcctggatgccgtgggnatcaatgtcctgtgcggagaccagcaccacggcccatgacagcgcgtggttcttcaccagcgggaaaaggcgctggcgctggcgtgctgtgagttttttagaatcggtgagttccgccagatctgtgatcgggtgatccggcaagatgcatgcggcgatagcaataggaccggcgcatgcaccccgacccgcctcatcnacccccgcgaccgggccgagaccactcttggatagggtgacctcgtacgtacggagctgctttaacgtgcgcaccgtgcggatgttagtgctgaatatctgggtcgtccactaggcccattcggccaagcggaagcgcaatggctacaaccttgcccacaatgttcttctcggggatggtgccctggtactggtcggccatgtgatagcgggaatccgcagaattagtgcggttgtcgcccatcacaaagacattcccttcaggcaccttcacggggccgaagtagggaccaccacatgcttccgacccngtggactgatccaccgggtaggcgggcggctgcagcgtgtaggaagaatcaatcactttgccattgactttcacgcccgtatccccggcttggcattccactgtctgaccaccagtcgcaataacgcgcttgaccaggtcattctgatccggcgcaacnacccccaccatggacccgaggttctgcagaccacgaatcagagggttggaggagcggcgtgaatcgtagttagcattccacgactcggtgcccgcaaacaccaccacgtcccccggctttgggctgccgaaacgatacgaaattttctccacataaatgcggtcgcctgtgcaaccactacacccgtgcagcgtaggttccatcgactcactcggaataacatacaggcgaccaacaaacgtgtgcagcaacccaatgatcaggatggtggtgaacaccacgacggggatctcgatgtaccacggcagctgccgacggccatcgtccccccgcttattcttcttacgaccagcatcgcggtcatcgtcgtggcgatcatcagcccggctgctgtctacgcgaaagttatcgttcgagtcagtcacgaaagaaaactctaccagttacatcggaaaccctaaacagacttttatacgtctcacatctactaccctcgccacgctagcggtagtacacacaaaaacgccccgcttcatctccgaaacggggcgtcgtgtccatcctgtggatcacatcaagaaaccaagcactactgctcgcggtattccttgatcttggctgccttaccacgcagattacgcaggtagtacagcttagcgcggcgaaccttaccgcgggagacaacctcaatcttgtcgatgttgggtgagtgcaccgggaaagtacgctccacaccaataccgaaagaaatcttacgaaccgtaaaggtctcacggatgccaccgttctgacggcggataacaacacccttgaaaacctgaatacgggacttgtcaccctcaatgaccttcacgtgaacgttcacagtgtcgccggggcggaatttcggaatatcgtcgcgcaactgtgcggcatcgaccttatccagaatgttcatagaaacaatccttaagttctgtaatagaaagaggaacctggcggcgcttcccaccgcaccatcgcgcggtgactaattgggcgctcggccggctcgtatccgagacatgacgtgccactgccaggccaagaccaagcagacaactgcgcaattttcgcacatgaagcgctgtggcgtcaaaaatcgatgcaacaagacgcacatacaacgcctcctgttgacagcacaacaactcatcactactttggtgaacatgttcactgaacctgttcaccctggcgtgttacgcagatgggatcactcatgaccgcacgacaagaacaacgcttggccacagaaaacaccatccttgccactgcagaacagcactttgtcacgcacggataccagaacgcgaccatccgcgccatcgccgcagaagccaatgtgagcactggctccgtcatgtcggttggcgataagaaaacgctgctcatcaggatttttgacacaaagattgcagccatccaccaatcgcgcaacggccacactggcattgctgacncgcccaaccccaccgacgcagtgctggccaccgtctctccattccttacgattttcgccaagcacttggacctatcccgcgagtactttgccacgctggtcagcggctcgcactcctcgatcatcttcaacgaactcgccgaagcgcttgaacgagaatttgcagaactcatcacgcacttcttaccccagcacgctgacaccgccgccagcgctgcccacgcactctacctgggtttcttaggggtgctggtggtatgggcnggcagtgtcgatgccactgtgggcgacgtccagcttcccaccactgagctgcgccgcttcgtcgatttctttttcacctcgcaaggggcacactcatgaacatccttgtactcggggcaacggggaccattggcacaccgctgacacaacgtctccatgacgacgggcacgctgtaaccgcctggtcacgacgtacacatggtgacctctccacacagctcattccgttggacatggtggaagggacagaactgatcatcgacgtcaccgacgccaaacgccgcagctccatgctccccacaatggccnccagtgtngtctccagcgttcaccgcgccgctgtcacaccccgcatcctctgcctgggcatcctcaaccaggacaaaagcacattctcgtattacaaacacaagcaacaacaacatcaggtctacgcatcntccggtctcccctacaccgccgtacgatgcacacaattcaccacatttctnacctcgcttttcgacgccgcaacgcccaccggcctcatcccactaccgacaggggctcggtggcagttgattgatccacgggacgtcgctacgcagctngcatgcctnccccaatcagatgtattgaccctcgctggaccagaaaccctgacatcacgcgaggctgccgancggtatcgcacagcacncngaagcaagcgcatccttgttaacctgcgcgttcccggtgcgttcggcaagtttctgcgtgaagggctgaatctgacaactgaaccggacgctatgggcaccctcacgtaccaaggaaggtaatcaatgactctttttctcgccatcgtcctactcgccgacgtcgccatgtccatacgtcccatggcgttcatncgcgcgtgcctgagcggggtgaacctgccggaaaacttctggtgggtnctgctcgtgatcaaaaccctggcagctgcgggcctcatcgccgaccactggcttgccgacgccggatacgcgggcgtcgggctggcagccaccgtgggcgtggtggtgtacttcctgtgtgccgtcgtggcacacattcgggcgcatttcctgggcagggaattctggctaaattgcctgggaatgttggcactctctctggtcacgctgggttttgtcgtgctatgaccagtcgtactgtgaccagtcgatgaccacagcnccttagttaccaaaacctgcttttcgcagtgcatcagccatgctgccgcccgcagtgtcgttgcggtcattgcggcgctggcgttggctgcgtccattcccacgttgttgacggggcttcttaccggcttgcccacccttcgacttcttcggcccctttgctccgggttcatcattcaaccgcagcgataggccgatgcgctgacgatctacatccacttccatgaccttcaccttgacgacctggccggaacgcaccaccgtgtgcgggtcatccacaaacgtgtccgacatag

SEQ ID NO: 1088 - DNA, 4000 bp, Escherichia coli
  misc_feature (975)..(975): n is a, c, g, or t
  misc_feature (1959)..(1959): n is a, c, g, or t
  misc_feature (1985)..(1985): n is a, c, g, or t
  misc_feature (1988)..(1988): n is a, c, g, or t
  misc_feature (2389)..(2389): n is a, c, g, or t
  misc_feature (2721)..(2721): n is a, c, g, or t
  misc_feature (2724)..(2724): n is a, c, g, or t
  misc_feature (2726)..(2727): n is a, c, g, or t
  misc_feature (2736)..(2743): n is a, c, g, or t
  misc_feature (2745)..(2747): n is a, c, g, or t
  misc_feature (2750)..(2750): n is a, c, g, or t
  misc_feature (2752)..(2752): n is a, c, g, or t
  misc_feature (2755)..(2757): n is a, c, g, or t
  misc_feature (2760)..(2760): n is a, c, g, or t
  misc_feature (2762)..(2763): n is a, c, g, or t
  misc_feature (2765)..(2766): n is a, c, g, or t
  misc_feature (2769)..(2769): n is a, c, g, or t
  misc_feature (2771)..(2772): n is a, c, g, or t
  misc_feature (2775)..(2775): n is a, c, g, or t
  misc_feature (2780)..(2781): n is a, c, g, or t
  misc_feature (2784)..(2784): n is a, c, g, or t
  misc_feature (2786)..(2786): n is a, c, g, or t
  misc_feature (2788)..(2789): n is a, c, g, or t
  misc_feature (2791)..(2791): n is a, c, g, or t
  misc_feature (2793)..(2796): n is a, c, g, or t
  misc_feature (2798)..(2798): n is a, c, g, or t
  misc_feature (2800)..(2802): n is a, c, g, or t
  misc_feature (2804)..(2805): n is a, c, g, or t
  misc_feature (2808)..(2808): n is a, c, g, or t
  misc_feature (2810)..(2812): n is a, c, g, or t
  misc_feature (2814)..(2814): n is a, c, g, or t
  misc_feature (2816)..(2817): n is a, c, g, or t
  misc_feature (2820)..(2820): n is a, c, g, or t
  misc_feature (2822)..(2824): n is a, c, g, or t
  misc_feature (2826)..(2827): n is a, c, g, or t
  misc_feature (2829)..(2829): n is a, c, g, or t
  misc_feature (2831)..(2832): n is a, c, g, or t
  misc_feature (2834)..(2834): n is a, c, g, or t
  misc_feature (2836)..(2836): n is a, c, g, or t
  misc_feature (2839)..(2839): n is a, c, g, or t
  misc_feature (2841)..(2843): n is a, c, g, or t
  misc_feature (2846)..(2850): n is a, c, g, or t
  misc_feature (2852)..(2853): n is a, c, g, or t
  misc_feature (2857)..(2860): n is a, c, g, or t
  misc_feature (2862)..(2862): n is a, c, g, or t
  misc_feature (2865)..(2865): n is a, c, g, or t
  misc_feature (2867)..(2867): n is a, c, g, or t
  misc_feature (2870)..(2870): n is a, c, g, or t
  misc_feature (2872)..(2872): n is a, c, g, or t
  misc_feature (2875)..(2875): n is a, c, g, or t
  misc_feature (2877)..(2878): n is a, c, g, or t
  misc_feature (2882)..(2882): n is a, c, g, or t
  misc_feature (2884)..(2884): n is a, c, g, or t
  misc_feature (2886)..(2888): n is a, c, g, or t
  misc_feature (2891)..(2891): n is a, c, g, or t
  misc_feature (2894)..(2896): n is a, c, g, or t
  misc_feature (2898)..(2899): n is a, c, g, or t
  misc_feature (2903)..(2904): n is a, c, g, or t
  misc_feature (2908)..(2908): n is a, c, g, or t
  misc_feature (2910)..(2915): n is a, c, g, or t
  misc_feature (2921)..(2922): n is a, c, g, or t
  misc_feature (2924)..(2924): n is a, c, g, or t
  misc_feature (2927)..(2928): n is a, c, g, or t
  misc_feature (2930)..(2931): n is a, c, g, or t
  misc_feature (2933)..(2935): n is a, c, g, or t
  misc_feature (2937)..(2940): n is a, c, g, or t
  misc_feature (2944)..(2946): n is a, c, g, or t
  misc_feature (2948)..(2949): n is a, c, g, or t
  misc_feature (2951)..(2952): n is a, c, g, or t
  misc_feature (2954)..(2954): n is a, c, g, or t
  misc_feature (2957)..(2957): n is a, c, g, or t
  misc_feature (2963)..(2964): n is a, c, g, or t
  misc_feature (2966)..(2967): n is a, c, g, or t
  misc_feature (2969)..(2969): n is a, c, g, or t
  misc_feature (2971)..(2976): n is a, c, g, or t
  misc_feature (2978)..(2979): n is a, c, g, or t
  misc_feature (2981)..(2985): n is a, c, g, or t
  misc_feature (2987)..(2991): n is a, c, g, or t
  misc_feature (2993)..(2993): n is a, c, g, or t
  misc_feature (2995)..(2997): n is a, c, g, or t
  misc_feature (2999)..(3000): n is a, c, g, or t
  misc_feature (3002)..(3003): n is a, c, g, or t
  misc_feature (3005)..(3005): n is a, c, g, or t
  misc_feature (3007)..(3015): n is a, c, g, or t
  misc_feature (3018)..(3018): n is a, c, g, or t
  misc_feature (3020)..(3020): n is a, c, g, or t
  misc_feature (3023)..(3024): n is a, c, g, or t
  misc_feature (3027)..(3027): n is a, c, g, or t
  misc_feature (3029)..(3037): n is a, c, g, or t
  misc_feature (3040)..(3041): n is a, c, g, or t
  misc_feature (3043)..(3043): n is a, c, g, or t
  misc_feature (3045)..(3048): n is a, c, g, or t
  misc_feature (3050)..(3051): n is a, c, g, or t
  misc_feature (3054)..(3054): n is a, c, g, or t
  misc_feature (3059)..(3061): n is a, c, g, or t
  misc_feature (3066)..(3073): n is a, c, g, or t
  misc_feature (3075)..(3075): n is a, c, g, or t
  misc_feature (3078)..(3079): n is a, c, g, or t
  misc_feature (3081)..(3081): n is a, c, g, or t
  misc_feature (3084)..(3085): n is a, c, g, or t
  misc_feature (3087)..(3087): n is a, c, g, or t
  misc_feature (3090)..(3090): n is a, c, g, or t
  misc_feature (3097)..(3097): n is a, c, g, or t
  misc_feature (3099)..(3099): n is a, c, g, or t
  misc_feature (3102)..(3103): n is a, c, g, or t
  misc_feature (3108)..(3109): n is a, c, g, or t
  misc_feature (3111)..(3111): n is a, c, g, or t
  misc_feature (3117)..(3117): n is a, c, g, or t
  misc_feature (3120)..(3121): n is a, c, g, or t
  misc_feature (3123)..(3123): n is a, c, g, or t
  misc_feature (3126)..(3127): n is a, c, g, or t
  misc_feature (3135)..(3135): n is a, c, g, or t
  misc_feature (3138)..(3138): n is a, c, g, or t
  misc_feature (3142)..(3144): n is a, c, g, or t
  misc_feature (3147)..(3147): n is a, c, g, or t
  misc_feature (3149)..(3150): n is a, c, g, or t
  misc_feature (3152)..(3153): n is a, c, g, or t
  misc_feature (3155)..(3156): n is a, c, g, or t
  misc_feature (3161)..(3162): n is a, c, g, or t
  misc_feature (3164)..(3164): n is a, c, g, or t
  misc_feature (3167)..(3167): n is a, c, g, or t
  misc_feature (3169)..(3169): n is a, c, g, or t
  misc_feature (3180)..(3180): n is a, c, g, or t
  misc_feature (3192)..(3192): n is a, c, g, or t
  misc_feature (3195)..(3195): n is a, c, g, or t
  misc_feature (3199)..(3199): n is a, c, g, or t
  misc_feature (3207)..(3207): n is a, c, g, or t
  misc_feature (3210)..(3210): n is a, c, g, or t
  misc_feature (3217)..(3217): n is a, c, g, or t
  misc_feature (3219)..(3219): n is a, c, g, or t
  misc_feature (3227)..(3228): n is a, c, g, or t
  misc_feature (3237)..(3237): n is a, c, g, or t
  misc_feature (3243)..(3243): n is a, c, g, or t
  misc_feature (3249)..(3249): n is a, c, g, or t
  misc_feature (3255)..(3255): n is a, c, g, or t
  misc_feature (3265)..(3265): n is a, c, g, or t
  misc_feature (3271)..(3273): n is a, c, g, or t
  misc_feature (3276)..(3276): n is a, c, g, or t
  misc_feature (3285)..(3285): n is a, c, g, or t
  misc_feature (3291)..(3291): n is a, c, g, or t
  misc_feature (3295)..(3295): n is a, c, g, or t
  misc_feature (3300)..(3300): n is a, c, g, or t
  misc_feature (3308)..(3308): n is a, c, g, or t
  misc_feature (3313)..(3313): n is a, c, g, or t
  misc_feature (3327)..(3328): n is a, c, g, or t
  misc_feature (3330)..(3330): n is a, c, g, or t
  misc_feature (3338)..(3338): n is a, c, g, or t
  misc_feature (3342)..(3343): n is a, c, g, or t
  misc_feature (3363)..(3365): n is a, c, g, or t
  misc_feature (3369)..(3369): n is a, c, g, or t
  misc_feature (3371)..(3371): n is a, c, g, or t
  misc_feature (3374)..(3374): n is a, c, g, or t
  misc_feature (3376)..(3376): n is a, c, g, or t
  misc_feature (3383)..(3383): n is a, c, g, or t
  misc_feature (3386)..(3386): n is a, c, g, or t
  misc_feature (3388)..(3388): n is a, c, g, or t
  misc_feature (3390)..(3390): n is a, c, g, or t
  misc_feature (3392)..(3392): n is a, c, g, or t
  misc_feature (3396)..(3396): n is a, c, g, or t
  misc_feature (3400)..(3400): n is a, c, g, or t
  misc_feature (3402)..(3403): n is a, c, g, or t
  misc_feature (3411)..(3411): n is a, c, g, or t
  misc_feature (3415)..(3415): n is a, c, g, or t
  misc_feature (3428)..(3428): n is a, c, g, or t
  misc_feature (3430)..(3431): n is a, c, g, or t
  misc_feature (3433)..(3437): n is a, c, g, or t
  misc_feature (3440)..(3440): n is a, c, g, or t
  misc_feature (3442)..(3442): n is a, c, g, or t
  misc_feature (3444)..(3444): n is a, c, g, or t
  misc_feature (3446)..(3447): n is a, c, g, or t
  misc_feature (3449)..(3449): n is a, c, g, or t
  misc_feature (3451)..(3453): n is a, c, g, or t
  misc_feature (3455)..(3462): n is a, c, g, or t
  misc_feature (3464)..(3465): n is a, c, g, or t
  misc_feature (3467)..(3469): n is a, c, g, or t
  misc_feature (3471)..(3473): n is a, c, g, or t
ggcgcgaaaggctcgcgtccgctcgcgcccgcgggcaaggcggcgaaggccggcgcgctcgcggtcgtggcgatcggccgcttctccctgaagcgcgtcacgccctgggcgggcgtgctggcggtgcgcgtcttcggcagccacggcgcgttccaggcgctcagcgcggcgacgctcgcggtgaacgccgtgcgttgtcgtcgcgccgcgcgagcgctcaacgccgcgctcgcgcgcgcggcggagcggcgcgggaacggcgccgggttctggaagggcggtctgctcaacgaggacgcgacgacgaaagcgccatcggtggctgtcgcgggaggggcgcgtcttcgtgcgttcgacgacgccaaccacccgctggtgatattgcaggatcgcgcgcccgcgttgttccaccccgcgctgcgcgcgctcagtttgccaaccctcatcacgcatttgagcccgcgcgtgctgcgcctcgtcgcgccgggcgcgctgcgcacgctgcggttctacggccacctgctgccggtcgtcgccgggtacgtcaagtgcctcgtcgtggacgcccgcggcgtcttcgccggcgccaagctgagcgaggaggagaagcagaaggtgtgggacgcgaggcacgagtggggcgccgagcgcgttaaacgcatgatcctcgagctcggtgggttctacttgaaggtgggccaggtgttcgccacgaagtcggacctgctgccgccgcagtacatcgcggcgctcaagtcggtgttcgacgattgcgcgccggcgaacgcgagcgccatcgtgaagatcgtcgagaaggatctcggcgggtccgtggactcgctgttcgcggagtttgaccgcgcgcccatggccacggcgaccatcgcgcaggtgcacgtcgcgcggcttcgggacgcgccgcgcacgaaggtggcggtgaaggtgcaggtgcccggctcggagcgcctgatgaanatggacatgcggaacatgctggcggtttccgaattcgccgacgatcggctgcgcgtccggctgccgttcgaccacaccagcatcctgaaggagtacgcggttcaggtgcccctggagtttgacttcaagcgcgaggcgcagatgctgacggtgatcggcgccgccatccaggggcgcgtcccggatgtcaccacgccgcgcgccttcgagcgcctctcgtcgcggcgcgtgctgacgatgagcttcgtggagggcgagccgctcggggacatcatccagagggcgctgcgtggctccgcgggcggcccgcccggatcgcccatcagctcgtcgccggggtaccacgagcgcgccgccgcgggtatgcagacgaagggtggcgtctccgtggacggcaacgcgctggtggcgcgcttagtggaatcgtacggcacgcagatcttcggcatcgggcggttccactccgacccgcaccccgggaacgtgctcgtgggtgaggatggcaaaaccctgagcgtcatcgactttgggcaaacgaaggagttgcgcgacgaaacgaggctcgggatatgccgcctgattttggcgctcgccgcggaccgcgcggaggagacggcgcggtacgccgccgcgctcgggctgcaaatttccggcgcgagcgaagcgttcgccatgacggtgtgttacatcttgttcgacacgcgcatggacctgatcgaggcgcacctctcgcctctggacgcggtcgtgcctcccgagatgcggctggtgaagctggagacgattccggaggacatcttcatgctcatccgcgtcgtcgcgctgattcgcgggatgctcatctcgctcaacgccctcgacgtcaacgcgcggctcatctggcgcccctacgccatggccgcgctgcgcgccgccggcgaacgcgtgccgggctgggcgctggaccacgaggctgcggtggacgaggcggcggtgacgaccccnaacaagacgccgaacgccggcgccgncgncgccgccgccgccgacccgaagtcgggcgcggtgtacgggaagatgaaggcgttggccggctggatgcgcgccaacgatttgccgcacaaccgtaaggctttgacgcctttcgtcgccacgggtttgctcaccgtggagcacgtcgccgccgccatcgagcgcgaagaagaggacaagctcgcgcgggcgttcctgatgttctcgcccgaggacgccaagcggtgccgcgcgatcgcgatgcgcgtcgccgccggcgccgccgcgcgcatggacgccgaggaggcggccggaaaggagggcgccgagcggggcgtgaacgacgcggagaagcggctccgggaacgcgccgaggccaaggcgcgcgaggcgcgagacaagaagcacaagggcaaagggaaangttcgagcgagggcgcggacgcgcgcgacgacgacgtcgacgtatccgtcgtctcgatgaacatcctgacgtcgatgctgcggtggtcgtggcgcgccaagcgctacgtcgccgcggaggcaaaggcggaggcggcgcggctcgaggcggagaagaagcgcgcggcgaacatcgcgaagcgcgaggcggaggagaaggcggtgctcgaggcggcggcggagaaggcgcgggaggaggcggcggagaagaagaaggcggaagaggaagccgccgcgaagaagaagaagaaggcggaagaggaagccgccgcgaagaagaagaaggcggcggangangnngccgccgcnnnnnnnnannnggngncgnnngangnngnngcngnngcngccgnngcngngnngncnnnngngnnngnngangnnncngnngcngnnncnncngnngngnagncnnnggnnnnngnngcgnnnncnccngnggngnagncnncggngncnnnggnggnnncnnccgnngcgnannnnnnggcggnngnggnngnngnnncnnnngcgnnngnngnngnggnggcggnngnngngnnnnnngnngnnnnngnnnnngngnnngnngnngngnnnnnnnnngcngnggnngangnnnnnnnnnagnngnannnngnngcngaggnnnaggcnnnnnnnnangcnnangcnnangcngaggcgnangcnnaagcnnangcggangcnnangcnnaggcggangcngaannngangnngnngnngaggnngnggngnaagcgaaagcngacgcggcaganaangcgncggcggangcnaagacgncngcgacggnngccgcgtcngcgaangctacngccgangcggcgacgnccgcgnnngcngacgccgcngcggangcgncggcngccgccgncgcgncggccgaggcgganncngccgcggnagcnnccgcgtcggccgaggcggannncgcngnggngnaggcggngangnananggcnaacncnncgggggcnaagnggggggagaaagngnngnnnnnggngngngnngngnnngnnnnnnnngnngnnnannngccgacgtcctcggtcgccgccgccgcggcggatcccgccgccgccggccccgcgtcgcccgaggcggcgaatgccgcggtatcgtccgccttgggcacacctaagtcctcgggggcgaagggggggaagaaaggggggaagaagggggggaagaagggggggaaggggaagtgagcggcggtcgcgcccttcttcgttatcgaaatattttttcgtcgttgcgccgttcgcacagctttgcatcgctcgcagagagccgctctcgatattcttcgtccttcttttaacgggtcgcacttccccccacgcgcgccgccatggccaagaagcgcaagaacgtcgaccccgacgcgcccccgccgcctcagtggacgccgcccaccgacgacgtcgagtggcgcgactggatgaaggacagcttctggtgctccgacgacctgcgcaagtacggcgtcgcgcacagcgcgaaggcgtcttttaaaacgccgttccccgttttcgtcggtccggaccgcgcgtgtctctc

SEQ ID NO: 1089 - DNA, 4000 bp, Escherichia coli
  misc_feature (3)..(4): n is a, c, g, or t
  misc_feature (7)..(8): n is a, c, g, or t
  misc_feature (14)..(14): n is a, c, g, or t
  misc_feature (18)..(18): n is a, c, g, or t
  misc_feature (21)..(21): n is a, c, g, or t
  misc_feature (24)..(28): n is a, c, g, or t
  misc_feature (30)..(31): n is a, c, g, or t
  misc_feature (35)..(40): n is a, c, g, or t
  misc_feature (42)..(44): n is a, c, g, or t
  misc_feature (46)..(46): n is a, c, g, or t
  misc_feature (52)..(52): n is a, c, g, or t
  misc_feature (57)..(57): n is a, c, g, or t
  misc_feature (67)..(69): n is a, c, g, or t
  misc_feature (72)..(72): n is a, c, g, or t
  misc_feature (74)..(74): n is a, c, g, or t
  misc_feature (77)..(79): n is a, c, g, or t
  misc_feature (81)..(82): n is a, c, g, or t
  misc_feature (85)..(85): n is a, c, g, or t
  misc_feature (88)..(88): n is a, c, g, or t
  misc_feature (90)..(92): n is a, c, g, or t
  misc_feature (94)..(94): n is a, c, g, or t
  misc_feature (97)..(99): n is a, c, g, or t
  misc_feature (101)..(106): n is a, c, g, or t
  misc_feature (108)..(108): n is a, c, g, or t
  misc_feature (110)..(111): n is a, c, g, or t
  misc_feature (115)..(117): n is a, c, g, or t
  misc_feature (119)..(120): n is a, c, g, or t
  misc_feature (122)..(122): n is a, c, g, or t
  misc_feature (127)..(127): n is a, c, g, or t
  misc_feature (129)..(129): n is a, c, g, or t
  misc_feature (131)..(131): n is a, c, g, or t
  misc_feature (134)..(134): n is a, c, g, or t
  misc_feature (138)..(138): n is a, c, g, or t
  misc_feature (141)..(142): n is a, c, g, or t
  misc_feature (145)..(145): n is a, c, g, or t
  misc_feature (148)..(154): n is a, c, g, or t
  misc_feature (156)..(156): n is a, c, g, or t
  misc_feature (158)..(159): n is a, c, g, or t
  misc_feature (163)..(165): n is a, c, g, or t
  misc_feature (167)..(169): n is a, c, g, or t
  misc_feature (171)..(171): n is a, c, g, or t
  misc_feature (173)..(173): n is a, c, g, or t
  misc_feature (177)..(177): n is a, c, g, or t
  misc_feature (179)..(179): n is a, c, g, or t
  misc_feature (182)..(183): n is a, c, g, or t
  misc_feature (187)..(192): n is a, c, g, or t
  misc_feature (194)..(194): n is a, c, g, or t
  misc_feature (197)..(199): n is a, c, g, or t
  misc_feature (201)..(201): n is a, c, g, or t
  misc_feature (204)..(206): n is a, c, g, or t
  misc_feature (208)..(208): n is a, c, g, or t
  misc_feature (210)..(211): n is a, c, g, or t
  misc_feature (213)..(213): n is a, c, g, or t
  misc_feature (215)..(216): n is a, c, g, or t
  misc_feature (219)..(219): n is a, c, g, or t
  misc_feature (221)..(223): n is a, c, g, or t
  misc_feature (225)..(225): n is a, c, g, or t
  misc_feature (227)..(228): n is a, c, g, or t
  misc_feature (230)..(234): n is a, c, g, or t
  misc_feature (236)..(236): n is a, c, g, or t
  misc_feature (240)..(240): n is a, c, g, or t
  misc_feature (242)..(245): n is a, c, g, or t
  misc_feature (248)..(250): n is a, c, g, or t
  misc_feature (254)..(256): n is a, c, g, or t
  misc_feature (258)..(258): n is a, c, g, or t
  misc_feature (260)..(260): n is a, c, g, or t
  misc_feature (262)..(262): n is a, c, g, or t
  misc_feature (264)..(272): n is a, c, g, or t
  misc_feature (275)..(276): n is a, c, g, or t
  misc_feature (278)..(279): n is a, c, g, or t
  misc_feature (281)..(282): n is a, c, g, or t
  misc_feature (284)..(289): n is a, c, g, or t
  misc_feature (291)..(293): n is a, c, g, or t
  misc_feature (296)..(296): n is a, c, g, or t
  misc_feature (299)..(301): n is a, c, g, or t
  misc_feature (303)..(305): n is a, c, g, or t
  misc_feature (307)..(309): n is a, c, g, or t
  misc_feature (318)..(318): n is a, c, g, or t
  misc_feature (324)..(324): n is a, c, g, or t
  misc_feature (327)..(327): n is a, c, g, or t
  misc_feature (331)..(332): n is a, c, g, or t
  misc_feature (336)..(336): n is a, c, g, or t
  misc_feature (339)..(340): n is a, c, g, or t
  misc_feature (343)..(343): n is a, c, g, or t
  misc_feature (347)..(347): n is a, c, g, or t
  misc_feature (350)..(351): n is a, c, g, or t
  misc_feature (353)..(353): n is a, c, g, or t
  misc_feature (355)..(355): n is a, c, g, or t
  misc_feature (358)..(359): n is a, c, g, or t
  misc_feature (363)..(363): n is a, c, g, or t
  misc_feature (365)..(365): n is a, c, g, or t
  misc_feature (369)..(371): n is a, c, g, or t
  misc_feature (373)..(373): n is a, c, g, or t
  misc_feature (377)..(380): n is a, c, g, or t
  misc_feature (382)..(386): n is a, c, g, or t
  misc_feature (388)..(388): n is a, c, g, or t
  misc_feature (390)..(391): n is a, c, g, or t
  misc_feature (394)..(395): n is a, c, g, or t
  misc_feature (397)..(398): n is a, c, g, or t
  misc_feature (400)..(401): n is a, c, g, or t
  misc_feature (404)..(408): n is a, c, g, or t
  misc_feature (411)..(413): n is a, c, g, or t
  misc_feature (418)..(418): n is a, c, g, or t
  misc_feature (420)..(422): n is a, c, g, or t
  misc_feature (425)..(425): n is a, c, g, or t
  misc_feature (428)..(429): n is a, c, g, or t
  misc_feature (431)..(431): n is a, c, g, or t
  misc_feature (437)..(437): n is a, c, g, or t
  misc_feature (444)..(444): n is a, c, g, or t
  misc_feature (449)..(453): n is a, c, g, or t
  misc_feature (456)..(456): n is a, c, g, or t
  misc_feature (460)..(464): n is a, c, g, or t
  misc_feature (466)..(466): n is a, c, g, or t
  misc_feature (468)..(470): n is a, c, g, or t
  misc_feature (472)..(472): n is a, c, g, or t
  misc_feature (474)..(476): n is a, c, g, or t
  misc_feature (479)..(480): n is a, c, g, or t
  misc_feature (482)..(483): n is a, c, g, or t
  misc_feature (489)..(489): n is a, c, g, or t
  misc_feature (491)..(493): n is a, c, g, or t
  misc_feature (495)..(497): n is a, c, g, or t
  misc_feature (504)..(505): n is a, c, g, or t
  misc_feature (511)..(513): n is a, c, g, or t
  misc_feature (518)..(524): n is a, c, g, or t
  misc_feature (534)..(539): n is a, c, g, or t
  misc_feature (542)..(543): n is a, c, g, or t
  misc_feature (545)..(550): n is a, c, g, or t
  misc_feature (554)..(555): n is a, c, g, or t
  misc_feature (557)..(558): n is a, c, g, or t
  misc_feature (560)..(561): n is a, c, g, or t
  misc_feature (566)..(567): n is a, c, g, or t
  misc_feature (570)..(571): n is a, c, g, or t
  misc_feature (573)..(574): n is a, c, g, or t
  misc_feature (577)..(579): n is a, c, g, or t
  misc_feature (582)..(584): n is a, c, g, or t
  misc_feature (586)..(586): n is a, c, g, or t
  misc_feature (588)..(588): n is a, c, g, or t
  misc_feature (593)..(593): n is a, c, g, or t
  misc_feature (595)..(595): n is a, c, g, or t
  misc_feature (597)..(599): n is a, c, g, or t
  misc_feature (603)..(603): n is a, c, g, or t
  misc_feature (608)..(610): n is a, c, g, or t
  misc_feature (613)..(613): n is a, c, g, or t
  misc_feature (616)..(618): n is a, c, g, or t
  misc_feature (621)..(624): n is a, c, g, or t
  misc_feature (626)..(627): n is a, c, g, or t
  misc_feature (631)..(631): n is a, c, g, or t
  misc_feature (635)..(637): n is a, c, g, or t
  misc_feature (639)..(640): n is a, c, g, or t
  misc_feature (642)..(644): n is a, c, g, or t
  misc_feature (646)..(646): n is a, c, g, or t
  misc_feature (648)..(648): n is a, c, g, or t
  misc_feature (650)..(650): n is a, c, g, or t
  misc_feature (652)..(653): n is a, c, g, or t
  misc_feature (655)..(656): n is a, c, g, or t
  misc_feature (658)..(661): n is a, c, g, or t
  misc_feature (664)..(665): n is a, c, g, or t
  misc_feature (667)..(673): n is a, c, g, or t
  misc_feature (679)..(681): n is a, c, g, or t
  misc_feature (683)..(683): n is a, c, g, or t
  misc_feature (685)..(685): n is a, c, g, or t
  misc_feature (687)..(689): n is a, c, g, or t
  misc_feature (692)..(693): n is a, c, g, or t
  misc_feature (695)..(696): n is a, c, g, or t
  misc_feature (698)..(698): n is a, c, g, or t
  misc_feature (700)..(700): n is a, c, g, or t
  misc_feature (702)..(702): n is a, c, g, or t
  misc_feature (704)..(705): n is a, c, g, or t
  misc_feature (707)..(708): n is a, c, g, or t
  misc_feature (711)..(713): n is a, c, g, or t
  misc_feature (715)..(715): n is a, c, g, or t
  misc_feature (718)..(720): n is a, c, g, or t
  misc_feature (722)..(722): n is a, c, g, or t
  misc_feature (724)..(724): n is a, c, g, or t
  misc_feature (727)..(727): n is a, c, g, or t
  misc_feature (730)..(730): n is a, c, g, or t
  misc_feature (732)..(732): n is a, c, g, or t
  misc_feature (734)..(736): n is a, c, g, or t
  misc_feature (738)..(740): n is a, c, g, or t
  misc_feature (743)..(744): n is a, c, g, or t
  misc_feature (746)..(746): n is a, c, g, or t
  misc_feature (751)..(754): n is a, c, g, or t
  misc_feature (756)..(756): n is a, c, g, or t
  misc_feature (758)..(758): n is a, c, g, or t
  misc_feature (763)..(764): n is a, c, g, or t
  misc_feature (766)..(766): n is a, c, g, or t
  misc_feature (768)..(774): n is a, c, g, or t
  misc_feature (776)..(778): n is a, c, g, or t
  misc_feature (782)..(783): n is a, c, g, or t
  misc_feature (786)..(789): n is a, c, g, or t
  misc_feature (792)..(792): n is a, c, g, or t
  misc_feature (795)..(795): n is a, c, g, or t
  misc_feature (800)..(800): n is a, c, g, or t
  misc_feature (802)..(802): n is a, c, g, or t
  misc_feature (805)..(806): n is a, c, g, or t
  misc_feature (808)..(810): n is a, c, g, or t
  misc_feature (813)..(814): n is a, c, g, or t
  misc_feature (817)..(818): n is a, c, g, or t
  misc_feature (821)..(823): n is a, c, g, or t
  misc_feature (826)..(826): n is a, c, g, or t
  misc_feature (829)..(829): n is a, c, g, or t
  misc_feature (831)..(831): n is a, c, g, or t
  misc_feature (833)..(833): n is a, c, g, or t
  misc_feature (836)..(836): n is a, c, g, or t
  misc_feature (842)..(844): n is a, c, g, or t
  misc_feature (846)..(846): n is a, c, g, or t
  misc_feature (850)..(850): n is a, c, g, or t
  misc_feature (852)..(852): n is a, c, g, or t
  misc_feature (860)..(860): n is a, c, g, or t
  misc_feature (863)..(867): n is a, c, g, or t
  misc_feature (873)..(873): n is a, c, g, or t
  misc_feature (875)..(875): n is a, c, g, or t
  misc_feature (877)..(877): n is a, c, g, or t
  misc_feature (886)..(886): n is a, c, g, or t
  misc_feature (888)..(889): n is a, c, g, or t
  misc_feature (891)..(892): n is a, c, g, or t
  misc_feature (894)..(894): n is a, c, g, or t
  misc_feature (897)..(897): n is a, c, g, or t
  misc_feature (900)..(902): n is a, c, g, or t
  misc_feature (907)..(907): n is a, c, g, or t
  misc_feature (909)..(909): n is a, c, g, or t
  misc_feature (913)..(915): n is a, c, g, or t
  misc_feature (918)..(920): n is a, c, g, or t
  misc_feature (927)..(928): n is a, c, g, or t
  misc_feature (931)..(931): n is a, c, g, or t
  misc_feature (939)..(941): n is a, c, g, or t
  misc_feature (947)..(947): n is a, c, g, or t
  misc_feature (949)..(950): n is a, c, g, or t
  misc_feature (952)..(954): n is a, c, g, or t
  misc_feature (956)..(957): n is a, c, g, or t
  misc_feature (959)..(960): n is a, c, g, or t
  misc_feature (1303)..(1304): n is a, c, g, or t
  misc_feature (1307)..(1307): n is a, c, g, or t
  misc_feature (1309)..(1311): n is a, c, g, or t
  misc_feature (1315)..(1316): n is a, c, g, or t
  misc_feature (1319)..(1319): n is a, c, g, or t
  misc_feature (1325)..(1325): n is a, c, g, or t
  misc_feature (1330)..(1331): n is a, c, g, or t
  misc_feature (1366)..(1366): n is a, c, g, or t
  misc_feature (1390)..(1390): n is a, c, g, or t
  misc_feature (1410)..(1410): n is a, c, g, or t
  misc_feature (1424)..(1424): n is a, c, g, or t
  misc_feature (1986)..(1986): n is a, c, g, or t
  misc_feature (1992)..(1992): n is a, c, g, or t
  misc_feature (3569)..(3569): n is a, c, g, or t
ggnntanntgacgngggnggngannnnngnnatgnnnnnngnnngngcgccnggtgncgcgcgcgtnnnggngnggnnncnntgncgnannngncgnnngnnnnnncngnntttnnnanngnattgngnanatnattnaannaantcnnnnnnnancnnttgnnncnnngntngatngntgnnacgnnnnnnanatnnngnttnnnantnngntnnctngnnngncnngnnnnngntcgntnnnntgnnntttnnncnantnannnnnnnnncgnncnncnngnnnnnngnnntgntgnnngnnntnnngcgcgtagncggcgncgncgcnngcgncgnncgnctcntcnntngnttnntcgntngttnnntncgtnnnngnnnnngngnngcnncnnanncgnnnnnaannntcgtngnnngcntgnngnggcgcncgaggancgcgnnnnnganggcnnnnntnannncnannntcnncnnaatcgncnnnannntcgagannatccannngatcnnnnnnntcgtcgcggnnnnnncgnngnnnnnncggnngnnannaccgnngannannatnnngannngnancacgnanannncgangacgnnnatnatnnngannnncnncgtnaacnnncnnannnancntngnncnntnnnngcnncnnnnnnngcgacnnncngnannncgnncnncncncncnncnnccnnncnatnnngncnatngtngncnnngnnnatnncncgaannnncncncaaanncncnnnnnnncnnncgtnncgnnnncancgncgccncngcnncnnncgnngcnntcnnngcngcngntncgncggatnnnanggcncncatcgcgnccnnnnncgcgtntncntcggcgtcnanngnngncancgnnntcgtnancgcnnnggnnntttcgtnngcntcttcctnnncttccncnngnnncnncnngagcgccgcgatggcgttcgccgcgagctccgcgcgccaaacggcgacgtagtgcttgcagtctcggtcgatcgccgcggattcttcagagtacacggcaaactcaatccctctgtccaacataaatccccccaccgcatcgtcgccctctgtttcgtcgtcaccgcccgcatccacatcacgcgcgcgcccgagcgcgcgcaacacgcaccgctcgcacccatccccgcgttcggcgcacgccccgctcctcgcccgcgcgcccgcgcgctccaaccgacacctcgcgctcgcgctcgccgcctcgcaccgcatccccgacgacccaccgacacccaccagnnccncnnncgcnncgncgccgncgccnncgtcgatcaccgccccccacgcgcgcgcgcggcancgttccgcgtccgtcgtcatcgancgcaacgaagaacccgtcgncatccaggcgtcgnctctcgcgtcggcgagcccagaaccagggcgcgatcgcccatcctcgtgcgcgcgcgcgaccgcgatgacgcacgcggtcaacaccgcgcgcgcgacgagagggaccgcgccgcgacgacgcgcgacgttcgccggtttcgtcgtcctccgcggcatcgcgcgggcgtgtggcgcgcgtcgcgcggatcgtcgtcggctctgacgccggttcgtctcccgtcagaccaaccggcgtttgtgtatgtacaaacagtataaaatacttttctttcgagacgaccgaggccaagagaccgttgggccgcggggcgctcgatgcccgatgcgtcgggggattcgcgcgcgtcgtcggcgtccgacggcagttcgcgcgcgaccggcgacgcgggatgacggcggagaccaccgcccgtcgcccggacgcgcgaacgcgggagaacgggcgcccgcgggaacggtcgaggaggaaacgacgccgcgcgcggagtgatgatttcgtggggcgacgctcggaatggacgcgtggacggcgtcgcgggcgacccgcgtgggcggcggtgncggcgntggtggtcgtcgcggtgacgtgtgggacgtggggggagatcgtggagggttcggggacgtgcgcgagcgggtgcggggcggcggagggttgggggagttgcggcgcggaggacgcgtgcgcgtgcgagccgacgagggatgggttggattgcggcgccgcgcgggttgcggcgcacgcgttcgagatcggggatggatctgggatggcgtttgaggcgatcgatggcggtaactctgggatggcgacgacgagcgcgatggtggtggatggggaaacgtacgcggcgatagccgtcgggtggacggatgggtgcgcggacgcgttcgcgagattcgccgacgtcggtgtgagggcttggcgcggtgggacgtggccggagaggggtgcggtagcgatgctgaacgtggaggacgcgacgccgaggggatgggtagggtcttgtgcgcatccgagggcgtccgcgtcgtcgtcggagggatgggctccgtcgcgcggtccgttcctcgtagcggatggtgtgcacgcgtacaccgtcgtgaacgcgtggttacagtcgagcggtgagcttggattcgtcatttcgaaacgacaagcgaacggaggtggcacgcccgaggagcaccacgagaagacgagcgcgggatacactgcagacgcggcggcgattggatcgagcggcgacttgatcgtcttggcgacgccatcagcgacgagctctagagtgaagctgttggtgtatccgagcggtgatattagtactgctggacaaggggcgacggtgaaagaagtggggttgccgacgctggctgcggcgtgttcggcgtgccacgcgagcagggatggggtaaagttgacggcggcggcggcaacagtgattagttcgagcacgagcgtgctcttcgccggtcgagcacgagtttcggcgttgcaagattatcccgccatagttagaatcgatccatactcgcagacgacggcgaatggtgttgagatgtactttaaggatgcctcggctatcgacgaagcatgcgaaggcgcgtctctggcgtcatcttcattgggtagatacaccgcgttcaccgcattggcagtgatggacgagtttgcctacgtcgcgacatctagcgtcacacacgggggtagcgtgtgcggatctgcgtgctctactcgagtctcgtgcttgtacagggtcaggtcggcgtttagcgcgggcgattcagccttggaacacgttcgactgtacggatcgtcgggctcgctagctaaagatgcgatcgcgatcacgacggtgatcgaagaagctacgagcggtggctcagtgtatattttaacgacgtccgattttatggattcatacgcgtcgaccagcatagtcaaagtgagagtcagcggcgactctggctgtggctcgtcgtgcatgacggtgacgggtacgtatttgtcagcgtcaccgatgcagacaatgaccctcgtgccggtgatgggtgcgctgttcactgtctctagagatagtcttggctcgcgagacttttacagaagtctatcgttcactgaaattgagaatgtttctccgacnaagggtcccgtcggcggaggcacacgcattctcatctacggcgtcggatttccgtacgatgctagttggacttctgatggagtgctggcgtacccagcggcgtgtcggttcgagcacgacggtaacccagtttacgtgcacgcagtggtcgtgaactcgacggcgatcgagtgtgtgactccatcttacgccgcattcgcgacgacaggttcgtacgtatccgaagttgccatcagtttcgatggttatcccttggcacagaacgacgtcacgttctttgacgactccacgtgggttggaggacccacatatttcatgtactatgacgttccgcacgttagggagacaaagctcacaaactcgccaatcgagtctgctctatacacgggagaagcgccagacggacaagtcgctgttctagctcttgacgg

SEQ ID NO: 1090 - DNA, 4000 bp, Escherichia coli
  misc_feature (1607)..(1607): n is a, c, g, or t
  misc_feature (1611)..(1611): n is a, c, g, or t
  misc_feature (1776)..(1777): n is a, c, g, or t
  misc_feature (1880)..(1880): n is a, c, g, or t
  misc_feature (1987)..(1990): n is a, c, g, or t
  misc_feature (1994)..(1994): n is a, c, g, or t
tcgcggcggtggtcgtggtggcggcggtggtcgcggcggcggtcgcggcggcggacgcggcggcggcgccaacgcgacgagcatgaactggcaacagcaaagcttctattgagcgcggtgtcacccttttttcaaataaattcgcagtagattacattcttttatccgtcgtgtggactagaaccctattcgactagaaccgtgattgtatcaaacgcctactctcctctctatttcacgcacttctttagatgcctcaggacgtcgccgaccaaatacagactgccagtgacgaggacgttgacgcgcgccggcgccacctctcgcgctcgatgtcgaatgagactgagcgcttgatgaatgctcgaaaccacgacacctcgagtgtcttgagctttttctgcgagcacgttcgcacgtttgacgatgatatcgtcccacgtacgcgcacacctgtcttgccaagaggtcgcctttgcgtccccgcacttgtctaacccgctcgtggtgctatccggcgggctaaaaatagcgcgctctaactgtacgtttgaagtcgtgtggaaaacatccgcgaccggttcgagtaaatcctccggtttgcgatcatccatgcagttgaaaagcatgatgttgtgctccgccgccgtcaccgctcgcgcggtgctcgtaaaccattcggcgctgtggcgcatggattcgatggtgtgcgcgccgtcgagataaaacgtcaagttcatcacatcgggatcgtgcatcacctgcgatcgacccggccacgtcgtcttctctaacccgacgcgaaagctctccggtaactcgtttcgcgcgaacgaagcctccatctcctccgcccacggttggttcgtggcgttcgcccactcccgcaccaactccacggcgacggcggcgttgacgcgttggtgcggtcccgccaaccccacttcgatctcactcccgccctcgtagctgtctaaatctctcgcgacgactaacggcgaaccaacctcggcggcgcgacgctcgagcgcgaccatcgcctcgggtttttgcggcgccgtaaacgttcgcacgcccggcttcatgatccccgccttctccgtcgcgattttccccaaagtatcccctaaaatatccacgtgatccatcccgagcgacgtgatcccgcacgccgccggcgcgcgcaccacgttcgtcgcgtccaggcgcccccccaaccccacctccagcacgcacgcctccacccccgcgctcgagaaaattcgcagccccaacagcgtcaaaaacctaaagtacgccggcatccccagatctccgcaccgcgccgcgatcgcgtcccgcgtccaccaaaactccctcgcgaacgtctcctcgtccaccatcgccccgtcgatccgaaatcgctctcgcacgtccatcaagtgcgggctcgtgaacgtccccacccgcgtcccgctcgccctgagcatcccctccaccatcgcgcacgtcgatcccttccccttcgtccccgccacgtgcaccacgtcgagcgcgtcgacgcgacctcgcaggtccagcctcgagacgtacgtctccagctgcgcgaactgcgcctcccacgtcancgcncccgggtccgcgcgttttttacccgtgatcgtcttcgcgagctcgcgcaccgccgcgtcgtacgcgcggtcgtcgtcgcgcatcgtcgtcgtcgtcgcgaaagtgtcgtcgtcgttcgattcgtttcgtttcgattcgacgcgttcgccgacggcgcgcgcgcgnnttcgacgccgtcgcgcgcgcggattatttttatctcgcgattcgccgcgtcggcgatcgcggcgcggtcgcgcgcgcgcgcgtcgcgcgatcgcgcgcgcggngggcggtcgaggcggcctcgtcgttttatatagcgaaagtgtcgtatttaaggagtctctcgttcgcgtcgagtcacgacccgtcgagagcgtcgtaacaccccggnnnngagngacggcgcgcgcacaccgcgacgcgcgcggtcgcgtcgcgcgcgcgtcgccgcggtcgctcggactcgattccgacgacgcaaagagcgcgatggcgtcgcccgcgcgacggacgcgcgagacggacgacgcgacggtgaacgccatgggtggcgatcgaaacgtgttcgcgtcgcgcgcgtgcgacgcgtgccgcgcgctcgggtcgttcatggtgctcgtcgtgctggcgatcgtcgggctgacgtactacgccacggtggtggtcgtgtacggaccggtggcggcggaggggggggaggacgcgggcttggcgacgggggcgctgtgcgcgtatcacgtcttcgcgttcatgctgctgtggtcgtactttgcgtgcgtgctgacggcgccgggagacgtgccgagggggtggacgccggcgccggaggatcccgaggaggcggcgtcggaggcgaagaagtcgaacagcgaaaagagacggcggttttgtaaaaagtgcgcggcgtggaagccgacgcggacgcaccactgctcggtgtgcaaacgatgcgtgttgaagatggatcatcactgcgtgtgggtcgcgaattgcgtgggggcgtataactataaattttttctgcagtttttggcgtacacgttcttggcgacggtgctggatgcgattttactgttgagcaattttatagatttcttcaaagacgtcgaggagagtcaggctgcgggaagccaaggggcggacgcgaaggtcgatccggcggaaggaacggagttagcggtggtgtttgtgacgtttatagtcaacgtggcgttctcggcgtcgttactgggctttttagtgatgcacggtaacttgatcctgagcaacatgacgacgatcgaaatgtacgaaaagaaaaagacgcttccgtggaagtacgacttgggaaggttcagaaacttcaaggaagtgtttggagagaacgttttcatgtggttcctccccgtgcattcgagctcgcacttggaaaagatgcgcgtgaacacggggatttcagacggggaatgtttagaaggcgccgcgtacgccagggcgtgcgaaagcgcgcaacgagaggcgacgatcgggaatagaaaaggtcgagcgtagatttattggatgcaagcatagatttgtcgagcgcgcgtcgcgtccatggagatgtcgacgtcgcgagcgatacaagtgactagaaagacgaagcgcgggactattgtgtagtatacatgcactcgctactgtctgcgtctttcgctaccctcgcctcggtttgctcatgatttctttcaacatctgccgcctcgccagctctctcggcgcgttcgccgcctctattttcttctccagcgccaacttcttctcgctcaaattctccaacaactcgtatcgcagctgcggcatcgctcgcgagcgtctatcgtaattctcaatcgccgtcttcgcgctcgaactgcgcgtcatccgaagcgcacgtcgacgcattcgtcagtcacccgcgcgccttcgtcgttacgcgtcgccgtcgagtcctcgcgcgcgctcgctcggctcgcaacaccaatcgcacctcatcgccttcaccgcccgctcgagcgtcggcaaatcgctcgtcgcgctcgcctcgctctgtatcgccgcgttcagcgtcgtcgttcgcagcacctccgccgcgtctcgcacgttcgccgccgtcgcgtcgacgcacgcgcgcgcgaacccatcgacgaagtgcgtcccgcgcttcgcgatgaaactcgcgacttcgcccccccccgcgccgtcgccgccgccgacgagcgcgtgcatcgcgccctgcgtcaccgtgtcgctcaccgcggacgccgcggtggagagcgtggacgagagcgcgtccatggcgcgtcgcgatgtcgcgcgcggggcgcgactcgacgcgcgcggcatttcgccgccgtcggcgcgtcatgcgcgccgtcgtctcggcgcgcgcgcgaagcgcgcgaag

SEQ ID NO: 1091 - DNA, 4000 bp, Escherichia coli
  misc_feature (1985)..(1985): n is a, c, g, or t
  misc_feature (1987)..(1987): n is a, c, g, or t
  misc_feature (2422)..(2422): n is a, c, g, or t
  misc_feature (2468)..(4000): n is a, c, g, or t
aagaaaatccaaaggttgatattatactctctagtagcatcaatgatgatttctcaccgatatattctagtgttttagaaaactcaattgaagagcttcctccaactgtaaataatcaatcaaaaattgcttttaatagaacatcccttcaaccaaaaccaagaaacagttcccttccagaaaataataatttaatattaatgaatttagaagatgataaaacttcttctattctttctcaaaccatcgttgaagctccaacccaaacttctgatatgccagaaactctttctactgctatcgttgaaagtaagagtaatgtcggagatttatctcaacatagtataagaattttaaatattgaaaaagaaaatgaaggtaaaaatgagaacaatcaagaaagtcaatgtctttctaaactcgaaaccctttccataaatactaacaaggaacaatcattccttaaagaagatagtatgatatccaatagaaagagtattatttcagacagaaagagtatcagatcaaaaactgatattagccaaatgaatttggaaaatattaaaatgtctcgttccaacatttcattatcttcaagaagattatctatttgtactacatcaactacaaataatacctctttccttacaccaaataatagtaaaagattatctattattaataccagctttaatgatgtatcaatggatagtcttcatccaatggtaggtcatacctcattaatcattccaaatgatacttcttcagaaagaaagagatattcattaaatgcttataagcaaaatcgtaacagtttacgtataccatcaagtacttctatgttaaattcatttaattctactaattctaaacaccatacttccaagattatcaattcaaaaagtcaacattcaattttgaattctgaaaataaattagaaaataataatattaaaaataatgaacctcttatgattttagatgaattgaaggatgataaacaacttcatgtcattaaaccaacttctagtaatctccaattagaagttgtagaaaatagtagtactagtgaaatagaaaatgctcctaaaacagaagataataccgaagttacaccaactgcagttactgaatccaaaataaaaattgaagaattaacaccaacagaaaataaaccaattataacgaaaccagtaagagaacttatatcaccaaaaaacccatatattaaattatttaatggtgtcattgattctaaagcccttaccataacaccaccatttgtaacctttttagaaatgcaaaaaacattaattgatatggatattgattaccgtgtcttgaataattgtttcaagattcgttgtcaaaaaatcttcaataatattgattcaccagaagacttagaagcaatcgctaaagcttcaccagtaatgtctcctcttcatacccctgtaaatacaccatcatccactccatcaccacatctaaatggtaaaaatacaccaattaatagaagtaagaaatctcttagtgatgaagttattactactgctagtccaagagttaaagccattaattctgatcaggtatcttccaaatgttatagtttccattcccatggatctggtaaattaaagtcattagtaaattcaattatatgtgctaaaccatcttcaccaccaaatcaatcacgtggtaatgaccaaaagcgtttattctctcttataaaacgtaaaaaaacgcaatcactcgtaatatttaccatggaaatttgtcgtattaaaaatcgtgatgaactttacattataaaattcaaacgtcgaaagggtgatgtttggctctttagagatctctatcaacaaattatttccagattacccttaagaacttaagtttgtccttttttttaattaaccatatacaaatattacaaatattattttttatttttatttttattattattttttttttttttttantnaaataattaatataatttaaaaaaaataataataataataatataataataataataataggggaaaacaaatatatataaaacaaatatatataaaaggaaaaagaaaaaaaagaaaatattttttattttagttcattcatataaatattttatctttatatatataattttattttaatattaacacaactatctttttttttattattattattattattaagaaaatacaaaaaaaaagtcacaattttaattttcttcaactatttttattactatttcattatttctttatactattcttataatatttattacaaaatcacaatttttctctttaaactaatcaacaaaaaaaaaaaaaaaaaaaaaaaaaaaaaaaaaaaaaaaaaaaaaaaaaaaaaaaaaaaaaaaaaaaaaaaaaaaaaaaanaaaaaaaaaaaaaaattaaaaaaaaaaaaaaaaaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1092 - DNA, 4000 bp, Escherichia coli
  misc_feature (1289)..(1289): n is a, c, g, or t
  misc_feature (2304)..(2304): n is a, c, g, or t
  misc_feature (2452)..(2452): n is a, c, g, or t
  misc_feature (3297)..(3297): n is a, c, g, or t
  misc_feature (3327)..(3327): n is a, c, g, or t
  misc_feature (3342)..(3342): n is a, c, g, or t
  misc_feature (3381)..(3381): n is a, c, g, or t
  misc_feature (3393)..(3393): n is a, c, g, or t
  misc_feature (3434)..(3434): n is a, c, g, or t
  misc_feature (3479)..(3479): n is a, c, g, or t
  misc_feature (3483)..(3483): n is a, c, g, or t
  misc_feature (3765)..(3765): n is a, c, g, or t
ttgcattatgtctcttgttctccatatagagttccaattgcaagattatctgctgcccaagcaagcataagagccaaaaaataaatcgattcttataaatttaagataaattcttaactaacagaactacacataggccaggtatgtagtttgtttaaaaatcgttgatttacttgggtatttaagaatctttattaagaatgaaggcttttccttgtcaaaaaaacatttacaggaaagcctaaattaaatagtttcgcccctaattaacttaacaacaagtaaaacaaatgaaaactatactagcaacaatcgtaagtatgttcttattcgtatcttttgcaaatgctcaagctaaatcttgcgctgatttaatcaaaggttacgatgcagcagtaaaaacagcaaaattagatgcagcagcaactaaaaaagctggtgatcttagaaaagcagctggtgatgcactagcagctaaaaaagaagctgattgcgttaaatcaatcaacgccgcttctgctgttctagctccggctaagaagtaagcatttttttttaaagtgctaacttctggttagcactttaaaaatccccctcctctaaaattactcaaaatagaagtttttcactaagtttttaaaaagttattaaaaattacaaatccatttcgtctataagatagtattttttgtagattaggttaaatatattttatgagccctacgttagttcaaagtatagctttaataatatttgttgtagcaattcttcatacattttctgtaaaattttttaaatctctagctcagaaatttccaaggcatcataatatttttgatatgttgggagaggttgaaattgtttttggattttgggctatagttttggttttaattatattctttttactaggaaaaactgaaacagttaattatttaaataaccaaagttatgttgagccattatttgtttttgtaataatggtaatagcagctagtaagccgattttagatttttcattatcttgtgttaaaaaaatatcagcattgttacctgttaataaatctttaagtctttttttaattacaatgtcttttgtgcctttgttgggttcatttataacagagcctgcagcaatgactttgggggcattaattttaagagatcatttttactcaaaaaaaatttcaaataaatttaaatatggaatcattggaactttatttgtaaatgtaagcataggtggagctatgacaccatttgctgcgcctcccattcttatggttgcngctaaatggaattgggatttaaatttcatgattaatacttttgcgtggaggactgcacttgccgtttttgtaaatagtataattcttacttttctttttagaaatgaacttactaaattaggagaatctaagattaaaacaattaaaattccgtcttttgttttgattctacatttaattttacttttaggagtaatcttttttgttcatgatttaataatttttcttggaatttttttaatatttttagcggttgtaaatgcctttaatcaatatcaagataagctgattattaatcaagcttttctagtttcgttatttttagcaggattagtggttttaggaggacaacaaaaatggtggcttcaaacagttcttgctaaattaaccccagatcagatttactatgttgcaacagccttaacagctgttacagataatgctgctcttacttatttagcctcgcttgttgatggcctttcagaccaattcaagtacgcaattgcagcaggagcaattactggtggaggattaactgtaattgcaaacgctcctaaccctgcaggttattcaattttaaataaaaaattctctggaggtatcgttagtcctttgtatttgtttttatccgctttgggacctacgattgttgcaattatttgttataaaattatataaatagcggaataatttttcgtaaacttattattataataagacagccaacaactgttaaaatcattttaatactcatttttgaggtagcttttgcagcgtaaggagctattaaaaaaccaccaattataagcccagctaacgcttcccagtctgtaattttaactaaaaatacaaaagtagttgctgatgctaaattaataaaaaattcggaagcattaacagttccaataactttttttggcaacatttttccacctaataaacttgttgtaacaacaggaccccagccacctccaccagcgccatccacaaatccaccggttaccgcaagaggaanaacagctgaatttttttgtttaaattgtaattttatttttgaataggcttttgcaattagaaatattcccatgaagaataaataaatagaaattacgattgataaatagggaattttaactttagttattactaaagctccaagaatngccccaacgatcccaggtatcagaagttttttaaataattttgtatcaacatttccaattttccagtgatttaatcctgacgatcctgagacaaaaatttcagctatatgaatataagcgaccgctttaacaggagagattccgtagcctaataaaaaagctgtacctgtcacaccataagccattcctaaactaccatcgattaatgcagcaatcgatccaaacaataaagcccagaaaaataaatcactgttaaaaggagtggggtctattcctcgataataggttagcattgctattgctgagataactaataaaccaaataaaattttaaatactttattactcattatataaatttattatttttcaaataatgttattagttaataacaatgtttcaagtgttagataaatttaaacaaccaatatttgtgcttattgcaggttctattctacttgcccttgcatttgggattagacactcctttggaatatttttaattcctattagtgaaaagaatgagtggggcagagaagtgtttgcaatgggtcttgcttttcaaaatttaatgtggggaatttggcaaccttttaccggtagaatttctgacaagataggttctggtgttgtcgtatttgtcggcagcattctttattcattaggtttatttttaatgggatctctttcaacaaaaacaggatttattattgcatcaggaattttaggaattggaatatcaggagttacatttccaatttttggagcaattagcaggtctgtaacgccagagaaaagaagcatttcaattggaattgcaatgtcgagcgcatcccttggacantttataatgttgcctgcatctttagtgttnttgcaaaactttggnccaactttagcctttggtattttatctgttttcacactngtaatgttagtnctcgccgttcctatgtttgaaaagccaattcaacaaacagntgctcaagatttgtcattaagagaaatattaacagaagcttttanccanaaaggattttggctgttatgcattggattctttgtatgtggctttcatattctttttattatgactcatgcgccggcattcttaattgatagaggtctatcaccgcaaatagggactattgtattagctttaataggactatttaatatttttggaacttattacgcaggatttttaggaggtaagattagaaaacctttactcttaagttctatttatgcatcacgtgcagtgattattttaatttttattttatttcctgttacaaatttaacagcctanatatttgctgctttaatgggagtgctttggctttcaacaattccactaactcaaggaacaatcacaacagtttttggtgttaaaaatatgagcatgctctatggaattgcttttttatttcatcaagtgggagcttttttaggtggttggttggggggcaaagtttatgatgtgacaggctcttatgatattgtttggtatatttcaattgcacttggagtatttggggcaatta

SEQ ID NO: 1093 - DNA, 4000 bp, Escherichia coli
  misc_feature (704)..(704): n is a, c, g, or t
  misc_feature (3402)..(3402): n is a, c, g, or t
  misc_feature (3924)..(3924): n is a, c, g, or t
  misc_feature (3962)..(3962): n is a, c, g, or t
gttaccttgaacaacatataaaatttagccatcaaacaataattgatgaagttgctagtgtgttgccagaagagcgtatctatgaaacatggaagggcgaaaaaatccttaatggacttggattctcagatgaagaaatgttacaagatccaaatttgttttctggaggataccaagttaaagtaaatcttgcaaagttactactcctggaacctaatttattattacttgatgaacctacaaattatcttgatatacattccattagatggcttaaaaaatttctaaaagactggaatgaagaactcatactcataacgcatgatagaaatttcatggatagtattatcactcacacacttaatattcatcgtggtaattttagaaaatttccaggtaatacaaagaagattaaggagcaaattttgcaagaagaagaaatttatgaaaaaacacgtatcaatcaggagagagaaagagaaaaaactcaggcttggatcgacaggtttaagtcaaaagctacacttgctagcagagctcaatcaagagcaaaaatgttagaaaaaatggaagtcaaagagaagctccaagcaattgtaaatctagattttaatttcaactatcttaactataatagtaagcaaaacctcatgaaagtaacagatattagttttggttatgatccaaataaaatactaattaanaatttatctttcaatgttcagaaaggagataaaatttgtataattggtaaaaatggtaaaggtaaatcaactcttttaaaattactctctcaagaaatcgatgttctaaatggagagattaatattcatgaaaaagtcgaaattgggtattttggtcaaatgaatatagatagattgaataatgataattcaatctatgaggagatccaatctgttgatccatcaataccggagacaaaagtaagaacaatatgcgctcatatgatgtttcccgggaaggcttctaataaaaaaattggaatactctcagggggtgaaagaagtcgtgttacattaggaagaatattattaaatcctgttaatctgttatttttagatgagcctacaaatcacctagatatggagtctacggaaacactcatggaggcagtccaaagatttgaaggttcagtaataatggttacccatgacgaatatttcttaaataaaattgcaaataaattaattatctatgatgaaggtaaggctttcttttataatggcaactatagagattttcaaaaaaaaattgggtggaaagatatttaaattaatacaaatacttaatttgttttggcggagggggagggattcgaacccccgaacgagttgccccgttgccggttttcaagaccggtgctttcaaccactcagccacccctccggcatttttgattatacaatcaaaaaatatacaaatatcattatcaaataaaatctatatttaaaagtcttaaatttatcatcatttaaataaaatataaatttggaaaaattattttaattatcacatcatcagttttgttatgtaataataaagttttatgtatgaaaggatagaatatgcctaaaatgcttataactgtaaatatatcgaaaggttttaaaacctggactgatatggcaaagtcacttgaagacgaagctggcgctaatggggcgaaaattatatgggctggaacaaacccagacgagtcgtctgtttatgtaatgatggatgttcctgatccagagtttatgcaaacatttggcttgcgtcccgatatcaaaaaagcccgtgaagaggccggtgctgatgttgcttcaacaactgtaataactcctataggtgattattggctgggttagtttgatatatgatcaaaagtccgttaagatatccaggtggaaaatcacgcgccattaatttcataggtaagtttattcctaacttttttaaaacttatagagaaccattttttggtgggggctctctaggtttccatgtatatcaaaactcattaaccaaccataaaacagataaaaaacaaaaaggaaatttaatatgactgtgccttatccaaatacaaaactttatattgctggcaattgggtagatgccatcggaggtgaaaccattgatgtcatgaaccctgtaaccggaaaaccgattggaaatgtcgcacatgctagaattgcagatctcgaccttgcaatagatgctgcacaatcagggtttaaggtttggaaagaaacctcagcatataaccgttacaaaatgatgcggaatgctgctatgaatttaagagatcgtattgatgaagttgcagatattttaactcaagaacagggtaaacctctggcacaatcaaaagccgaaactaatcttgccatagatatcattgattggtttgctgaagagggtaggagaacctatggtaggattatacctgcacgtatagatggagttcaacaaatggtagtaaaagagccagtaggacctgtagcaggctttacaccatggaatttcccactgaatcagagtgttagaaaaatttctgctgcaattgctgccggttgttcaattataataaaagcagcagaagaaacacccgcaagtactgccgcattagtaaagtgtttcgcagatgctgaaattccagctggtgtaataaatctcgtatatggaatcccatcagagatatcggaatatttaataccacaccctattataaaaaaagtaacctttaccggttcaactgccgtagggaagcagttggctgcattagctggtgctcatatgaaaaaggtaacaatggaacttggaggacacgctccagctattgtttgtgaagatgcaaatatagacacagcactcaaagtacttgttgaaaataaatatcgaaatgcaggtcaagtctgtgtttcacctactcgttttatagtccatgaaaaatgttttaatgaatttgtgaaacgatttactgaaatggtaaaaaatataaaagttggtaatggcttagacccagaaacacagatgggtcctcttgctcacgatagaagagttgaatctgtagaatcatttgtaacagatgcggtaaataaaggggcaaaaatagaaaccggtggaaatagaattggtaatgaaggatattttttcgaacctaccgttctcactgaagtctcattagatactagaataatgaatgaagaaccttttggacccatagcaccaataattccatttaaagattttgatgaggcaattgaagaagcaaatcgtctcaattatggacttgctgcatatgcatatagtacatctgccgattcaatcagagaactcggttctagaattgaaagcggtatgatctctattaatcatcatggaatagcactaatngagacaccgtttggcggtatcaaagattcaggatatggttctgaaggaggtttggaagcaattgaaggttatatgaatactaagtttattactcaaaagtctttttaacttatagtttattttgataagcaaaatttctatactttaaacagattaattataatattttaacccttactttgaaataagtcttttgctaatgatcatatgtgtgttattgagatatatctcaatcacatagaaaaccatcactaatgaaagactttaacgaaatgggacttcctgagtccctaacacacacccttaatcatttaaaatttgataaaccaacccaaatacaatccattgctatccctatagcattggaaggaaaagatattttaggatctgcgcaaactggtacaggtaaaaccgctgcttttgcaattccattaattgttaatttatataataagcccacaagtaaggctttagtcatggcacctacacgtgagttagctacacaggtaatgagccaattcncttcattgctcggtagaaaaactaaaatcaaaagtgcnttactaatcggtggtgactcaatgtttaaacaattaaa

SEQ ID NO: 1094 - DNA, 4000 bp, Escherichia coli
  misc_feature (6)..(6): n is a, c, g, or t
  misc_feature (8)..(8): n is a, c, g, or t
  misc_feature (10)..(10): n is a, c, g, or t
  misc_feature (14)..(14): n is a, c, g, or t
  misc_feature (18)..(18): n is a, c, g, or t
  misc_feature (20)..(22): n is a, c, g, or t
  misc_feature (28)..(29): n is a, c, g, or t
  misc_feature (33)..(33): n is a, c, g, or t
  misc_feature (38)..(40): n is a, c, g, or t
  misc_feature (42)..(42): n is a, c, g, or t
  misc_feature (46)..(46): n is a, c, g, or t
  misc_feature (49)..(49): n is a, c, g, or t
  misc_feature (51)..(51): n is a, c, g, or t
  misc_feature (54)..(54): n is a, c, g, or t
  misc_feature (58)..(59): n is a, c, g, or t
  misc_feature (61)..(61): n is a, c, g, or t
  misc_feature (63)..(63): n is a, c, g, or t
  misc_feature (65)..(65): n is a, c, g, or t
  misc_feature (69)..(70): n is a, c, g, or t
  misc_feature (75)..(75): n is a, c, g, or t
  misc_feature (78)..(78): n is a, c, g, or t
  misc_feature (80)..(80): n is a, c, g, or t
  misc_feature (82)..(82): n is a, c, g, or t
  misc_feature (90)..(90): n is a, c, g, or t
  misc_feature (93)..(93): n is a, c, g, or t
  misc_feature (95)..(97): n is a, c, g, or t
  misc_feature (99)..(99): n is a, c, g, or t
  misc_feature (106)..(106): n is a, c, g, or t
  misc_feature (108)..(108): n is a, c, g, or t
  misc_feature (111)..(111): n is a, c, g, or t
  misc_feature (115)..(116): n is a, c, g, or t
  misc_feature (118)..(118): n is a, c, g, or t
  misc_feature (120)..(122): n is a, c, g, or t
  misc_feature (124)..(124): n is a, c, g, or t
  misc_feature (126)..(126): n is a, c, g, or t
  misc_feature (128)..(128): n is a, c, g, or t
  misc_feature (132)..(135): n is a, c, g, or t
  misc_feature (137)..(137): n is a, c, g, or t
  misc_feature (141)..(141): n is a, c, g, or t
  misc_feature (147)..(148): n is a, c, g, or t
  misc_feature (151)..(151): n is a, c, g, or t
  misc_feature (154)..(157): n is a, c, g, or t
  misc_feature (159)..(159): n is a, c, g, or t
  misc_feature (161)..(161): n is a, c, g, or t
  misc_feature (163)..(164): n is a, c, g, or t
  misc_feature (167)..(167): n is a, c, g, or t
  misc_feature (169)..(170): n is a, c, g, or t
  misc_feature (172)..(173): n is a, c, g, or t
  misc_feature (180)..(181): n is a, c, g, or t
  misc_feature (183)..(185): n is a, c, g, or t
  misc_feature (188)..(188): n is a, c, g, or t
  misc_feature (190)..(190): n is a, c, g, or t
  misc_feature (192)..(192): n is a, c, g, or t
  misc_feature (194)..(194): n is a, c, g, or t
  misc_feature (196)..(196): n is a, c, g, or t
  misc_feature (201)..(201): n is a, c, g, or t
  misc_feature (204)..(204): n is a, c, g, or t
  misc_feature (207)..(207): n is a, c, g, or t
  misc_feature (209)..(209): n is a, c, g, or t
  misc_feature (212)..(212): n is a, c, g, or t
  misc_feature (222)..(223): n is a, c, g, or t
  misc_feature (225)..(225): n is a, c, g, or t
  misc_feature (228)..(228): n is a, c, g, or t
  misc_feature (230)..(230): n is a, c, g, or t
  misc_feature (233)..(233): n is a, c, g, or t
  misc_feature (236)..(246): n is a, c, g, or t
  misc_feature (250)..(250): n is a, c, g, or t
  misc_feature (254)..(254): n is a, c, g, or t
  misc_feature (259)..(259): n is a, c, g, or t
  misc_feature (262)..(262): n is a, c, g, or t
  misc_feature (264)..(269): n is a, c, g, or t
  misc_feature (272)..(272): n is a, c, g, or t
  misc_feature (275)..(275): n is a, c, g, or t
  misc_feature (277)..(278): n is a, c, g, or t
  misc_feature (280)..(286): n is a, c, g, or t
  misc_feature (292)..(293): n is a, c, g, or t
  misc_feature (295)..(295): n is a, c, g, or t
  misc_feature (297)..(297): n is a, c, g, or t
  misc_feature (304)..(307): n is a, c, g, or t
  misc_feature (310)..(310): n is a, c, g, or t
  misc_feature (314)..(314): n is a, c, g, or t
  misc_feature (316)..(316): n is a, c, g, or t
  misc_feature (321)..(324): n is a, c, g, or t
  misc_feature (327)..(327): n is a, c, g, or t
  misc_feature (330)..(330): n is a, c, g, or t
  misc_feature (332)..(332): n is a, c, g, or t
  misc_feature (334)..(335): n is a, c, g, or t
  misc_feature (340)..(340): n is a, c, g, or t
  misc_feature (343)..(343): n is a, c, g, or t
  misc_feature (350)..(353): n is a, c, g, or t
  misc_feature (359)..(359): n is a, c, g, or t
  misc_feature (362)..(362): n is a, c, g, or t
  misc_feature (366)..(368): n is a, c, g, or t
  misc_feature (372)..(372): n is a, c, g, or t
  misc_feature (376)..(376): n is a, c, g, or t
  misc_feature (381)..(381): n is a, c, g, or t
  misc_feature (385)..(386): n is a, c, g, or t
  misc_feature (388)..(388): n is a, c, g, or t
  misc_feature (390)..(395): n is a, c, g, or t
  misc_feature (397)..(398): n is a, c, g, or t
  misc_feature (401)..(401): n is a, c, g, or t
  misc_feature (403)..(404): n is a, c, g, or t
  misc_feature (406)..(412): n is a, c, g, or t
  misc_feature (415)..(421): n is a, c, g, or t
  misc_feature (423)..(423): n is a, c, g, or t
  misc_feature (426)..(426): n is a, c, g, or t
  misc_feature (429)..(434): n is a, c, g, or t
  misc_feature (436)..(436): n is a, c, g, or t
  misc_feature (438)..(442): n is a, c, g, or t
  misc_feature (445)..(445): n is a, c, g, or t
  misc_feature (447)..(453): n is a, c, g, or t
  misc_feature (456)..(456): n is a, c, g, or t
  misc_feature (458)..(458): n is a, c, g, or t
  misc_feature (460)..(462): n is a, c, g, or t
  misc_feature (466)..(467): n is a, c, g, or t
  misc_feature (469)..(469): n is a, c, g, or t
  misc_feature (475)..(479): n is a, c, g, or t
  misc_feature (493)..(494): n is a, c, g, or t
  misc_feature (496)..(496): n is a, c, g, or t
  misc_feature (498)..(498): n is a, c, g, or t
  misc_feature (502)..(502): n is a, c, g, or t
  misc_feature (504)..(507): n is a, c, g, or t
  misc_feature (511)..(521): n is a, c, g, or t
  misc_feature (523)..(525): n is a, c, g, or t
  misc_feature (527)..(527): n is a, c, g, or t
  misc_feature (529)..(530): n is a, c, g, or t
  misc_feature (532)..(532): n is a, c, g, or t
  misc_feature (1991)..(1991): n is a, c, g, or t
  misc_feature (2525)..(2525): n is a, c, g, or t
  misc_feature (2529)..(2529): n is a, c, g, or t
  misc_feature (2533)..(2533): n is a, c, g, or t
  misc_feature (2535)..(2535): n is a, c, g, or t
  misc_feature (2537)..(2538): n is a, c, g, or t
  misc_feature (2540)..(2541): n is a, c, g, or t
  misc_feature (2545)..(2545): n is a, c, g, or t
  misc_feature (2550)..(2552): n is a, c, g, or t
  misc_feature (2560)..(2560): n is a, c, g, or t
  misc_feature (2638)..(2638): n is a, c, g, or t
  misc_feature (2641)..(2641): n is a, c, g, or t
  misc_feature (2644)..(2644): n is a, c, g, or t
  misc_feature (2663)..(2664): n is a, c, g, or t
  misc_feature (2669)..(2669): n is a, c, g, or t
  misc_feature (2672)..(2672): n is a, c, g, or t
  misc_feature (2679)..(2679): n is a, c, g, or t
  misc_feature (2704)..(2704): n is a, c, g, or t
  misc_feature (2708)..(2709): n is a, c, g, or t
  misc_feature (2715)..(2715): n is a, c, g, or t
  misc_feature (2734)..(2736): n is a, c, g, or t
  misc_feature (2741)..(2741): n is a, c, g, or t
  misc_feature (2754)..(2754): n is a, c, g, or t
  misc_feature (2757)..(2757): n is a, c, g, or t
  misc_feature (2760)..(2760): n is a, c, g, or t
  misc_feature (2762)..(2763): n is a, c, g, or t
  misc_feature (2765)..(2765): n is a, c, g, or t
  misc_feature (2779)..(2780): n is a, c, g, or t
  misc_feature (2789)..(2789): n is a, c, g, or t
  misc_feature (2791)..(2792): n is a, c, g, or t
  misc_feature (2797)..(2797): n is a, c, g, or t
  misc_feature (2806)..(2807): n is a, c, g, or t
  misc_feature (2818)..(2818): n is a, c, g, or t
  misc_feature (2820)..(2820): n is a, c, g, or t
  misc_feature (2822)..(2822): n is a, c, g, or t
  misc_feature (2825)..(2825): n is a, c, g, or t
  misc_feature (2828)..(2828): n is a, c, g, or t
  misc_feature (2831)..(2831): n is a, c, g, or t
  misc_feature (2833)..(2833): n is a, c, g, or t
  misc_feature (2838)..(2838): n is a, c, g, or t
  misc_feature (2845)..(2845): n is a, c, g, or t
  misc_feature (2852)..(2853): n is a, c, g, or t
  misc_feature (2856)..(2856): n is a, c, g, or t
  misc_feature (2862)..(2862): n is a, c, g, or t
  misc_feature (2866)..(2866): n is a, c, g, or t
  misc_feature (2868)..(2868): n is a, c, g, or t
  misc_feature (2870)..(2871): n is a, c, g, or t
  misc_feature (2873)..(2874): n is a, c, g, or t
  misc_feature (2876)..(2876): n is a, c, g, or t
  misc_feature (2879)..(2879): n is a, c, g, or t
  misc_feature (2881)..(2881): n is a, c, g, or t
  misc_feature (2883)..(2883): n is a, c, g, or t
  misc_feature (2889)..(2889): n is a, c, g, or t
  misc_feature (2892)..(2894): n is a, c, g, or t
  misc_feature (2896)..(2897): n is a, c, g, or t
  misc_feature (2901)..(2901): n is a, c, g, or t
  misc_feature (2910)..(2910): n is a, c, g, or t
  misc_feature (2913)..(2913): n is a, c, g, or t
  misc_feature (2916)..(2916): n is a, c, g, or t
  misc_feature (2920)..(2920): n is a, c, g, or t
  misc_feature (2922)..(2922): n is a, c, g, or t
  misc_feature (2924)..(2924): n is a, c, g, or t
  misc_feature (2927)..(2927): n is a, c, g, or t
  misc_feature (2931)..(2931): n is a, c, g, or t
  misc_feature (2936)..(2936): n is a, c, g, or t
  misc_feature (2940)..(2940): n is a, c, g, or t
  misc_feature (2943)..(2943): n is a, c, g, or t
  misc_feature (2952)..(2952): n is a, c, g, or t
  misc_feature (2957)..(2958): n is a, c, g, or t
  misc_feature (2960)..(2964): n is a, c, g, or t
  misc_feature (2966)..(2966): n is a, c, g, or t
  misc_feature (2968)..(2974): n is a, c, g, or t
  misc_feature (2976)..(2976): n is a, c, g, or t
  misc_feature (2978)..(2978): n is a, c, g, or t
  misc_feature (2980)..(2980): n is a, c, g, or t
  misc_feature (2982)..(2985): n is a, c, g, or t
  misc_feature (2987)..(2987): n is a, c, g, or t
  misc_feature (2989)..(2989): n is a, c, g, or t
  misc_feature (2991)..(2992): n is a, c, g, or t
  misc_feature (2994)..(2995): n is a, c, g, or t
  misc_feature (2997)..(2998): n is a, c, g, or t
  misc_feature (3001)..(3005): n is a, c, g, or t
  misc_feature (3007)..(3007): n is a, c, g, or t
  misc_feature (3009)..(3012): n is a, c, g, or t
  misc_feature (3016)..(3016): n is a, c, g, or t
  misc_feature (3018)..(3021): n is a, c, g, or t
  misc_feature (3023)..(3024): n is a, c, g, or t
  misc_feature (3026)..(3030): n is a, c, g, or t
  misc_feature (3032)..(3034): n is a, c, g, or t
  misc_feature (3036)..(3041): n is a, c, g, or t
  misc_feature (3043)..(3045): n is a, c, g, or t
  misc_feature (3047)..(3048): n is a, c, g, or t
  misc_feature (3052)..(3052): n is a, c, g, or t
  misc_feature (3055)..(3056): n is a, c, g, or t
  misc_feature (3058)..(3060): n is a, c, g, or t
  misc_feature (3063)..(3063): n is a, c, g, or t
  misc_feature (3065)..(3069): n is a, c, g, or t
  misc_feature (3074)..(3074): n is a, c, g, or t
  misc_feature (3076)..(3076): n is a, c, g, or t
  misc_feature (3078)..(3083): n is a, c, g, or t
  misc_feature (3085)..(3086): n is a, c, g, or t
  misc_feature (3088)..(3089): n is a, c, g, or t
  misc_feature (3092)..(3096): n is a, c, g, or t
  misc_feature (3098)..(3108): n is a, c, g, or t
  misc_feature (3110)..(3111): n is a, c, g, or t
  misc_feature (3113)..(3115): n is a, c, g, or t
  misc_feature (3117)..(3119): n is a, c, g, or t
  misc_feature (3123)..(3128): n is a, c, g, or t
  misc_feature (3130)..(3130): n is a, c, g, or t
  misc_feature (3136)..(3136): n is a, c, g, or t
  misc_feature (3138)..(3143): n is a, c, g, or t
  misc_feature (3145)..(3146): n is a, c, g, or t
  misc_feature (3148)..(3151): n is a, c, g, or t
  misc_feature (3153)..(3154): n is a, c, g, or t
  misc_feature (3156)..(3156): n is a, c, g, or t
  misc_feature (3158)..(3159): n is a, c, g, or t
  misc_feature (3162)..(3162): n is a, c, g, or t
  misc_feature (3165)..(3169): n is a, c, g, or t
  misc_feature (3172)..(3176): n is a, c, g, or t
  misc_feature (3178)..(3178): n is a, c, g, or t
  misc_feature (3180)..(3180): n is a, c, g, or t
  misc_feature (3182)..(3187): n is a, c, g, or t
  misc_feature (3189)..(3191): n is a, c, g, or t
  misc_feature (3194)..(3195): n is a, c, g, or t
  misc_feature (3197)..(3197): n is a, c, g, or t
  misc_feature (3199)..(3200): n is a, c, g, or t
  misc_feature (3203)..(3203): n is a, c, g, or t
  misc_feature (3207)..(3208): n is a, c, g, or t
  misc_feature (3213)..(3213): n is a, c, g, or t
  misc_feature (3216)..(3217): n is a, c, g, or t
  misc_feature (3219)..(3219): n is a, c, g, or t
  misc_feature (3222)..(3223): n is a, c, g, or t
  misc_feature (3229)..(3234): n is a, c, g, or t
  misc_feature (3241)..(3241): n is a, c, g, or t
  misc_feature (3246)..(3247): n is a, c, g, or t
  misc_feature (3249)..(3250): n is a, c, g, or t
  misc_feature (3253)..(3253): n is a, c, g, or t
  misc_feature (3262)..(3262): n is a, c, g, or t
  misc_feature (3265)..(3266): n is a, c, g, or t
  misc_feature (3268)..(3268): n is a, c, g, or t
  misc_feature (3270)..(3271): n is a, c, g, or t
  misc_feature (3289)..(4000): n is a, c, g, or t
ggatgncnangtgnaggngnnnagggannaggnggatnnncngcanaancnagnggannangngnaggnncaggnganangngaaaaggnggntnnncngcaatancnagnggannangnnnangngnaggnnnnangggnaaaggnnganggnnnngnantnnagnannannatggggnnannnaantnangntnataanggnganantgntaaaccaaanncnccntntgntannnnnnnnnnnaatngtanaccanaancnnnnnntanacnannannnnnnncaagtnnancnaatgaannnnaanatcntngagannnngangantntnntccanatncaccaannnncccatntcnaccnnntacnccancaagnccannancnnnnnnanntcnannannnnnnncannnnnnncnaangannnnnnanannnnnganannnnnnngantntnnnccanntncaccannnnncccatgtcaacctnntncnccancnnnnccannnnnnnnnnnannncnannanaaggtgaagaatgtggtccagattcaccaaatggcccatgtcaacctgatactccaccaagtccaccatccccaccatctccaccatatgaaggtgaagaccaaggagagggtgaagaatgtggaccaaattcaccaaatggtccatgtgaacctgatgttccttcttctccacctaatgatgatgttcaaggaaatgaccaaggtgaaaaccaaggagaaggtgaagaatgtggaccaaattcaccaaatggtccatgtgaacctgatgttccttccaccttaccatgcgatccaacatctgatccaaattgcttaccaattccttcatgtgatccatctgttgatccaagttgtggaaatgatgatccatacaacgatccagccgatgaaccagccgaagtttctgataatgaaaatgaaggaattgatgtaggtgaagttgatgaagttaatgataataatgatattgctaatgaatctgatattgaataaaaatatgatttaattaatatgaagataatatataaaaaataaattagcaataaatatagattttagtagagataaaaaaataaaaataatataacatttacttatttaattaatatttttatttttattttattgtcctctatattgttaaaatcaattttttgattgattttaaaaatgtaatttataaaagaaaaatataaataaatatttacttaaatataatattggttaattgtttttttattgttataatatgaaaaattacaaaatagaaattgtaaaaatttataaaaaacagtatatatttcatttatgaaaaaaatatattttaaattttatttttaaaaaaaatatatttaaaatatccataagttatataataaacaatgagtttaaatttatggaagtaaataaatttagcataagaaaaaccaatactaaatttattataaaattactcaataatagcttaaataatttaatataaaaatatttaagaattatgattaatagatctagaaacagatatttataaagaaattatatatggtaatacattttggtttcaagctcaaaatttgaaatattttagattttaaaataacagctttaattaaggtttgtaacattaatccgctagtttttataaaatatttaatagatcatgacgctgatattaataaagaaaataaaaatggtgatataacattaattaaagtaagtcataatgaaaatagttctattattaagtatttgattgaacatagatcagacttagctaaaggaaataaaaatgaggaaataaaaatgaggaaataaaaatggggatataccaacttaatattacatataaaataaaaaaaataaatgaataaataaatgaataaacaagcaaataaatagtaaagaaatatattgatgaaactttttttttttttttttttttttttttaaacatttanatattaatattgtagtattttattcttaacaaaaaatactacatatattaatatctaacttttattatattaaaattaaatatttttatgtgttattatttagttaaagtctcagaatgatagtatatactttcttattgttattatataagtaaataatattataattgaatattataaattaatatagactacataaatatatgtaatgtaattacattgtggcaacgaatgtggtgcatttcgccaatttttataatacaaaatttcaatacgccatttatttttaatggcttgtaaaattttttgttaacgtcataaaaatttttaatacaattatatgtaaaaaaataaatgtataaataaataaataaataaagaatgtaataatattagtaaataaaataaaataaaataaaataaatagtataatatgaatatagagtacagattgaattaaataaaataaaataaaataaaataaaataaaataaaataaaataaaataaaataaaataaaataaaataaaatanatantatnanannannatanagtannnattgaatnaaataaaataaaataaaataaaataaaataaaataaaataaaataaaataaaataaaataaaataaaatagaataaantanaanataagaaaatagaataaannaaganaanaataaanaaaaaaaaaatttaataaaacatantaanntaaaanaaaaattattaaagaaaannntattnaagaagaagaatntanaantnnanaaaataagagaaannaatataatnannatttnataaaacanntattaaattantnanaanaanaananaaatnttgatantaaagannatntatganttanantnnannantcnananaggtanatnnngnngaanaattaaaanatntantaantncnatnacantactnaaanaanttttaaagnaaatnntnnnnnanannnnnnntnantnannnntnantnntnnanncannnnnantnnnngaantnnnnannannnnnannntnnnnnntnnnannacantannannnttnannnnntatanantnnnnnntnnannaannnnntnnnnnnnnnnntnnannngnnnaaannnnnnanaaaaanannnnnnannannnnannanannaanaannnnnaannnnnananannnnnnannnaannanannaanaatnnaaatnttnnanaannaaaaannnnnnaaaaaanaaaannannaanaaaaaaaanaannanannaaaaaaaaataactatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1095 - DNA, 4000 bp, Escherichia coli
  misc_feature (1)..(18): n is a, c, g, or t
  misc_feature (20)..(29): n is a, c, g, or t
  misc_feature (31)..(36): n is a, c, g, or t
  misc_feature (38)..(38): n is a, c, g, or t
  misc_feature (40)..(41): n is a, c, g, or t
  misc_feature (43)..(49): n is a, c, g, or t
  misc_feature (51)..(59): n is a, c, g, or t
  misc_feature (61)..(65): n is a, c, g, or t
  misc_feature (70)..(80): n is a, c, g, or t
  misc_feature (82)..(82): n is a, c, g, or t
  misc_feature (85)..(88): n is a, c, g, or t
  misc_feature (90)..(98): n is a, c, g, or t
  misc_feature (101)..(111): n is a, c, g, or t
  misc_feature (113)..(113): n is a, c, g, or t
  misc_feature (115)..(116): n is a, c, g, or t
  misc_feature (118)..(128): n is a, c, g, or t
  misc_feature (130)..(130): n is a, c, g, or t
  misc_feature (132)..(135): n is a, c, g, or t
  misc_feature (137)..(145): n is a, c, g, or t
  misc_feature (147)..(173): n is a, c, g, or t
  misc_feature (175)..(177): n is a, c, g, or t
  misc_feature (180)..(180): n is a, c, g, or t
  misc_feature (183)..(191): n is a, c, g, or t
  misc_feature (193)..(201): n is a, c, g, or t
  misc_feature (203)..(203): n is a, c, g, or t
  misc_feature (205)..(207): n is a, c, g, or t
  misc_feature (209)..(212): n is a, c, g, or t
  misc_feature (214)..(224): n is a, c, g, or t
  misc_feature (226)..(228): n is a, c, g, or t
  misc_feature (230)..(230): n is a, c, g, or t
  misc_feature (232)..(233): n is a, c, g, or t
  misc_feature (235)..(248): n is a, c, g, or t
  misc_feature (250)..(256): n is a, c, g, or t
  misc_feature (258)..(268): n is a, c, g, or t
  misc_feature (270)..(272): n is a, c, g, or t
  misc_feature (274)..(282): n is a, c, g, or t
  misc_feature (284)..(289): n is a, c, g, or t
  misc_feature (292)..(293): n is a, c, g, or t
  misc_feature (295)..(299): n is a, c, g, or t
  misc_feature (301)..(302): n is a, c, g, or t
  misc_feature (305)..(306): n is a, c, g, or t
  misc_feature (308)..(311): n is a, c, g, or t
  misc_feature (313)..(324): n is a, c, g, or t
  misc_feature (326)..(333): n is a, c, g, or t
  misc_feature (335)..(340): n is a, c, g, or t
  misc_feature (342)..(342): n is a, c, g, or t
  misc_feature (344)..(350): n is a, c, g, or t
  misc_feature (352)..(353): n is a, c, g, or t
  misc_feature (355)..(372): n is a, c, g, or t
  misc_feature (374)..(375): n is a, c, g, or t
  misc_feature (377)..(381): n is a, c, g, or t
  misc_feature (383)..(390): n is a, c, g, or t
  misc_feature (393)..(393): n is a, c, g, or t
  misc_feature (395)..(399): n is a, c, g, or t
  misc_feature (401)..(402): n is a, c, g, or t
  misc_feature (404)..(406): n is a, c, g, or t
  misc_feature (408)..(408): n is a, c, g, or t
  misc_feature (410)..(423): n is a, c, g, or t
  misc_feature (425)..(425): n is a, c, g, or t
  misc_feature (427)..(434): n is a, c, g, or t
  misc_feature (436)..(449): n is a, c, g, or t
  misc_feature (452)..(458): n is a, c, g, or t
  misc_feature (460)..(460): n is a, c, g, or t
  misc_feature (462)..(499): n is a, c, g, or t
  misc_feature (501)..(503): n is a, c, g, or t
  misc_feature (505)..(508): n is a, c, g, or t
  misc_feature (510)..(516): n is a, c, g, or t
  misc_feature (519)..(541): n is a, c, g, or t
  misc_feature (543)..(547): n is a, c, g, or t
  misc_feature (549)..(552): n is a, c, g, or t
  misc_feature (554)..(555): n is a, c, g, or t
  misc_feature (557)..(557): n is a, c, g, or t
  misc_feature (559)..(559): n is a, c, g, or t
  misc_feature (561)..(567): n is a, c, g, or t
  misc_feature (569)..(570): n is a, c, g, or t
  misc_feature (572)..(573): n is a, c, g, or t
  misc_feature (575)..(582): n is a, c, g, or t
  misc_feature (584)..(585): n is a, c, g, or t
  misc_feature (587)..(588): n is a, c, g, or t
  misc_feature (590)..(590): n is a, c, g, or t
  misc_feature (592)..(596): n is a, c, g, or t
  misc_feature (598)..(600): n is a, c, g, or t
  misc_feature (603)..(604): n is a, c, g, or t
  misc_feature (607)..(610): n is a, c, g, or t
  misc_feature (612)..(614): n is a, c, g, or t
  misc_feature (616)..(618): n is a, c, g, or t
  misc_feature (620)..(629): n is a, c, g, or t
  misc_feature (633)..(634): n is a, c, g, or t
  misc_feature (636)..(639): n is a, c, g, or t
  misc_feature (642)..(644): n is a, c, g, or t
  misc_feature (646)..(649): n is a, c, g, or t
  misc_feature (651)..(659): n is a, c, g, or t
  misc_feature (661)..(666): n is a, c, g, or t
  misc_feature (668)..(671): n is a, c, g, or t
  misc_feature (674)..(679): n is a, c, g, or t
  misc_feature (681)..(689): n is a, c, g, or t
  misc_feature (691)..(700): n is a, c, g, or t
  misc_feature (702)..(705): n is a, c, g, or t
  misc_feature (707)..(709): n is a, c, g, or t
  misc_feature (711)..(711): n is a, c, g, or t
  misc_feature (713)..(733): n is a, c, g, or t
  misc_feature (735)..(748): n is a, c, g, or t
  misc_feature (750)..(751): n is a, c, g, or t
  misc_feature (753)..(757): n is a, c, g, or t
  misc_feature (759)..(759): n is a, c, g, or t
  misc_feature (761)..(771): n is a, c, g, or t
  misc_feature (773)..(774): n is a, c, g, or t
  misc_feature (777)..(779): n is a, c, g, or t
  misc_feature (781)..(781): n is a, c, g, or t
  misc_feature (783)..(790): n is a, c, g, or t
  misc_feature (792)..(795): n is a, c, g, or t
  misc_feature (798)..(801): n is a, c, g, or t
  misc_feature (803)..(805): n is a, c, g, or t
  misc_feature (807)..(808): n is a, c, g, or t
  misc_feature (810)..(814): n is a, c, g, or t
  misc_feature (816)..(817): n is a, c, g, or t
  misc_feature (819)..(829): n is a, c, g, or t
  misc_feature (831)..(835): n is a, c, g, or t
  misc_feature (840)..(841): n is a, c, g, or t
  misc_feature (843)..(850): n is a, c, g, or t
  misc_feature (852)..(853): n is a, c, g, or t
  misc_feature (855)..(859): n is a, c, g, or t
  misc_feature (861)..(865): n is a, c, g, or t
  misc_feature (867)..(875): n is a, c, g, or t
  misc_feature (877)..(880): n is a, c, g, or t
  misc_feature (883)..(883): n is a, c, g, or t
  misc_feature (886)..(893): n is a, c, g, or t
  misc_feature (895)..(899): n is a, c, g, or t
  misc_feature (901)..(903): n is a, c, g, or t
  misc_feature (906)..(914): n is a, c, g, or t
  misc_feature (916)..(918): n is a, c, g, or t
  misc_feature (921)..(929): n is a, c, g, or t
  misc_feature (931)..(931): n is a, c, g, or t
  misc_feature (933)..(934): n is a, c, g, or t
  misc_feature (936)..(936): n is a, c, g, or t
  misc_feature (938)..(940): n is a, c, g, or t
  misc_feature (943)..(943): n is a, c, g, or t
  misc_feature (945)..(949): n is a, c, g, or t
  misc_feature (952)..(952): n is a, c, g, or t
  misc_feature (954)..(963): n is a, c, g, or t
  misc_feature (965)..(967): n is a, c, g, or t
  misc_feature (969)..(976): n is a, c, g, or t
  misc_feature (978)..(978): n is a, c, g, or t
  misc_feature (980)..(981): n is a, c, g, or t
  misc_feature (986)..(992): n is a, c, g, or t
  misc_feature (994)..(1001): n is a, c, g, or t
  misc_feature (1003)..(1005): n is a, c, g, or t
  misc_feature (1007)..(1007): n is a, c, g, or t
  misc_feature (1010)..(1013): n is a, c, g, or t
  misc_feature (1015)..(1018): n is a, c, g, or t
  misc_feature (1020)..(1021): n is a, c, g, or t
  misc_feature (1023)..(1024): n is a, c, g, or t
  misc_feature (1026)..(1028): n is a, c, g, or t
  misc_feature (1032)..(1033): n is a, c, g, or t
  misc_feature (1035)..(1039): n is a, c, g, or t
  misc_feature (1041)..(1042): n is a, c, g, or t
  misc_feature (1044)..(1045): n is a, c, g, or t
  misc_feature (1047)..(1047): n is a, c, g, or t
  misc_feature (1051)..(1051): n is a, c, g, or t
  misc_feature (1053)..(1057): n is a, c, g, or t
  misc_feature (1059)..(1060): n is a, c, g, or t
  misc_feature (1062)..(1063): n is a, c, g, or t
  misc_feature (1066)..(1066): n is a, c, g, or t
  misc_feature (1068)..(1072): n is a, c, g, or t
  misc_feature (1076)..(1078): n is a, c, g, or t
  misc_feature (1081)..(1081): n is a, c, g, or t
  misc_feature (1083)..(1093): n is a, c, g, or t
  misc_feature (1095)..(1096): n is a, c, g, or t
  misc_feature (1098)..(1098): n is a, c, g, or t
  misc_feature (1102)..(1102): n is a, c, g, or t
  misc_feature (1104)..(1105): n is a, c, g, or t
  misc_feature (1107)..(1107): n is a, c, g, or t
  misc_feature (1110)..(1110): n is a, c, g, or t
  misc_feature (1114)..(1114): n is a, c, g, or t
  misc_feature (1116)..(1116): n is a, c, g, or t
  misc_feature (1118)..(1118): n is a, c, g, or t
  misc_feature (1120)..(1120): n is a, c, g, or t
  misc_feature (1122)..(1123): n is a, c, g, or t
  misc_feature (1125)..(1125): n is a, c, g, or t
  misc_feature (1127)..(1127): n is a, c, g, or t
  misc_feature (1129)..(1129): n is a, c, g, or t
  misc_feature (1132)..(1133): n is a, c, g, or t
  misc_feature (1135)..(1137): n is a, c, g, or t
  misc_feature (1139)..(1139): n is a, c, g, or t
  misc_feature (1141)..(1144): n is a, c, g, or t
  misc_feature (1146)..(1148): n is a, c, g, or t
  misc_feature (1150)..(1150): n is a, c, g, or t
  misc_feature (1152)..(1152): n is a, c, g, or t
  misc_feature (1154)..(1155): n is a, c, g, or t
  misc_feature (1157)..(1159): n is a, c, g, or t
  misc_feature (1162)..(1163): n is a, c, g, or t
  misc_feature (1165)..(1167): n is a, c, g, or t
  misc_feature (1169)..(1171): n is a, c, g, or t
  misc_feature (1176)..(1177): n is a, c, g, or t
  misc_feature (1179)..(1179): n is a, c, g, or t
  misc_feature (1182)..(1186): n is a, c, g, or t
  misc_feature (1189)..(1191): n is a, c, g, or t
  misc_feature (1195)..(1195): n is a, c, g, or t
  misc_feature (1198)..(1204): n is a, c, g, or t
  misc_feature (1206)..(1207): n is a, c, g, or t
  misc_feature (1210)..(1210): n is a, c, g, or t
  misc_feature (1212)..(1217): n is a, c, g, or t
  misc_feature (1219)..(1223): n is a, c, g, or t
  misc_feature (1225)..(1227): n is a, c, g, or t
  misc_feature (1229)..(1230): n is a, c, g, or t
  misc_feature (1232)..(1232): n is a, c, g, or t
  misc_feature (1234)..(1238): n is a, c, g, or t
  misc_feature (1240)..(1240): n is a, c, g, or t
  misc_feature (1243)..(1245): n is a, c, g, or t
  misc_feature (1249)..(1249): n is a, c, g, or t
  misc_feature (1251)..(1252): n is a, c, g, or t
  misc_feature (1255)..(1256): n is a, c, g, or t
  misc_feature (1258)..(1259): n is a, c, g, or t
  misc_feature (1261)..(1261): n is a, c, g, or t
  misc_feature (1264)..(1264): n is a, c, g, or t
  misc_feature (1266)..(1266): n is a, c, g, or t
  misc_feature (1268)..(1274): n is a, c, g, or t
  misc_feature (1276)..(1277): n is a, c, g, or t
  misc_feature (1280)..(1284): n is a, c, g, or t
  misc_feature (1287)..(1287): n is a, c, g, or t
  misc_feature (1289)..(1289): n is a, c, g, or t
  misc_feature (1291)..(1293): n is a, c, g, or t
  misc_feature (1295)..(1298): n is a, c, g, or t
  misc_feature (1302)..(1302): n is a, c, g, or t
  misc_feature (1304)..(1304): n is a, c, g, or t
  misc_feature (1306)..(1306): n is a, c, g, or t
  misc_feature (1309)..(1318): n is a, c, g, or t
  misc_feature (1320)..(1321): n is a, c, g, or t
  misc_feature (1323)..(1323): n is a, c, g, or t
  misc_feature (1327)..(1327): n is a, c, g, or t
  misc_feature (1330)..(1331): n is a, c, g, or t
  misc_feature (1333)..(1333): n is a, c, g, or t
  misc_feature (1336)..(1337): n is a, c, g, or t
  misc_feature (1341)..(1341): n is a, c, g, or t
  misc_feature (1345)..(1348): n is a, c, g, or t
  misc_feature (1351)..(1351): n is a, c, g, or t
  misc_feature (1356)..(1360): n is a, c, g, or t
  misc_feature (1362)..(1363): n is a, c, g, or t
  misc_feature (1366)..(1369): n is a, c, g, or t
  misc_feature (1371)..(1371): n is a, c, g, or t
  misc_feature (1373)..(1374): n is a, c, g, or t
  misc_feature (1376)..(1377): n is a, c, g, or t
  misc_feature (1380)..(1380): n is a, c, g, or t
  misc_feature (1383)..(1384): n is a, c, g, or t
  misc_feature (1387)..(1387): n is a, c, g, or t
  misc_feature (1389)..(1390): n is a, c, g, or t
  misc_feature (1392)..(1393): n is a, c, g, or t
  misc_feature (1395)..(1395): n is a, c, g, or t
  misc_feature (1398)..(1399): n is a, c, g, or t
  misc_feature (1402)..(1403): n is a, c, g, or t
  misc_feature (1405)..(1405): n is a, c, g, or t
  misc_feature (1408)..(1408): n is a, c, g, or t
  misc_feature (1410)..(1410): n is a, c, g, or t
  misc_feature (1412)..(1414): n is a, c, g, or t
  misc_feature (1420)..(1420): n is a, c, g, or t
  misc_feature (1422)..(1422): n is a, c, g, or t
  misc_feature (1425)..(1426): n is a, c, g, or t
  misc_feature (1429)..(1430): n is a, c, g, or t
  misc_feature (1432)..(1432): n is a, c, g, or t
  misc_feature (1434)..(1435): n is a, c, g, or t
  misc_feature (1438)..(1438): n is a, c, g, or t
  misc_feature (1443)..(1443): n is a, c, g, or t
  misc_feature (1446)..(1447): n is a, c, g, or t
  misc_feature (1449)..(1450): n is a, c, g, or t
  misc_feature (1453)..(1453): n is a, c, g, or t
  misc_feature (1456)..(1456): n is a, c, g, or t
  misc_feature (1464)..(1464): n is a, c, g, or t
  misc_feature (1466)..(1466): n is a, c, g, or t
  misc_feature (1468)..(1468): n is a, c, g, or t
  misc_feature (1470)..(1470): n is a, c, g, or t
  misc_feature (1474)..(1474): n is a, c, g, or t
  misc_feature (1483)..(1483): n is a, c, g, or t
  misc_feature (1486)..(1486): n is a, c, g, or t
  misc_feature (1488)..(1488): n is a, c, g, or t
  misc_feature (1490)..(1490): n is a, c, g, or t
  misc_feature (1492)..(1493): n is a, c, g, or t
  misc_feature (1495)..(1495): n is a, c, g, or t
  misc_feature (1497)..(1499): n is a, c, g, or t
  misc_feature (1501)..(1507): n is a, c, g, or t
  misc_feature (1518)..(1518): n is a, c, g, or t
  misc_feature (1520)..(1524): n is a, c, g, or t
  misc_feature (1527)..(1528): n is a, c, g, or t
  misc_feature (1531)..(1531): n is a, c, g, or t
  misc_feature (1535)..(1536): n is a, c, g, or t
  misc_feature (1538)..(1543): n is a, c, g, or t
  misc_feature (1545)..(1546): n is a, c, g, or t
  misc_feature (1549)..(1549): n is a, c, g, or t
  misc_feature (1551)..(1555): n is a, c, g, or t
  misc_feature (1557)..(1557): n is a, c, g, or t
  misc_feature (1562)..(1562): n is a, c, g, or t
  misc_feature (1564)..(1564): n is a, c, g, or t
  misc_feature (1569)..(1571): n is a, c, g, or t
  misc_feature (1574)..(1574): n is a, c, g, or t
  misc_feature (1576)..(1576): n is a, c, g, or t
  misc_feature (1582)..(1583): n is a, c, g, or t
  misc_feature (1588)..(1588): n is a, c, g, or t
  misc_feature (1593)..(1593): n is a, c, g, or t
  misc_feature (1599)..(1600): n is a, c, g, or t
  misc_feature (1605)..(1605): n is a, c, g, or t
  misc_feature (1610)..(1610): n is a, c, g, or t
  misc_feature (1613)..(1613): n is a, c, g, or t
  misc_feature (1617)..(1618): n is a, c, g, or t
  misc_feature (1621)..(1622): n is a, c, g, or t
  misc_feature (1626)..(1627): n is a, c, g, or t
  misc_feature (1629)..(1631): n is a, c, g, or t
  misc_feature (1636)..(1637): n is a, c, g, or t
  misc_feature (1639)..(1640): n is a, c, g, or t
  misc_feature (1642)..(1643): n is a, c, g, or t
  misc_feature (1647)..(1647): n is a, c, g, or t
  misc_feature (1651)..(1651): n is a, c, g, or t
  misc_feature (1653)..(1654): n is a, c, g, or t
  misc_feature (1656)..(1657): n is a, c, g, or t
  misc_feature (1661)..(1661): n is a, c, g, or t
  misc_feature (1663)..(1663): n is a, c, g, or t
  misc_feature (1667)..(1667): n is a, c, g, or t
  misc_feature (1672)..(1672): n is a, c, g, or t
  misc_feature (1674)..(1674): n is a, c, g, or t
  misc_feature (1676)..(1676): n is a, c, g, or t
  misc_feature (1681)..(1682): n is a, c, g, or t
  misc_feature (1688)..(1689): n is a, c, g, or t
  misc_feature (1695)..(1695): n is a, c, g, or t
  misc_feature (1699)..(1699): n is a, c, g, or t
  misc_feature (1702)..(1702): n is a, c, g, or t
  misc_feature (1705)..(1706): n is a, c, g, or t
  misc_feature (1708)..(1708): n is a, c, g, or t
  misc_feature (1712)..(1712): n is a, c, g, or t
  misc_feature (1714)..(1714): n is a, c, g, or t
  misc_feature (1716)..(1717): n is a, c, g, or t
  misc_feature (1719)..(1719): n is a, c, g, or t
  misc_feature (1722)..(1726): n is a, c, g, or t
  misc_feature (1735)..(1735): n is a, c, g, or t
  misc_feature (1737)..(1737): n is a, c, g, or t
  misc_feature (1747)..(1747): n is a, c, g, or t
  misc_feature (1750)..(1750): n is a, c, g, or t
  misc_feature (1752)..(1752): n is a, c, g, or t
  misc_feature (1754)..(1754): n is a, c, g, or t
  misc_feature (1762)..(1762): n is a, c, g, or t
  misc_feature (1770)..(1771): n is a, c, g, or t
  misc_feature (1774)..(1775): n is a, c, g, or t
  misc_feature (1777)..(1777): n is a, c, g, or t
  misc_feature (1779)..(1779): n is a, c, g, or t
  misc_feature (1787)..(1787): n is a, c, g, or t
  misc_feature (1797)..(1797): n is a, c, g, or t
  misc_feature (1840)..(1840): n is a, c, g, or t
  misc_feature (1848)..(1848): n is a, c, g, or t
  misc_feature (2236)..(2236): n is a, c, g, or t
  misc_feature (2362)..(2362): n is a, c, g, or t
  misc_feature (2445)..(2445): n is a, c, g, or t
  misc_feature (3529)..(3529): n is a, c, g, or t
  misc_feature (3571)..(3571): n is a, c, g, or t
  misc_feature (3772)..(3772): n is a, c, g, or t
  misc_feature (3805)..(3805): n is a, c, g, or t
  misc_feature (3890)..(3890): n is a, c, g, or t
  misc_feature (3961)..(3961): n is a, c, g, or t
  misc_feature (3976)..(3976): n is a, c, g, or t
nnnnnnnnnnnnnnnnnncnnnnnnnnnncnnnnnncncnncnnnnnnnannnnnnnnncnnnnncgacnnnnnnnnnnncntcnnnngnnnnnnnnncgnnnnnnnnnnncncnncnnnnnnnnnnncntnnnngnnnnnnnnntnnnnnnnnnnnnnnnnnnnnnnnnnnntnnnctnatnnnnnnnnngnnnnnnnnnangnnncnnnngnnnnnnnnnnncnnncngnncnnnnnnnnnnnnnngnnnnnnnannnnnnnnnnntnnngnnnnnnnnncnnnnnncgnncnnnnngnngcnnannnncnnnnnnnnnnnnannnnnnnngnnnnnntnannnnnnncnncnnnnnnnnnnnnnnnnnncnncnnnnncnnnnnnnncgncnnnnncnnannngncnnnnnnnnnnnnnncncnnnnnnnncnnnnnnnnnnnnnnccnnnnnnncncnnnnnnnnnnnnnnnnnnnnnnnnnnnnnnnnnnnnnnannncnnnntnnnnnnncannnnnnnnnnnnnnnnnnnnnnntnnnnntnnnncnncncngnnnnnnncnncnncnnnnnnnncnncnncncnnnnngnnncgnnacnnnngnnncnnncnnnnnnnnnncganntnnnngannncnnnnannnnnnnnncnnnnnnannnntcnnnnnntnnnnnnnnntnnnnnnnnnngnnnncnnngngnnnnnnnnnnnnnnnnnnnnngnnnnnnnnnnnnnngnntnnnnngntnnnnnnnnnnncnncgnnntngnnnnnnnngnnnnggnnnncnnngnngnnnnngnngnnnnnnnnnnngnnnnntgctnngnnnnnnnngnntnnnnngnnnnngnnnnnnnnncnnnngcngcnnnnnnnncnnnnncnnnctnnnnnnnnncnnnctnnnnnnnnncntnntncnnntgngnnnnngcntnnnnnnnnnnannntnnnnnnnngncnnggcannnnnnncnnnnnnnntnnncntgnnnntnnnngnngnntnnntctnngnnnnngnntnntncgtntnnnnngnntnngcngnnnnngcgnnngcngnnnnnnnnnnngnngnggcngnntncgncgcngncncntnngncncnganncnnncncnnnngnnncngncnnannnganncnnncnnngcctnntncgnnnnngcnnntgcngcnnnnnnngnngcntnnnnnncnnnnncnnncnnancnnnnncngcnnntgcngnngcnncnncngcngncnnnnnnncnncgnnnnnagncntnnncnnnncagncngngcnnnnnnnnnngnngnctgngcnncnttnnctgncgcnnnngcngcggnnnnngnngtnnnngnanncnnagnctnngcngnntnntnagnntgnncnggntntnnnggctgngncgnntcnngngnntgngccgnttnngnngtntgngccggttncngngnctgngctgactcntgngncngnncngnnncnnnnnnnggcgcaggctnannnnncgnngcnggcnnannnnnngnngcngnnnnntnagccngngccgnnngtncnggctgnncgggngcagnagcctnngccgncgtancantctnntcnntctnncnnncgccnncnncnngctncgcngnngnngccngngcanccggntncnccgcnntattcnnctcggncgcncgntgnncntcancngnntncgnnnnngcgggggcngncgaagacgcngantntnccgaagcnttatcctnngcnngntnggcgttcnccgccacagnggcagcaggttgtacaggttgtgattgtaccggcgcctgcganccttgcgntgcagaagcagaagtatcagcagcaggtgaagcagcagcatttttcacggacataccgggctgcacagccgcgtgcgcagcgcccggagccggtgctgcggtggcaggcgcatccgaggaagaagcgggcgcttccacacccattgacgcaccctcagccgaggaggcggcagccgcatcctgcccctggttcagagcggctttcctcttttgccggtaggtgtacatgtacacgagcccggcgaaggcaagctgcagaataagggcctgcacaaagtcaagcggctgttcctcacgaaccgcaccaaagggatcctccaaacccagcagcccaaagataaaaatcgaaacattattcgcaatatgcagaccgataccggcttcaagnccgccggtgtaccagcacaagaacccggcgatcagagccatcgtcagcacagaaagcagaccccacagtccgtaaccatgcagcaccataaagataggcgctggaataataattgcccaaacgggnttcttcagccaccgacccacggtctgcatgagataaccgcggaagagcagttcctcggcgtagcactggaacggaactattancagaataagcacaatgtacagccagaacatgccggaattcagcggatgcacgctgttctgcgtggtcaaagaaccatccagagtcgcgaaccctacatagtaaagaccgaaaatgaggaacccaaagcctaggaaaacacctaaataggaccaccgcatgcggcccgcaatggagtgaatcagccctaagggtttgaagttggtaatcaggcgcgcaatgaaaatcgccggaatcaccggaatgatggtaataaggagcgcaataaaaacaagcggggtcttaaaaacgttcgcgtaaatacgctgcagatcggtcaggtaatcgtaagggacgcgcagcatcacggcgaatgccagcagcgcaaagctcacaatcagcaggagcacaaaatagatgccggcaatcagcaagccctcaagaaccggggtgaaccaacgcgcacgcgggttcacatgcgataaccggtgatagggcagctcgctggcgcgttccagaagttccttacgggtaaggcggttactcctgtaatactcagcggaggcgaaggtagactcagcgccgtacccgtaactttctgcctgatgcgggctcagcatcgtgggcatattttgggtattagtgactgcgccaggtggttggtttgttggaatgaactcagaaccgtgatgtccgggttcctgctggtgattagtgctcatagtatccataatagaggggaccctcccccgaatgtcacaccggggccatctgtgcgggttgccttacggtgtaataatttacctgcctatgaacttttcgggcttatattttatgggaaatatgccataatttgagggttaccgtagtttaaaatttgaggctactcgtgcctacgcttccgggtgtttttggcgccagtagtgaaggaaggttcagatggctctcgtcttcaatccgcccccaaattggcccaaaccgcctgccgggtggtctcctaccccgacgtggcggcccgatcccgcatggggtcctgttcccgaaggttggcagctgtggattgaggagcccgagcctgagaatgagcaggcaccctcgacggcggantcttcatctgccgcatcgggctcttctgagggttcttccagngcgaagccctcgccatcgtcaagctctgagcagagcggtgagtctgcgcaggattctgccccgaagcagcgtaccgcgccgaccatttccgaacagtttgccgagcagaaaacttcccatcagcagacccctgagcagaagactcaggcggagtctgcccacgctcaggatgcggcgtccaggagttccgagccgcgcgangccgcgggtgagcgtgcgggcgcatccggttcnggtgcagcggcaggctcttcggccgagtcgcaggtgcgttccgagcagagcgtttctgagactcccgtgaaccgtcagagcggcnccgccgaggctccaaagcctcaggtttcggagcctacccgcgagcccgctcgcgatacccacaatgccccntccgcgccggagacnagcgcacagcagccgggagtcgcg

SEQ ID NO: 1096 - DNA, 4000 bp, Escherichia coli
  misc_feature (797)..(797): n is a, c, g, or t
  misc_feature (1985)..(1985): n is a, c, g, or t
  misc_feature (3137)..(3137): n is a, c, g, or t
  misc_feature (3182)..(3182): n is a, c, g, or t
  misc_feature (3212)..(3212): n is a, c, g, or t
  misc_feature (3519)..(3519): n is a, c, g, or t
  misc_feature (3600)..(3600): n is a, c, g, or t
  misc_feature (3660)..(3660): n is a, c, g, or t
acatccccctaatattgacccgacagagcatatcaatgcatatttaaacgctttggctggtattgcaactgctaacgctattaagagaacgtccggcggaatcgggaaaaaagaggattcacaaaatgcgagtataaagagcgcccacgtactatgaggcctttctgcccaatgtattgtccaatcatagagcctccttatataatttgcttttctagtgacgtgctctttttcaattgattccattatctaattatgcaaacgacaaatgctgtgttgtaatgattagttaaagttgcatagtctctgtaagttacccgttacttagctactctttcttcgccaccttaggtatgtagatacaatacggctcttctgccatgtagtctcctgtttcgtagaacgcacgtgctctgcaaccttcgcaaaccttcttgtattcgcataggccacacttgcctccaagcaaatcaggctgtctgagtttggcgaaaacagcagaatccttccagatatctacaaacttctgcttcttgatgtgtccggcttcaactggcagatatccacatgggaagacctctcccttgtgagaaacaaagcatactccggtcccggccaggcatccttttgtcattgcggccattccgtgagtcttcggtgtgatcttgacaccctcttcttttgcccgttcgcgcattattctgaaatagtgaggtgaacaggtagccttagtctggatcactgcctctttggatagatcatagaaaagattaaggagctcctcgtacttttcagcnggcagcatctggtcctccgcaatttcaacaccgcaacctaccggaacgagcataaatatatgaatcgcctcggcgcccaagttaacggcaaggttatacaagtcgcgaaactgatgtgcgttgtgctttgcaatagtacagttaacctgcatacccattcccagcgccaataaatttttgaatccttttatggccagctcaaacgatcctttcaatttgcggaattcgtcgtgagtagctgcatctgcaccgtcaaggcttatagcaaccctggatacacctgagtcaacaattttcttcgccatagcctcatctaccaatgtaccattggtagccagtgcgactgttaagccttgtttcaccgcgtattttgcaatatcgaatatgtctgggcgaaaaagcggttctcctccgcttaagacaagaatagggttacccgcttctactattgcatcgacgagttcgaaggattctttcgtggtcaaatcatcattcatcagctgggtacttacgtctatccttctacagtgaatacactccagattacagccagcagtcgtttcccagaaaacaagccgaagtttgttctgcatatttctcatatattcactggaaaccttggcgtccccatgtccttttatttgtgagtatacttccttgatagttccttcaggcatgccatgcggcataccctgtgaacctgaaccgttaccgtgatcatccttcattcttgcccccagtattctttctacattattggtaaaatgcgttaaattgtttgtccttgacaaggcaatttagcactgtaatattaaaattttgcataatatttacgattttacccttattttgcataaattcaaatacaaaaatatctaattaatcataaatgcgggtgttatgaagaccagagaaaaaataacaatatatgatacaacattgcgagatggcagccaatctgagggtatctcgttttctctgcaggataaagtaggaatagcacttaagctcgatgatctcggcgtagattatattgagggcggttatccattatctaatcccaaagataagaattttttcaaagagatcagaaaaaattcgttacagaacgctaaggttgccgcatttggcagtacaaagcgggcgaataaaaaggcatcggaagatcctggaataaaagcactgctnttaacagagatgactgtcgtaacaatcgtagccaagagttgggatttccatgtaacagatgttctcaaggtatcgttggatgaaaatctgaaaatggtatcggaaacagtcgaatatttgaaatcaaaaggaagagaagttattctcgatgcagaacatttttttgacgggtacaagaataattccagatattcattaaaagtattgaaggctgcacagaattcaggggtggatacaattgtcctttgtgataccaacggaggatgtttgccgcaagaagtggaaaagatcactggaagtgttatgggtaagataaaagtgccgctgggcatacatactcacaacgacggtgaacttgctgtggctaataccattgctgccataaattccggagcaaggcatgtacaggggacaataaacgggcttggagagagatgtggcaatgcgaatctctgttcggtaataccgaatctggtattgaaaaataaatttaagtgtcttggcaattcggaactcaagaaacttacggaaatatcaagatatgtcaacgaagtggcaaattttgtacccatggcgaatcagccttttgtaggttcaagtgcttttgcacacaaaggcggtttgcacgtaaatgcaatacagaagaacaaaagtacttacgagcatatagagccggagacagttggaaacgagagaaggattttaatatccgaactctccggaagctcaaatattctcaaaaaggtagaaaaatataagattgcacacgataagaaaataatgaagaagattctgaacaaagtccaggatatggagaacgaggggtatcattttgaatctgcagaaggttcattcgacctcctggtcaagaaggtgataggaaagcacaaaggtttttttgaacttgaagatttcagggtaactgtggaaagaggaaaagatggaaaatctactactcgtgcaaacgttaagataaaggttaatggtgtagaggagctgacggttagtgatggggatggtcctgtaaatgcccttgacggcgcattgcgaaaggcccttgagaaattctacccatctctttcggatatgcatctgatagattttaaggtacgtgttattaatcctaaagaggcaactgccgcgaaggtaagngtaataattgaatctcacgatcacaaagatacctggggtactgtnggtgtgtctggaaacctgatagaggcgagntggaaagcacttgtagaaagtattgaatataaacttttaaaggacgaagatggagactgaattaccaacaaaatacaatcctaaggagatagaggataaatggtacagcttttgggaagagggcaatttttttcattgcgaaccggatcctgccaagaaaccatatactatagtaattccacctccaaatgttacaggtgtcttacatatggggcatgctctcaataatatcctgcaggatattttgataagatggagaaggatgcagggatacaacacactatggatgccgggaacagatcacgcnggcatagcaactcagaatgtcgttgaaaggaaattggcgaaacaaggtacaaaccggcatgagcttggaagggaaaagttnatcgaggaggtgtggaaatggaaaaaagagtacggttcagaaatcatgaaacagcttagnaaactgggttcatcgtgtgattgggaaagagaaagattcacgatggacgaaggtttgtcaaaagccgttaaagaggcatttgttaaactgtatgaaaaaggatttatttataaaggaaaatacattgttaactggtgcccaaggtgccttaccgccatttcagatgatgaggtagaacatgaagatcatgaagggcacctctggcatatcagatatccttttcgggatgcacctcacctgtttgttactattgcgacaacacgtccggaaacgatgctgggtgatgttgccgtcgcggtaaatccggaggatgaacgatataaggatatgataggcgaga

SEQ ID NO: 1097 - DNA, 4000 bp, Escherichia coli
  misc_feature (1)..(4): n is a, c, g, or t
  misc_feature (6)..(6): n is a, c, g, or t
  misc_feature (8)..(10): n is a, c, g, or t
  misc_feature (12)..(13): n is a, c, g, or t
  misc_feature (19)..(19): n is a, c, g, or t
  misc_feature (25)..(26): n is a, c, g, or t
  misc_feature (28)..(32): n is a, c, g, or t
  misc_feature (35)..(36): n is a, c, g, or t
  misc_feature (42)..(42): n is a, c, g, or t
  misc_feature (44)..(44): n is a, c, g, or t
  misc_feature (47)..(48): n is a, c, g, or t
  misc_feature (50)..(50): n is a, c, g, or t
  misc_feature (52)..(53): n is a, c, g, or t
  misc_feature (56)..(56): n is a, c, g, or t
  misc_feature (59)..(63): n is a, c, g, or t
  misc_feature (65)..(66): n is a, c, g, or t
  misc_feature (68)..(70): n is a, c, g, or t
  misc_feature (74)..(75): n is a, c, g, or t
  misc_feature (78)..(78): n is a, c, g, or t
  misc_feature (80)..(82): n is a, c, g, or t
  misc_feature (85)..(85): n is a, c, g, or t
  misc_feature (90)..(91): n is a, c, g, or t
  misc_feature (93)..(95): n is a, c, g, or t
  misc_feature (101)..(102): n is a, c, g, or t
  misc_feature (104)..(104): n is a, c, g, or t
  misc_feature (106)..(107): n is a, c, g, or t
  misc_feature (110)..(110): n is a, c, g, or t
  misc_feature (112)..(112): n is a, c, g, or t
  misc_feature (114)..(115): n is a, c, g, or t
  misc_feature (119)..(119): n is a, c, g, or t
  misc_feature (122)..(123): n is a, c, g, or t
  misc_feature (125)..(126): n is a, c, g, or t
  misc_feature (128)..(129): n is a, c, g, or t
  misc_feature (139)..(139): n is a, c, g, or t
  misc_feature (141)..(142): n is a, c, g, or t
  misc_feature (144)..(145): n is a, c, g, or t
  misc_feature (147)..(147): n is a, c, g, or t
  misc_feature (149)..(151): n is a, c, g, or t
  misc_feature (153)..(158): n is a, c, g, or t
  misc_feature (160)..(164): n is a, c, g, or t
  misc_feature (166)..(168): n is a, c, g, or t
  misc_feature (171)..(172): n is a, c, g, or t
  misc_feature (174)..(174): n is a, c, g, or t
  misc_feature (176)..(178): n is a, c, g, or t
  misc_feature (182)..(183): n is a, c, g, or t
  misc_feature (187)..(187): n is a, c, g, or t
  misc_feature (189)..(189): n is a, c, g, or t
  misc_feature (192)..(192): n is a, c, g, or t
  misc_feature (195)..(196): n is a, c, g, or t
  misc_feature (198)..(199): n is a, c, g, or t
  misc_feature (201)..(201): n is a, c, g, or t
  misc_feature (203)..(203): n is a, c, g, or t
  misc_feature (206)..(208): n is a, c, g, or t
  misc_feature (211)..(213): n is a, c, g, or t
  misc_feature (217)..(218): n is a, c, g, or t
  misc_feature (222)..(222): n is a, c, g, or t
  misc_feature (224)..(225): n is a, c, g, or t
  misc_feature (228)..(228): n is a, c, g, or t
  misc_feature (231)..(232): n is a, c, g, or t
  misc_feature (234)..(234): n is a, c, g, or t
  misc_feature (236)..(239): n is a, c, g, or t
  misc_feature (241)..(241): n is a, c, g, or t
  misc_feature (243)..(244): n is a, c, g, or t
  misc_feature (247)..(250): n is a, c, g, or t
  misc_feature (253)..(253): n is a, c, g, or t
  misc_feature (255)..(258): n is a, c, g, or t
  misc_feature (261)..(261): n is a, c, g, or t
  misc_feature (263)..(265): n is a, c, g, or t
  misc_feature (268)..(275): n is a, c, g, or t
  misc_feature (277)..(277): n is a, c, g, or t
  misc_feature (279)..(279): n is a, c, g, or t
  misc_feature (281)..(285): n is a, c, g, or t
  misc_feature (287)..(289): n is a, c, g, or t
  misc_feature (291)..(294): n is a, c, g, or t
  misc_feature (300)..(301): n is a, c, g, or t
  misc_feature (305)..(305): n is a, c, g, or t
  misc_feature (310)..(310): n is a, c, g, or t
  misc_feature (314)..(316): n is a, c, g, or t
  misc_feature (318)..(318): n is a, c, g, or t
  misc_feature (320)..(320): n is a, c, g, or t
  misc_feature (322)..(322): n is a, c, g, or t
  misc_feature (327)..(327): n is a, c, g, or t
  misc_feature (335)..(336): n is a, c, g, or t
  misc_feature (338)..(338): n is a, c, g, or t
  misc_feature (343)..(349): n is a, c, g, or t
  misc_feature (351)..(351): n is a, c, g, or t
  misc_feature (354)..(354): n is a, c, g, or t
  misc_feature (359)..(359): n is a, c, g, or t
  misc_feature (364)..(365): n is a, c, g, or t
  misc_feature (368)..(369): n is a, c, g, or t
  misc_feature (371)..(371): n is a, c, g, or t
  misc_feature (374)..(375): n is a, c, g, or t
  misc_feature (381)..(382): n is a, c, g, or t
  misc_feature (384)..(384): n is a, c, g, or t
  misc_feature (386)..(387): n is a, c, g, or t
  misc_feature (389)..(389): n is a, c, g, or t
  misc_feature (391)..(392): n is a, c, g, or t
  misc_feature (395)..(396): n is a, c, g, or t
  misc_feature (399)..(404): n is a, c, g, or t
  misc_feature (406)..(413): n is a, c, g, or t
  misc_feature (415)..(415): n is a, c, g, or t
  misc_feature (419)..(422): n is a, c, g, or t
  misc_feature (425)..(426): n is a, c, g, or t
  misc_feature (430)..(431): n is a, c, g, or t
  misc_feature (436)..(436): n is a, c, g, or t
  misc_feature (438)..(440): n is a, c, g, or t
  misc_feature (443)..(443): n is a, c, g, or t
  misc_feature (447)..(448): n is a, c, g, or t
  misc_feature (450)..(451): n is a, c, g, or t
  misc_feature (453)..(453): n is a, c, g, or t
  misc_feature (457)..(457): n is a, c, g, or t
  misc_feature (460)..(462): n is a, c, g, or t
  misc_feature (464)..(464): n is a, c, g, or t
  misc_feature (470)..(471): n is a, c, g, or t
  misc_feature (475)..(475): n is a, c, g, or t
  misc_feature (478)..(478): n is a, c, g, or t
  misc_feature (480)..(480): n is a, c, g, or t
  misc_feature (493)..(493): n is a, c, g, or t
  misc_feature (498)..(498): n is a, c, g, or t
  misc_feature (503)..(504): n is a, c, g, or t
  misc_feature (507)..(508): n is a, c, g, or t
  misc_feature (510)..(511): n is a, c, g, or t
  misc_feature (514)..(515): n is a, c, g, or t
  misc_feature (519)..(519): n is a, c, g, or t
  misc_feature (523)..(523): n is a, c, g, or t
  misc_feature (526)..(528): n is a, c, g, or t
  misc_feature (532)..(532): n is a, c, g, or t
  misc_feature (535)..(535): n is a, c, g, or t
  misc_feature (537)..(537): n is a, c, g, or t
  misc_feature (539)..(539): n is a, c, g, or t
  misc_feature (541)..(541): n is a, c, g, or t
  misc_feature (543)..(544): n is a, c, g, or t
  misc_feature (549)..(549): n is a, c, g, or t
  misc_feature (554)..(556): n is a, c, g, or t
  misc_feature (561)..(561): n is a, c, g, or t
nnnntngnnnanntaaaanaaaaannannnnncannaaaaangnaanngntnnttnagnnnnntnntnnnttcnnccnannnatnttttnncnnnaaaaanngntnntgntngnntggnggnngnntnnttttttgcancnncnncnannngnnnnnnannnnncnnnaanncnannnaagnnggantnatnctnntnncntngtnnnttnnnattnnttcnannttnccnntnannnntncnncgnnnnaanannnngtngnnnccnnnnnnnntncnannnnngnnncnnnnttttcnncggngtcgncggnnnangntnataanaaaagcannanaaaannnnnnngnaanaaaanaaaanncannantannaagaannantnnantnncannaannnnnncnnnnnnnnantgannnnaanncaannttgtnannnaangtgnntnntnaagnggnnngntgggannaacnccnancaaaaaaattttnttttnaagannganngnncgnngaangagngannnaaanaangncngncnnggaancaatnnnttttncgtaaaacaaaatttagggtttagcgcccgtatcgattttacaaaatcttttttgaagctttcccacgagccaggctagaccaaaagtgcctttgcgcttctgaaaaggtggaataacgccatattcttctcgcaggttctgttgtattaagataatccctgagcgtaaccggtgctgaaaatatgcttgcatctgctggattcaataccgctatttcgagtgcgagggtaattcgcgcatttcttttttctccactgttcttatgtgattattttcgtatagttcaaccttgcgcactcgcgtcaatcgcgtacaaacgctagttacaggtagggcactaggaatatgtttgcgaaatgctaaaaataattcgaatggtgttcacaattcctccccctttccttttgatagaagtcgcccttatgttcaaccgtgtttttctaaactctttctcgcagaaacactagcaggaagtataaaccaattcaagcaagtgctgataaagcccaagttataaagcccattaatggcgacccattcatcggaatgctggagacaccggtcacgtctgctcctatcgtatccaactttttatcgaatcttccagcatacagaactggggtatcgccattattaagaggagttgaagttggccttgcgcacggtttctttgtagctggacctttcattaaacttggaccacttcgagcatctgatgccgccgaagtagctggttgcctatctggtgctggtctcattcttattcttacagcgtgcttaagcatctatggtgccacagcttttcaacgtgatgatgttgtcggcgtgaaaactttgagtggacgagctatcaatcgtgatccgttgcaaacttctgacggttgggcttccttcacctcaggatggcttgtggggggattatctggcgtcgcatggtgttatatcctgacccaagtgcttccgtattactcttgatttcagtactgaaccttagaaatgaggtactagttgtaaatatgtccaccactagtatcatcattcctttcaaactacaaatatgtatattcttacataccaataatttcctattttcccggcaatgataatattgagctctcgaaagatcctttgatttgagtctttggaaatcaatcggagcagtgatattgagcattttcaagcatttttcacagaatagccacgtgctccttgaagttcctaaaaccaagtaagcgggacaaaaaaaagcaggacaaaagcgggaagagcgaataaatgccgagagagaacatggtatgaacaaaaaaatgttggcatttggcgccaccgcggatcgaacgcgggacctttagatcttcagtctaacgctctcccaactgagctatggcaccgctttacaactagtgttctagttcgcattcgggtcggaaggcatatttacaaagtaaatacatcttttattctataatttagggtattttagggtatcagctaacaagcatttcgcaaaagatacgagtatgcattcattaaacttttcgtcaatcgttatctcaaaagtacttatttacccgttttgataatttaaagaacacataaacacacaaactggaaagtagcagtgcacattcgtgcatactacatgagtgaagcggaaatacgtaagtatatcatattgaagttccaagaagggaaccgatcctcactttcatacttaatttttcggtaattgttgttctcagctgagctcgaatagtaagctttgaacggtcttaaaagtatattccttcagcatgacaaaaattaaagaagcccctgttttttatcctacacgaaaggatatgttaggctccttcgaaaagtacatagggaaaatagagtccgaacttgcacagcacgggattgcaagaatagttccaccacgaagttggcaaccacggcaaagtggatacaaaagcctgcaatttgtttcggaacaaccgattaaacagcatgtagtaggaagcaagggcttttttcgaacagttcttgtagaatgcaagccgacgtcgattcagaaagagtttaaagttagagcaggagcagctgaaaatcaaccatcacaagcagcattgaaagataactcacttttagaacgcgagttttggaaaaatataacaacttctcctcctgtgtattgcgccgatatacctggaacactgtttgatagaaatataaagggatggcaaatgtcagatttaaatactatcttaacacgtactttgaggaagaatggttcaaatataccaggtgtaagttctgcatacctatattttggaatgtggcgttctttatttgcgtggcacacggaagatgctgacctttacagcttgaactatcttcattttggggcaccaaagttttggtattcaattgctccatgtcatagggaacgttttgaaacattattacgtgggagattccctgaactatctagctcatgcccagaatttttacggcataaggagtttcttgtgtctcctacgattctccatcagaatggcataccattctatcgatccatgcagtatccgggcgaatttatcgttacttatccgggaagctatcatagtggatttaattgtggatttaattgcgcagaaagtacgaattttgctactcgcgcatggatacctatcggtagaagggcaaatatttgcaaatgtgtcagtgattcagttcgcattgatatgtctttatttaagtttgaggacagaaaaatcccacaacaatcagaagagcgtaaaacacggtctgggaacctgaattatactacgaaaaaaaaaaaacgaaagagtatctcttcgaatcattcaacgaaacaatgtgtatctaccattaagctaaagaaatcgatactgaaaggagctctaaaaagagtggcttgctccaggaaaagactcagatactcaaaattgcttgcgttattggagcaggatctaagccttactccaggatctcttaagaatatgaaagatgagttgattgttataaaagatttatatcgctgctgatgtccgggggaaccaaataaatttctgtctagttgcatgacttgtgtttattatatttgttaattagaacagaattcatgtattggaaatctatatattataacaaaagtgaacatcgtagcgatcacttggggcaaactttgacaaatacttaatgaagtaaaaatcatgctctttattctgaacgagtgaaagcgtattaaatgatgcctgtactgatattaattgctcttcatttgatgttgtatcatacacctcagcagttgcggcgatatcctcaacttcaggtgaagttggtatgaagcactcaaagcctccaaaattaccagacatccatgcacgatgctcatttattgaatccgctttaacaaaacataacgtggat

SEQ ID NO: 1098 - DNA, 4000 bp, Escherichia coli
  misc_feature (461)..(461): n is a, c, g, or t
  misc_feature (626)..(626): n is a, c, g, or t
  misc_feature (1292)..(1292): n is a, c, g, or t
  misc_feature (1322)..(1322): n is a, c, g, or t
  misc_feature (1469)..(1469): n is a, c, g, or t
  misc_feature (1583)..(1583): n is a, c, g, or t
  misc_feature (1589)..(1589): n is a, c, g, or t
  misc_feature (2696)..(2696): n is a, c, g, or t
  misc_feature (3366)..(3366): n is a, c, g, or t
tggcaagctggttttataacacccaatagacggcatctgccaaaggagcctttatgaaatttgcaattctgtttgctactggcgccgcctgccttgccactgccgcaatggccgataatgcgatccttgttcaatcaacaacgtcgacaaaaaacgccggtctttatgattatattctgccaatggtcaaagccgataccggcatcacggtgaatgtggtcgcggttggaaccggggcggcgatcaagaatgccatgaattgtgatggtgatgtccttttggtgcatagccggaaacgcgaagaccagttcgttgccgctggttatgccaagcagcgttatgatgtcatgtataatgattttgtggtgattggtccggcgggtgatccggccggcattgctagcggcaaggatgtcatcgctgcaatggtgaaaatcgccaattcgaaatcaaaatttgcntcacgtggggatgattcgggaacgcatagcaaggaaaaatccttgtgggcaacggcaaagattgatcaggcggcaagttcgggtgactggtaccgcgaaaccggctcgggtatgggtgcgaccttgaatgccgctgttggcatgggcgcctatgctttgagtgancgcgcctcatggggcgcacatgcgaataaggcagatttcagaatcatggtcgagggtgatcaaaggcttttcaacccctatggtgtcatgcttgttgattcgcaaaaatgcccgaatgtcaaatcaaaggaaggccagatatttatcgattggctaatttcggcaaaaggccaagctgccattgccaatttcaaattagatggtaaacagcttttttttccaaacgcacaatagattttcgattatggcacaagaagaatcttgccaatatgatcgcttgactccatcaggtgatgcgctgcggctgcctcagcaaatgaaaagattgcatatgtttctggtgcaatggtttggtctttaaattttggccaaacatgcatctctaatgatcggcagattgcagatttttcggcgatagaacgtggccgcaagcgcgcgcctgttacggtgagatgtttgctatggatctggccaaaatcgatctcggctatttttccaccgcgaagattgataatcatcaaacgcccaccatgggcaagaagcttgacctccttcggtaaataatcaccgccaataatatcaatgataacatcaacgccgcgaccgttagtcaggttacgtgccacttccacaaaatcgtcttttctataattgatcgcagcgtcngcgccaaatctgcgaattgccgcacatttngtttcgtttcgtgcagtggcaaaaacagtggcgccaaatgccttggcaaccttaatcgccgcaaagccaataccgcttgtgccaccttgaaccaatacggtttcaccagcttgcagctggcagcgatccatcatatttgtccatacngtgcagaaaacctcaggcaagcctgccgcatcaatgaccgacaccccgtcgggaatgcccatacattggccttctggcgcaatcgcatattcagcatagccgccaccaattaanagcgcncagaccatatcgcccggccgaaagcgttcacataattctccaacagcaacaatttcgcccgaaacctcaagccccataatgtcgggcgcaccgggcggcactggatatttcccctcgcgttcgcgcaaatcggcaccattgacgccggcggcatgcactttgatcaaaacgtcactccccgttgcaaccggcacaggaacagtgatgatttccaatgattctggtccaccagggatatgaacgccaactgtacgcatggttttttggtactgttgcattacggtcgtcctaattatgatctggaaagctttattgttggaaaatttgtcaatatttaacacgacaatcaagccgcagccacttgaaacaaaaatttcaaaaaacttggagatattttggcggaaactataagattttcgttgacatcaaaggtcaaattaacctttactcacctaataatttgaattcaaaaaaatcaaaaatctttcggaggaataaatgaaaacttacaaagtagctgcgctgagtatagcggctttgacactggcttctggcgccgcaatggcaggcgcccacggatcatacccttcaaagccagttaaaattgttgtcggcttttctgcaggtggcggcactgacatcacatccaggggttttgcatcttttcttcatgagtctgagagcatggctggacagcccgcatatattgttaacgttcccggcgcatctgggcagaagggtgcaaagcaagttcttggtgaaaagccagatggttacacactttacatgataaatattggcacctttatcgtcggggagttggcaaagggtgcggacgcaccatacagtgtaaaaaatgactgggaaaaccttggctgcatgtctcaacttgtgacctccatacaagtacatcaatcccaccctgcaaaaacaatgaaagaatttgttgactgggcaaagtctgatggaaaaacagttacttggggaacatctggcgcaacaacgatgcactctggaattggtgtgactttctttgaaaaacatggcattccccataagatggtgccattcaagggcggcgcaccggcaagagctgctctggtctcncaatctgttcaagctgtttttggcggcaacaatacaattgctggtttcgaagatattatgcgtccgttggcaactgctggtgccacccgcgactctacgatgaaggatcttccaacatttagtgagcaaggcatgtcgggagctgactttactggtctattctgcctattctcgccaaagggtgtttcggatgaagtcaaaactaaaattgacgctgctatccaagacgttgttaaattgaagggattcaaaggcttcatgaagaagaacaaccttggagctttctacaccagcccatcagacgcacttaaagctcaagatgctatgtatcaagcgatgatccctgtaatggaaaaattgacaggaaaatagaagaagcaattaaatagtcttttgaggggtgggccaagactagcctgccccttaattattcacgacagcattattgaaattgagtgcagaatgcaggatcacaaatacaaagtaaaaattgaatatggcgtagcagccatcgtggcctttattggaatattttttatttttcaggcgctaacgataaaaatatccaatgaagccgttggcccacgaacaatgcccatggcactggccattagcttagttttaggagcaatttggctatggctaagggcataccgtggaaaagtgggcnctgttcagtctggctatgggtttattgacagcgacacaaaaagaataacgctcgtaattggatgtggtgttttgtttgtgaccacattttggctttttggatttttcatgtccgtgattactggctatgttgcagcgctcttatcttttggtgtcaggagtgggcctaaaatcattatttcaacaattgtcatggcggtaatgcttcaatggctctttatgggcgtcatgaggttaaatgatcccaaaggagaattaattgacatgcggcctcttactgacttcataagtgggaactagttaagttatgatttttgcagatattattggaggctttcaaaccttctttgccgacccttttgctatctattttgtttttcttgccgcatttgttggaatggtatttggagctttaccaggactaacagccgctgccgcaattgcgatgatgttacctatccttattgtttacaatgatgtaattggcggtttgtcaggcctggcttttttgtacgtcgtagggaaatctggccgctacggtgggtctattgcggcaattttattcaacacccccggaactgcagcatctgctgcaaccatgcaggacggctatcccatgtcccaatctgggcgag

SEQ ID NO: 1099 - DNA, 4000 bp, Escherichia coli
ggctcgtaggcgaaggcgatcgtcccgttggggccgggacgcaacaccccgaagccgtcgagccggaactcctgcccgtgctgggcggcatggcgcacctcgaagacaaagcggtcgatctcgcccgcagcctccagttcaccgacgcccgcctctcgcagcaggccgcgcagcacaccgtcgtcgcgtttgagcaactccgaaaaaacaatgcttacgcccggctccttgacgatgaacgtcccgagctggggcacgacgagccgcttgtgcgacccgagatattgcgatatggtctgaaccaacacgattgaaatccacttttaaaatccggttcaaaaatacccttttccgatgaaaaaagcaaaattcggcacggattttcaaaataatcgggcaaactattggttatacgaaaaatattcgtttgatttgcatcccgaaatttcaaaaaatccggacaagctactttggcccgaaattacggatgtagcgaagacggattgccgaaacttacacgaaccagccatgaaagacaagtacattgacctcatcgaacagacgttcgacttcccgcaggatgagttctcggtcgaagacaacgagttgaatttccatgacatcccgctcatggaactgatcaaacagtacggtacgccgctcaagataacgtacctgccgaagatctcgcaacagatcaaccgcgccaagcgcatgttcaacgtggcgatggcgaaggtcgactacaaaggctcgtacaactattgttactgcaccaagtcgagccatttctcgttcgtgctggaggaggccatgaagaacgacgtccacctggaaacgtcgtcggcatacgacatacatataatcaatgcgctttacgacggcggcatcatcgacaaagaccgttacatcatctgcaacgggttcaagcgcccgcagtacgtggagaacatcgcccagctggtgaacgacggcttcgtcaacacgatccccgtgctggacaacaaggaggagctcgacctgttcgaggacgccttcaccaagaaatgcaaggtcggcatccgcatcgcctgcgaggaggaacccaagttcgagttctacacctcgcggctgggtatccgctacaacgacatcctcgacttctacaaggccaagctcaagaacagcaagaagttccagctcaagatgctgcatttcttcatcaacacgggcatcaaggacacggcctactactggaacgagttgtcgaagtgcatgaacgtctactgcgaactcaaagccatctgccccgagctggacagcctcaacatcggcggcggattccccatcaagaactcgctcaacttcgaatacgactacgaatacctgaccgaggagatcatcgcccagatcaagaacatctgccaccgcaacgacacggaggaacccaacatcttcaccgagttcgggtcgttcaccgtaggcgaaagcggcgcggcgctctactcgatcgtcaaccagaaacagcagaacgaccgcgagaactggtacatgatcgactcgtcgttcatcactaccctgcccgacacgtggggcatcaaccagcgttacatcatgctggcggtgaacaactgggatcgcgaataccagcgcgtactgctcggggggctgacctgcgacagcgaggatttctacaatgccgaatcacacaccaacgccatattcctgcccaagctcgaaccgggtaacacacaatacatcgggttcttccacacgggtgcctaccaggagtcgctgggcggtttcggcggcatccagcactgcctgatcccggcacccaagcacatcatcatcgaccgcgacaagagcgacaacgaatattatacgaggctcttcgccaaggagcaatcctaccgctcgatgctgaggatactcggctactaaggccgcagtcccggggctttctgccggcggccgctcccgccccgagaacggggcggaaatacatttctgcggaatatcgatgcattaatccgcaaaaaataggaataaccgaataatttgattacctttgtcagcataaacaagggtttatattgaattcttctttcgtgcgtatttgtttccgcggtactttggcggactgtcccatctcagaatagatctcattatcagcttctttgttcataaacggcctcttggaggcaacaggcatcggaggtgatgcaaaaagaaaatgatggtgatttttttacagacaagcacgaaatccatgtcccataattccgtataccgagggaaaggccgccgaatctggcaccttttctgctttcaacacaggtatcggacagcggaaacacgatgaaaccgacggatacagtcccgcgacaggggcgatagccgcataacaacatagaatggcaaaacgaataacgacaggtaaaagagaccgggaaaagctcaaggagcaaaaacgacaggaaaagcaaaaacgcaaggacgaacgcaaaagcggcggtacgagttctttcgaggatatgatagcctatgtggacgagaacggcatactgcacaccacgccccaggatgtcaaacccaagacggagatagacgtctcgcagatcgagatttcgacacccaagcaggaggaaatggaaatactgccctccacagggcgcgtcgagtacttcaccgcctcgaaaggctacggcttcataaaggatgccgacagcggcgaaaaatactttttccacatctcttccgcacctgacaccattgccgaaggagacaaagtaacatttgaaattgaacgcgggacgcgcggattggccgcagtacgtatatcaatcataaacaaacaataattaaaaacaagaacgatgaacatttatgtttcacatctgagctggggtacgaaaagcgacagcctgcagaaccttttttcacagtacggcgaggtatcctcggctaacgtaatcaccgaccgcgaaacgggccgctcgcgtggcttcggcttcgtggagatgcctaacgagaccgaaggacaggctgcgatcgacgcgctcgacggcaccgacttcgaaggcaagaccatcggggtcaatgtcgcaaagcccaaggcagacagacctgccggcggttacggcggtggcaaccgtggcggcggttacggcggcggctacggcaacaggagatactaagcttccatacggaatatatcacccctgcttcatgcgattgaggcaggggtctcttttttgcccggtcagtcaaggctatgaggaaatccacgaagggtgcagcgtatcggaaaggggcagacggacgccggagcatcgggagaaaggaggaaattgcaggccgcaccggccaggctggcatgccgggtcacacggggagcaccccagaatttcgcccgaatcacgacaaggctgaaagcagggcacacaccggatcggaaataaacaggaaaagaacaatcttccgaacaaacaactaacaaacgacgacttgcaagcggttatgcattgtcggccggtaaacaggatggaaacgcgtcgagcgacaaggaaccgagtttgcgaaccgtttcctcgaaattgtcgccgccgttgagcgcggctttcttgattttgctcttgtaattatagatcgtctgcggcgaacagcgcaggaaatcggcgatctggttcacgtcggaaaccccgagccggatcagcgcgaagatgcgcagttcggtgttgaggcgcccttcttcgggcgtatagcggctctggggattgagcagggcgttgaatttctccacgaaattgggatagaggttcaggaaggcacggtcgaaattgcggcacaactcctcttcctccctgccgggagcctgcaacgaaaggtcatgcaggcggtcgaattgtttattcctgatcttcaggtttatatcgcggcggtatttgtccagtttgttgatatagatggcgcactggttcatgaaataacccaggtaacgctccttgaccaggttcgc

SEQ ID NO: 1100 - DNA, 4000 bp, Escherichia coli
  misc_feature (1985)..(1985): n is a, c, g, or t
aaaaaataaaaaaaaaaaaataatcatgattatgtatttaaattaataagaaaaaaatatgtttaaatttatttaattgaaaattttattttatttattttttatatttatttttagttgtaaattatttatttaaaatgattaaattccataaataatttttaataaaaaaaaagtttctttcattaatatagaaatttcaatagatgttttattttttttttttaatttttcttttaataatattttaattattttgaaaaataatagaaaataggataatataattttaataatttatggaaaattaaaatttaacaattaaaattaatataaaacaaataaaatttttgatttatcataaaaatttgatatatatatatataaaaacttaaattaataatacttatattaaaatatgtaacttaaatttattaactatttaccgtttctacaatgacaaggaattaaaggtgctccaaagaattcacttacttaccttagtcaatggtatcttaaaaatgttgaacaagaataaataaaatataaaaattaaaaataaatagataaaaaaataattattattacaacagttatataaatgttataatataataataaattaattataaatattaaacataaaaataaaaatattattttatgtaaaaacttatatatatatattaatattaaatgtgttatgttatgagtcagaaatttatttgtcttccttaaattgacagaataagcagcttttatcataatttacaacactaatttatttttctttgactgacataatattgtctccggcaaactattgctatgaaatttatggcatataattatgtcaatttcattaatatattttatgataaagagttactagcatttaattattataaattaaatgcttttatcttaatacattgggagttatacgttatttatattactatatgattcaatatatttgaagcttatttttcatgtatttcacatattctaatagttaggtatatgatagtcaagaatatatatatatttctttttataattattgttgttgggtattgaaatttggtattttgaaataataatttgaaatttatttaattatagctctaaattttttatttaaattattaactttgtcataatattatatagaaggtataaattattggtctattaattatttattttatgttaaaaaaattaaattagtttcaatatttcacattaaatatttaattattattaaataataatattattataaaaattatatatttaaatagatataaataaaataaatagtaatttaaaatattctaacgtattaatcattattattaatattaatatatatatatatatattagattattacttttttttgtttaattataattaacattataagatttccatacaatattcttgaatattaataggaattagtaaattagtatcgttattctagtattacccgcaattaaaaaaatattattaattttacattttttttaatataaccaaaaaaggatataaatccgtaatattgattaaatatatttagtataaaaataaaaataataataaaaaataattttatttattgtaatcataatactcataataataataataatactcataataataataataataataatataataataataataataataatataataataataataataatataataataataataataatattagtggtaataattttaagagatttaattaactaaaacgttaattataaaaaagaaaattaatctttaactgctattgtggttaaacatttaaatactttaaaaattcagatcttatttaataactaaccttaaaaataaataatatttaataaaaatttcatatgctaagaaatataatttttaattttattaatttatttgtttttttcataattttttttaaaaactttaanaaattaaaaaaaaaaaaaaaaaaactattaaagttcaatatttaataaacaatatacatattaattattgtacattcattttttaataattataaataatgtaacctagtaatctcatagtaaattaaaaagaaaacatataaaattatatcttataaactttactttataatattttatttaattagaaaattacaaatttattaaatatgtaacacaatattaaaataatatattgttaatatttttttttatcatttatattctttcatatttataatatatgaataatatattttaatataatttaatatattatttaagtaatgaaaatgaaacaaaaaatttaatttaaattattattatttatataatatttattctatatagaaattattattttaaaaaaaatatataaataataatttatttcatctttttttatttctctaaattccgccaaattatttggttcaaaagaatttatattttatagatttagtttatttaattatagatatatttaataaaaaatgaagactctcgctgttttcactactttattagctgttaccactgctaagaaatgtattgttaaggaaaacaatgccgctgctaatgatgctgctgctgtttccgatgctgaagaagttagtgctgcacttgagaatccagaagattctgctgtagaatctgatggtgatgatactgataaaaagaagaagcttccatccgacttcaaatggggagctgctactgctgcttaccaagttgaaggtgcttggaatgaagaaggtcgtggtgaatctgtttgggatcacttcactcatctttatccaaagaatgttgaatctggtgatagatcaaacaaaaattccactaacggtaatgttgcttgtgattcttaccacaaattcgatgaagatgttaagatgatgaaaatcatgaatgctactcactaccgtttctccatttcatggccacgtcttttcccagatggtcaagctagaaaggttaatggtaagtggaatgttaatgaaaagggtgctgaatactatgatatggttataaacactcttattgccaataacattactccacttgctactctttaccactgggatcttccatatgaacttcataaaaagtatggtggttggttagattatcactctcaagatgatttcgctaagtatgccgaattctgtttcgaacgtttcggtgaccgtgtcaagaattggatcaccattaacgaaccatgggttaattgtgtttctggttaccgtcttggtccaggtaaagctccatatagatgtactggtgaagccccacgtaagctccaaaacgatactgctggtctcgatttagaaggaggttgttcttacgaaattggtccatctcaatactctaaggattctgaagttcttccagccaaccgtccaccacaaagattagaagatgtttggtgttcacacaacattcttcttggacatgctaaagctgttaaggtttaccgtgagaagttccaaaaggaacaaaagggtcttattggtattaccattgatggtgaagctcaaattccatgggaagaaccaggtatgtctgaagaagaattagaaaacaacaagaagtacgcaaacttagctgctgaattccgtattggttggtactctgatccaccaattgttggtgattacccagaatcagttaagcaaagaatgggtaaggatatgcctgtctttactgaagaagaaaaggctcttttaaagggatcatcctcagacttcttaggttggaacacttacacttctcactgggctgctcaagttaagaatgaagatggtacttacgttgaaccaccaactgatgaagaagccaactttgaaaactctaagagagatatgtgggatgataactgtaagggacgtggagatggatggacttgtattcctccaactcttggttctcaagctggttcatcctggaacaccaagtatggtccaactattcgtgtt

SEQ ID NO: 1101 - DNA, 4000 bp, Escherichia coli
  misc_feature (549)..(549): n is a, c, g, or t
  misc_feature (2271)..(2271): n is a, c, g, or t
cacgacattcaaggaattggaatgtacggagaattgaatcagccagaaataccgcaatacagagcagcgattagcatcattaaaacaattgaaaaattgacgtatagaaaattaggagacaccgaagaattggaaatgttagcacgagagatagaacaaaaatttaaaaattaatgagtagtaccgacttcgtgtgcaggggtgttttcatcatgacagtcacaactgcacagatgagttttgtgattattcatacagtcaatacactcaaaatgttttcgagtttcacacggagcacaaatcatataataatcatgattaatacatgaatttgaatatttctttagacatagaggaacaaaatgggttttttacacattcaaagaagtttcagagttaagaaaaacaggagatcagaacaatggaaaaaagcattgtcaaaatttattaaataatttaacaaccatccattaattgaaaatatatcacaaaacatcttgcatcacatgtaaaaaaacaattgcagaggcggagcgaatgaatctaganatagatgcaagggatttttttaaagatccattaacagagtcagagttaagaaaaatagtcaaaatgacagggaaaaagccattggaattacttcgaaaaagagataaaacatacaaagaaatggatttagaaaaaaatgaaaaaacagattcagagttaatcaaactaatggtaaaaaatccaggactgatattgcgtccaatcataattttaaaagataaggcgttggttgggaaaatagacgttaaaaatataaaaaactaaccagaattttctcggacaaaaattctaattgcttccaaatgagagcaatttgctgtttttccattaccgtgatgaaacttataataatttttgaagccaaggcactcacaggaatcagaagttacaaaatatgatttttcaggattcgaggtagacctaatttgaaacaaatctttttcgattttagacacgcatccagaatcaactagtttttgtgctttcttgattgttgcatcactgctcataacatcacgacaataatttagacattttaaccttgtttgaaacaactgcacatgagtgcaataataaaacacatgcaaacaagaataatctcagaatttaaacatattttgtttaattttttgttcatgcatttggcatcagcacttaatcagcaacatgacagcaaaacaagcagagatgctaaaaaacatgaaacacgaatgtacctaaaacaaatacgtcaaaaattataattttgattaatgttaaaaattaattaaaatgtttattttttattatgcagtaggtacagtgtacaaatttattaaattttaaattcaaactttgcaccgttgctttgaaagtatttttgtattggaaccctaatgtgtttttgagtgtatttagctaaaagggcattcagtattttgtcggcataactaaccaatattttttttcgctcccgtgttgtttgagatgaaagggtccccatttcctcatatatgttattttgaatcataacaaggtatgcacgatcaacatcatcctgtatacgttctaacaaatccaggcttttttcccttaaccgtatattgtcggatttcatgatagttggaatttgtttaataaaatttatttgagttttttgatttgattcaaaaaattccatcatttttaaaaaattaaactcactctgcacatcgtcattttttttatatatcagcttatttttgtcaggcttagtttgaagatagccaataagttccaggattttaagagcgctggatatagcagccttgtcaccgccaatttttcgaacaatatcatttgtcaatttccaattaccagttaattcgagtattttatcatcatatttggttgtcaatcagtatgattttcgaacccggtagttaaatcatgcccaaaatagaacgtaacgaaaagatgacagtttctaataatattataagctatttttatcaaaatacaatattgagtatgaaaaaatacattgccacacgcactgcaacaatgtttggcgtattattaattacattactaattacgatattgctggtaggttccaacatggatacgattctaaaacaaggggttgtttttcaagtacgatctgagattattgaaaatcctgcaatagcagaaagtttttcatcagttaaagattttgaagcattcatccaagatcaaacagatcaaagaataaaacatctnggattagatgagccgtggtattcgcctcaaagaattggacttaccatgtacaagatagtcctgttggattttggacaggctacatttctcacaagtgattcaggatcttcggatgtaaaagatattatttttgaaaagttgccaaaaacaattctgctattcacgtcagctacagtgattatttccataataggaatatttgttggtgcgctagctgcaagcaaagttggctcgatagtagatagaattacatcgagttttgcaataatcagctccagttttccagtgtggtggattggaatgttaatgatatttttattcgcgttcacgtatcaaattttcccagcaagagcgactccggacattccagcaacaagtccagaatacctgggagctttgttgtatcacatggcattgccgctaatcacaattgtaatgatcgggtttggatcttgggcatatctggtaaggaatttcatggtgggcatcatgcaagaagatttcatagtagcaaaaaagacaattggaattaaacaaagcaagataacgtacactcatgccttaaaaaatgccgcgcccccaataattacaattctagcacttagtttgtcaggatcacttggaggggcgataatcacagaggccgtatttgattggccaggtatgggaagactatactttgaggcaataacagtcatggatttgccagtaattatcggtgcgacatacatcttgacagtattttttctagtaagcatattcattgcagatttgctttatggctattttgaccccagaatacggagcagtgcaggcgaatagcaatgagcaacataacaccccaggagataaagaaggagtttcttaaaagtaaaatgggaattgcaggaattgtaattcttacaattttaattttaacatcaatcatcacaatgatcataattccaatagaaacttttcaagaatggaacaatcccgaaagttggatcacttatccaaaagcggcaattccaatttgggtaaacttatttttgacagaaaaaattccggagcataaaattctagcagagcccaacattgaaacaatgtttaacgacgaaataaatctaacgtcgtatcaatttaatgtaaattttaattatgatcaatttccaaaagacttcatctactcatatttgttagagtattcaggttccccgctgattcaagtctcagtgatcaggccagacggagttaaactggaattggtttcaacgtcactgccgcattcagatttaaaaacaattcatagcgacagaatgttttcaactgacgccatggttaagaaggagttggttctgcaagaagaaaaatttgaattcgaaataaacgaattgtctgtagaagacattgttttttcaaaaacagaatcaaacaaaccactaaaaggaaactatgtttttttagttgatttttatgaaataaacgaagaaagcaaaattattgattcaaaattaatcataggcggtaaggcttttggcataatgggaacagatgaattgagaagggatttggcaataggactattgtggggaacgccactagcgttgttcataggtcttgcagtgtcaattggctcggtagtgatgggattggtgtatggaatctatgcagggttcaaagggaaaaaaacagatgaaaccatgatgagatttaacgatgttctttatgcgttgccggcgttgccttt

SEQ ID NO: 1102 - DNA, 4000 bp, Escherichia coli
  misc_feature (78)..(78): n is a, c, g, or t
  misc_feature (197)..(197): n is a, c, g, or t
  misc_feature (546)..(546): n is a, c, g, or t
  misc_feature (780)..(780): n is a, c, g, or t
  misc_feature (1984)..(1984): n is a, c, g, or t
aaatatgttaaaatatacatatagctaaattttagaaatgaggtaactatgaaaagaatattttctgccggcagaggnctggcttttatagtttttatgacggtttttttgtttactggctgtgggcagagtgctgaacctaaatcggaagtaaaaaatccgacattgcatgatgcggctgtaaaaatggttgccgntatgagtttagaagaaaaaatcggacaaatgctgctgatcggtattgatggtacggaaatagacgagggtgcgttgagcatgctgcgagattatcatgttggcggcgtgattttatttgaccgcaatatgaataataaatatcaggttacaggactgaatgctaacctgcagcgactgaataaagaatataataaattaccgctttatttatgtgttgaccaggaaggcgggatggttgccagaatgaagcaggggttgaccgttgctcctgcagcagccagaatagctgaacagggcactcctgaagatgcacgtcgctgggcttaccagacagctatggaattgganacgattggtttcaatgtaaattttgctcctgttttagatattggtattccttatggaagatcttatgggcacgatgctgcgtccgtgagcaagtttaccgaagcggcctgccgtggttatgatcaggcaggaattatttacagcttgaaacatttccccggtatgggaaaaagtgaggtcgatccgcatacagaacaatatcggattacagcttctaaagagattttattgcangaagacacaataccatttaaaaatattatccaaaattttgacaaccaggattttatggttatggtagggcatttgatttatacaggactggatacattgccggccagtgtttcacctcaggtaatcaataattttctgcgtaatgagcttggttttcagggtatcgtcattacagatgatatggaaatgggagctttaacaagtatgtatggttttcgtgaaatgggggttgcagcagttcaggccggagttgatgttttgctggtttgtcataattatgaacatcagcagcaggtttatcagggtgtactggaagctgtaaaaacaaataaattgacaacagccgctattgatgcagcagctgtaagaatagtggaaaataaaatgattaagttattagatgcaggcaaacaacaggaattgttgaaggacttgcagaaagaggcgcagtaaaaggagtcggaagtgggaaaaaacttaggaaaaattatatttttaaatgctgtaggtttaacaatattttttagctggtatttacctgctgaacatggtttttggtttacattggataaaagcattttctattactttaatgaacagcttcaacctgaaagctcttttacttattttgtcggtctgactaatgtacgtcatttcgatataatttctttaatggctatgttggcattatatggttattattattctaaacaggatcatttaggtaaacgaaaaatgtggtttatcggtgtcacgatgctgttttttgcggtaatattaaatcagctggggcatttgattcctgtacagcgatgcagtccgacaggattttttgaaaatattcatcgtgtcagtaaaatgctggtttttaaaactaaggattattctggcgacagttttccaggcgatcatggtctgatgctgatgatttatgccggtttcatgctgagatattttggcaaaaaagcttttgccgtcagctgcattattttaataatttttatgctgccgcgtattatggccggagcgcactggtttacagatattgttgtaggttctttaagtatttctttggttggtttgagttgggttttactgacgccggtgagtgataaatgtatagattttttaaataaaatttttccggataaagctgtaaaataatttttaaaatatcctgtcaaatttgacaggatattttttnaagcaatagggactttaaaagtcccgtgggtgacaaaaaatgaaatttttcttgtaaaaactataaagtaagttctttttttgtaaagaatgtgataaaattactaagtataacttagaatttttgtttaggatgtgaaatgatggaatttttcaaaacagcggatgtcgttgttatcggcggcggtattgttggtactgcaattctgcgtgagttgtcgaagtatgatttaaaatgcgtgcttgttgaaaaagaaccggaccttgctgcaggtactacgaaagctaacagtgctattttacatgctggttttgacgcgccgacaggcagtttaaaagcagttactaatgtacgcggcaataaattatatcatgagctgcaaaaagaattaggtctggatattgaatggacaggttctcttgttgctgctaccagtgaagaagaaatgcagactttacaggaattattggaacgcggtcagaaaaacggcgttgaaggcctgcgtattttaaatagagaagaagttttagccaaagaaaaaaatctgacaacagttgttggcgctttatgggcgccgtcggcaggcgtttgctggccttttgccatggctgtggcttttgcgcaatgtgcagtgcagaatggcgctgaagtagttacggactgccgtgtaactggatttattaaggaagctggcagaattacggctgtagaaacttcaaaaggtttgatcaaggctgcttgtgtcataaatgccggtggtgtttatgcagatggtatcgctcgtttggctggcgatgaaagcttcactattcatccgcgccgcggcgaatatattctttttgataaaactgctgcagccagtttggttaaaggcgttgttttcccaacacctaataaaaagtctaaaggtatactgatctgtacgactacgcatggcaatacatttatcggtcctaatgcacaggatatggagaataaggaagatactgccgttactctgacagggatggacgaaattatgaattctgccagaaaactgattccaaatttgccgatgggtgcttcgattactgaatttgcagggctgcgtgcagtttccggcagcggagattttgtcatcggcgcttcacctgtagcaggtttgtttaatgctgcagggatgcaatcgcctggactgacagctgctccggcagtagccgaaatgattgttgaagctgtgttggcatattgtccggccgctgtaaaagctgattttaaagctgctttaccgcaaaatcctctttttcatagattgtcacatgaggagcaggcaaagcttattgaaaaaaatagattgtatggccgtgttatctgtcgttgtgaaacggtcacggaagcggagattatcgctgctatcaaagcgccctgcggagctaaaacagttgacggtgttaaacgccgtacgcgtgccggtatgggacgctgtcagggcggtttctgcggtccgcgcgttacccagatcctggcacgggaactgggtatacccgtaccggaagttttgaaagaacgtgctgattctcatttgttttatgaaaaaaactctgcagatgagggggaagcataaaaatgaaaaatttatatgacgtaattattgtcggcggtggtccggctggactttctgctgcttatagcgcttggcagaatggtgctgaaagtattttggttattgagcgtgaccgggaattaggcggcattctgcagcagtgcattcataatggttttggcttgcatcattttaaagaagagctgactggacccggatatgcttatcgttgcattgaaatgatcaaagataaaccggaaatagaaaccttggttgatacgatggttttggaagttttgcaggacaaaacggtaattgcagtcagccctgaacatggactgctgaaaattgcaggcagaaccgttattctgactatgggctgccgcgaacgtacacgcggtgcgatcagaattccgggtgaacggccggccggt

SEQ ID NO: 1103 - DNA, 4000 bp, Escherichia coli
  misc_feature (295)..(295): n is a, c, g, or t
  misc_feature (1106)..(1106): n is a, c, g, or t
  misc_feature (1265)..(1265): n is a, c, g, or t
  misc_feature (1313)..(1313): n is a, c, g, or t
  misc_feature (1950)..(1950): n is a, c, g, or t
  misc_feature (1988)..(1988): n is a, c, g, or t
  misc_feature (2029)..(2029): n is a, c, g, or t
  misc_feature (3639)..(3639): n is a, c, g, or t
  misc_feature (3815)..(3817): n is a, c, g, or t
  misc_feature (3819)..(3819): n is a, c, g, or t
  misc_feature (3821)..(3829): n is a, c, g, or t
  misc_feature (3832)..(3832): n is a, c, g, or t
  misc_feature (3834)..(3835): n is a, c, g, or t
  misc_feature (3841)..(3842): n is a, c, g, or t
  misc_feature (3845)..(3859): n is a, c, g, or t
  misc_feature (3862)..(3862): n is a, c, g, or t
  misc_feature (3866)..(3866): n is a, c, g, or t
  misc_feature (3868)..(3868): n is a, c, g, or t
  misc_feature (3872)..(3875): n is a, c, g, or t
  misc_feature (3878)..(3882): n is a, c, g, or t
  misc_feature (3884)..(3884): n is a, c, g, or t
  misc_feature (3886)..(3887): n is a, c, g, or t
  misc_feature (3892)..(3894): n is a, c, g, or t
  misc_feature (3898)..(3898): n is a, c, g, or t
  misc_feature (3903)..(3911): n is a, c, g, or t
  misc_feature (3914)..(3915): n is a, c, g, or t
  misc_feature (3917)..(3917): n is a, c, g, or t
  misc_feature (3919)..(3919): n is a, c, g, or t
  misc_feature (3921)..(3924): n is a, c, g, or t
  misc_feature (3927)..(3927): n is a, c, g, or t
  misc_feature (3930)..(3931): n is a, c, g, or t
  misc_feature (3933)..(3936): n is a, c, g, or t
  misc_feature (3939)..(3942): n is a, c, g, or t
  misc_feature (3946)..(3948): n is a, c, g, or t
  misc_feature (3950)..(3953): n is a, c, g, or t
  misc_feature (3957)..(3958): n is a, c, g, or t
  misc_feature (3962)..(3963): n is a, c, g, or t
  misc_feature (3965)..(3965): n is a, c, g, or t
  misc_feature (3967)..(3967): n is a, c, g, or t
  misc_feature (3970)..(3972): n is a, c, g, or t
  misc_feature (3975)..(3977): n is a, c, g, or t
  misc_feature (3979)..(3979): n is a, c, g, or t
  misc_feature (3981)..(3986): n is a, c, g, or t
  misc_feature (3988)..(3998): n is a, c, g, or t
  misc_feature (4000)..(4000): n is a, c, g, or t
catcaatattgggttgaggccattcgcaaaagctttgctggtcacaaagcgggtttgtggcatgggtccatcaacggcatcaacaatcagtaaaacagagtcgaccatagagagtatccgctctacctcaccgccaaagtcagcgtgcccgggcgtatccacgatattaatgcggtggtcatgccattcaagcgcagtattcttggcgagaatagtgattcctcgctctttttcgatatcgtttgagtccatcaaacgttcgccgtcttcctcgccacgctggagcgcaccggcntgcacaagcaacttatcaataagtgtggtcttgccatggtcaacatgggcaataatcgcgatgtttctaatgttttgaatcatggtcactccagacgaagacgcggcattatacaggttgacacggatgattaaagtccggacaccgaacagtaaaacccgtttttatgggttataattaatcgttgccagtaatcggcccgatgatatggctatttgtcactttgacaaacgatactggtgcacccattaattcaggccaagcgcactggatcagtgcttttgttctataaatgagcaaataagttagtcaaagcaaatcaacaaaaagatcaccattaaacaccatgagcaaacagcgcaaagcggtctccctcatctcaggcgggctcgactcaatgttggcaacccgcgccattcaagatcagggaattcatgtcgagggcattaacttctacactgggttttgtgtcgagggtcacacccatgccatacgacgtaaggataccgataaagagaagcggaacaacgcactctgggtggcagagcagctaggtatcaagctgcatatcatcgatgtcattgaggaatataaggaagtactcatcaatccgaagcatggctacggtcagcacctcaacccttgccttgattgcaaaattttcatggtcaacaaggcgcaagcctgggcatggatggaagaaaaccagtttgattttatcatcactggcgaagtcatcggacagagacccaaatcccagaggaaagcgactatgcctatcatcgcccgggaatccggcgcagatgatcgnttactccgcccgctctgcgcaaaaaacctgccgcctacgctacccgagcgcgaaggttgggtagatcgagaaaaactttttaaatttggtggtcgcagccgaaaaccgcagatggaactggccgccaaattcggattcaccgaatattcccaaccagcnggcggttgttgcttcctgactgatcagagctattcagacaaactgggngacctctggcgcacgaggggcagcaagaattacgatctcgacgacatcatgctgctaaaagtcggtcgacatttacgacctaaaccacatttcaaaatcattgtcagtcgagaagagggagagaataactacctctcgggatacaagaacgaatacacaaccgtcagcattctgtcgcacaaggggccgattgcattactcgatggcgacttcagtcgagaatcctctgaggaggatatgaatcttgcagccagcatcgttgctcgattcagccaggggcgtgatgaaaaagaagtgaaggtgctgatcaggcaaaaagacggtgttgaaagagaattgatggtgacaccgctaccacaatcatccgtcgatcccgattggtatgtttgaatagacacttacttaacactttttcaccccatgacagagcaaaagccaacagtccatgaattaaatgcccgcaggatgttatgtcccttgccggtcattcgcacacaagacaaaattaaaacactctctagcggcgaaattctgagagtgatttgcacagacccgggtgtcaaagcggatatacccacctggtgcagaatcaatggccatctggtgctgaaaattgaagaaaagcatcaggagattnatgtaacgatagaagttggcaaccaataaacgcaccgncatggtgcgccttcacaaggctgcaccgttttggcgcgttnaggaaacatcgaaatcctctctagcccttttaaagtgcggattttaaatcagtttattaataggcaatcatggcatattctttgctcccataaattcacgaaagtttttgcgtagaacttgcagtaaatattcaagtaaccccaaccggagaacatgacgctatgtcacaaaagacactcaacctaataaaagaaagcgatgcgaaatgggtagacctacgtttcactgaccctcgaggtaaagaacaacacgtcaccaatcataaagactctgtcgatgaagacttttttgaaattggcgcaatgttcgatggttcatctatcgccggttggaaatcaatcaatgaatcagacatgattctgatgccagatgactcgagcgcagtcattgaccctttcacagaagaaacaacggttaatctgcgatgtaacatcgtggagcctgccacacttcagggttacgaacgcgatccacgttcgcttgcgcaacgtgcagaggcctacctcaaatctaccggcattggcgataccgcttactttggacccgagccagagttttttgtttttgacgaggtcaaattcaaaaataacatgagcggcgccatgtatgaaattggttccgaagaagctgcatggatgagcggcagcgacatagagggcggcaacatgggtcacagacctggtgttaagggcggctacttccctgttcctcccgtcgattcgctctacgatatccggaattcaatgtgctcagccatggaagcgatgggactcaagatcgatttgcaccatcacgaagtaggcaccgctggccagtgtgagattggcgtgccgttcaatacactgacccaaaaagcagacgaagtgcagatctacaagtactgcgtcctgaacgttgcacacgcctatggcaagacagcgacgtttatgccaaaaccactggttggcgacaacggcaatggcatgcatttgcaccagtcaatctggaaagacggcaccaaccttttcgcaggggacggctacggcaacttgtctcaaaccgcactgcattacattggcggcatcatcaagcacgcgagagcaataaacgcgttttcaaatgccagcaccaattcctacaagcgtctcgtgccaggtttcgaagcacctcttatgcttgtttattcagcaagaaatcgttctgcttcgattcggattccttacgtgcaaggcggcagccctaagggtgttagagtagaggttcgatttggcgatccaactgcgaacccttacctcatgttctctgccatgatgatggccggacttgacggcatcaagaacaaaatcgaacctgtcggcccgctcgacaaagacctttatgatctgcctgccgaagagctatctggcctgccaacggtatgtagctcacttgatcaggcacttgattgcctcgatgctgatcgtggattcctcaccgaaggtgacgtatttaccgattctgtcattgatggctacatcgatctgaaacgagaagagaccgagcgccttaattcatcaactcaccctgttgaatttgagatgtactacagcgtttaaacgctggcgatttatcgccactgtttttggactanaagaccccggatcaaaacgacccggggttttttttgtcttaaatccccataaaatgacatttgcaccataatggtgcaaaatgatttttaaggttttgccggatatccctatttcaagggcctgacgctgatatcgcaaggtggtacaaaacttgcgatagctatttattgtagcnnntnannnnnnnnnttnanngcagcnnttnnnnnnnnnnnnnnncgncagntnttgnnnncannnnnangnnacagnnntggnacgcnnnnnnnnnatnncnanannnnacnaanntnnnncannnnaagnnntnnnnaaannaaanncnangannngcnnntnannnnnnannnnnnnnnnngn

SEQ ID NO: 1104 - DNA, 4000 bp, Escherichia coli
  misc_feature (3683)..(3683): n is a, c, g, or t
  misc_feature (3693)..(3694): n is a, c, g, or t
  misc_feature (3696)..(3697): n is a, c, g, or t
  misc_feature (3700)..(3701): n is a, c, g, or t
  misc_feature (3703)..(3703): n is a, c, g, or t
  misc_feature (3710)..(3710): n is a, c, g, or t
  misc_feature (3713)..(3714): n is a, c, g, or t
  misc_feature (3717)..(3718): n is a, c, g, or t
  misc_feature (3720)..(3720): n is a, c, g, or t
  misc_feature (3723)..(3723): n is a, c, g, or t
  misc_feature (3725)..(3725): n is a, c, g, or t
  misc_feature (3727)..(3727): n is a, c, g, or t
  misc_feature (3730)..(3730): n is a, c, g, or t
  misc_feature (3733)..(3734): n is a, c, g, or t
  misc_feature (3737)..(3737): n is a, c, g, or t
  misc_feature (3742)..(3742): n is a, c, g, or t
  misc_feature (3744)..(3745): n is a, c, g, or t
  misc_feature (3749)..(3749): n is a, c, g, or t
  misc_feature (3751)..(3751): n is a, c, g, or t
  misc_feature (3757)..(3759): n is a, c, g, or t
  misc_feature (3761)..(3762): n is a, c, g, or t
  misc_feature (3768)..(3769): n is a, c, g, or t
  misc_feature (3771)..(3772): n is a, c, g, or t
  misc_feature (3774)..(3775): n is a, c, g, or t
  misc_feature (3777)..(3778): n is a, c, g, or t
  misc_feature (3786)..(3786): n is a, c, g, or t
  misc_feature (3788)..(3790): n is a, c, g, or t
  misc_feature (3794)..(3796): n is a, c, g, or t
  misc_feature (3799)..(3799): n is a, c, g, or t
  misc_feature (3801)..(3803): n is a, c, g, or t
  misc_feature (3807)..(3807): n is a, c, g, or t
  misc_feature (3810)..(3810): n is a, c, g, or t
  misc_feature (3813)..(3813): n is a, c, g, or t
  misc_feature (3815)..(3816): n is a, c, g, or t
  misc_feature (3818)..(3818): n is a, c, g, or t
  misc_feature (3821)..(3823): n is a, c, g, or t
  misc_feature (3825)..(3826): n is a, c, g, or t
  misc_feature (3828)..(3828): n is a, c, g, or t
  misc_feature (3831)..(3833): n is a, c, g, or t
  misc_feature (3835)..(3836): n is a, c, g, or t
  misc_feature (3841)..(3842): n is a, c, g, or t
  misc_feature (3850)..(3850): n is a, c, g, or t
  misc_feature (3853)..(3853): n is a, c, g, or t
  misc_feature (3863)..(3863): n is a, c, g, or t
  misc_feature (3872)..(3872): n is a, c, g, or t
  misc_feature (3877)..(3877): n is a, c, g, or t
  misc_feature (3879)..(3880): n is a, c, g, or t
  misc_feature (3882)..(3882): n is a, c, g, or t
  misc_feature (3886)..(3886): n is a, c, g, or t
  misc_feature (3892)..(3892): n is a, c, g, or t
  misc_feature (3894)..(3895): n is a, c, g, or t
  misc_feature (3899)..(3899): n is a, c, g, or t
  misc_feature (3902)..(3905): n is a, c, g, or t
  misc_feature (3907)..(3907): n is a, c, g, or t
  misc_feature (3909)..(3909): n is a, c, g, or t
  misc_feature (3911)..(3911): n is a, c, g, or t
  misc_feature (3916)..(3917): n is a, c, g, or t
  misc_feature (3921)..(3922): n is a, c, g, or t
  misc_feature (3924)..(3926): n is a, c, g, or t
  misc_feature (3928)..(3931): n is a, c, g, or t
  misc_feature (3933)..(3934): n is a, c, g, or t
  misc_feature (3937)..(3942): n is a, c, g, or t
  misc_feature (3945)..(3952): n is a, c, g, or t
  misc_feature (3954)..(3954): n is a, c, g, or t
  misc_feature (3956)..(3957): n is a, c, g, or t
  misc_feature (3959)..(3962): n is a, c, g, or t
  misc_feature (3964)..(3968): n is a, c, g, or t
  misc_feature (3972)..(3973): n is a, c, g, or t
  misc_feature (3975)..(3975): n is a, c, g, or t
  misc_feature (3977)..(3977): n is a, c, g, or t
  misc_feature (3979)..(3980): n is a, c, g, or t
  misc_feature (3982)..(3989): n is a, c, g, or t
  misc_feature (3992)..(3994): n is a, c, g, or t
  misc_feature (3996)..(3997): n is a, c, g, or t
  misc_feature (3999)..(4000): n is a, c, g, or t
tgaaactatctaaaagcgaaatccctcaaatatatgtcaatctaattgaacaagctaaaagtttatgctgatgtatcaaaacgaaatagaaattataaaatctcggattgagaacaaacaccaaggggatgaaaaacaattagaaattattttttctcctaacaaacgattattagttgaagcacctgctggctatggtaaaacacatacaatggtaagccggatagcctatttaatatctatcggcaagctacctgttccaaaaaaacttttagcattaacttttagcgtaaatgctgcatataaaattaaaaaagatgtaagtaagaatattccagaactattgcaggatttaggcaagcaaattaatattaaagaaaaaatatatgtatctaattatcatggtttctgtcgaagcattttaaaaaaatacggtcatagactacatcctgcattgtcgaatttagatactctacaatccgttgatgatagtcgaagtgatagtataatgcgagtatttaataatatttcaatagatgaagcgaatgttttgtcagaattcaacgccggagttaaaaacataaaaggaaagtatttaaaagaaaatattgataaatataattctattgtcatctccaaactattaataaagaatgccattccatataatgcaattattactttaacaattaaattgtttaaagaacaaattggaatattagaattttaccgaaattattatacatcaattctcgtagatgaatttcaagataccaatctactaagttattggctattgaatttcttaattacagataaaacaaatatattgctattaggagattctttacagcgaatttatggatttataggagccgtacccaatttactttcacatgcacaaaatacattcaatttacaacttatttcattggagaagaattatcgttttgcatccaatgagaatatgcttcaattggataaaataatacggcaaaatgctattactccttttgataaccctaatagcttaaaatccaaggtggaatttaatatctatgataaccaagaagaagaagctttacaagttgtaattaagtcacaaaaaatattacaaaacgattcctttgctaaagttgccatacttgcaaagcaaagaggacctaatattgagcatattataaaaactttcaatcacaataagataccattcttttatggattatttacagatgaagactctgaatatataacattcaacagaaaatgtctgtatgaatttattgaattactaaaatcaaattcaaagattactaaaaagatagggaaaaaacatattgataaaatacgagaaatatatattaacaatgattccgtacttgttaaagctcttttagaattactcgaaattttttgggttcagctttttgtcgattattcgtttttatctaatgaagataaaattaatctgattaaagatacctttgaacataatggtataaaacaatatatggaattcttaaatacgtctataataatctctacggtacatgcagcaaaaggtttagaatgggattatgtaatacttcctgatatggaaaaagattcatttcctaactggtatggattatgcggtagatgtaaaaatggaaatgactgtaattttgtgatgactaaagatatagaaaaatcattctttgaggaattaagtgtattttatgtagcagttactcgggctaaaaagcaagttttttttacggcaagtcataaacaactcacaaataggggcatttttgaaaaaaattatagttgttttatgaaattgccaggtattgaatatatacaaacagtatagagagacagaaagtattattggctaaccaacagctagtcagaaggcattggttgctaataatttttggggaatataggcgggtttctttgctactttatttcccggcactcacgaaagaaagtagcggcggcaaacagccgccgttctctatcaactggttttaaggctccttatggacgtgtatttctctaaccacacctttacctgttccatgttgtattcgcccgtgataattgccgtatggtcgtttatggctacaaaccggacactctcgtggctgtttacccagccttgcagggaacagacgccccacgtgtccacatcttcaaaaacactgcggtctatccggctgattggctcgccgaaaactaccgtcattatctgaaagtccggcttatctgccagcagttgcaaatggtgcagcgtgccgaaatcgtcaattttgcgcccccacgcccacacatcattatacaaatcatcgccccattggtgcgggtggtcgaaacggacttttacctctatggtgtgttcgttttcttctgtgtcctcgataacgcccgttaccattaagcccgtaaaaatgcactcgcaacgcctgccgataagctccttgtttacttctgtcgttttcatgcccccaaaatttacttgtttattactccgttcttctttgctatccacccgtcacgcctgcggcggcactcgtccagcgttttggctaccgtgctgaaaagttcgccgtccgtgtggcggtagtcatattgaaaataaatctgtcccctgaaagcccctaaatggcatttcacgaacttttcttctcccggtgtctgggtgatgcttaccccgtttttgttaagtgactgcatgatgtcttatttttttatggttataaacttggttgtttttagcgggcagggctttgacaccccgcccggattggttgttatgccgcccggaacacaaagccgtcatcaaaccagtaatcgcacatgaacaggtcacgggcgaactgtttgtaatcgaaataggtctttgcgaactccggcaggtcgtaacattcttctataatttcataggcgaaatcttcttcatcgtcatattccccttgatattcatcccggaaatcccgtacaaggtcgtccgcatcttcctcgcccaaatcatggcttttatagttgcaccacacgaaaaaggcttcctgctcggtgtcgctcaaatcctccaccgcatcacgcagggcaaagaagttttcagaaatccagctttcgtcgattaagccctccggcacgttctcccagtcctgaaacatgtattccgcatcttcctcgtccttgtgaagttcccggcaggcttcataaaattcttccttgtccgaatagtccgaaaggtcgagccatgcgccggacaatgaaccgttgttgtacttgacataagtgcctacataaacttttgcttccgataatacctttgcttccatattgctgtaattttttaagtttttaattttatgcggatttgagaggtgagggagttgaagtttcactgaacttttttcctgtttcccgtaaatccgactttttttttatgcgtcttccggtcgggtcggtcgttttcgtttcacataggcgtaaaagggtagtgtttagagtttgcaaggttttgggcaaaaaatacctcgcaaggcagggaagattttttcgccaaaccggaacggctcgaccttgcaaaatcgtgaagaacacgtaactacctttgcctattgaaatgattaaaacgactgtcccggctgggggactgcgtaagaggaagatttacagatagggaaacnggggaaaagnncnngtnntntttcatnttnnagnnancantncntgnggnnggnaaagncnngggngntgtgannntnnttgcannanncnngnncgggtttncnnnggcnnnttncnnngaanacngtnanncntgnnncnnanggnnngnntttcnnggaatgtnccngttggaaaangatataaanaatgngnntngtcngtggantnnccgnaannnngnanantgtanntcanntnnntnnnntnngtnnnnnngannnnnnnnancnnannnntnnnnnattnntntntnncnnnnnnnntgnnnanntnn

SEQ ID NO: 1105 - DNA, 4000 bp, Escherichia coli
  misc_feature (342)..(342): n is a, c, g, or t
  misc_feature (809)..(809): n is a, c, g, or t
  misc_feature (868)..(868): n is a, c, g, or t
  misc_feature (2681)..(2681): n is a, c, g, or t
  misc_feature (2714)..(2714): n is a, c, g, or t
  misc_feature (2732)..(2732): n is a, c, g, or t
  misc_feature (2738)..(2738): n is a, c, g, or t
  misc_feature (2741)..(2741): n is a, c, g, or t
  misc_feature (2762)..(2762): n is a, c, g, or t
  misc_feature (2765)..(2765): n is a, c, g, or t
  misc_feature (2807)..(2807): n is a, c, g, or t
tagtaactgattatattggtagttgttttttgaagatagcaaatcacttatcttatagacctaactttatcaattatacatttagggacgatatggttagtgatggtatcgaaaactgtctacaatacctagataattttgatcctgctaaatcaagtaatcctttcgcttactttacacaaattatatattacgcatttataagaagaatacaaaaagaaaagaaacaaactactatcaaacataaactaattatggatagtaactatgatgattcggcactacaaccaggtgatgatgctgaatttaagaatcaatttagagactttttacaaaagaacntaaagatggaagatacccctatcaaaaaagttgaaaagaaagtcaaaaagaaaagagtaagaaaatctacatctaaattattcaactaaattatgaaaattgctttgttaaacgacacgcactttggtgcgaggaatgatagtccagcatttttggattattttatgcgattctataatgagatattttttccatatcttaaagagaataacataacaacacttgtacacttaggtgatgtagtagatagaagaaaatttatcaactttaaaacagcacacacatttagagaagactttatgcaccgattgtataaagagggtattgatactcatattatattaggtaaccacgatacttactacaagaatactaatgaagtaaatgctatcaaagaactatgtacaacctttgatggaataaaagaaccttggatatatgaaaaagcaactactgtaaattttggnggcaccgatatttgtttaataccttggatttgtgatgataactatgaccactcaataanagaaatagaaaatacaaacgctgaacttgcgttaggtcatttagagattaagggttttgaaatgaacgctggtcatatgaaccaacaaggtttagaaaaggctatgtttcatagatttgaaaaagttatctctggtcattttcataaaaaatctgatgatggtcaagtgtactatcttggctctcaatatgaaattacttggtcagactataagtgtccaaaagggtttcatatactagatacagaaacaagagaactaacaagagtacctaatccaattagaatacataagaagttagtttataatgataaagacgaagattatagtaagttagatttagaacattataaagactgcttcgtaaaagtttttgtaacaaataaaactaatgaagaaatgtttaataatctaattgatagattacacaatacagtagatacacacgaagttaatattatagaagatttaaatacagatataacagcatctgtcggtgatgatgtactacaacaaggcgaagatactctaacctttttaggtaactatgtagaaaaaacagatactgatttagataaaaataaattaaaagaaacattaaaagatttatatgtagaggccagtgaaagatgagtaaaataacaaatgtaaaatcaaattttatgaattggggtccttttgttatgaaaacaaagatacctgattatataattaagaagttaaaaaccgaaggtacaaaagcaaaaattagttataataaaagtttagctggtcatttagataatcaatatttgtatccatcaaaaatacaacaatggttttataatgaaatacaccctattatacaagcatatagaaatggtcattgtaagtatcacggtatagaagaattaaatgtagaattacaagcagatgatttatgggttaattatatgcaagctggtgactttaatcctgtacatacacacggtgctgattattcatttgtattatttttagatgtacctaaacaattaaaaaaagaacaagataaatttgaaggaacatcagcaaaaccaggttcgttaatgtttgaatacacacaacaagcaagacctcgttgggctactactggtaaagttgtaacgccagaaacaggtgatatgattatgtttcctgctctattacaacattgggtagtaccctttaaatctaaagtaactagaataagtgtgtccggcaatttaagaattttaaacaaagataaattaccaaatgattatttttaaaaagattagatggaaaaactttctatctacaggaaacaattttgttgagatagaactaaacaagtcacaaatgactttgatgattggtgctaatggctctggtaaatcaactatgctagacgcattatgttttgcgttatttaatagaccatttagattaattaaaaaagaacagatagtaaatacaataaacaatgctgatactttagttgagttagagtttcaagtaggtactaaagctttcaaagttataagaggtattaaaccaaatatatttgagatttattgtgatgatgttttacaaaaccaagatgcctctagtatagattatcaaaagatattagaagatcaaatattaagattaaattatagagcatttaaacagatagctgtattaggttcttcagcgtatcaaccatttatgcagatgagaccaagacatagacgagaggttgtagaagaaatattagacataagagtattaacacacatggatattcttactagaaatcaacaaacagaattaggtaaacaaataattgaagcnagacatcaatgtgatttaattgaatctaaacangaattacaaacaaaacantttaanganttaaagaatagaagtacaggnganattgatattaagaaacaaaaactacaagaaaacaaagacgcnactgaatcatatttaagaaagactgaacgattagaagatgaatataaacaattagaaactagcatatcagatagaccacaatatgaaacaaagttaaaacagttagagaaacttgaaacaaagatagaacaaaatttagaaacacataaaaagaatttagagttttttgaacaaaatgataactgtccaacttgtactcaaaagatagaagaaacatttagagaagaaaagatagtaaaagaaaagaccaaagtagttactttaaatcaaggtatgaaagatttagtagctgaactagctaaagttgaaggtaaaattacagagtttaatggtatatcagataaactatatgaaaacaaaatatcaatatctaaagtagaatcttctttaaaagaacttaaaagattttccgattcattacataatgagatattactattagaaggtaaagatgaagacgataaagatatagaaaaaagtttagtagaattacaagaacaattagaacaaacaaaaattgaattaaacagaattactgaagagaagaaatacctagatgttgctagagagatactgtctgatagaggggctaaagctaaaatcattaagaagtatctaccaattatgaatagtttaattaatcaacatttacaatctatggacttctttgtatcctttcatttagacgaagaatttaaagaagaagtaaaaagcagacatagagatacctttgactacaataactttagtgagggtgagaagatgagaatagatttagcattagtatttacatggcgtgctattgcgaagatgaagaacagtgctaacacaaacttaatggtacttgatgaaatatttgatagctcgttagatggacaaggtacagatgacttctttaagattgtaaataaaatgggcaaagagaatatctttattatatcacacaaaggagatatattatttgataaatttactaacataatcaagtttgaaaaagaacacaattttacgaggttaacaaatggctaaagaaataaaattaataccaccaacagacgtgagagtacaatcagcaattgcaccttttagtgatgatatgctaaaagaacatgacttcaaagatagaaaagagttaagtgattctatgtttgatacaatgaaaaagtatggtggaataggattaacttgtaatc

SEQ ID NO: 1106 - DNA, 4000 bp, Escherichia coli
  misc_feature (95)..(95): n is a, c, g, or t
  misc_feature (239)..(239): n is a, c, g, or t
  misc_feature (320)..(320): n is a, c, g, or t
  misc_feature (323)..(323): n is a, c, g, or t
  misc_feature (383)..(383): n is a, c, g, or t
  misc_feature (856)..(856): n is a, c, g, or t
  misc_feature (1466)..(1466): n is a, c, g, or t
  misc_feature (1571)..(1571): n is a, c, g, or t
  misc_feature (1961)..(1961): n is a, c, g, or t
  misc_feature (2018)..(2018): n is a, c, g, or t
ggtgtcgcgtgcgcccttctagcgttcgtcgccaataccctgatccctcccgcaagtaacgaccaaatcttgtacgcattgcgtactgctctgtnctgagccggggtaccgtacccacgaggtcaaacgctgtcaattgcaggagcgtcacgtttgctgacccattagtacctccgtaggctaggcgcgtgcccgactacaacctctcctatgtctatgtgttcgcgttcttcgtagcnggagctctggtcgtcacggcgatgatgctgctcagccacctgctcgctccgtggaagcccacgcgcgaaaaactcaagacntangagtccggcgaggagcccgtggggcaggcctggggtcgttacccgacgcatttctacgtnttcgcgctcctcttcgtcgtgttcgacgtcgaggtgatcttcctgttcccgtgggcggtcctgttccgcgatctcggctggtacggcctggtcgagatgacgatcttcatcggcatcctggtcgtcggcctcgtctacgcctggaagaagaaagcgctcaattggtactgagcactccgcgcgcgaccatcgacctcgcatccgcgcgggaagcgctcgcgaaaagtcttggagagcgagcacgtgtgtcgaccctgcacgacatggtcgtcgtcgacgtcgatgccgcgcggctggtcgaggtggcaacggtggtgcgcgacgatccggccacgcgatgcgacctctattcggtgaacgcgggcgtcgacacggggaccgagcttcggagcgtcacgttcgtccgcggcatcgagacgcacgtcttcgtcatgctccgcacgccgtgcgactcaggcgagccgcacgtgccntcgctcacctcggtgtgggacggcgcgaactggtgcgagcgcgagacctacgacatgttcggcatcgtgttcgatggacacccggatctccgccgcatcttcctcgaggaatcgttcccgggacacccgatgcgaaagtcgttccttcctccacgcagcgacgcccgcgggggctgatgacgctgtgccggtaggtccgttcggcatcgatcctttcatctgggcgccgctgcgcttggtcatcgccgtgttgctcgtggtcggtctcgtcttcaacggcgcgctggcgcagatctatctcgagcggaagatccaggcggtcatccaggaccgcctcggcccactgcacaccgggccctggggcctgctccaaaccttcgccgacgcgatcaagctcctcggtaaggaagacatccgcgcgcggctgaccgacaaatggttcttcctcgccgcgccgtcgatcgtgttcagcccgatgctcgcgagctacgtcgtgatcccctttgcgcccggcatcgtcggcgccgacctgaacgtcggattgctctacatgaccacgcttggttcgatgaccgttcttgggatcgtcatcgccggctgggcttcgaanaacaagtactcgctcatgggcggccttcgctcggccggccagctcatctcgtacgaggtgccgcagatcctgtcgctcgtgaccgtcgtgctcgtcgtcgggacnctgtcgatggtcggcatcgccgagagtcagccgggctggcagctgaacgtcctcgtgctgccactcgcgttcgtcacctatttcatcgccggactggccgaaacgaaccgcgccccgttcgatctgccggaggccgaatccgagctcgtcgccgggttcctcaccgaatactcggggatgcgctgggccatcttcttcctcgccgaatacggtgagatcacggtcgtgtcgtcgatcgtgacgacgctctggttcggcgcgtggcacggcccgttcgtcgaggtcttcccgctgatcggcgttctctggttcacgctgaagacgtacttcttcgtgctcgtcttcatgtggatccgcgccacgcttccccgactgcggatcgaccagctnatgtccctctgctggaaggtgctgatcccgctgacgctcacgaacctcgtggtcacngcgaccctgctgctggtcttcccgagcaccctggtgcccgtggcgatcgcgaactggatcctcctcgccgccttcgtgctgctgctgccctacgtccagcgtcgtcggctcgtcgcgctccgcgagcggctgcggaccgcggcctgatggtcgacttcatcgaaccggcgctgttcgcgatcctgacgatcgccatcgtcgcggcgggtgcgggcgtggtcctcgccaaccggatcacgacctcggccctgctcatggccttcaccttcctgaacatcgccggcatgttcgtgctgctcggcgcggaaaccatcgcgatgttccaggtcctcatctacgtcggcgccatcaccgtcctgatcctgtacggcgtgatgttcacaccgcagtctccccgcgcttacggcctgttcttccagacccagaagtactgggccgcgctctttgtcgtgccgatcgcgatcttcgtcgcgctcgtggcgttctccttccgcgattcggcgacgctgggcgccaagggcggcgacctcctgccgctcgcgacgagcgtgttccgcgacttcgcgtttccgttcgaggtcgcgtcggtccttctcctcgcggccatggtcggcgcgatcgtgctagtgaagcgggacgaggactgaatggccgttccgctcggagcgttcatcgcggtctcggcggtgctgttcttcatcggcacagccggcgttctcgtccggcgcaacgcggtcgtgatcctcatgtccgtcgagctgatgctcaacgcgacgaacctcgctctggtcgcattctcacggcgctattcgtcgatcgacgagcgcgggagcgtgttcgtcgtcttcgtcttcgtcgtcgccgcggcggaggtcgcggtcggcctggccatcgtcctatcggcgtatcgcaacaggcccacggtcgacgtcgacgagatccggcagctcaagggttgatcgcgtgatccagaacgtctggctcatccccgcgttcccgctggcggcgttcctcatcgacggcctcttcggtcggcgatggctccataggtggaccggcatcatcgcgtcgtcggcggtcggactctcggcgatcgtcgcgatcggcgtgttcctcgaggtcctcggcggccagactcggacgaccgtcaacctctatgagtggatcggcgtcggggacttccactcgcgcgtcgccgcgctcgtcgatccgctgtcgtcggtcatgctgcttgtcgtcaccgtcgtgagcttcctcatcttcgtctactcgaacggatacatggagcacgatcacggcttccatcgtttcttcacctggctgtcgctgttcgtgttcgcgatgctcatcctggtcatggccgacaactacctcctcatgttcgtcgggtgggagggggtcggtctctgcagctatctcctgatcgggttctggttcgagcgtcccgagccgtatgtcgcggcgaagaaagcgttcgtgatgaaccggatcggcgactggggctacacgatcggcatgatcacgacgttcctcgtcttcggctcgatgcagttcaccgacgtgttcgagcacgttggcatcgcgacgcaggcgaacctcacgctcatctgcgtcgccttcttcttcggcgccaccggcaagtcggcgcagctgccgctgtactcgtggctgcccgacgcgatggagggcccgacgccggtgtcggccctgatccacgcggcgacgatggtcaccgccggcgtgtatctggtcgcgcgctcgatgccgctgttcgcggcggcgggtccctcgctcgcggtcgtcggcgtcgtcggcgctatcaccgcgatcttcgcggccacgatcgcgctcgtgcaattcgacatcaagcgcgtgatggcctattcgaccgtgagccagctcggctacatgttccttgcgctcggcgtcggggctccggtcgcggcgatcttccacctcgcgacgcacgcgttcttcaaggc

SEQ ID NO: 1107 - DNA, 4000 bp, Escherichia coli
  misc_feature (532)..(532): n is a, c, g, or t
  misc_feature (547)..(547): n is a, c, g, or t
  misc_feature (559)..(559): n is a, c, g, or t
  misc_feature (574)..(574): n is a, c, g, or t
  misc_feature (739)..(739): n is a, c, g, or t
  misc_feature (757)..(757): n is a, c, g, or t
  misc_feature (884)..(884): n is a, c, g, or t
  misc_feature (914)..(914): n is a, c, g, or t
  misc_feature (1297)..(1297): n is a, c, g, or t
  misc_feature (1595)..(1595): n is a, c, g, or t
  misc_feature (1667)..(1667): n is a, c, g, or t
  misc_feature (1768)..(1768): n is a, c, g, or t
  misc_feature (1785)..(1785): n is a, c, g, or t
  misc_feature (1808)..(1808): n is a, c, g, or t
  misc_feature (1812)..(1812): n is a, c, g, or t
  misc_feature (1948)..(1948): n is a, c, g, or t
  misc_feature (1965)..(1965): n is a, c, g, or t
  misc_feature (1985)..(1985): n is a, c, g, or t
  misc_feature (1992)..(1992): n is a, c, g, or t
  misc_feature (2490)..(2490): n is a, c, g, or t
  misc_feature (3502)..(3502): n is a, c, g, or t
aagatggggtagcctctttgactcactttatggaaccaatgtcatacctaataagggtagcatgagtacctcatttgcgcataatcttcaaagggttaatcgaacagcagaacttgcttgtgattttctcgatgaaattgcaccccttaagggcgcttcatatcgacaaattacaactcaagttaagtataagggaactttaatttttaatttgaatgacggtgaagtagcaaccttaataaaccctagtcaatatattgggcttactgaaaatggaaatatattattaaaaaacaataatcttcatattgagattgtatgtgaccaagaaaggagccttcataagagtgggatctttgatgtcatattggagtctgctgtgactacaatcgttgactttgaggattctgcatccactgtctcagacgaagaaaaaattcatgcatatcgaaactatcttggactcatgaagcgtgaattaagtgcctcttttgtaaagggtggcgaaactattacgagatcattgaataangataagacctatacngatactcatggngctatctgtaagctncctggaacaagtttaacgcttgttcgaaatgtaggcatccacatgacaactgaaatggtcacgaataatgatggatcaccaatcccagaaggcattttggacgcaatggttacttcactgattgcccttcatgatttaaaactcaaaatgaattccaaaaaaggnagcatctacattgtcaancccaagcttcatggccctgaagaagttaaattcactatggatttattttcagcagttgagaaagcactgtcaattaaggaaaacactcttaagattggggttatggatgaagaaagaagaacaactntaaacctaaaagcctgtatttacgaagctngaaatcgcatcatttttattaataccggatttcttgatagaacgggtgatgaaatacatacttctatgatggcgggagcgatgcgctgtaaaaacctcatcaaggaagaggcatggttttctgcctatgaagaaaataatgtcagttcaggccttgaatgtggtctttataaaagagcacaaattggaaaaggtatgtgggctcagcccgaccaaatgcgtcaaatgctagataacaaaatggtccatttagaggctggagcaagctgttcatgggttccttcaccaacagcagcaactttacatgctactcattatcatcgttttaatgtatttagacagcaacaagagctcttatctaagcaccaaaaaccaaaccaggangacctgtataaaattccatttttgaagttagctgatcaattatctgaagagaaaattattaaggaaatcaataacaatgcgcagagcatcttagggtatgtcgttaaatggattaaccaggggattggttgctcaaaagttcaagatatcaatcatattggtctaatggaagaccgagctacactaagaatttcttcacaacatatggcaaattggcttcatcataaaatatgtacaaaagatcaggtaaataaagcatttcaagatatggctgttattgttgatgatcaaaacaaanatgaccctaactatcttgcattggcaccaaactatgatagttttgcttacaaagcctcaatagcacttgcanttgaaggtgcagatcaggcaaatggatacacagaagatatattaataaggtttagacgtaaatttcttgaagctaagaaggcaaagtagatggattgtcantttttcttggaaacagntagctcttatcaccaatggaacnctancttaaagtaaatattaaaccgcaatagatgtgtcagttgatttgacctaaatcacctttgacaattactaaatctactctttgaaaatgtagctatattattacgaaagtgatcaatataaaggggtttttatgantcatattatctatgagnaagttaaacagaggttgcancgaaacnaattagctgctctgcgagttatattatgaaacaagtactaaaacttacgcttgaagatacaaagaaaatgatggatggtgccattaataaagcaattgaactaggtatagacatggatatcgctattgtggacgatggtggtcacctcatgttatttacaagaatggataatgcaaaaattacaagcattaatgtctctatcgataaggcatttactgctgcggcagctagaaaggcgaccttagattatggtaaatctgttattaatcatgggccagcatttggtattcaaacctcacatcaaggtcgtttttgtgtagttggtggtggcctacctctttttgttgatggtcagattgttggtgggattggttgcagttctggcagctctgaccaagatatagtggtttctcaagcagggattgacgcaatactttctgttaaataaataataagtcctaacccttaaatgcgttatcagaaagaagatagtcaagntcctccatggtactcatgcgccctaaaatttcatttctatgtgggaagcgaccaaattttttaacgagatctctgtgatgctttgaaaactcaaggttaaagttgtacttatcaaacaaataaacttgtaaattttgatgatcaatattttcactatgcatcaatggcataaacagaaataatagcttttcatcattgagctcctcatcaaacccattattaattgcatttaaagctacttcaactgccatactctctgtttgaaagccttttggatctgatctgaacatattaaggggtagctgatccaaaattactataagagcaacagagccatcagctgtttctctccactgactatattctccttccgctgctttttcccaaacgctttcaaaacgtactttaatttcgttgtctacttggggggttgaagcaaaccagaattgtttgcttttttctgaaaaccaataatctaaaacatcagatggtgttatcgaattttcattcattgtaaaaaaatttattccctcagagcgcaataatataccactctgagggattgatagttaagacttatcgatgaggagatttttcaccaaaatctttatacttgtcaaggaatctaactggcttgcttaatgcgtcttttctgaacggatctccaagctctcttgagcacataatttcaatgattgttgtctttctttcattcatttgcatatctatcgcttttttaagagctggacctacatcttcaagtttatcaactcgtattccttcagcacccattgattctgcaatattaacaaagtgctgatcagtaagctcagcagcaataaaacgtctgtcataaaaatctacttgatttttcttttcagcgccccaatgacgattatgaaaaacaactgcagtcactggaatatcatgacgcacacaagtcatagtttcaaccatgctcattgcccaagcaccatcacctgcgtaagaaacagcgggtctgtgttgagcngctgctttggctccaataattgttggaaaggcataaccacagtttccaaaactcatcgctgcaaaaaaactacgtggcttttcaaatctaagatagctattggctacagaattgatatttccaatatcagtagagaccatgacatcctcaggcatggctttttcaagttcgcgtaggacttgtcttgggtgaagccatccttcttctttgttagcaatcatatccatactataagagtcagtttcatgaatccactcatcaagctcgagctcccaagctgatttttcatcagcaattgttgttgctctttcagacttagttgaatcacagctcaacgtttctgattttagtttttgacatagaacttcagctacagcttttgcatcaccacagataccaacattgattggcttcaccaaacctaacattttgtgatcagcatcaatttgaataatttgagcatctttaggccaataatccatcccgtgctgaggtagc

SEQ ID NO: 1108 - DNA, 4000 bp, Escherichia coli
  misc_feature (676)..(676): n is a, c, g, or t
  misc_feature (1123)..(1124): n is a, c, g, or t
  misc_feature (1188)..(1188): n is a, c, g, or t
  misc_feature (1460)..(1460): n is a, c, g, or t
  misc_feature (1631)..(1631): n is a, c, g, or t
  misc_feature (1990)..(1991): n is a, c, g, or t
  misc_feature (2003)..(2003): n is a, c, g, or t
  misc_feature (2624)..(2624): n is a, c, g, or t
  misc_feature (2675)..(2675): n is a, c, g, or t
  misc_feature (2715)..(2716): n is a, c, g, or t
  misc_feature (2820)..(2827): n is a, c, g, or t
  misc_feature (2831)..(2834): n is a, c, g, or t
  misc_feature (2838)..(2843): n is a, c, g, or t
  misc_feature (2850)..(2851): n is a, c, g, or t
  misc_feature (2853)..(2853): n is a, c, g, or t
  misc_feature (2855)..(2855): n is a, c, g, or t
  misc_feature (2858)..(2859): n is a, c, g, or t
  misc_feature (2861)..(2861): n is a, c, g, or t
  misc_feature (2870)..(2870): n is a, c, g, or t
  misc_feature (2872)..(2872): n is a, c, g, or t
  misc_feature (2874)..(2876): n is a, c, g, or t
  misc_feature (2879)..(2880): n is a, c, g, or t
  misc_feature (2882)..(2882): n is a, c, g, or t
  misc_feature (2884)..(2887): n is a, c, g, or t
  misc_feature (2890)..(2890): n is a, c, g, or t
  misc_feature (2892)..(2892): n is a, c, g, or t
  misc_feature (2896)..(2896): n is a, c, g, or t
  misc_feature (2898)..(2898): n is a, c, g, or t
  misc_feature (2903)..(2907): n is a, c, g, or t
  misc_feature (2910)..(2911): n is a, c, g, or t
  misc_feature (2913)..(2916): n is a, c, g, or t
  misc_feature (2918)..(2919): n is a, c, g, or t
  misc_feature (2921)..(2922): n is a, c, g, or t
  misc_feature (2925)..(2926): n is a, c, g, or t
  misc_feature (2928)..(2928): n is a, c, g, or t
  misc_feature (2930)..(2932): n is a, c, g, or t
  misc_feature (2934)..(2935): n is a, c, g, or t
  misc_feature (2937)..(2940): n is a, c, g, or t
  misc_feature (2942)..(2942): n is a, c, g, or t
  misc_feature (2947)..(2951): n is a, c, g, or t
  misc_feature (2954)..(2957): n is a, c, g, or t
  misc_feature (2960)..(2961): n is a, c, g, or t
  misc_feature (2963)..(2965): n is a, c, g, or t
  misc_feature (2968)..(2969): n is a, c, g, or t
  misc_feature (2971)..(2971): n is a, c, g, or t
  misc_feature (2973)..(2973): n is a, c, g, or t
  misc_feature (2976)..(2976): n is a, c, g, or t
  misc_feature (2979)..(2984): n is a, c, g, or t
  misc_feature (2986)..(3004): n is a, c, g, or t
  misc_feature (3006)..(3008): n is a, c, g, or t
  misc_feature (3011)..(3012): n is a, c, g, or t
  misc_feature (3014)..(3015): n is a, c, g, or t
  misc_feature (3017)..(3017): n is a, c, g, or t
  misc_feature (3019)..(3021): n is a, c, g, or t
  misc_feature (3023)..(3033): n is a, c, g, or t
  misc_feature (3036)..(3036): n is a, c, g, or t
  misc_feature (3039)..(3039): n is a, c, g, or t
  misc_feature (3041)..(3043): n is a, c, g, or t
  misc_feature (3046)..(3053): n is a, c, g, or t
  misc_feature (3055)..(3059): n is a, c, g, or t
  misc_feature (3061)..(3063): n is a, c, g, or t
  misc_feature (3065)..(3068): n is a, c, g, or t
  misc_feature (3071)..(3071): n is a, c, g, or t
  misc_feature (3073)..(3074): n is a, c, g, or t
  misc_feature (3076)..(3081): n is a, c, g, or t
  misc_feature (3083)..(3083): n is a, c, g, or t
  misc_feature (3089)..(3089): n is a, c, g, or t
  misc_feature (3092)..(3097): n is a, c, g, or t
  misc_feature (3099)..(3100): n is a, c, g, or t
  misc_feature (3103)..(3103): n is a, c, g, or t
  misc_feature (3106)..(3107): n is a, c, g, or t
  misc_feature (3112)..(3113): n is a, c, g, or t
  misc_feature (3115)..(3121): n is a, c, g, or t
  misc_feature (3123)..(3127): n is a, c, g, or t
  misc_feature (3130)..(3130): n is a, c, g, or t
  misc_feature (3132)..(3132): n is a, c, g, or t
  misc_feature (3134)..(3135): n is a, c, g, or t
  misc_feature (3137)..(3139): n is a, c, g, or t
  misc_feature (3141)..(3143): n is a, c, g, or t
  misc_feature (3146)..(3151): n is a, c, g, or t
  misc_feature (3153)..(3154): n is a, c, g, or t
  misc_feature (3157)..(3157): n is a, c, g, or t
  misc_feature (3159)..(3167): n is a, c, g, or t
  misc_feature (3169)..(3175): n is a, c, g, or t
  misc_feature (3177)..(3177): n is a, c, g, or t
  misc_feature (3180)..(3181): n is a, c, g, or t
  misc_feature (3183)..(3187): n is a, c, g, or t
  misc_feature (3189)..(3191): n is a, c, g, or t
  misc_feature (3194)..(3196): n is a, c, g, or t
  misc_feature (3198)..(3198): n is a, c, g, or t
  misc_feature (3202)..(3202): n is a, c, g, or t
  misc_feature (3205)..(3205): n is a, c, g, or t
  misc_feature (3207)..(3207): n is a, c, g, or t
  misc_feature (3214)..(3216): n is a, c, g, or t
  misc_feature (3218)..(3218): n is a, c, g, or t
  misc_feature (3220)..(3220): n is a, c, g, or t
  misc_feature (3222)..(3222): n is a, c, g, or t
  misc_feature (3228)..(3228): n is a, c, g, or t
  misc_feature (3231)..(3237): n is a, c, g, or t
  misc_feature (3239)..(3239): n is a, c, g, or t
  misc_feature (3241)..(3241): n is a, c, g, or t
  misc_feature (3244)..(3246): n is a, c, g, or t
  misc_feature (3250)..(3253): n is a, c, g, or t
  misc_feature (3255)..(3256): n is a, c, g, or t
  misc_feature (3258)..(3260): n is a, c, g, or t
  misc_feature (3264)..(3267): n is a, c, g, or t
  misc_feature (3270)..(3272): n is a, c, g, or t
  misc_feature (3274)..(3274): n is a, c, g, or t
  misc_feature (3276)..(3276): n is a, c, g, or t
  misc_feature (3298)..(3300): n is a, c, g, or t
  misc_feature (3302)..(3302): n is a, c, g, or t
  misc_feature (3305)..(3308): n is a, c, g, or t
  misc_feature (3310)..(3310): n is a, c, g, or t
  misc_feature (3317)..(3317): n is a, c, g, or t
  misc_feature (3322)..(3324): n is a, c, g, or t
  misc_feature (3326)..(3326): n is a, c, g, or t
  misc_feature (3329)..(3330): n is a, c, g, or t
  misc_feature (3332)..(3332): n is a, c, g, or t
  misc_feature (3336)..(3337): n is a, c, g, or t
  misc_feature (3339)..(3339): n is a, c, g, or t
  misc_feature (3341)..(3341): n is a, c, g, or t
  misc_feature (3350)..(3351): n is a, c, g, or t
  misc_feature (3355)..(3355): n is a, c, g, or t
  misc_feature (3357)..(3357): n is a, c, g, or t
  misc_feature (3359)..(3360): n is a, c, g, or t
  misc_feature (3362)..(3363): n is a, c, g, or t
  misc_feature (3366)..(3368): n is a, c, g, or t
  misc_feature (3370)..(3370): n is a, c, g, or t
  misc_feature (3373)..(3374): n is a, c, g, or t
  misc_feature (3376)..(3385): n is a, c, g, or t
  misc_feature (3389)..(3389): n is a, c, g, or t
  misc_feature (3392)..(3394): n is a, c, g, or t
  misc_feature (3396)..(3397): n is a, c, g, or t
  misc_feature (3399)..(3400): n is a, c, g, or t
  misc_feature (3402)..(3406): n is a, c, g, or t
  misc_feature (3409)..(3410): n is a, c, g, or t
  misc_feature (3415)..(3415): n is a, c, g, or t
  misc_feature (3417)..(3422): n is a, c, g, or t
  misc_feature (3425)..(3426): n is a, c, g, or t
  misc_feature (3428)..(3428): n is a, c, g, or t
  misc_feature (3433)..(3433): n is a, c, g, or t
  misc_feature (3436)..(3436): n is a, c, g, or t
  misc_feature (3439)..(3441): n is a, c, g, or t
  misc_feature (3443)..(3443): n is a, c, g, or t
  misc_feature (3446)..(3448): n is a, c, g, or t
  misc_feature (3451)..(3451): n is a, c, g, or t
  misc_feature (3453)..(3457): n is a, c, g, or t
  misc_feature (3459)..(3459): n is a, c, g, or t
  misc_feature (3463)..(3464): n is a, c, g, or t
  misc_feature (3466)..(3468): n is a, c, g, or t
  misc_feature (3471)..(3480): n is a, c, g, or t
  misc_feature (3483)..(3484): n is a, c, g, or t
  misc_feature (3486)..(3486): n is a, c, g, or t
  misc_feature (3489)..(3491): n is a, c, g, or t
  misc_feature (3493)..(3493): n is a, c, g, or t
  misc_feature (3495)..(3497): n is a, c, g, or t
  misc_feature (3499)..(3500): n is a, c, g, or t
  misc_feature (3505)..(3506): n is a, c, g, or t
  misc_feature (3508)..(3511): n is a, c, g, or t
  misc_feature (3514)..(3514): n is a, c, g, or t
  misc_feature (3517)..(3519): n is a, c, g, or t
  misc_feature (3521)..(3522): n is a, c, g, or t
  misc_feature (3524)..(3526): n is a, c, g, or t
  misc_feature (3528)..(3528): n is a, c, g, or t
  misc_feature (3530)..(3530): n is a, c, g, or t
  misc_feature (3533)..(3536): n is a, c, g, or t
  misc_feature (3539)..(3540): n is a, c, g, or t
  misc_feature (3542)..(3546): n is a, c, g, or t
  misc_feature (3548)..(3549): n is a, c, g, or t
  misc_feature (3553)..(3553): n is a, c, g, or t
  misc_feature (3556)..(3556): n is a, c, g, or t
  misc_feature (3558)..(3560): n is a, c, g, or t
  misc_feature (3562)..(3570): n is a, c, g, or t
  misc_feature (3574)..(3574): n is a, c, g, or t
  misc_feature (3577)..(3577): n is a, c, g, or t
  misc_feature (3579)..(3579): n is a, c, g, or t
  misc_feature (3581)..(3581): n is a, c, g, or t
  misc_feature (3583)..(3600): n is a, c, g, or t
  misc_feature (3603)..(3603): n is a, c, g, or t
  misc_feature (3607)..(3617): n is a, c, g, or t
  misc_feature (3620)..(3622): n is a, c, g, or t
  misc_feature (3625)..(3625): n is a, c, g, or t
  misc_feature (3628)..(3630): n is a, c, g, or t
  misc_feature (3632)..(3634): n is a, c, g, or t
  misc_feature (3637)..(3642): n is a, c, g, or t
  misc_feature (3644)..(3644): n is a, c, g, or t
  misc_feature (3646)..(3651): n is a, c, g, or t
  misc_feature (3656)..(3657): n is a, c, g, or t
  misc_feature (3660)..(3660): n is a, c, g, or t
  misc_feature (3662)..(3663): n is a, c, g, or t
  misc_feature (3669)..(3669): n is a, c, g, or t
  misc_feature (3675)..(3675): n is a, c, g, or t
  misc_feature (3677)..(3677): n is a, c, g, or t
  misc_feature (3680)..(3688): n is a, c, g, or t
  misc_feature (3692)..(3693): n is a, c, g, or t
  misc_feature (3695)..(3695): n is a, c, g, or t
  misc_feature (3697)..(3699): n is a, c, g, or t
  misc_feature (3702)..(3702): n is a, c, g, or t
  misc_feature (3706)..(3707): n is a, c, g, or t
  misc_feature (3709)..(3711): n is a, c, g, or t
  misc_feature (3714)..(3721): n is a, c, g, or t
  misc_feature (3724)..(3725): n is a, c, g, or t
  misc_feature (3727)..(3727): n is a, c, g, or t
  misc_feature (3729)..(3729): n is a, c, g, or t
  misc_feature (3732)..(3737): n is a, c, g, or t
  misc_feature (3739)..(3741): n is a, c, g, or t
  misc_feature (3743)..(3744): n is a, c, g, or t
  misc_feature (3746)..(3748): n is a, c, g, or t
  misc_feature (3756)..(3757): n is a, c, g, or t
  misc_feature (3760)..(3763): n is a, c, g, or t
  misc_feature (3765)..(3766): n is a, c, g, or t
  misc_feature (3770)..(3771): n is a, c, g, or t
  misc_feature (3773)..(3773): n is a, c, g, or t
  misc_feature (3775)..(3779): n is a, c, g, or t
  misc_feature (3781)..(3783): n is a, c, g, or t
  misc_feature (3786)..(3786): n is a, c, g, or t
  misc_feature (3788)..(3790): n is a, c, g, or t
  misc_feature (3793)..(3796): n is a, c, g, or t
  misc_feature (3798)..(3798): n is a, c, g, or t
  misc_feature (3802)..(3802): n is a, c, g, or t
  misc_feature (3804)..(3804): n is a, c, g, or t
  misc_feature (3807)..(3807): n is a, c, g, or t
  misc_feature (3810)..(3810): n is a, c, g, or t
  misc_feature (3813)..(3813): n is a, c, g, or t
  misc_feature (3819)..(3821): n is a, c, g, or t
  misc_feature (3825)..(3827): n is a, c, g, or t
  misc_feature (3830)..(3830): n is a, c, g, or t
  misc_feature (3833)..(3835): n is a, c, g, or t
  misc_feature (3837)..(3837): n is a, c, g, or t
  misc_feature (3840)..(3840): n is a, c, g, or t
  misc_feature (3842)..(3843): n is a, c, g, or t
  misc_feature (3846)..(3847): n is a, c, g, or t
  misc_feature (3850)..(3853): n is a, c, g, or t
  misc_feature (3856)..(3858): n is a, c, g, or t
  misc_feature (3860)..(3861): n is a, c, g, or t
  misc_feature (3868)..(3869): n is a, c, g, or t
  misc_feature (3872)..(3873): n is a, c, g, or t
  misc_feature (3876)..(3876): n is a, c, g, or t
  misc_feature (3879)..(3880): n is a, c, g, or t
  misc_feature (3883)..(3884): n is a, c, g, or t
  misc_feature (3888)..(3889): n is a, c, g, or t
  misc_feature (3891)..(3891): n is a, c, g, or t
  misc_feature (3895)..(3896): n is a, c, g, or t
  misc_feature (3899)..(3899): n is a, c, g, or t
  misc_feature (3903)..(3905): n is a, c, g, or t
  misc_feature (3908)..(3909): n is a, c, g, or t
  misc_feature (3912)..(3917): n is a, c, g, or t
  misc_feature (3923)..(3924): n is a, c, g, or t
  misc_feature (3927)..(3927): n is a, c, g, or t
  misc_feature (3929)..(3930): n is a, c, g, or t
  misc_feature (3932)..(3932): n is a, c, g, or t
  misc_feature (3934)..(3934): n is a, c, g, or t
  misc_feature (3936)..(3936): n is a, c, g, or t
  misc_feature (3940)..(3940): n is a, c, g, or t
  misc_feature (3942)..(3942): n is a, c, g, or t
  misc_feature (3947)..(3947): n is a, c, g, or t
  misc_feature (3949)..(3949): n is a, c, g, or t
  misc_feature (3951)..(3951): n is a, c, g, or t
  misc_feature (3957)..(3957): n is a, c, g, or t
  misc_feature (3959)..(3960): n is a, c, g, or t
  misc_feature (3963)..(3965): n is a, c, g, or t
  misc_feature (3968)..(3968): n is a, c, g, or t
  misc_feature (3970)..(3970): n is a, c, g, or t
  misc_feature (3972)..(3972): n is a, c, g, or t
  misc_feature (3975)..(3977): n is a, c, g, or t
  misc_feature (3981)..(3981): n is a, c, g, or t
  misc_feature (3984)..(3984): n is a, c, g, or t
  misc_feature (3986)..(3986): n is a, c, g, or t
  misc_feature (3989)..(3989): n is a, c, g, or t
  misc_feature (3991)..(3995): n is a, c, g, or t
  misc_feature (3997)..(3998): n is a, c, g, or t
  misc_feature (4000)..(4000): n is a, c, g, or t
acgaagctccgcggagagcttttcgtccgaagatggcggaagatgatgtttctctcgttcgttgttgttcgttttcatcatcatcgcgtctctgtgttgattatgaagagtatacaaattcgtgcgaatattgccaacgcttcctccatttccgctcgcgggcgttcgttggtgttgaaaaatcggcgtcctaggtaacggtccttcccctctcgcaaagttcgcatcgtcttcgttaaacccgccttgaaacgatgcgatgccgttcaaaaacgcctccgtgttcatgccttcgttcgtgtgctcgtttggccacggcaccgccgtattcgccaacggcgtcggcggtatgcctaaaaccgcggagcgctgctgagcgtgcgagtgaaatccaggcgtgctcatcaacgtccccatcatctgcggctgttgctgcccaaactccacgacgccgccgtaaaacttcgcctgttccggctgtttatgccacgtcagatttctcgcattcactctcgccaaaatctcctccgtcgcgtccacgttctcgtgcgtttccttcggggtcccgtcctcgtcttcgaccacttcttcctcttcctcgccgttcaaaaccgcgtgatcatcatccaaaaaatccaacttgaacccacccgcatcttcacctgtgttactcatnccacgcgcaggagtctcgttttgatgtttaacgacaacactcggagacttattatcgtcgtccgtccatcgcttatgcgtcgacggcggcatgttaaattcttccttccttccttcccctttgacatcaaaatcatcattttccaatgtcatcagcggagaaaacggaggctctgtgaacactttctcttctcgtttctttgtctttttcttcgtcgatcgcgtttttggtgttttcattctcgtcttcttcgcgttgtctgtctctttgatgatattattcgtgttaaacgtcatcgtcacgtcctctaaatttcgcatcgaccggagcggcgaattgatgtcgtcttggtcttcttctatcgcctcgcgaacgagttggacgttggaaatttccgtgagatcgttcgattcttcctccttgacagatgcttcttctttagctttnngtcgactgctccgtcgagacgagtgtgctgctgtcgcgctcattattgtgtgattttgtatcgntttgcgctgaatttgtaacgtttggattttgaattttgagggattttacgacgtacaaaaaatgtggtgagcgctcttcttactttacttttgttatgcgtacattgtgattctaccattgatgctgctgattagattattattctttttaagtttcagcgtcggtttggggcgggccgacggctttccacatggccaaaccaccgcctcttcctcgagcggcgacgcacttttcatccgcgtagacgaatttgaagaacgggttcgcgccnggcttggatttatcgttggattttgtgattttgccttgaccttcggtggttttctcctcggtcgctttgaccgcgtcccatttgccgtcgtcgatgtcgaagcctttgacgaaagagaagacgcctacggagcacttcgtgaaggtgaactcgagcatttttaagttttgnctccaaatgaaagggccgtcgaaaaagaatttgattgggcctacgtacacgccgttgcgtatgcgttcgttttttatgtcgaacgattggacggctttgattgggaagtaagtcccgtcgccgtttcggttgacgttggctttgtttttgttcgtcccggtggtgtacacgagttcccattcgccgttgagcatgtcgccggtgacgttgaatttactcttttcgcacgccgcgatggcgtcgcagacgtcttcgacgtttacgtttttcgtttcgcacgcttcgtgcatcaccgagatggcgtcaaacggcgctttcgggtcgccctccagcaacgcgaattgcgtcaatcgtttcgnntcgcagtagccnaaaatccccggatccacgtggtcaaagacaatctctccttcttcgtccaagaccatcgacccgcctctttgcaccaagagctgatcgtcttcgcacactaaatcgtcccagttgtttaaaatttccgtcatgtttgccaatctcaaggtcgccatctcaaacggtctcaaatactcggcgcctaaagtcgcgtccatcaatttcctcacttccggtacgtccgcgttcgagccttccactaacacgggcggcttattcttcgatccaaaataccccgatatcaccgtcttcaaagtccccggagacccgataccggcgcacattaccaacaacttcaccatcccgggaagcttcaccggaagcgcgtcgccgaacccgggcgaatactccatcttccgatataacttagaacttgtcgtcacgattaacttctccttgggaaacttcgtccgttcgcaaaactgttccccggcttgaactgaacctaaaccaaacgcgatcacgtttacgttcgcggcttccaatcgcggtaaatcgtccaccataaatttcgcctgttcccacgagtcaaaatccgccagttgcgtcaggaataaaacaatcgttcttttcccactttcntgtttaccaccgaacacctggtcgcttccgccggaaagtacctctttcgtntccactttaatcaactcttgtttgcactcgtcgacgaaanngcgaaagtttttcgcggtgtcgcgaatctttcgcctgtttgcgaggatgacgacgtttggtgcgtccgtcgttctcccgacggatgacgacgacgaattcatcnnnnnnnncgcnnnncgannnnnncgacgannantnttnntngtcgtcgtngngnnnttnntngnnnnaananaagnancatcnnnnngannannnntnntnntgnncntnnncnncnnnncngcgannnnnacnnnnacnncnnngcnngngnttntgnnnnnnannnnnnnnnnnnnnnnnnnannnttnntnntntnnntnnnnnnnnnnngtncgngnnngtnnnnnnnntnnnnnannnannnntcntnntnnnnnntnctactnctnnnnnntnnttnttnntactnntnnnnnnnannnnnctncntnntnnnannntcnnnnnngnngangnnnnnnnnntnnnnnnngncgnngnnnnntnnngannngncgtngtngncgccgcnnntntngncggcgncgnnnnnnncnangannncttnnnncnncnnntctnnnnaannnangntgttgttgttgttgttgttgtnnncnccnnnngncgttgtngttgnnncngcnncnactnntntngtcgtcgtnntcgncncnncnncgnnntngtnntnnnnnnnnnngtcntcnnncnncnncnnnnnttnnttctncnnnnnnagnngnttttnttnttnnncntcnnnttntnnnnntntttnntnnncgnnnnnnnnnncgnngntcnnntncnnntnnttgtnntnnnncgnggnnnannannncnanaannnntcnncnnnnncnncggnggngnnngnnnnnnnnncgcngcngntncnnnnnnnnnnnnnnnnnnccnccgnnnnnnnnnnnttnnncancannntnnncgnnnnnnancnnnnnntggtnnttntnntcatcntctccncngtnnnnnnnnngccnncncnnncgncgtnntnnnttnnnnnnnncgnngngncgnnnnnncnnncnncnnncgccgccnncannnncnnctgnngngnnnnnannncgncnnntannnncncccncncgncgncgncgacgnnngcgnnngcngcnnngncgncnncgnncgnnnncgnnncnncgacgannatnntcngcnnatnnttcnncnccannacnattnnnttnntcnnnnnntcgtcnnaancnnancncnacgncngcacntncncctcgntnncgnnntcntncnccnnngcgncgncnacnannnnnannan

SEQ ID NO: 1109 - DNA, 4000 bp, Escherichia coli
  misc_feature (465)..(465): n is a, c, g, or t
  misc_feature (1991)..(1991): n is a, c, g, or t
  misc_feature (2508)..(2508): n is a, c, g, or t
  misc_feature (3553)..(3553): n is a, c, g, or t
tttgcgagctggtaaagataaacttatggggttctttgtcggcaaggttatgcaagccaccggcggtaaagctaacccgcaacaagtcaacgcgatgattaggcagaaactcagtccttaacggctctggataagtcgccacttttttaggagattcggccaacctaaacgcgtcaaatactgatctatgcggccctttgaaggattcattttggcccgccttcgagaccatcgcccgctcgcgattgagaaatctaggactagaagcagtccgccgcgcgcgcgactaacccctagccggcttggaactcgcccagaaaggtcagaatccttgcggcattgaccccaaggtccgactgcccaaccctcgagactgaacgaacgtcgagcaatgtttgccctccttcatctttgaccctgaccactacatcatctttaaatccaaaccagaacgttgttgcggtngcttcaacgatccctgctgcaccatcaacattaatgatctcaagccccatattgctgagcactatctcggctaactcaagactttcttggactgatttttctgttagcaaggtggtaacttctggataggcttcgtcctgcagcgccgccatttcttccactgatcgattttcgtctgcataaacaagatcatttgcggcatgcacccgacgctttttaatttcttgaaactcagggggatctattgggttggtggtaatgtcatgaatagcaggcacacgtcctgcctgttgcaattgagggacgacgaacgcgatagggattaacgctattaccgtggccgccaacaaagcgcctcgatcgacggtctgctttctaatgacaccagcgacccatagccccaggactgcaataatcgtaagcgccgcacccgcaaacgccatcgtaaagccacccaatgcagtcataacgtcaaagagtccagcccgatacccaagcgggctacccaacaagatcaataactgacaagccacaaatatgagaagaactttactacttgttttcatgtttcttacctttgttttagtgacaccactgtatcttacaatcgtaaggggacgctcatcgaagtgtcatctccgatccaacgaaccgtctctttgatttgctttcccggggaccggatcaaaccgccgaattatgtatcccagctttaggaacccactttaacatgccaaggttcaaagcggacgccaaaccgattacccgccggatatcgcaattctatgtaggcaaggccctgcattctgcgaaacacatcagaacgtgcaaacagatgtgtgaaattttcatcccctaagtgtctcgagcccacatcgaaatcacccgacccatgaaaggaataacccggcggcgcaagacttcttgacgccagcgagacatttccttgactgtccattaattttgccaaaaacaatccgcactgctttggcaacgcgcgagcacccgacgtcaagattagatctcgaccaatatccttgcgcattctctcccaaagcggcttggccttttcccgaaacaaaaattgaccgaactgccgctcataatgaacctgcccagaggtaaatccggctaagaaatccatagagacctttggccccttaaaaccaaaatttttcgcatcctcaaaaaatagccactgcagaagtcccaattcatcgatactaaagcgccctatttccgtcgttttacccgcggtttcaaacagctgtttaaagcccacaatattgaaaaaaccatgcccataatacccctgagcccgattcaatcgtgccaaggcactgggcaatgcttgcctaaactcagagggcaaaaagacatcaccttcggcataacgatcaggcgactgcatcttttttgaatctaatctaaccgcctctaggtcggcttcagtccagccaaattcatcaagaaactctaactggttaggtgcttcggataatatttgctcaggcgcgagctctganaggccgcctgcccccgagagacccggcgcagatgagatgtcagcacctgggcctagcagtcgataggcagtgatcccaagggccgaggtacccgaagcaccgatcagccacttcaagaatcgccgttttgaaagattcaaatcattacttcgttagtttcgccctgactagccgctaaagtcttttcaccaaacgaccctttgcaaatacgtagcccgggttttgcaatgccttaagatccgccaaaggtgattggtcaaaaacaatcaaatctgcagacaaccctgtttcaagtcgaccggtgatatggtcgatcgccaaagccttggcacaatcgctcgtggcgcttcgcaaagtttgcaccggcgtaaaatctgcaatctgttcaaaaacccgaagcgccttgggtaaatcctcatgatagacatgaggaatccccgcatctgtggacgcaatgaactgacagcccttttccttcattgcgccataacgcgcttgcactgcggttaggtaattnggattactcaggtgacgggcccagccagcattcaccgttggcgaaatccagatgcctttatccgcaatctccgctgctaaatcagggtcaaaatgcttaccccaaccgtttgggccaacccaagagcagtgctcaatcgtggtgacgccagctcttgcggcatgggcgatgccatcaaccccatgacaatgtgcggcaacacaatagccgctctctgtagccgctcgcacaatacccgtcatagtcccttgatcaaattgagcatcactgggcttacttccaggcgtaatattaccgcctgttgccatgactttaatcagatctacgccagcggcagcttgtcgctcaatgaccgacaacgcctcagctaaatccgatgcttcgcctccccaaaagtgacaatggcctccaggcgatgtaatgggctgacctgcacaaattaaccgaggaccgtcaatctcgccggccgcaatcgcatctctaactttcagctccaaccattgcccaccacctaagtcgcgagccgtcgtgatcccggcctggaccattttttttgccctaagccccatggcactgagctggtccttagccggcaccttgccgtgtgcaaaagggtcagactcatcagggtctaaacaaagatgaatatgcgcatcgatcaatcccggtaagacgaacgcaccggcaagatctaactcaggctctccactcgaccgatcatccgcggacgtcagcgctatggtgccagctgctgtaatacggatcgcatcgaactcagtaccgtagtcttccgaaaccccatcccaaaattttatatttctgagcaacatgttctaagccctaacgctagttatccccttgaataatagcagagtcagcaccatcggccgcgcagaaggtgccctatcgcgtcgctaaattagctcgctgaccgtagttgaccttagcaaccctgaaggaatcagcacgttgggcagacggcgtccgccccaaaataccctcttacagcgctggattcgttcgattaagtcttagtacctctagnagaccttccaagattaggtcacttacaacatgatcaaacacacgttctcgatcaaaaagatgtacaaagccgccggtaccaacaaccagcggggcctcatctggaaatgcttgctctgaaatacgtgcaaccaattctttgatcatgccgacattagaccaatacagcccagactgaatactctcgatggtcgtcgtccctatcgccgttttaaccggtttaatctcgaccgagggcagctgcgctgtgcgcatttcaagcgcctccatcgacaaacgtacgcccggcaagatattaccgcctaaaaaggttcgatccttcttcacggcacataccgttgtggctgtaccgaaatcagcaacgatcaagtgcctatcgggaaaaagctttaaggcacccactgcatcagcaatccgatcagcgcctacttctttcggatctctgtaa

SEQ ID NO: 1110 - DNA, 4000 bp, Escherichia coli
  misc_feature (288)..(288): n is a, c, g, or t
  misc_feature (293)..(293): n is a, c, g, or t
  misc_feature (295)..(297): n is a, c, g, or t
  misc_feature (299)..(300): n is a, c, g, or t
  misc_feature (302)..(302): n is a, c, g, or t
  misc_feature (304)..(304): n is a, c, g, or t
  misc_feature (306)..(306): n is a, c, g, or t
  misc_feature (309)..(310): n is a, c, g, or t
  misc_feature (312)..(312): n is a, c, g, or t
  misc_feature (314)..(314): n is a, c, g, or t
  misc_feature (317)..(318): n is a, c, g, or t
  misc_feature (321)..(321): n is a, c, g, or t
  misc_feature (323)..(324): n is a, c, g, or t
  misc_feature (326)..(329): n is a, c, g, or t
  misc_feature (332)..(332): n is a, c, g, or t
  misc_feature (334)..(336): n is a, c, g, or t
  misc_feature (341)..(344): n is a, c, g, or t
  misc_feature (349)..(350): n is a, c, g, or t
  misc_feature (352)..(352): n is a, c, g, or t
  misc_feature (354)..(356): n is a, c, g, or t
  misc_feature (359)..(359): n is a, c, g, or t
  misc_feature (363)..(364): n is a, c, g, or t
  misc_feature (366)..(368): n is a, c, g, or t
  misc_feature (370)..(370): n is a, c, g, or t
  misc_feature (373)..(374): n is a, c, g, or t
  misc_feature (378)..(380): n is a, c, g, or t
  misc_feature (383)..(385): n is a, c, g, or t
  misc_feature (389)..(392): n is a, c, g, or t
  misc_feature (395)..(398): n is a, c, g, or t
  misc_feature (401)..(402): n is a, c, g, or t
  misc_feature (406)..(407): n is a, c, g, or t
  misc_feature (414)..(414): n is a, c, g, or t
  misc_feature (416)..(419): n is a, c, g, or t
  misc_feature (421)..(423): n is a, c, g, or t
  misc_feature (427)..(427): n is a, c, g, or t
  misc_feature (429)..(429): n is a, c, g, or t
  misc_feature (432)..(432): n is a, c, g, or t
  misc_feature (435)..(438): n is a, c, g, or t
  misc_feature (440)..(440): n is a, c, g, or t
  misc_feature (442)..(443): n is a, c, g, or t
  misc_feature (446)..(449): n is a, c, g, or t
  misc_feature (452)..(454): n is a, c, g, or t
  misc_feature (456)..(458): n is a, c, g, or t
  misc_feature (460)..(460): n is a, c, g, or t
  misc_feature (462)..(464): n is a, c, g, or t
  misc_feature (466)..(466): n is a, c, g, or t
  misc_feature (468)..(480): n is a, c, g, or t
  misc_feature (486)..(492): n is a, c, g, or t
  misc_feature (494)..(497): n is a, c, g, or t
  misc_feature (499)..(500): n is a, c, g, or t
  misc_feature (502)..(502): n is a, c, g, or t
  misc_feature (504)..(504): n is a, c, g, or t
  misc_feature (507)..(512): n is a, c, g, or t
  misc_feature (514)..(516): n is a, c, g, or t
  misc_feature (518)..(518): n is a, c, g, or t
  misc_feature (520)..(520): n is a, c, g, or t
  misc_feature (522)..(522): n is a, c, g, or t
  misc_feature (526)..(528): n is a, c, g, or t
  misc_feature (532)..(532): n is a, c, g, or t
  misc_feature (534)..(536): n is a, c, g, or t
  misc_feature (538)..(543): n is a, c, g, or t
  misc_feature (545)..(549): n is a, c, g, or t
  misc_feature (551)..(551): n is a, c, g, or t
  misc_feature (553)..(554): n is a, c, g, or t
  misc_feature (557)..(562): n is a, c, g, or t
  misc_feature (564)..(567): n is a, c, g, or t
  misc_feature (569)..(571): n is a, c, g, or t
  misc_feature (573)..(574): n is a, c, g, or t
  misc_feature (576)..(577): n is a, c, g, or t
  misc_feature (579)..(597): n is a, c, g, or t
  misc_feature (599)..(601): n is a, c, g, or t
  misc_feature (603)..(606): n is a, c, g, or t
  misc_feature (608)..(608): n is a, c, g, or t
  misc_feature (610)..(613): n is a, c, g, or t
  misc_feature (615)..(615): n is a, c, g, or t
  misc_feature (618)..(618): n is a, c, g, or t
  misc_feature (621)..(625): n is a, c, g, or t
  misc_feature (628)..(630): n is a, c, g, or t
  misc_feature (632)..(637): n is a, c, g, or t
  misc_feature (641)..(642): n is a, c, g, or t
  misc_feature (644)..(644): n is a, c, g, or t
  misc_feature (647)..(647): n is a, c, g, or t
  misc_feature (649)..(649): n is a, c, g, or t
  misc_feature (651)..(652): n is a, c, g, or t
  misc_feature (656)..(658): n is a, c, g, or t
  misc_feature (663)..(670): n is a, c, g, or t
  misc_feature (673)..(675): n is a, c, g, or t
  misc_feature (678)..(679): n is a, c, g, or t
  misc_feature (681)..(685): n is a, c, g, or t
  misc_feature (687)..(687): n is a, c, g, or t
  misc_feature (690)..(690): n is a, c, g, or t
  misc_feature (693)..(695): n is a, c, g, or t
  misc_feature (699)..(704): n is a, c, g, or t
  misc_feature (706)..(708): n is a, c, g, or t
  misc_feature (710)..(715): n is a, c, g, or t
  misc_feature (717)..(717): n is a, c, g, or t
  misc_feature (719)..(721): n is a, c, g, or t
  misc_feature (723)..(723): n is a, c, g, or t
  misc_feature (725)..(726): n is a, c, g, or t
  misc_feature (728)..(729): n is a, c, g, or t
  misc_feature (731)..(731): n is a, c, g, or t
  misc_feature (733)..(739): n is a, c, g, or t
  misc_feature (741)..(768): n is a, c, g, or t
  misc_feature (770)..(773): n is a, c, g, or t
  misc_feature (776)..(779): n is a, c, g, or t
  misc_feature (781)..(783): n is a, c, g, or t
  misc_feature (785)..(792): n is a, c, g, or t
  misc_feature (794)..(798): n is a, c, g, or t
  misc_feature (800)..(821): n is a, c, g, or t
  misc_feature (824)..(833): n is a, c, g, or t
  misc_feature (835)..(842): n is a, c, g, or t
  misc_feature (844)..(845): n is a, c, g, or t
  misc_feature (848)..(853): n is a, c, g, or t
  misc_feature (855)..(855): n is a, c, g, or t
  misc_feature (857)..(864): n is a, c, g, or t
  misc_feature (866)..(866): n is a, c, g, or t
  misc_feature (868)..(868): n is a, c, g, or t
  misc_feature (872)..(872): n is a, c, g, or t
  misc_feature (874)..(874): n is a, c, g, or t
  misc_feature (876)..(876): n is a, c, g, or t
  misc_feature (878)..(880): n is a, c, g, or t
  misc_feature (883)..(889): n is a, c, g, or t
  misc_feature (891)..(891): n is a, c, g, or t
  misc_feature (894)..(894): n is a, c, g, or t
  misc_feature (896)..(896): n is a, c, g, or t
  misc_feature (898)..(898): n is a, c, g, or t
  misc_feature (901)..(904): n is a, c, g, or t
  misc_feature (906)..(910): n is a, c, g, or t
  misc_feature (913)..(913): n is a, c, g, or t
  misc_feature (915)..(915): n is a, c, g, or t
  misc_feature (918)..(918): n is a, c, g, or t
  misc_feature (920)..(923): n is a, c, g, or t
  misc_feature (925)..(926): n is a, c, g, or t
  misc_feature (929)..(929): n is a, c, g, or t
  misc_feature (932)..(932): n is a, c, g, or t
  misc_feature (936)..(936): n is a, c, g, or t
  misc_feature (938)..(938): n is a, c, g, or t
  misc_feature (942)..(943): n is a, c, g, or t
  misc_feature (948)..(949): n is a, c, g, or t
  misc_feature (954)..(957): n is a, c, g, or t
  misc_feature (961)..(961): n is a, c, g, or t
  misc_feature (963)..(963): n is a, c, g, or t
  misc_feature (965)..(966): n is a, c, g, or t
  misc_feature (968)..(968): n is a, c, g, or t
  misc_feature (970)..(970): n is a, c, g, or t
  misc_feature (973)..(974): n is a, c, g, or t
  misc_feature (977)..(980): n is a, c, g, or t
  misc_feature (983)..(989): n is a, c, g, or t
  misc_feature (992)..(992): n is a, c, g, or t
  misc_feature (995)..(995): n is a, c, g, or t
  misc_feature (997)..(997): n is a, c, g, or t
  misc_feature (999)..(1001): n is a, c, g, or t
  misc_feature (1004)..(1005): n is a, c, g, or t
  misc_feature (1007)..(1007): n is a, c, g, or t
  misc_feature (1010)..(1012): n is a, c, g, or t
  misc_feature (1016)..(1016): n is a, c, g, or t
  misc_feature (1018)..(1020): n is a, c, g, or t
  misc_feature (1023)..(1023): n is a, c, g, or t
  misc_feature (1026)..(1026): n is a, c, g, or t
  misc_feature (1030)..(1031): n is a, c, g, or t
  misc_feature (1034)..(1034): n is a, c, g, or t
  misc_feature (1036)..(1038): n is a, c, g, or t
  misc_feature (1040)..(1041): n is a, c, g, or t
  misc_feature (1044)..(1045): n is a, c, g, or t
  misc_feature (1047)..(1047): n is a, c, g, or t
  misc_feature (1051)..(1053): n is a, c, g, or t
  misc_feature (1055)..(1055): n is a, c, g, or t
  misc_feature (1064)..(1064): n is a, c, g, or t
  misc_feature (1066)..(1069): n is a, c, g, or t
  misc_feature (1071)..(1071): n is a, c, g, or t
  misc_feature (1077)..(1077): n is a, c, g, or t
  misc_feature (1081)..(1082): n is a, c, g, or t
  misc_feature (1084)..(1084): n is a, c, g, or t
  misc_feature (1090)..(1090): n is a, c, g, or t
  misc_feature (1092)..(1092): n is a, c, g, or t
  misc_feature (1098)..(1098): n is a, c, g, or t
  misc_feature (1101)..(1103): n is a, c, g, or t
  misc_feature (1105)..(1105): n is a, c, g, or t
  misc_feature (1108)..(1109): n is a, c, g, or t
  misc_feature (1112)..(1113): n is a, c, g, or t
  misc_feature (1121)..(1121): n is a, c, g, or t
  misc_feature (1123)..(1123): n is a, c, g, or t
  misc_feature (1228)..(1228): n is a, c, g, or t
  misc_feature (1243)..(1243): n is a, c, g, or t
  misc_feature (1250)..(1252): n is a, c, g, or t
  misc_feature (1256)..(1258): n is a, c, g, or t
  misc_feature (1260)..(1262): n is a, c, g, or t
  misc_feature (1265)..(1266): n is a, c, g, or t
  misc_feature (1273)..(1273): n is a, c, g, or t
  misc_feature (1282)..(1282): n is a, c, g, or t
  misc_feature (1288)..(1288): n is a, c, g, or t
  misc_feature (1298)..(1298): n is a, c, g, or t
  misc_feature (1300)..(1300): n is a, c, g, or t
  misc_feature (1303)..(1304): n is a, c, g, or t
  misc_feature (1306)..(1306): n is a, c, g, or t
  misc_feature (1315)..(1315): n is a, c, g, or t
  misc_feature (1318)..(1318): n is a, c, g, or t
  misc_feature (1321)..(1321): n is a, c, g, or t
  misc_feature (1324)..(1324): n is a, c, g, or t
  misc_feature (1326)..(1326): n is a, c, g, or t
  misc_feature (1330)..(1330): n is a, c, g, or t
  misc_feature (1333)..(1334): n is a, c, g, or t
  misc_feature (1336)..(1336): n is a, c, g, or t
  misc_feature (1339)..(1339): n is a, c, g, or t
  misc_feature (1342)..(1342): n is a, c, g, or t
  misc_feature (1357)..(1357): n is a, c, g, or t
  misc_feature (1360)..(1363): n is a, c, g, or t
  misc_feature (1366)..(1367): n is a, c, g, or t
  misc_feature (1370)..(1370): n is a, c, g, or t
  misc_feature (1372)..(1373): n is a, c, g, or t
  misc_feature (1375)..(1375): n is a, c, g, or t
  misc_feature (1377)..(1377): n is a, c, g, or t
  misc_feature (1384)..(1385): n is a, c, g, or t
  misc_feature (1389)..(1389): n is a, c, g, or t
  misc_feature (1391)..(1391): n is a, c, g, or t
  misc_feature (1393)..(1393): n is a, c, g, or t
  misc_feature (1396)..(1399): n is a, c, g, or t
  misc_feature (1403)..(1403): n is a, c, g, or t
  misc_feature (1435)..(1435): n is a, c, g, or t
  misc_feature (1528)..(1528): n is a, c, g, or t
  misc_feature (1585)..(1585): n is a, c, g, or t
  misc_feature (1600)..(1600): n is a, c, g, or t
  misc_feature (1624)..(1624): n is a, c, g, or t
  misc_feature (1627)..(1627): n is a, c, g, or t
  misc_feature (1630)..(1630): n is a, c, g, or t
  misc_feature (1786)..(1786): n is a, c, g, or t
  misc_feature (1990)..(1990): n is a, c, g, or t
  misc_feature (1992)..(1992): n is a, c, g, or t
  misc_feature (2014)..(2014): n is a, c, g, or t
  misc_feature (2740)..(2740): n is a, c, g, or t
  misc_feature (2970)..(2970): n is a, c, g, or t
  misc_feature (3031)..(3031): n is a, c, g, or t
  misc_feature (3187)..(3187): n is a, c, g, or t
  misc_feature (3289)..(3289): n is a, c, g, or t
  misc_feature (3334)..(3334): n is a, c, g, or t
  misc_feature (3337)..(3337): n is a, c, g, or t
  misc_feature (3647)..(3647): n is a, c, g, or t
  misc_feature (3651)..(3651): n is a, c, g, or t
  misc_feature (3731)..(3731): n is a, c, g, or t
  misc_feature (3776)..(3776): n is a, c, g, or t
  misc_feature (3861)..(3861): n is a, c, g, or t
taaaactgtctacccaaagcctccaaaagttttggattgcttcgctggtggcgggagtataccgttggaagcactgaggttgggttgtgaaacttacgctctggaatacaaccctgtcgctgtcctcatccttaaagccactttggagtatccgcaaaagtttgggaaaaggttgctggaagaagtgaggcgttggggagaatgggtgttaaatgaagcaaagaaggaactcgcaagtttctaccccaaagaccctgacggctcaatccctgttggctacatttgggngaggncnnngnntngncnagnncntnacnncgntnncnnnntancnnngatgnnnnaaacnngncnnncanacanngnnnanagnnaaannncannnaaannnntgnnnnacnngaannacaagcnannnnannnagtnancgnggnnnncnannaannnnacnnngnnncntnnnangnnnnnnnnnnnnncgctgnnnnnnntnnnncnntntncgnnnnnncnnntnangncgannnaacnannnannnnnncnnnnnangnnaannnnnncnnnnannnanngnngnnnnnnnnnnnnnnnnnnncnnntnnnncnannnntnccnatnnnnnaannnannnnnnttgnnanccnancnnaatnnnaaagnnnnnnnnaannnaanngnnnnncnaangcnnnaggnnnnnngnnngnnnnnngngnnngnanngnnancnnnnnnngnnnnnnnnnnnnnnnnnnnnnnnnnnnntnnnnttnnnnannntnnnnnnnncnnnnngnnnnnnnnnnnnnnnnnnnnnnagnnnnnnnnnntnnnnnnnntnnccnnnnnngncnnnnnnnncnangcananangnnnaannnnnnngncgncncngannnngnnnnngcngnagngnnnntnntgnctntggngntgannggganngatgnnnntacntncnncntntgnnttnnnnatnnnnnnnaanctngngnnntcnntnttnnnggtngnnntgnccnaccnntancnnngnnctnntntgannngnacgcaattncnnnngntggagntgcnngngggagntnggcacncgnnngnatnntgnnagtccttncncatcttacccaaatcccgtcagcagatgttccgcctaaggttcatcaaggttcagccactgaccttccttaccctgaccaattctttgatgccgtcatcactganccaccttattacganaatgtgnnntacnnngnnntgnncgacttnttttatgtntggctnagacgcaccntnggnnanctttacccnganttnttngnaacnccnntnacnccnaaggcagaagagttngtnnnngannctnanngncntggcggnnactngnangcnnnnaagnaatggtttgagcagaaactcactcaagccttncgtgagatttatcgtgtgcttaaggacgatgggattgccgtcattgtcttcgcccacacgagcgttgatgcatgggagagcatcattaacgcnttgcttgatgccgacctttacttaaccgcatcgctgcccatccacacggagatggangcgaggttgcgccancaaaattcagccgcattagcgtcntcngtntacatggtttgtcgcaagcgggttgaggagaaggtaggcgaatatcgttcggtcattcgtgagatggaagaggaaatcccgaaatcgttggagaagttctgggaggcagggattagcggacctgatttttggcaaagtgccatcggtcctgccgtngccatcttcgggcgatacaagaaagtcgtcaagcaggatgggacggaagtgagcgtcagggaactgctggaggaagcccgcagaatcaccgcccactatgcattgaagcgagttttggagaaagttggtggcgacgaacacactgttggagcacttgaccctgtgacccgattctaccttgtctggcgatggacttttgggggngngaaaattcaagtcccctttgangatgcgttgcgggtcgctcgctccgagggcgtagagttaagagactatgcgagagccgacagcataatccgcatttctggtggtaaggtgaaagttgtcggaccaaccgaacggaaagatgacaaacgcttccttgagaacttaaggttcaattccctcattgatgctatccacagggcagtgatagcgtggcaaagcggagatgatgtcacactgcaagcgatattgtcacagagaggcaacgaaaccttctggcaagtcgcccaagcaatcgctgaagttttgccagaaggcgacgaagaacgaaggttacttttcgggcttctccaaaggcgtggacgagttccccaaacagcacaggagcaaacacaacttgatttgtcttaggagtgaacacgacaatttgaacattgcaaaaacgccgttgcgatgcccaagggcgtggtgaagttatcatggagcaaacgattatgcaattgctggagtcaactgctgaaggagcaaagggagaagttgaaagggcgaaagagaaatggcggcaacagattcaggacttggttcgcaacttgacaggtttgagattaactcatatccactctccaaaggaaacagtcaaattgagcatccgtgttgatgctgggttgcctaaaaaggtggttgagaagatcaaatcggatgtagggcaaatggaactgatcagggaacttttgagtttccacaaagcgncgcttactgccctaagggataactgcaaggaattgttgacgaacagtctttttgacaagttgcgggatttaggttggagcaaagcagagagttaccgttcaacaattgaatcaacccttaaggtggctgaggaattactcagggaagccgagcaagcacaggttatccgcaaaattttggagatagatgaagatgtcttgggagaatacagcccagagggtttccactcnggcaagatcacactctactggatggtgattggtgcagtggcgaggtggttgggagttagcnttgagggactaacagtagttgtgctaactcacgaaatggttcacgcttacacccatttgggaacggacatagacggtttagggtgttgcgtatgttttttaaaggcaaaacatgaggttcatgagggtttggctcaatacttcactcacgaagtcntgaatgttttgagggtaagagggcatgaagagttttggagagcctatgagagactgttgaaacatcaaaaaggtccctacaaggagcacgagaattggttgnaaaacgaatacactccagaggttgtgcgggctgcctatttggcanttnggggagaagagggagaggtcacaattgaaaaatttcgcagtaaattgagtgaatgtgcccaacttcttgggcgtgatagcaagagagatcaaacaacgcagaggtaagcacaatctccgttatggcagtgaaaccgctgcaatgcttaaaggctttaaggaggtgctttgtgatggaaagattgccgtcatggatggaggtcgtaaatcctgacccgattgtgctttcagagaggttagatgaatcgctatttgcagccgacctttacagggttctaaaaggcgatgctccccgtgagtatcaagacccnaganggtttgccgagcaaacttatccgaccgaaggcatggttcaactccttagcgatgtagtgaggcgattgagtggcaaaggntcatccaacccagtcatccaaatccagacaccctttggaggcggnaaaactcacgctttgattgccctttaccacttggtgaagcaaggaagtgagatcaaaaattccctgttgggtgaaagagtgttanagaaggctggtgtcagcagtttcccgaaggcaaaagttgcggtcttcgtggggacggtagtaagccctaaagagtcacctacaccatggggtgaaattgcaaggcaacttggtcgctacgatttggttaagagagccga

SEQ ID NO: 1111 - DNA, 4000 bp, Escherichia coli
  misc_feature (718)..(718): n is a, c, g, or t
  misc_feature (1961)..(1961): n is a, c, g, or t
  misc_feature (1963)..(1963): n is a, c, g, or t
  misc_feature (1989)..(1989): n is a, c, g, or t
  misc_feature (1992)..(1992): n is a, c, g, or t
  misc_feature (2301)..(2301): n is a, c, g, or t
  misc_feature (2699)..(2699): n is a, c, g, or t
  misc_feature (3103)..(3103): n is a, c, g, or t
  misc_feature (3690)..(3690): n is a, c, g, or t
  misc_feature (3732)..(3732): n is a, c, g, or t
  misc_feature (3944)..(3944): n is a, c, g, or t
gcgtcacctctcacggggatagatcgaacagatctgagattttgacttcggatctgtcatgccaagcgcttttgtgtccctgattacgccccatttagcgtaatcggtctgtgtcggacgcgttctcataaacaagccacggttaatttggaagccgcacggaagggtgcgtctacacgcctcttcgacctgttcgattacgtcctcatcctcaagttcaagccaaatcctaccaacctgtaccccaagctccacatcctgttgccccacttgaatgtgtttgcgccctgcgtgcgcgttcggcgttcccttagctggccctgtcggcacagtggaagcgatccgaggtccgtgcaatatcaagcgcgttataccgttgatcttggctaattctgtaagcaacttctcaaccatgtctgggctaagaaatcgttcagtgaaaagctctatttgaacagggatgttcgtatcggggacattcgtatccattatgtatcgtaaacctccgcgcaatttacgtaattacattccctccgctgctttggcaacagcagtgattgggtctttgaattctggtatctcgccgtacactatgccgatgagctttgacgttgactcgacagagaacatctgtgtccccgcgtcaattgacacggctgctgcaacgcatggaatcgcaaagcccttggagtgtctcgtcacgatgtggttcccattnaacacaccaggtccgccgccgccgtagatcgagtggctgaagaacgagaacccgaccgctgtacccataaccttaccgaagtcacagccggggagtcccgtctcgtgctcgagcaggtcgtttgcgtacagcagcgttgacgaaaccgcttgcgcgcctcgagacgcaccacagtttacaatggtcgcggcgagtgtgcaagcagcgcaataggcgttccaggctgcgacgtcgccagtcttcatcgccttaaagccagaaggccaggttacatcttctttgatgacaccggctgcttttgccttttcaacggtcgacgcaactacagaaccgatagtgccgtcttgtccgttctctttaacgagcgagtaggtcacgttgttcgcgtttaacccctgcatcgcaagtccgcagagttgtaaacgctcgttccagccaatagcgtcacccatctcccagacacccgcctgttcgaatatcgatgacagcgcggccgcgttcatcgtccgcttgccagtggcagctgcaacgtggttaaccgctacatttcgcagtgagtaaccgtacccttcatctttctgtggggtttcaagcatggatttcaccataccgcccacggcgtcgagagtctgtgggtactctccccaaatggccgccttaaccatcggcgcttggaacatgtccaccttgaacatgtcgataatcgcctgagttagtgcgctgcttgttgcagtgattcctgagacataggtagctccagcctcgagacgtgctgtcggtatttggaccataagctgctttccgtcgccaaggggcttgacgaccgtgtcgtcgccttcacttaccattatgaggtccttgacctccttcgcaagagcgtcgacgttgcccaataggtccaggttcaactcgcgaccgagtatctgtctacccttgccgcccattttaccggtcatcaaagcgttttggataccaccaagattaacggccaccgttcttaaggtggtgttgataatcttcttgatagccgggttcaccatcgggctgagcgcctcgagtggtatgttggaaccaactttttgacctttgtcgttatgtaaatcgactttgtcttcaaattttggcattctatccctccacagggtcaactgccacacgatcaactctgtatgctgtaaaccatgactgaaaaatagctgaatacaactcgaccgtaaaacgataaaaagttgtatgttttacntngcatggagcgtaccctgggtttaccntcnaatccttttaatagtttattaagcttgtgctggaaaacagcggagcggtaaagaaatattttccgtggatatttttgtaaaaaaacccttctaaatttttatttaattttttatatataaacagttctatagagttatagatacgcaacggccgccaatcactcaaaagttttatatgtttccaatcttatctcgcctttgcatatgaaggtattaataagtcccaaagacgaatttgaggcaaaagcagcagttaatgggggcgcagatattatagacgttaaaaaccccgatgaaggatcactcggngctaactttccgtgggtaatacgacaggttcggaaccttgtaccttactccatagaggtgagcgcgacgatcggtgattttccgcatctccctggctccgcctcattagctgcactaggcgcagctgtgtctggggctaattacgtcaaagtaggactcaaagggtcaaaaacgcgagacgaggcgatttttttaatgcagcatgtaacgagagcggtgaaggaatacaacattaaagccaaagtcgttctcgcagggtacgcagactatcacagagcaaagactctcgatccctttctgctgcctgaagttgccggtagtgctggctgtgacgtcgtgatggtcgatacgttcattaaggacggaaaaaggctgtttgatttcatggacgaagcttnctgtaagcgttttatcgataaagggcacgaaaaagacttggaagttgcccttgcaggatccatcaaactgcaagatatccccatattaaaacgcacaggtgctgacatcattggaattagaggcgcagcttgttcacacggcgaccgtttagctggagcgatacaggccgaaaacgtcagggcgctaatggacctcgcaaaacaatcatgagtgtcttcggacaaacctaactgccacctgatgtcgcttagcaaactattacttttcacgctgccatgtttataatatgagtgtaaactacgcagctctgtcagacaagctcacgagtgttttaggtctaaaaggctcacccgtggcagtcaaacttattcgaacggaatcaagccttccaaaagggcttgtncatacaaacgaggttctgcgccattgcgaaatggttcagaaggcgcgacgcggttctaaattctacgcaacagtcgagcagcacgcgtgtaagggcggcgctggaatgctcggagtaatcgatataccagagaacatcaaatccggcgaattttactacaaactaggaagattctcttcagttgaacacgcggcagagaccatgcaaggtattccccacgtcgatttcaagacctatgcgaccgcttactcgccacttgccgagaccccttttgacccagacgtggtcgtacttgttgttagtccccatcaagcgatgatgatcgcgcaagctaacgtttacgaactacattcgaggaatattgctgatttctcaggaattcaatcgatatgtggagatgccgtcgctgcgccccttatgagggataccgtaaacttcacgctcggctgctcgggttctcgcaaatacgcaaaggtgagcgaagatgaacttatagttggcatccctatgaagatgctcccaaaattagctgatgctatccaaaaacttgcctaaccagcgtattcgagctcaatcgcgcgaagggngatgaactgtaccgttaaatttaaaaagaacaattcgtccangctatgtgcaaagttatggaccgaatagctcacagcaagcgagctccctaataaataccgtgttaaactctgctaaagtatgaggatcggtagcagtggttatattcccatctctctccacggatccccctgaatagttagcgcccgcctctagcaattctcgtccaacgctggggtgcgacgtcatcgtcttattcttgacgattccagcngatatcaacacctgtgggccgtgacaaaccgcgcctatctgtaatcctcgcttgta

SEQ ID NO: 1112 - DNA, 4000 bp, Escherichia coli
  misc_feature (2118)..(2118): n is a, c, g, or t
  misc_feature (2216)..(2216): n is a, c, g, or t
  misc_feature (2470)..(2470): n is a, c, g, or t
  misc_feature (2479)..(2479): n is a, c, g, or t
  misc_feature (2482)..(2485): n is a, c, g, or t
  misc_feature (2489)..(2491): n is a, c, g, or t
  misc_feature (2493)..(2493): n is a, c, g, or t
  misc_feature (2502)..(2503): n is a, c, g, or t
  misc_feature (2506)..(2508): n is a, c, g, or t
  misc_feature (2510)..(2511): n is a, c, g, or t
  misc_feature (2515)..(2516): n is a, c, g, or t
  misc_feature (2518)..(2518): n is a, c, g, or t
  misc_feature (2521)..(2521): n is a, c, g, or t
  misc_feature (2524)..(2524): n is a, c, g, or t
  misc_feature (2527)..(2527): n is a, c, g, or t
  misc_feature (2537)..(2540): n is a, c, g, or t
  misc_feature (2542)..(2542): n is a, c, g, or t
  misc_feature (2545)..(2545): n is a, c, g, or t
  misc_feature (2548)..(2548): n is a, c, g, or t
  misc_feature (2552)..(2554): n is a, c, g, or t
  misc_feature (2557)..(2557): n is a, c, g, or t
  misc_feature (2560)..(2560): n is a, c, g, or t
  misc_feature (2566)..(2567): n is a, c, g, or t
  misc_feature (2571)..(2572): n is a, c, g, or t
  misc_feature (2576)..(2576): n is a, c, g, or t
  misc_feature (2578)..(2578): n is a, c, g, or t
  misc_feature (2582)..(2582): n is a, c, g, or t
  misc_feature (2584)..(2584): n is a, c, g, or t
  misc_feature (2586)..(2586): n is a, c, g, or t
  misc_feature (2594)..(2594): n is a, c, g, or t
  misc_feature (2596)..(2596): n is a, c, g, or t
  misc_feature (2605)..(2605): n is a, c, g, or t
  misc_feature (2609)..(2609): n is a, c, g, or t
  misc_feature (2615)..(2616): n is a, c, g, or t
  misc_feature (2618)..(2618): n is a, c, g, or t
  misc_feature (2620)..(2620): n is a, c, g, or t
  misc_feature (2625)..(2625): n is a, c, g, or t
  misc_feature (2628)..(2628): n is a, c, g, or t
  misc_feature (2644)..(2644): n is a, c, g, or t
  misc_feature (2647)..(2647): n is a, c, g, or t
  misc_feature (2656)..(2656): n is a, c, g, or t
  misc_feature (2667)..(2667): n is a, c, g, or t
  misc_feature (2671)..(2671): n is a, c, g, or t
  misc_feature (2676)..(2678): n is a, c, g, or t
  misc_feature (2681)..(2681): n is a, c, g, or t
  misc_feature (2692)..(2692): n is a, c, g, or t
  misc_feature (2695)..(2695): n is a, c, g, or t
  misc_feature (2697)..(2697): n is a, c, g, or t
  misc_feature (2700)..(2700): n is a, c, g, or t
  misc_feature (2705)..(2706): n is a, c, g, or t
  misc_feature (2713)..(2713): n is a, c, g, or t
  misc_feature (2742)..(2742): n is a, c, g, or t
  misc_feature (2747)..(2747): n is a, c, g, or t
  misc_feature (2749)..(2749): n is a, c, g, or t
  misc_feature (2754)..(2754): n is a, c, g, or t
  misc_feature (2760)..(2761): n is a, c, g, or t
  misc_feature (2764)..(2764): n is a, c, g, or t
  misc_feature (2768)..(2769): n is a, c, g, or t
  misc_feature (2771)..(2772): n is a, c, g, or t
  misc_feature (2796)..(2796): n is a, c, g, or t
  misc_feature (2810)..(2810): n is a, c, g, or t
  misc_feature (2812)..(2813): n is a, c, g, or t
  misc_feature (2821)..(2821): n is a, c, g, or t
  misc_feature (2824)..(2824): n is a, c, g, or t
  misc_feature (2843)..(2845): n is a, c, g, or t
  misc_feature (2848)..(2848): n is a, c, g, or t
  misc_feature (2858)..(2860): n is a, c, g, or t
  misc_feature (2866)..(2866): n is a, c, g, or t
  misc_feature (2869)..(2869): n is a, c, g, or t
  misc_feature (2875)..(2875): n is a, c, g, or t
  misc_feature (2879)..(2879): n is a, c, g, or t
  misc_feature (2884)..(2884): n is a, c, g, or t
  misc_feature (2894)..(2894): n is a, c, g, or t
  misc_feature (2901)..(2901): n is a, c, g, or t
  misc_feature (2914)..(2914): n is a, c, g, or t
  misc_feature (2926)..(2926): n is a, c, g, or t
  misc_feature (2942)..(2942): n is a, c, g, or t
  misc_feature (2945)..(2945): n is a, c, g, or t
  misc_feature (2947)..(2948): n is a, c, g, or t
  misc_feature (2964)..(2964): n is a, c, g, or t
  misc_feature (2967)..(2967): n is a, c, g, or t
  misc_feature (2976)..(2976): n is a, c, g, or t
  misc_feature (2981)..(2982): n is a, c, g, or t
  misc_feature (2989)..(2989): n is a, c, g, or t
  misc_feature (3010)..(3010): n is a, c, g, or t
  misc_feature (3014)..(3014): n is a, c, g, or t
  misc_feature (3018)..(3018): n is a, c, g, or t
  misc_feature (3028)..(3028): n is a, c, g, or t
  misc_feature (3032)..(3032): n is a, c, g, or t
  misc_feature (3038)..(3040): n is a, c, g, or t
  misc_feature (3044)..(3044): n is a, c, g, or t
  misc_feature (3046)..(3046): n is a, c, g, or t
  misc_feature (3070)..(3070): n is a, c, g, or t
  misc_feature (3074)..(3074): n is a, c, g, or t
  misc_feature (3076)..(3076): n is a, c, g, or t
  misc_feature (3079)..(3079): n is a, c, g, or t
  misc_feature (3082)..(3082): n is a, c, g, or t
  misc_feature (3086)..(3086): n is a, c, g, or t
  misc_feature (3089)..(3089): n is a, c, g, or t
  misc_feature (3098)..(3098): n is a, c, g, or t
  misc_feature (3102)..(3102): n is a, c, g, or t
  misc_feature (3109)..(3110): n is a, c, g, or t
  misc_feature (3113)..(3113): n is a, c, g, or t
  misc_feature (3120)..(3122): n is a, c, g, or t
  misc_feature (3126)..(3126): n is a, c, g, or t
  misc_feature (3129)..(3129): n is a, c, g, or t
  misc_feature (3131)..(3131): n is a, c, g, or t
  misc_feature (3140)..(3141): n is a, c, g, or t
  misc_feature (3144)..(3144): n is a, c, g, or t
  misc_feature (3152)..(3152): n is a, c, g, or t
  misc_feature (3155)..(3155): n is a, c, g, or t
  misc_feature (3160)..(3160): n is a, c, g, or t
  misc_feature (3162)..(3163): n is a, c, g, or t
  misc_feature (3165)..(3165): n is a, c, g, or t
  misc_feature (3169)..(3169): n is a, c, g, or t
  misc_feature (3172)..(3172): n is a, c, g, or t
  misc_feature (3175)..(3177): n is a, c, g, or t
  misc_feature (3181)..(3181): n is a, c, g, or t
  misc_feature (3183)..(3183): n is a, c, g, or t
  misc_feature (3187)..(3188): n is a, c, g, or t
  misc_feature (3192)..(3192): n is a, c, g, or t
  misc_feature (3194)..(3194): n is a, c, g, or t
  misc_feature (3197)..(3197): n is a, c, g, or t
  misc_feature (3200)..(3200): n is a, c, g, or t
  misc_feature (3202)..(3202): n is a, c, g, or t
  misc_feature (3206)..(3206): n is a, c, g, or t
  misc_feature (3211)..(3213): n is a, c, g, or t
  misc_feature (3217)..(3218): n is a, c, g, or t
  misc_feature (3220)..(3220): n is a, c, g, or t
  misc_feature (3226)..(3227): n is a, c, g, or t
  misc_feature (3229)..(3229): n is a, c, g, or t
  misc_feature (3232)..(3232): n is a, c, g, or t
  misc_feature (3237)..(3239): n is a, c, g, or t
  misc_feature (3244)..(3248): n is a, c, g, or t
  misc_feature (3264)..(3266): n is a, c, g, or t
  misc_feature (3274)..(3275): n is a, c, g, or t
  misc_feature (3279)..(3279): n is a, c, g, or t
  misc_feature (3281)..(3281): n is a, c, g, or t
  misc_feature (3283)..(3283): n is a, c, g, or t
  misc_feature (3286)..(3288): n is a, c, g, or t
  misc_feature (3290)..(3290): n is a, c, g, or t
  misc_feature (3298)..(3301): n is a, c, g, or t
  misc_feature (3304)..(3305): n is a, c, g, or t
  misc_feature (3308)..(3309): n is a, c, g, or t
  misc_feature (3313)..(3313): n is a, c, g, or t
  misc_feature (3317)..(3317): n is a, c, g, or t
  misc_feature (3321)..(3321): n is a, c, g, or t
  misc_feature (3331)..(3333): n is a, c, g, or t
  misc_feature (3336)..(3337): n is a, c, g, or t
  misc_feature (3340)..(3341): n is a, c, g, or t
  misc_feature (3344)..(3344): n is a, c, g, or t
  misc_feature (3349)..(3349): n is a, c, g, or t
  misc_feature (3351)..(3351): n is a, c, g, or t
  misc_feature (3353)..(3354): n is a, c, g, or t
  misc_feature (3356)..(3359): n is a, c, g, or t
  misc_feature (3362)..(3363): n is a, c, g, or t
  misc_feature (3367)..(3367): n is a, c, g, or t
  misc_feature (3375)..(3375): n is a, c, g, or t
  misc_feature (3379)..(3379): n is a, c, g, or t
  misc_feature (3400)..(3400): n is a, c, g, or t
  misc_feature (3418)..(3419): n is a, c, g, or t
  misc_feature (3429)..(3430): n is a, c, g, or t
  misc_feature (3433)..(3433): n is a, c, g, or t
  misc_feature (3440)..(3440): n is a, c, g, or t
  misc_feature (3444)..(3444): n is a, c, g, or t
  misc_feature (3449)..(3450): n is a, c, g, or t
  misc_feature (3458)..(3458): n is a, c, g, or t
  misc_feature (3467)..(3467): n is a, c, g, or t
  misc_feature (3483)..(3483): n is a, c, g, or t
  misc_feature (3505)..(3507): n is a, c, g, or t
  misc_feature (3516)..(3516): n is a, c, g, or t
  misc_feature (3527)..(3527): n is a, c, g, or t
  misc_feature (3529)..(3529): n is a, c, g, or t
  misc_feature (3531)..(3531): n is a, c, g, or t
  misc_feature (3534)..(3534): n is a, c, g, or t
  misc_feature (3548)..(3552): n is a, c, g, or t
  misc_feature (3560)..(3561): n is a, c, g, or t
  misc_feature (3565)..(3565): n is a, c, g, or t
  misc_feature (3567)..(3567): n is a, c, g, or t
  misc_feature (3582)..(3582): n is a, c, g, or t
  misc_feature (3586)..(3586): n is a, c, g, or t
  misc_feature (3596)..(3597): n is a, c, g, or t
  misc_feature (3605)..(3605): n is a, c, g, or t
  misc_feature (3612)..(3612): n is a, c, g, or t
  misc_feature (3619)..(3619): n is a, c, g, or t
  misc_feature (3630)..(3631): n is a, c, g, or t
  misc_feature (3637)..(3637): n is a, c, g, or t
  misc_feature (3643)..(3643): n is a, c, g, or t
  misc_feature (3646)..(3646): n is a, c, g, or t
  misc_feature (3648)..(3648): n is a, c, g, or t
  misc_feature (3650)..(3650): n is a, c, g, or t
  misc_feature (3654)..(3654): n is a, c, g, or t
  misc_feature (3660)..(3660): n is a, c, g, or t
  misc_feature (3680)..(3681): n is a, c, g, or t
  misc_feature (3691)..(3692): n is a, c, g, or t
  misc_feature (3697)..(3697): n is a, c, g, or t
  misc_feature (3724)..(3724): n is a, c, g, or t
  misc_feature (3735)..(3735): n is a, c, g, or t
  misc_feature (3742)..(3742): n is a, c, g, or t
  misc_feature (3745)..(3745): n is a, c, g, or t
  misc_feature (3753)..(3753): n is a, c, g, or t
  misc_feature (3756)..(3757): n is a, c, g, or t
  misc_feature (3769)..(3769): n is a, c, g, or t
  misc_feature (3781)..(3781): n is a, c, g, or t
  misc_feature (3783)..(3783): n is a, c, g, or t
  misc_feature (3791)..(3791): n is a, c, g, or t
  misc_feature (3793)..(3793): n is a, c, g, or t
  misc_feature (3801)..(3801): n is a, c, g, or t
  misc_feature (3812)..(3812): n is a, c, g, or t
  misc_feature (3843)..(3843): n is a, c, g, or t
  misc_feature (3852)..(3852): n is a, c, g, or t
  misc_feature (3855)..(3855): n is a, c, g, or t
  misc_feature (3861)..(3861): n is a, c, g, or t
  misc_feature (3865)..(3865): n is a, c, g, or t
  misc_feature (3871)..(3872): n is a, c, g, or t
  misc_feature (3874)..(3875): n is a, c, g, or t
  misc_feature (3882)..(3883): n is a, c, g, or t
  misc_feature (3885)..(3886): n is a, c, g, or t
  misc_feature (3891)..(3891): n is a, c, g, or t
  misc_feature (3898)..(3898): n is a, c, g, or t
  misc_feature (3901)..(3901): n is a, c, g, or t
  misc_feature (3903)..(3903): n is a, c, g, or t
  misc_feature (3907)..(3907): n is a, c, g, or t
  misc_feature (3911)..(3911): n is a, c, g, or t
  misc_feature (3918)..(3918): n is a, c, g, or t
  misc_feature (3921)..(3921): n is a, c, g, or t
  misc_feature (3924)..(3924): n is a, c, g, or t
  misc_feature (3926)..(3927): n is a, c, g, or t
  misc_feature (3930)..(3931): n is a, c, g, or t
  misc_feature (3936)..(3936): n is a, c, g, or t
  misc_feature (3939)..(3939): n is a, c, g, or t
  misc_feature (3941)..(3943): n is a, c, g, or t
  misc_feature (3945)..(3946): n is a, c, g, or t
  misc_feature (3948)..(3948): n is a, c, g, or t
  misc_feature (3953)..(3953): n is a, c, g, or t
  misc_feature (3961)..(3961): n is a, c, g, or t
  misc_feature (3963)..(3963): n is a, c, g, or t
  misc_feature (3966)..(3967): n is a, c, g, or t
  misc_feature (3971)..(3973): n is a, c, g, or t
  misc_feature (3977)..(3977): n is a, c, g, or t
  misc_feature (3980)..(3980): n is a, c, g, or t
  misc_feature (3982)..(3982): n is a, c, g, or t
  misc_feature (3988)..(3990): n is a, c, g, or t
  misc_feature (3995)..(3998): n is a, c, g, or t
  misc_feature (4000)..(4000): n is a, c, g, or t
caccgctgcatcgacgagcttgccgggaactgattggcatgtccatcccgcgcggcgtgtcgcgtttgcctggcagagataggtcggggcaatgcgaccgtgctcctggctgtagcgcacactcatgcgttcgccacatagaccgcacaggacgcgaccttggagtaacgcggggccctcgcgggccggccccgacagccgctcgccagcgaaggcgcgggcgttatccgcgagccgacgctgattggtctcgaagcagtcccagtcgatgtagccctgatgcatgccaggcatcacgaactgccagtccgccctggcaaccttgacgacactggtgccaccatcgggccggtggcgtgtgcgcgtgcggccatacgcgaatgcgccggcgtagcgtggattgtgcagaacctgcaggatgcgcgaatgctgcggtggcgcccacaagagttcgcccttgtttgacccggtaagcagtcgacgcgggaacatgaggccctgctcccggaagaagcggactgtctggacagcacttccggtccgatcgaatgtctcgaagaccaagcgtagggcgcgctgcacctgcatgtcgggatcaaggccgagtgttccctcggccatgtaaaccaagccgaccggcggccgcatctcgagctcgccgcgcttggccttgttgagttgaccaccacgcatgcgcgccttgaggatgtgcagttcggcctcgctcattgtgcctttgaggccgagcagcaggcgatcgttgaaggcggctggatcgtagattccatcttcgtcaacaataagcgtcgccgtcaatgcgcacaactcgatgaggcgatgccagtccgccgagttgcgagcaagacgcgagacttcgagacccatgacaaccccagccttaccgagcgccacctcgctcacgagttgctggaagccatcgcgtgctgctgcattcgatccggatttaccaagatcgcgatcgatgacatggatgcgatcgatcggccagcccgccgccaccgcccgatcacgcaacgcgtattggcgcttcgtactctcgccgtgctcggcaacctggcgaagcgtcgattggcgaacataaagataggcgtcacgcttgagatggtcggcggtgaccttgagttcaggcatggacgggctccattgcgatggcgacgaggatgctggcgacaagacgagtgatgtcgcttgttgccggtgctgggtcgtgcggggttgagggcgtgagccgatcatcggagcaggccacctcgacagggggctcctgcccgagtgctcgaatccattccgccacacctcggcggtggagaatgccgagaccgggacaagccgcgcccccgccgcgcaataccgcggcgcgcaacgtctcgtagcgctccgtggtgtccgacggcgcgacgatcaggttggattgattcgtttttttttgcgcgccagcgcccgttccaggctgcgccggtgcaccttgattccgaaccgcgtttcgatcgcaccgacacattgcgaagtcgtcagagcggggcttgcggttttgagatcggcaacgaaggcaaccacctcggtggagatcttgtggccgctcctgggaccgcgtctgctcggcagcagaccagcaagaccagtcgtctgcagcgcgttctgggccttgtagaaggtcggccgggtgacgccgaacgtcgcggcggcatcgctgattgcagtgccgtcgacctggtggcgccgcaccatctcgtagcgcacctggaccaggtctttggcatcgaagaatggattgccggtgaacaagtcgtcgcgcacggcttcgggattgggattgagcacgccgtcctgcgacagcgcttcgctcttcgggtctggcttttttgcctttgccatgggcggccctgctaaaacgtaaatataaatatgcctcaatatattgcgtgtcaatcgcgaatttgacgcaacataaaggattcattgcaaataagacccgataagttgctctgctatggcagcgtataggcgtcatttcgtttacatatgtggcgtaattacctttacgcatcgccggtctctatgctctcggcgagccggctcaacacatcgcacaacgcnaacagatcaaccgtgcggaaggccgctctctccgcagcaactaaccggaagtcatccataggatcgacatcggtgaatgcgctggtgatcgtgcacantcgaccgcttgggccctcatagaccacacgatcttcgccccaatgacggcgtcggcagatcaagtcgaatgaaagaccatgccgcggatggaacgggtgcgtgatgcgtaccttgcgggagatcgtacccacacagcgtgcagtcgacgactttcgataaggccaaggtcgaggtcgccgtgcaggtcgcgacgcgctggattatcgccaagctgcgcaacacccggttcttctcgctcgtcgagttgaacgtngcgatcggngannnngtcnnngngctcaacgnncgnnngnngcgnnanctnggngcnagccgccgcnnnntnttngangcgnnngancgnccggcnntgannccgntnccgncngngccctatnantacgccgantggnggcggnncngngtggnccncgattaccatgtcgangtngaggagcantactactcggngccnccccnnntgntccgccaggcngtngnggngcggnncaccgcngccaccatcgaggtgttccatcgcggcanccgcntngccgnccacgnncgntcgnngnngaaccgccaccacaccaccatgcncgagcacatgccgncnncccatcgncgntacgccgcctggacgccgnnncgnctcctgggcnnngctgangangtcggnccgncgacnaccgcgctgntcgaggngatcatgcgcganaagccgcatccngagcagggcttccgcnccncnntcggcatcctcaggcnggncaacagctncgggnngcaacgnctggaagccgcctgcggccgngggntcancatcggcgcngcgngctacnnntcgntngcctcgatcctcaagaccaacctngatnancgncancctnccnccaccaccnccgnggccgannccntgcaccnnnacancancngccgccgcnnctnctactacnganaaganannangtgntgntcnnnccancnaccnnccancngcncgncncgcngctcnnnggcnngncggcanngnccntcgcnnngatgnnnnncgatgccgacccggcnnncccgcgtnncgcntngnggnnngngctgctcnnnngannganngcgnagcnacgnagcgagagannnaanngcnngcngcgcnantnnannnngcnncgcnaccaggcntcgntcgaggacatcgactatcgcnccgcgcgccgcctcgacnnggccctgctnncgntgctggncgcnggccnntggattgncgagcatgncaatctgctgatctcnggaccctgcggcgtcggcaagnnntggctcggntcggcgctggncnanaangcctgccgtgacgnnnnnaccgtgcnntatnancgcgtgccgcgcctnttcngcgatctcgnnttggcgcncggcganggccgcnacgctcgtctnntccgtncgctcngcnangncganctgctnatcctcgacgactggggtcnngacccgctcnncgccnccgcgcgccgcgacctcatggagatcntggaggaccgntacggcnccngctcgacnctnntcaccagccagntcccggtcgatncntggcacgngntgatcggngatccgacctncgccgacgccatcctcgaccgcctcgtccanaacgccaancgnatcgcnctcnacgggnngnngatgcgnngnnccagnacgcccngcngngagnccancgcgacnggnccnannganncgganccnannncnnangccgncaagcacncngcnnccgnnnccanagnancagcannncgccnnnngn

SEQ ID NO: 1113 - DNA, 4000 bp, Escherichia coli
  misc_feature (409)..(409): n is a, c, g, or t
  misc_feature (1469)..(1469): n is a, c, g, or t
  misc_feature (1475)..(1475): n is a, c, g, or t
  misc_feature (1984)..(1984): n is a, c, g, or t
  misc_feature (1990)..(1991): n is a, c, g, or t
  misc_feature (1994)..(1994): n is a, c, g, or t
  misc_feature (1999)..(2000): n is a, c, g, or t
  misc_feature (2011)..(2011): n is a, c, g, or t
  misc_feature (2014)..(2015): n is a, c, g, or t
  misc_feature (2023)..(2023): n is a, c, g, or t
  misc_feature (2041)..(2041): n is a, c, g, or t
  misc_feature (2047)..(2047): n is a, c, g, or t
  misc_feature (2056)..(2057): n is a, c, g, or t
  misc_feature (2066)..(2066): n is a, c, g, or t
  misc_feature (2213)..(2213): n is a, c, g, or t
  misc_feature (2259)..(2259): n is a, c, g, or t
  misc_feature (2607)..(4000): n is a, c, g, or t
gatgccctgcctcgtgcgagattaaaccggcgcaatactcaaaaccctttgtctcgatatcgctagggtcgacttcgatcgtattcactggcttgaaaacatagcgccagccgggtttgtctccgattttcaccgctactcccgcgtcttcgccaatagtgttggctagcgcctttaatctctctaatcgcgcttttttctctggcgcgctaatttctggctgaaatgcacctaaactattttctgtttcgttcataatatttgcgctaaaaattgattgattgtgcttaaatttttacctctaactaaaatccctcgatacgattgccacgatgcatttagtttgctagcgctgatactgtcttttttatactcaaccacccgttgagcaaatttgcttttcatctgnctgacgctttctgcttttatcttagaataattattcacaaatttccagcccaaaattttcaccccactatttagattgcaaatactataatgatctggcggaattgacagctttaaattaattttcaaaaaatcaccaatttgcactagccacttttggcactcttttctatcgcgagagaaaataaaagagtcgtccgcgtatcttagataatgtttaatttttaacttctctttaacaaatctgtctagtgggtccaaatagatgttgataaatagctgactggtcaagctccctagcggtatccccttgctttccgcagtgtggtagccataaattattttttctaatatctgaatcgttttttgacaatgtattctttggcgtaaaaattgctttaaaattaaatgatcaatcgaatcaaagcattttttaatatcaaaatgtaaaacccatattttgcaatgataattttggctaacgcttttaaggtaggactgcgtcaaccccaacgctttactcagccctttaccttcccgacaggaaaaagaacaagccataaacaaacgatcataaaaaggataaagggcgttatacagcgctcggtggacaatatgatctgccatacccggcgctgaaataactctttttttcggatcgaaaacaataaatttcctatatggcgatgactcgtgtgtatatttttcaaccggcggtaaagctcggttaggttttcctccaagcgatattcgtattcggctaccgactgacggtttcgcttgcctttgcggtaatcaacccaagctttccataaatttgcttggctaaaaatattttcaaaattttcaataaattttttcattatgaataccatactttttcaaaaaacttatctgctatataacgagttatctactattgtgccaaagtttcctaaaatttcccggtatagtttaggcattaaaatagaatcctcttgcctagctctaatagagcaaattattcgcgcagaactatcggagccagtatttaaagaaaaagccctttttgaagccggagngcagtntagcctgctgaaaatgctgatacggatttgtgtggagaaaaaatcgatcaaagaaaacaagtattttacttggtcaaaccagctcattgaaatcgtaaaaatgatcagtgggtggagaaaaacactacgacgataaaaagtagcatgaccgcgaggcggaaaaccctatcattccaatgattctcgcgatgatcattgtcgacatacccagcaccaccattgtcagaatccccgatattcaagcaattcccgcctcaagtaaatggtaatttgttcgtacacgcgcctgtgccctagtggcgccaagctgacaaaaagctatattaccaacgtcatgcaatcaataatgaaaagcgcttttcattacatgggcgaatctcactttggatgacaaagcagacttcattagcccaatttctacccaaatttttcagggtttaggttttagctatagggtttagagcttagtggttaggatttttcatgcatgaccgcgaggcggaaaaccntaccannccnagganncccgcgatgancanngtcgacanacccagcaccaccacggncagaanccccgatanncaagcaatncccgctgtctgatccgtcagctttaagcagggtgtcttctgcccattcaaaattggaacgggtagagttttcgggatgattgagggtggtttgaaggttgaaagctaggactgggcagagagtgacacgaaacttgctagcttctgnctccgaaatgccagaggagacaagagattgacggagtttagcttcngctagcgggatgagctgggtagtgatgtcatcccaagatagattggcgcgattttctctatcgactccaaatacttctttgatcaaggggagcatggggtcagagacggaatcagaagtgtttcttgattcaacccaaagaggtttaccttgatgtttttgggtagtggcaatcattgctctttggtaagcttcaaaccatgtttcgtctgcgcctgtcgtgtccttggctgattgctcaaaccaatctgactgaaaaagagttaatcctttggcagtatcctctggtctttgagctttgggataaagggtgccaaatgttgttggggttaggtcgtctggggaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1114 - DNA, 4000 bp, Escherichia coli
  misc_feature (1)..(1): n is a, c, g, or t
  misc_feature (4)..(4): n is a, c, g, or t
  misc_feature (10)..(10): n is a, c, g, or t
  misc_feature (13)..(13): n is a, c, g, or t
  misc_feature (15)..(15): n is a, c, g, or t
  misc_feature (18)..(31): n is a, c, g, or t
  misc_feature (34)..(34): n is a, c, g, or t
  misc_feature (36)..(48): n is a, c, g, or t
  misc_feature (50)..(51): n is a, c, g, or t
  misc_feature (53)..(58): n is a, c, g, or t
  misc_feature (60)..(60): n is a, c, g, or t
  misc_feature (64)..(67): n is a, c, g, or t
  misc_feature (72)..(72): n is a, c, g, or t
  misc_feature (74)..(81): n is a, c, g, or t
  misc_feature (83)..(88): n is a, c, g, or t
  misc_feature (90)..(91): n is a, c, g, or t
  misc_feature (93)..(93): n is a, c, g, or t
  misc_feature (97)..(103): n is a, c, g, or t
  misc_feature (105)..(106): n is a, c, g, or t
  misc_feature (108)..(111): n is a, c, g, or t
  misc_feature (114)..(116): n is a, c, g, or t
  misc_feature (118)..(120): n is a, c, g, or t
  misc_feature (123)..(124): n is a, c, g, or t
  misc_feature (126)..(129): n is a, c, g, or t
  misc_feature (132)..(133): n is a, c, g, or t
  misc_feature (136)..(136): n is a, c, g, or t
  misc_feature (140)..(143): n is a, c, g, or t
  misc_feature (145)..(147): n is a, c, g, or t
  misc_feature (149)..(149): n is a, c, g, or t
  misc_feature (152)..(152): n is a, c, g, or t
  misc_feature (154)..(158): n is a, c, g, or t
  misc_feature (161)..(164): n is a, c, g, or t
  misc_feature (167)..(169): n is a, c, g, or t
  misc_feature (171)..(178): n is a, c, g, or t
  misc_feature (183)..(183): n is a, c, g, or t
  misc_feature (185)..(186): n is a, c, g, or t
  misc_feature (188)..(197): n is a, c, g, or t
  misc_feature (200)..(200): n is a, c, g, or t
  misc_feature (203)..(206): n is a, c, g, or t
  misc_feature (208)..(213): n is a, c, g, or t
  misc_feature (215)..(215): n is a, c, g, or t
  misc_feature (218)..(218): n is a, c, g, or t
  misc_feature (220)..(220): n is a, c, g, or t
  misc_feature (224)..(227): n is a, c, g, or t
  misc_feature (230)..(233): n is a, c, g, or t
  misc_feature (237)..(237): n is a, c, g, or t
  misc_feature (243)..(243): n is a, c, g, or t
  misc_feature (251)..(251): n is a, c, g, or t
  misc_feature (270)..(270): n is a, c, g, or t
  misc_feature (278)..(279): n is a, c, g, or t
  misc_feature (291)..(291): n is a, c, g, or t
  misc_feature (294)..(294): n is a, c, g, or t
  misc_feature (303)..(303): n is a, c, g, or t
  misc_feature (312)..(313): n is a, c, g, or t
  misc_feature (315)..(315): n is a, c, g, or t
  misc_feature (321)..(321): n is a, c, g, or t
  misc_feature (336)..(336): n is a, c, g, or t
  misc_feature (338)..(339): n is a, c, g, or t
  misc_feature (341)..(343): n is a, c, g, or t
  misc_feature (345)..(345): n is a, c, g, or t
  misc_feature (348)..(348): n is a, c, g, or t
  misc_feature (351)..(351): n is a, c, g, or t
  misc_feature (353)..(353): n is a, c, g, or t
  misc_feature (356)..(356): n is a, c, g, or t
  misc_feature (361)..(362): n is a, c, g, or t
  misc_feature (366)..(368): n is a, c, g, or t
  misc_feature (370)..(371): n is a, c, g, or t
  misc_feature (374)..(375): n is a, c, g, or t
  misc_feature (377)..(377): n is a, c, g, or t
  misc_feature (379)..(380): n is a, c, g, or t
  misc_feature (383)..(383): n is a, c, g, or t
  misc_feature (385)..(385): n is a, c, g, or t
  misc_feature (389)..(389): n is a, c, g, or t
  misc_feature (391)..(392): n is a, c, g, or t
  misc_feature (396)..(396): n is a, c, g, or t
  misc_feature (399)..(399): n is a, c, g, or t
  misc_feature (402)..(402): n is a, c, g, or t
  misc_feature (417)..(417): n is a, c, g, or t
  misc_feature (431)..(432): n is a, c, g, or t
  misc_feature (438)..(438): n is a, c, g, or t
  misc_feature (442)..(442): n is a, c, g, or t
  misc_feature (447)..(450): n is a, c, g, or t
  misc_feature (452)..(453): n is a, c, g, or t
  misc_feature (465)..(466): n is a, c, g, or t
  misc_feature (471)..(471): n is a, c, g, or t
  misc_feature (473)..(474): n is a, c, g, or t
  misc_feature (481)..(482): n is a, c, g, or t
  misc_feature (484)..(486): n is a, c, g, or t
  misc_feature (489)..(492): n is a, c, g, or t
  misc_feature (495)..(495): n is a, c, g, or t
  misc_feature (497)..(497): n is a, c, g, or t
  misc_feature (501)..(501): n is a, c, g, or t
  misc_feature (504)..(504): n is a, c, g, or t
  misc_feature (507)..(507): n is a, c, g, or t
  misc_feature (511)..(511): n is a, c, g, or t
  misc_feature (513)..(513): n is a, c, g, or t
  misc_feature (525)..(525): n is a, c, g, or t
  misc_feature (528)..(528): n is a, c, g, or t
  misc_feature (534)..(534): n is a, c, g, or t
  misc_feature (540)..(540): n is a, c, g, or t
  misc_feature (542)..(542): n is a, c, g, or t
  misc_feature (549)..(549): n is a, c, g, or t
  misc_feature (552)..(553): n is a, c, g, or t
  misc_feature (559)..(561): n is a, c, g, or t
  misc_feature (563)..(563): n is a, c, g, or t
  misc_feature (582)..(582): n is a, c, g, or t
  misc_feature (584)..(585): n is a, c, g, or t
  misc_feature (596)..(597): n is a, c, g, or t
  misc_feature (600)..(600): n is a, c, g, or t
  misc_feature (603)..(603): n is a, c, g, or t
  misc_feature (606)..(606): n is a, c, g, or t
  misc_feature (612)..(612): n is a, c, g, or t
  misc_feature (623)..(623): n is a, c, g, or t
  misc_feature (639)..(639): n is a, c, g, or t
  misc_feature (642)..(643): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (660)..(660): n is a, c, g, or t
  misc_feature (663)..(664): n is a, c, g, or t
  misc_feature (670)..(670): n is a, c, g, or t
  misc_feature (672)..(672): n is a, c, g, or t
  misc_feature (675)..(675): n is a, c, g, or t
  misc_feature (687)..(687): n is a, c, g, or t
  misc_feature (693)..(693): n is a, c, g, or t
  misc_feature (695)..(695): n is a, c, g, or t
  misc_feature (706)..(708): n is a, c, g, or t
  misc_feature (714)..(714): n is a, c, g, or t
  misc_feature (717)..(717): n is a, c, g, or t
  misc_feature (738)..(738): n is a, c, g, or t
  misc_feature (747)..(747): n is a, c, g, or t
  misc_feature (768)..(768): n is a, c, g, or t
  misc_feature (791)..(791): n is a, c, g, or t
  misc_feature (798)..(798): n is a, c, g, or t
  misc_feature (801)..(801): n is a, c, g, or t
  misc_feature (897)..(897): n is a, c, g, or t
  misc_feature (921)..(921): n is a, c, g, or t
  misc_feature (981)..(981): n is a, c, g, or t
  misc_feature (984)..(984): n is a, c, g, or t
  misc_feature (1116)..(1116): n is a, c, g, or t
  misc_feature (1122)..(1122): n is a, c, g, or t
  misc_feature (1143)..(1143): n is a, c, g, or t
  misc_feature (1155)..(1155): n is a, c, g, or t
  misc_feature (1182)..(1182): n is a, c, g, or t
  misc_feature (1185)..(1185): n is a, c, g, or t
  misc_feature (1224)..(1224): n is a, c, g, or t
  misc_feature (1248)..(1248): n is a, c, g, or t
  misc_feature (1263)..(1263): n is a, c, g, or t
  misc_feature (1299)..(1299): n is a, c, g, or t
  misc_feature (1344)..(1344): n is a, c, g, or t
  misc_feature (1425)..(1425): n is a, c, g, or t
  misc_feature (1515)..(1515): n is a, c, g, or t
  misc_feature (1518)..(1518): n is a, c, g, or t
  misc_feature (1668)..(1668): n is a, c, g, or t
  misc_feature (1722)..(1722): n is a, c, g, or t
  misc_feature (1728)..(1728): n is a, c, g, or t
  misc_feature (1764)..(1764): n is a, c, g, or t
  misc_feature (1769)..(1769): n is a, c, g, or t
  misc_feature (1777)..(1777): n is a, c, g, or t
  misc_feature (1788)..(1788): n is a, c, g, or t
  misc_feature (1794)..(1794): n is a, c, g, or t
  misc_feature (1846)..(1847): n is a, c, g, or t
  misc_feature (1989)..(1989): n is a, c, g, or t
  misc_feature (1992)..(1992): n is a, c, g, or t
nccncccagnaanancannnnnnnnnnnnnnccntnnnnnnnnnnnnnannannnnnnanaatnnnnttttntnnnnnnnntnnnnnnannantttnnnnnnntnntnnnnttnnntnnntanncnnnnaannttnttgnnnntnnntnttnannnnnaannnnttnnntnnnnnnnnaaaananngnnnnnnnnnnctntannnnannnnnntnttntnaaannnnatnnnnttcntttttnctttttgngacaaagatagcagatagngctagtcnnacacttgccaanaanatagctgtntctgactgnntntcaccngtttctggcaatctntnntnnncnttngcnanttnaactnntgcnnntnnagnntnannttntnctancnnactnagnttnaactctggtttctcnactgtcggtgctgnntggtcncctnctgtnnnnannggacctgtgtannctggnanntcatgtnncnnngcnnnnacngngttnacnccncctntnaactctggtttntcnactgtnggtgcngnttggtcnccnnctgttnnnantgggcctgtgtactctggnanntcatgtaccanngcntcnacngcattnacaccaccttngaactcaggtttctcnacnntnggngcngcttggtcnccnnctgttncnagngggcctgtgtantctggnanttcatgcactnnngcctcnacngcattgacaccacctgtgaantcaggaacntcaagcacgggtgctggttcntcacccttgcttgattgaacagnttcttcngtnaattcttgatagaagctcgccaattcataaaactcagccttgccaccttcccagactaatttgacgtctagaagagagccaccatttcggatagcnaaggtttggagactagatgtaatngcaccgaggtctgtccaactgtcttgaccatccttgagtgttctagcaagaacacgtgcnttngctccttcaggaagactggaaacgagacgaaggtggttggcattggttggctcagataagtgatacaccaattcgcccttgtctttttcagacttgtagctggtcaagactttgccgtctacaagattattntaaagnttgccttggctttctccaccntttccttctacngttggatcattgattggtttgacaaantcnccatcgttgatgaccaattctgtaaagcctacaaaacgngcatcatagtctgcagtatagagnacacggagatagttngctttgactggtgtcgtcaattcaccttcgatgtancgatttcctggcatcttagaatcatgtgtccaaccatctgtcagngaatcatcgtgttggctattggccacaccatctcctactgtcacaacatctgtccaagttttaccgtcttggctgacttgnatcttaccatcacgaaggtagttttgagttccgtcttggatgtaggctctaatcttcttgatagtgcgttcgctaccaagtttcaaggtnacntgaccatctttatgggcatagtctgaaaactcaacgaagttgttgtaaacaccgtcaaatagttgatctaggttgttcagtttacgaacatcattgcttccgtatgttggatgaatgcccatagttgtagattctagtttggttggttgnacttctttggttgtcacaaggagagaagtggctgtcacagcttgttcctgatcngttttnttgaccagacgaacataacgtaccaagtgggttgcnacagntctgtctntcaactggctngctggngtccattcttgcgcatttgcagaatactctaggctaagagcagggttggctnngccttggagctggatgctcttgatctgatggatacggtcaagcttcatacctagatagctatgagcagggagtttggttccagctggaatttgaagctcgtaactgcccaagctatccactactggcgtttccttcaaggcntcnacgttggtgtctgttaagtcaagatttggactatcgacatctactgtaaattccgcaattctccaccacttatttaaggtttgtgtattgcgaatgcgaacaaaacgagttgtaaattcttgcacaatatcagaagttcgttgccctgataaattttgaagcgttgtccaatttgtaccatctgcagaatattcgatgacaccagatgctagtttgtctcgttccccttgcatcagatgaactcgttttactttgtgcagtccacctaagtccatttgtacccaggcttgcgctggtgtgacattggtctgatcaacatgtgccatcatggattctgtgttttctcgaccatcttgcatctgaacaacacttgttccatatttgtaaacaaggtttggacttaaactaatagtgcccctaaccttcttactacccaattctaggggtctgttaacagcaatttcacgcatggcaagccaagcattatccttcttagctgttgctatcatacgaacagcttgagctgtgatatcgaggtcattaaattccagaatacgttctctaccagtataagcggggctcgttatggctacccattctccatgttcattttgatattcaacaagagcattactaaaggtataattatcggccgtattagtacccgtagcgaaacctaatttgtgtattttaattgccttattaaagcgcaagcctacataatcgcctctctcaatcacaatggttgttttggcaatcacatgtgtatcaaagtcaccatctgtgacttctttcaatccgccttctattccagcacgattcgtaataaatgttgtcacaaatttatctggattcaacattgcttggatatgtaaggctaagtattctttgagattattgataaatggtcgaatatgttggacaccaaattctgcgtattcataatggtcaacgtaaaagaaggcatacttaactgactggtcataatgtttgactccggcctgataatactcccacaccttggcatcattcttttcagtaagaccttctgtagctgttaggaaagcttcaagcgcgttcatttgatctactgtattctctaaccaatagtgaatttgttcgattaatttctgatcacctttttctttaagtaatagagcattggctttcaaaccagcaaaaatttccctcaactcttttctttcagtatccagattttgaccagatttgagtttgttatagaattctgtcaattttggagccaattctacagactcttctaatttagtgacatggggaggtctattttgattgcgcatgtgttttccgagttctcgaaaagccttcgaaacactgctttcttcaaaatgatcattaactacatagttaaaggccatatcgttgatttgttctgcttcttctacacttctccattgtttccatccatactgagccatatcaaaaagtgccactttagatgcttcagattgttgcattggatttagcataattccttgtgcaagtgataaatcaacatttggatgtaagaatttttcaccacctccaagaattaggtggggttttgtattatcattacatggccagttaatccagaactgaattggacggtaagtcttaccaccttctgttaaatttttctttaagttcgttaagaatgtttggtcaacagccccccagacctttccaccagtaagagttaaatggacattttcaggaagatgttcattcaaggttcgaagttcagcttcagttccttgccccatgtaccaggcaggaacaaaaatcatatctttacggagaccactgtatgttgtttgtttttcagtcaaccaatttgtgatatccttcatcaagcgaacataactatggtaaccaccaactgggcttggtgcatcatctgcaagcacaccaaattcacgcactcccacgtccaacaactgagtaaacttagcctttatggttgcaagatcagcctggtaatgcgctt

SEQ ID NO: 1115 - DNA, 4000 bp, Escherichia coli
  misc_feature (1)..(12): n is a, c, g, or t
  misc_feature (14)..(21): n is a, c, g, or t
  misc_feature (23)..(24): n is a, c, g, or t
  misc_feature (26)..(31): n is a, c, g, or t
  misc_feature (34)..(35): n is a, c, g, or t
  misc_feature (37)..(41): n is a, c, g, or t
  misc_feature (43)..(44): n is a, c, g, or t
  misc_feature (46)..(46): n is a, c, g, or t
  misc_feature (48)..(49): n is a, c, g, or t
  misc_feature (52)..(53): n is a, c, g, or t
  misc_feature (55)..(62): n is a, c, g, or t
  misc_feature (64)..(64): n is a, c, g, or t
  misc_feature (66)..(76): n is a, c, g, or t
  misc_feature (80)..(91): n is a, c, g, or t
  misc_feature (93)..(101): n is a, c, g, or t
  misc_feature (103)..(108): n is a, c, g, or t
  misc_feature (110)..(111): n is a, c, g, or t
  misc_feature (113)..(120): n is a, c, g, or t
  misc_feature (122)..(124): n is a, c, g, or t
  misc_feature (126)..(133): n is a, c, g, or t
  misc_feature (136)..(136): n is a, c, g, or t
  misc_feature (138)..(139): n is a, c, g, or t
  misc_feature (141)..(159): n is a, c, g, or t
  misc_feature (161)..(165): n is a, c, g, or t
  misc_feature (167)..(168): n is a, c, g, or t
  misc_feature (170)..(172): n is a, c, g, or t
  misc_feature (174)..(175): n is a, c, g, or t
  misc_feature (177)..(177): n is a, c, g, or t
  misc_feature (179)..(180): n is a, c, g, or t
  misc_feature (182)..(195): n is a, c, g, or t
  misc_feature (197)..(209): n is a, c, g, or t
  misc_feature (211)..(215): n is a, c, g, or t
  misc_feature (217)..(226): n is a, c, g, or t
  misc_feature (228)..(228): n is a, c, g, or t
  misc_feature (230)..(230): n is a, c, g, or t
  misc_feature (233)..(234): n is a, c, g, or t
  misc_feature (236)..(239): n is a, c, g, or t
  misc_feature (241)..(248): n is a, c, g, or t
  misc_feature (250)..(250): n is a, c, g, or t
  misc_feature (252)..(258): n is a, c, g, or t
  misc_feature (260)..(265): n is a, c, g, or t
  misc_feature (267)..(273): n is a, c, g, or t
  misc_feature (275)..(279): n is a, c, g, or t
  misc_feature (283)..(286): n is a, c, g, or t
  misc_feature (288)..(324): n is a, c, g, or t
  misc_feature (327)..(334): n is a, c, g, or t
  misc_feature (336)..(339): n is a, c, g, or t
  misc_feature (341)..(348): n is a, c, g, or t
  misc_feature (350)..(362): n is a, c, g, or t
  misc_feature (364)..(367): n is a, c, g, or t
  misc_feature (369)..(374): n is a, c, g, or t
  misc_feature (376)..(387): n is a, c, g, or t
  misc_feature (390)..(398): n is a, c, g, or t
  misc_feature (401)..(409): n is a, c, g, or t
  misc_feature (411)..(411): n is a, c, g, or t
  misc_feature (413)..(414): n is a, c, g, or t
  misc_feature (416)..(416): n is a, c, g, or t
  misc_feature (418)..(418): n is a, c, g, or t
  misc_feature (420)..(423): n is a, c, g, or t
  misc_feature (425)..(425): n is a, c, g, or t
  misc_feature (427)..(429): n is a, c, g, or t
  misc_feature (431)..(435): n is a, c, g, or t
  misc_feature (438)..(454): n is a, c, g, or t
  misc_feature (457)..(458): n is a, c, g, or t
  misc_feature (460)..(464): n is a, c, g, or t
  misc_feature (468)..(469): n is a, c, g, or t
  misc_feature (471)..(472): n is a, c, g, or t
  misc_feature (474)..(475): n is a, c, g, or t
  misc_feature (477)..(484): n is a, c, g, or t
  misc_feature (487)..(491): n is a, c, g, or t
  misc_feature (493)..(494): n is a, c, g, or t
  misc_feature (500)..(500): n is a, c, g, or t
  misc_feature (502)..(503): n is a, c, g, or t
  misc_feature (505)..(515): n is a, c, g, or t
  misc_feature (517)..(518): n is a, c, g, or t
  misc_feature (520)..(520): n is a, c, g, or t
  misc_feature (522)..(522): n is a, c, g, or t
  misc_feature (524)..(524): n is a, c, g, or t
  misc_feature (526)..(527): n is a, c, g, or t
  misc_feature (529)..(532): n is a, c, g, or t
  misc_feature (534)..(534): n is a, c, g, or t
  misc_feature (538)..(540): n is a, c, g, or t
  misc_feature (543)..(547): n is a, c, g, or t
  misc_feature (550)..(550): n is a, c, g, or t
  misc_feature (552)..(552): n is a, c, g, or t
  misc_feature (557)..(563): n is a, c, g, or t
  misc_feature (565)..(569): n is a, c, g, or t
  misc_feature (571)..(576): n is a, c, g, or t
  misc_feature (578)..(581): n is a, c, g, or t
  misc_feature (583)..(592): n is a, c, g, or t
  misc_feature (594)..(601): n is a, c, g, or t
  misc_feature (603)..(603): n is a, c, g, or t
  misc_feature (605)..(611): n is a, c, g, or t
  misc_feature (613)..(619): n is a, c, g, or t
  misc_feature (621)..(622): n is a, c, g, or t
  misc_feature (624)..(627): n is a, c, g, or t
  misc_feature (629)..(631): n is a, c, g, or t
  misc_feature (633)..(640): n is a, c, g, or t
  misc_feature (642)..(650): n is a, c, g, or t
  misc_feature (652)..(677): n is a, c, g, or t
  misc_feature (680)..(685): n is a, c, g, or t
  misc_feature (687)..(692): n is a, c, g, or t
  misc_feature (694)..(697): n is a, c, g, or t
  misc_feature (700)..(701): n is a, c, g, or t
  misc_feature (703)..(704): n is a, c, g, or t
  misc_feature (706)..(707): n is a, c, g, or t
  misc_feature (709)..(712): n is a, c, g, or t
  misc_feature (714)..(720): n is a, c, g, or t
  misc_feature (722)..(736): n is a, c, g, or t
  misc_feature (739)..(745): n is a, c, g, or t
  misc_feature (747)..(756): n is a, c, g, or t
  misc_feature (758)..(759): n is a, c, g, or t
  misc_feature (761)..(763): n is a, c, g, or t
  misc_feature (765)..(768): n is a, c, g, or t
  misc_feature (770)..(781): n is a, c, g, or t
  misc_feature (783)..(788): n is a, c, g, or t
  misc_feature (791)..(800): n is a, c, g, or t
  misc_feature (802)..(802): n is a, c, g, or t
  misc_feature (804)..(814): n is a, c, g, or t
  misc_feature (816)..(839): n is a, c, g, or t
  misc_feature (842)..(842): n is a, c, g, or t
  misc_feature (844)..(848): n is a, c, g, or t
  misc_feature (850)..(851): n is a, c, g, or t
  misc_feature (853)..(866): n is a, c, g, or t
  misc_feature (868)..(868): n is a, c, g, or t
  misc_feature (870)..(874): n is a, c, g, or t
  misc_feature (876)..(888): n is a, c, g, or t
  misc_feature (890)..(891): n is a, c, g, or t
  misc_feature (893)..(893): n is a, c, g, or t
  misc_feature (895)..(896): n is a, c, g, or t
  misc_feature (898)..(900): n is a, c, g, or t
  misc_feature (902)..(905): n is a, c, g, or t
  misc_feature (907)..(907): n is a, c, g, or t
  misc_feature (909)..(911): n is a, c, g, or t
  misc_feature (913)..(913): n is a, c, g, or t
  misc_feature (915)..(923): n is a, c, g, or t
  misc_feature (925)..(931): n is a, c, g, or t
  misc_feature (933)..(935): n is a, c, g, or t
  misc_feature (938)..(941): n is a, c, g, or t
  misc_feature (943)..(943): n is a, c, g, or t
  misc_feature (945)..(948): n is a, c, g, or t
  misc_feature (950)..(961): n is a, c, g, or t
  misc_feature (964)..(965): n is a, c, g, or t
  misc_feature (967)..(980): n is a, c, g, or t
  misc_feature (982)..(989): n is a, c, g, or t
  misc_feature (991)..(1005): n is a, c, g, or t
  misc_feature (1007)..(1008): n is a, c, g, or t
  misc_feature (1010)..(1013): n is a, c, g, or t
  misc_feature (1015)..(1017): n is a, c, g, or t
  misc_feature (1019)..(1032): n is a, c, g, or t
  misc_feature (1034)..(1036): n is a, c, g, or t
  misc_feature (1038)..(1044): n is a, c, g, or t
  misc_feature (1046)..(1046): n is a, c, g, or t
  misc_feature (1048)..(1049): n is a, c, g, or t
  misc_feature (1051)..(1053): n is a, c, g, or t
  misc_feature (1055)..(1056): n is a, c, g, or t
  misc_feature (1058)..(1059): n is a, c, g, or t
  misc_feature (1062)..(1062): n is a, c, g, or t
  misc_feature (1066)..(1067): n is a, c, g, or t
  misc_feature (1069)..(1070): n is a, c, g, or t
  misc_feature (1073)..(1077): n is a, c, g, or t
  misc_feature (1079)..(1084): n is a, c, g, or t
  misc_feature (1086)..(1089): n is a, c, g, or t
  misc_feature (1091)..(1092): n is a, c, g, or t
  misc_feature (1095)..(1095): n is a, c, g, or t
  misc_feature (1101)..(1102): n is a, c, g, or t
  misc_feature (1104)..(1105): n is a, c, g, or t
  misc_feature (1107)..(1107): n is a, c, g, or t
  misc_feature (1110)..(1110): n is a, c, g, or t
  misc_feature (1112)..(1120): n is a, c, g, or t
  misc_feature (1122)..(1122): n is a, c, g, or t
  misc_feature (1125)..(1127): n is a, c, g, or t
  misc_feature (1131)..(1131): n is a, c, g, or t
  misc_feature (1134)..(1139): n is a, c, g, or t
  misc_feature (1142)..(1144): n is a, c, g, or t
  misc_feature (1146)..(1152): n is a, c, g, or t
  misc_feature (1154)..(1155): n is a, c, g, or t
  misc_feature (1157)..(1173): n is a, c, g, or t
  misc_feature (1176)..(1185): n is a, c, g, or t
  misc_feature (1188)..(1191): n is a, c, g, or t
  misc_feature (1193)..(1194): n is a, c, g, or t
  misc_feature (1196)..(1207): n is a, c, g, or t
  misc_feature (1209)..(1210): n is a, c, g, or t
  misc_feature (1212)..(1223): n is a, c, g, or t
  misc_feature (1225)..(1228): n is a, c, g, or t
  misc_feature (1230)..(1233): n is a, c, g, or t
  misc_feature (1235)..(1235): n is a, c, g, or t
  misc_feature (1237)..(1238): n is a, c, g, or t
  misc_feature (1240)..(1242): n is a, c, g, or t
  misc_feature (1245)..(1246): n is a, c, g, or t
  misc_feature (1249)..(1258): n is a, c, g, or t
  misc_feature (1260)..(1261): n is a, c, g, or t
  misc_feature (1264)..(1266): n is a, c, g, or t
  misc_feature (1269)..(1270): n is a, c, g, or t
  misc_feature (1272)..(1274): n is a, c, g, or t
  misc_feature (1277)..(1278): n is a, c, g, or t
  misc_feature (1281)..(1281): n is a, c, g, or t
  misc_feature (1283)..(1285): n is a, c, g, or t
  misc_feature (1287)..(1287): n is a, c, g, or t
  misc_feature (1290)..(1290): n is a, c, g, or t
  misc_feature (1292)..(1293): n is a, c, g, or t
  misc_feature (1295)..(1295): n is a, c, g, or t
  misc_feature (1297)..(1297): n is a, c, g, or t
  misc_feature (1396)..(1396): n is a, c, g, or t
  misc_feature (1406)..(1406): n is a, c, g, or t
  misc_feature (2003)..(2003): n is a, c, g, or t
  misc_feature (2060)..(2060): n is a, c, g, or t
  misc_feature (2064)..(2064): n is a, c, g, or t
  misc_feature (2340)..(2345): n is a, c, g, or t
  misc_feature (2347)..(2347): n is a, c, g, or t
  misc_feature (2349)..(2349): n is a, c, g, or t
  misc_feature (2351)..(2354): n is a, c, g, or t
  misc_feature (2356)..(2358): n is a, c, g, or t
  misc_feature (2360)..(2361): n is a, c, g, or t
  misc_feature (2366)..(2371): n is a, c, g, or t
  misc_feature (2374)..(2374): n is a, c, g, or t
  misc_feature (2376)..(2379): n is a, c, g, or t
  misc_feature (2381)..(2381): n is a, c, g, or t
  misc_feature (2383)..(2386): n is a, c, g, or t
  misc_feature (2388)..(2389): n is a, c, g, or t
  misc_feature (2391)..(2392): n is a, c, g, or t
  misc_feature (2394)..(2394): n is a, c, g, or t
  misc_feature (2396)..(2396): n is a, c, g, or t
  misc_feature (2398)..(2399): n is a, c, g, or t
  misc_feature (2402)..(2402): n is a, c, g, or t
  misc_feature (2404)..(2405): n is a, c, g, or t
  misc_feature (2407)..(2412): n is a, c, g, or t
  misc_feature (2414)..(2414): n is a, c, g, or t
  misc_feature (2416)..(2419): n is a, c, g, or t
  misc_feature (2421)..(2429): n is a, c, g, or t
  misc_feature (2431)..(2431): n is a, c, g, or t
  misc_feature (2436)..(2444): n is a, c, g, or t
  misc_feature (2446)..(2456): n is a, c, g, or t
  misc_feature (2458)..(2459): n is a, c, g, or t
  misc_feature (2461)..(2464): n is a, c, g, or t
  misc_feature (2466)..(2468): n is a, c, g, or t
  misc_feature (2470)..(2479): n is a, c, g, or t
  misc_feature (2481)..(2487): n is a, c, g, or t
  misc_feature (2490)..(2491): n is a, c, g, or t
  misc_feature (2493)..(2499): n is a, c, g, or t
  misc_feature (2501)..(2517): n is a, c, g, or t
  misc_feature (2519)..(2523): n is a, c, g, or t
  misc_feature (2525)..(2529): n is a, c, g, or t
  misc_feature (2532)..(2534): n is a, c, g, or t
  misc_feature (2537)..(2539): n is a, c, g, or t
  misc_feature (2541)..(2541): n is a, c, g, or t
  misc_feature (2543)..(2549): n is a, c, g, or t
  misc_feature (2551)..(2554): n is a, c, g, or t
  misc_feature (2557)..(2557): n is a, c, g, or t
  misc_feature (2559)..(2564): n is a, c, g, or t
  misc_feature (2566)..(2566): n is a, c, g, or t
  misc_feature (2568)..(2568): n is a, c, g, or t
  misc_feature (2570)..(2571): n is a, c, g, or t
  misc_feature (2573)..(2573): n is a, c, g, or t
  misc_feature (2576)..(2576): n is a, c, g, or t
  misc_feature (2578)..(2579): n is a, c, g, or t
  misc_feature (2581)..(2581): n is a, c, g, or t
  misc_feature (2583)..(2585): n is a, c, g, or t
  misc_feature (2587)..(2588): n is a, c, g, or t
  misc_feature (2590)..(2595): n is a, c, g, or t
  misc_feature (2599)..(2623): n is a, c, g, or t
  misc_feature (2625)..(2627): n is a, c, g, or t
  misc_feature (2629)..(2630): n is a, c, g, or t
  misc_feature (2632)..(2632): n is a, c, g, or t
  misc_feature (2634)..(2636): n is a, c, g, or t
  misc_feature (2639)..(2640): n is a, c, g, or t
  misc_feature (2642)..(2643): n is a, c, g, or t
  misc_feature (2645)..(2645): n is a, c, g, or t
  misc_feature (2647)..(2647): n is a, c, g, or t
  misc_feature (2649)..(2650): n is a, c, g, or t
  misc_feature (2652)..(2655): n is a, c, g, or t
  misc_feature (2658)..(2663): n is a, c, g, or t
  misc_feature (2665)..(2665): n is a, c, g, or t
  misc_feature (2667)..(2667): n is a, c, g, or t
  misc_feature (2670)..(2672): n is a, c, g, or t
  misc_feature (2674)..(2674): n is a, c, g, or t
  misc_feature (2677)..(2678): n is a, c, g, or t
  misc_feature (2680)..(2683): n is a, c, g, or t
  misc_feature (2685)..(2690): n is a, c, g, or t
  misc_feature (2692)..(2693): n is a, c, g, or t
  misc_feature (2695)..(2696): n is a, c, g, or t
  misc_feature (2698)..(2700): n is a, c, g, or t
  misc_feature (2702)..(2702): n is a, c, g, or t
  misc_feature (2704)..(2706): n is a, c, g, or t
  misc_feature (2708)..(2708): n is a, c, g, or t
  misc_feature (2710)..(2711): n is a, c, g, or t
  misc_feature (2714)..(2719): n is a, c, g, or t
  misc_feature (2722)..(2725): n is a, c, g, or t
  misc_feature (2728)..(2729): n is a, c, g, or t
  misc_feature (2732)..(2740): n is a, c, g, or t
  misc_feature (2742)..(2743): n is a, c, g, or t
  misc_feature (2745)..(2747): n is a, c, g, or t
  misc_feature (2749)..(2751): n is a, c, g, or t
  misc_feature (2755)..(2757): n is a, c, g, or t
  misc_feature (2759)..(2759): n is a, c, g, or t
  misc_feature (2762)..(2763): n is a, c, g, or t
  misc_feature (2765)..(2772): n is a, c, g, or t
  misc_feature (2774)..(2780): n is a, c, g, or t
  misc_feature (2782)..(2782): n is a, c, g, or t
  misc_feature (2784)..(2786): n is a, c, g, or t
  misc_feature (2789)..(2790): n is a, c, g, or t
  misc_feature (2792)..(2792): n is a, c, g, or t
  misc_feature (2795)..(2795): n is a, c, g, or t
  misc_feature (2798)..(2798): n is a, c, g, or t
  misc_feature (2800)..(2800): n is a, c, g, or t
  misc_feature (2802)..(2803): n is a, c, g, or t
  misc_feature (2806)..(2807): n is a, c, g, or t
  misc_feature (2809)..(2816): n is a, c, g, or t
  misc_feature (2818)..(2820): n is a, c, g, or t
  misc_feature (2822)..(2823): n is a, c, g, or t
  misc_feature (2826)..(2826): n is a, c, g, or t
  misc_feature (2829)..(2835): n is a, c, g, or t
  misc_feature (2838)..(2839): n is a, c, g, or t
  misc_feature (2841)..(2841): n is a, c, g, or t
  misc_feature (2843)..(2849): n is a, c, g, or t
  misc_feature (2851)..(2857): n is a, c, g, or t
  misc_feature (2860)..(2860): n is a, c, g, or t
  misc_feature (2862)..(2868): n is a, c, g, or t
  misc_feature (2870)..(2871): n is a, c, g, or t
  misc_feature (2875)..(2880): n is a, c, g, or t
  misc_feature (2882)..(2888): n is a, c, g, or t
  misc_feature (2890)..(2892): n is a, c, g, or t
  misc_feature (2895)..(2898): n is a, c, g, or t
  misc_feature (2900)..(2901): n is a, c, g, or t
  misc_feature (2903)..(2905): n is a, c, g, or t
  misc_feature (2907)..(2914): n is a, c, g, or t
  misc_feature (2916)..(2916): n is a, c, g, or t
  misc_feature (2918)..(2920): n is a, c, g, or t
  misc_feature (2922)..(2922): n is a, c, g, or t
  misc_feature (2924)..(2926): n is a, c, g, or t
  misc_feature (2929)..(2932): n is a, c, g, or t
  misc_feature (2934)..(2934): n is a, c, g, or t
  misc_feature (2936)..(2937): n is a, c, g, or t
  misc_feature (2939)..(2942): n is a, c, g, or t
  misc_feature (2944)..(2944): n is a, c, g, or t
  misc_feature (2946)..(2946): n is a, c, g, or t
  misc_feature (2948)..(2948): n is a, c, g, or t
  misc_feature (2950)..(2950): n is a, c, g, or t
  misc_feature (2952)..(2952): n is a, c, g, or t
  misc_feature (2954)..(2956): n is a, c, g, or t
  misc_feature (2958)..(2961): n is a, c, g, or t
  misc_feature (2964)..(2965): n is a, c, g, or t
  misc_feature (2967)..(2967): n is a, c, g, or t
  misc_feature (2969)..(2970): n is a, c, g, or t
  misc_feature (2974)..(2975): n is a, c, g, or t
  misc_feature (2977)..(2978): n is a, c, g, or t
  misc_feature (2980)..(2981): n is a, c, g, or t
  misc_feature (2987)..(2988): n is a, c, g, or t
  misc_feature (2990)..(2992): n is a, c, g, or t
  misc_feature (2994)..(3006): n is a, c, g, or t
  misc_feature (3009)..(3009): n is a, c, g, or t
  misc_feature (3013)..(3017): n is a, c, g, or t
  misc_feature (3019)..(3022): n is a, c, g, or t
  misc_feature (3026)..(3027): n is a, c, g, or t
  misc_feature (3032)..(3034): n is a, c, g, or t
  misc_feature (3036)..(3037): n is a, c, g, or t
  misc_feature (3039)..(3041): n is a, c, g, or t
  misc_feature (3043)..(3043): n is a, c, g, or t
  misc_feature (3045)..(3046): n is a, c, g, or t
  misc_feature (3048)..(3048): n is a, c, g, or t
  misc_feature (3051)..(3051): n is a, c, g, or t
  misc_feature (3053)..(3055): n is a, c, g, or t
  misc_feature (3057)..(3074): n is a, c, g, or t
  misc_feature (3076)..(3078): n is a, c, g, or t
  misc_feature (3080)..(3095): n is a, c, g, or t
  misc_feature (3097)..(3101): n is a, c, g, or t
  misc_feature (3103)..(3108): n is a, c, g, or t
  misc_feature (3110)..(3116): n is a, c, g, or t
  misc_feature (3118)..(3120): n is a, c, g, or t
  misc_feature (3123)..(3126): n is a, c, g, or t
  misc_feature (3128)..(3128): n is a, c, g, or t
  misc_feature (3130)..(3132): n is a, c, g, or t
  misc_feature (3134)..(3140): n is a, c, g, or t
  misc_feature (3142)..(3143): n is a, c, g, or t
  misc_feature (3147)..(3153): n is a, c, g, or t
  misc_feature (3155)..(3155): n is a, c, g, or t
  misc_feature (3157)..(3162): n is a, c, g, or t
  misc_feature (3164)..(3165): n is a, c, g, or t
  misc_feature (3167)..(3168): n is a, c, g, or t
  misc_feature (3170)..(3171): n is a, c, g, or t
  misc_feature (3174)..(3174): n is a, c, g, or t
  misc_feature (3178)..(3178): n is a, c, g, or t
  misc_feature (3180)..(3181): n is a, c, g, or t
  misc_feature (3184)..(3192): n is a, c, g, or t
  misc_feature (3194)..(3194): n is a, c, g, or t
  misc_feature (3197)..(3197): n is a, c, g, or t
  misc_feature (3203)..(3203): n is a, c, g, or t
  misc_feature (3207)..(3207): n is a, c, g, or t
  misc_feature (3210)..(3212): n is a, c, g, or t
  misc_feature (3214)..(3215): n is a, c, g, or t
  misc_feature (3218)..(3218): n is a, c, g, or t
  misc_feature (3221)..(3223): n is a, c, g, or t
  misc_feature (3225)..(3226): n is a, c, g, or t
  misc_feature (3231)..(3231): n is a, c, g, or t
  misc_feature (3233)..(3233): n is a, c, g, or t
  misc_feature (3235)..(3235): n is a, c, g, or t
  misc_feature (3237)..(3238): n is a, c, g, or t
  misc_feature (3240)..(3242): n is a, c, g, or t
  misc_feature (3248)..(3249): n is a, c, g, or t
  misc_feature (3251)..(3251): n is a, c, g, or t
  misc_feature (3254)..(3259): n is a, c, g, or t
  misc_feature (3261)..(3263): n is a, c, g, or t
  misc_feature (3266)..(3267): n is a, c, g, or t
  misc_feature (3269)..(3271): n is a, c, g, or t
  misc_feature (3273)..(3275): n is a, c, g, or t
  misc_feature (3277)..(3277): n is a, c, g, or t
  misc_feature (3279)..(3279): n is a, c, g, or t
  misc_feature (3281)..(3282): n is a, c, g, or t
  misc_feature (3284)..(3285): n is a, c, g, or t
  misc_feature (3287)..(3289): n is a, c, g, or t
  misc_feature (3292)..(3292): n is a, c, g, or t
  misc_feature (3296)..(3298): n is a, c, g, or t
  misc_feature (3302)..(3303): n is a, c, g, or t
  misc_feature (3305)..(3307): n is a, c, g, or t
  misc_feature (3309)..(3310): n is a, c, g, or t
  misc_feature (3312)..(3313): n is a, c, g, or t
  misc_feature (3318)..(3318): n is a, c, g, or t
  misc_feature (3320)..(3323): n is a, c, g, or t
  misc_feature (3326)..(3329): n is a, c, g, or t
  misc_feature (3336)..(3338): n is a, c, g, or t
  misc_feature (3340)..(3345): n is a, c, g, or t
  misc_feature (3350)..(3351): n is a, c, g, or t
  misc_feature (3354)..(3355): n is a, c, g, or t
  misc_feature (3357)..(3360): n is a, c, g, or t
  misc_feature (3364)..(3368): n is a, c, g, or t
  misc_feature (3371)..(3373): n is a, c, g, or t
  misc_feature (3375)..(3379): n is a, c, g, or t
  misc_feature (3381)..(3383): n is a, c, g, or t
  misc_feature (3387)..(3392): n is a, c, g, or t
  misc_feature (3394)..(3400): n is a, c, g, or t
  misc_feature (3405)..(3405): n is a, c, g, or t
  misc_feature (3407)..(3408): n is a, c, g, or t
  misc_feature (3411)..(3411): n is a, c, g, or t
  misc_feature (3413)..(3413): n is a, c, g, or t
  misc_feature (3415)..(3416): n is a, c, g, or t
  misc_feature (3418)..(3418): n is a, c, g, or t
  misc_feature (3420)..(3420): n is a, c, g, or t
  misc_feature (3424)..(3424): n is a, c, g, or t
  misc_feature (3426)..(3427): n is a, c, g, or t
  misc_feature (3431)..(3434): n is a, c, g, or t
  misc_feature (3438)..(3448): n is a, c, g, or t
  misc_feature (3451)..(3451): n is a, c, g, or t
  misc_feature (3454)..(3456): n is a, c, g, or t
  misc_feature (3458)..(3458): n is a, c, g, or t
  misc_feature (3462)..(3463): n is a, c, g, or t
  misc_feature (3465)..(3467): n is a, c, g, or t
  misc_feature (3469)..(3470): n is a, c, g, or t
  misc_feature (3472)..(3473): n is a, c, g, or t
  misc_feature (3478)..(3482): n is a, c, g, or t
  misc_feature (3486)..(3488): n is a, c, g, or t
  misc_feature (3490)..(3490): n is a, c, g, or t
  misc_feature (3492)..(3492): n is a, c, g, or t
  misc_feature (3494)..(3494): n is a, c, g, or t
  misc_feature (3498)..(3499): n is a, c, g, or t
  misc_feature (3501)..(3503): n is a, c, g, or t
  misc_feature (3505)..(3508): n is a, c, g, or t
  misc_feature (3510)..(3517): n is a, c, g, or t
  misc_feature (3520)..(3521): n is a, c, g, or t
  misc_feature (3524)..(3525): n is a, c, g, or t
  misc_feature (3528)..(3528): n is a, c, g, or t
  misc_feature (3531)..(3531): n is a, c, g, or t
  misc_feature (3533)..(3534): n is a, c, g, or t
  misc_feature (3536)..(3536): n is a, c, g, or t
  misc_feature (3538)..(3538): n is a, c, g, or t
  misc_feature (3542)..(3543): n is a, c, g, or t
  misc_feature (3545)..(3548): n is a, c, g, or t
  misc_feature (3550)..(3551): n is a, c, g, or t
  misc_feature (3554)..(3554): n is a, c, g, or t
  misc_feature (3558)..(3559): n is a, c, g, or t
  misc_feature (3566)..(3566): n is a, c, g, or t
  misc_feature (3579)..(3580): n is a, c, g, or t
  misc_feature (3582)..(3588): n is a, c, g, or t
  misc_feature (3590)..(3590): n is a, c, g, or t
  misc_feature (3595)..(3595): n is a, c, g, or t
  misc_feature (3597)..(3601): n is a, c, g, or t
  misc_feature (3603)..(3603): n is a, c, g, or t
  misc_feature (3606)..(3606): n is a, c, g, or t
  misc_feature (3609)..(3609): n is a, c, g, or t
  misc_feature (3611)..(3614): n is a, c, g, or t
  misc_feature (3616)..(3617): n is a, c, g, or t
  misc_feature (3620)..(3620): n is a, c, g, or t
  misc_feature (3622)..(3624): n is a, c, g, or t
  misc_feature (3626)..(3628): n is a, c, g, or t
  misc_feature (3631)..(3631): n is a, c, g, or t
  misc_feature (3633)..(3634): n is a, c, g, or t
  misc_feature (3636)..(3636): n is a, c, g, or t
  misc_feature (3638)..(3641): n is a, c, g, or t
  misc_feature (3643)..(3643): n is a, c, g, or t
  misc_feature (3646)..(3646): n is a, c, g, or t
  misc_feature (3650)..(3650): n is a, c, g, or t
  misc_feature (3654)..(3654): n is a, c, g, or t
  misc_feature (3656)..(3658): n is a, c, g, or t
  misc_feature (3661)..(3661): n is a, c, g, or t
  misc_feature (3664)..(3665): n is a, c, g, or t
  misc_feature (3667)..(3667): n is a, c, g, or t
  misc_feature (3669)..(3672): n is a, c, g, or t
  misc_feature (3674)..(3675): n is a, c, g, or t
  misc_feature (3678)..(3679): n is a, c, g, or t
  misc_feature (3682)..(3685): n is a, c, g, or t
  misc_feature (3689)..(3689): n is a, c, g, or t
  misc_feature (3694)..(3694): n is a, c, g, or t
  misc_feature (3696)..(3696): n is a, c, g, or t
  misc_feature (3698)..(3698): n is a, c, g, or t
  misc_feature (3700)..(3700): n is a, c, g, or t
  misc_feature (3702)..(3703): n is a, c, g, or t
  misc_feature (3706)..(3706): n is a, c, g, or t
  misc_feature (3709)..(3709): n is a, c, g, or t
  misc_feature (3711)..(3711): n is a, c, g, or t
  misc_feature (3714)..(3714): n is a, c, g, or t
  misc_feature (3717)..(3723): n is a, c, g, or t
  misc_feature (3726)..(3728): n is a, c, g, or t
  misc_feature (3732)..(3734): n is a, c, g, or t
  misc_feature (3737)..(3737): n is a, c, g, or t
  misc_feature (3742)..(3743): n is a, c, g, or t
  misc_feature (3745)..(3746): n is a, c, g, or t
  misc_feature (3750)..(3751): n is a, c, g, or t
  misc_feature (3754)..(3754): n is a, c, g, or t
  misc_feature (3757)..(3757): n is a, c, g, or t
  misc_feature (3759)..(3759): n is a, c, g, or t
  misc_feature (3762)..(3763): n is a, c, g, or t
  misc_feature (3765)..(3766): n is a, c, g, or t
  misc_feature (3768)..(3770): n is a, c, g, or t
  misc_feature (3772)..(3772): n is a, c, g, or t
  misc_feature (3774)..(3775): n is a, c, g, or t
  misc_feature (3777)..(3783): n is a, c, g, or t
  misc_feature (3788)..(3790): n is a, c, g, or t
  misc_feature (3792)..(3792): n is a, c, g, or t
  misc_feature (3795)..(3797): n is a, c, g, or t
  misc_feature (3799)..(3799): n is a, c, g, or t
  misc_feature (3801)..(3801): n is a, c, g, or t
  misc_feature (3803)..(3806): n is a, c, g, or t
  misc_feature (3808)..(3814): n is a, c, g, or t
  misc_feature (3818)..(3819): n is a, c, g, or t
  misc_feature (3822)..(3822): n is a, c, g, or t
  misc_feature (3824)..(3824): n is a, c, g, or t
  misc_feature (3828)..(3831): n is a, c, g, or t
  misc_feature (3833)..(3835): n is a, c, g, or t
  misc_feature (3838)..(3841): n is a, c, g, or t
  misc_feature (3844)..(3847): n is a, c, g, or t
  misc_feature (3849)..(3849): n is a, c, g, or t
  misc_feature (3851)..(3851): n is a, c, g, or t
  misc_feature (3853)..(3854): n is a, c, g, or t
  misc_feature (3857)..(3859): n is a, c, g, or t
  misc_feature (3861)..(3861): n is a, c, g, or t
  misc_feature (3864)..(3865): n is a, c, g, or t
  misc_feature (3867)..(3868): n is a, c, g, or t
  misc_feature (3870)..(3870): n is a, c, g, or t
  misc_feature (3873)..(3874): n is a, c, g, or t
  misc_feature (3877)..(3877): n is a, c, g, or t
  misc_feature (3879)..(3880): n is a, c, g, or t
  misc_feature (3883)..(3884): n is a, c, g, or t
  misc_feature (3887)..(3891): n is a, c, g, or t
  misc_feature (3894)..(3897): n is a, c, g, or t
  misc_feature (3900)..(3901): n is a, c, g, or t
  misc_feature (3903)..(3903): n is a, c, g, or t
  misc_feature (3905)..(3905): n is a, c, g, or t
  misc_feature (3907)..(3907): n is a, c, g, or t
  misc_feature (3909)..(3911): n is a, c, g, or t
  misc_feature (3914)..(3914): n is a, c, g, or t
  misc_feature (3916)..(3916): n is a, c, g, or t
  misc_feature (3918)..(3919): n is a, c, g, or t
  misc_feature (3921)..(3922): n is a, c, g, or t
  misc_feature (3926)..(3926): n is a, c, g, or t
  misc_feature (3935)..(3935): n is a, c, g, or t
  misc_feature (3943)..(3943): n is a, c, g, or t
  misc_feature (3946)..(3947): n is a, c, g, or t
  misc_feature (3949)..(3949): n is a, c, g, or t
  misc_feature (3953)..(3953): n is a, c, g, or t
  misc_feature (3955)..(3955): n is a, c, g, or t
  misc_feature (3957)..(3957): n is a, c, g, or t
  misc_feature (3962)..(3964): n is a, c, g, or t
  misc_feature (3966)..(3966): n is a, c, g, or t
  misc_feature (3968)..(3968): n is a, c, g, or t
  misc_feature (3970)..(3970): n is a, c, g, or t
  misc_feature (3975)..(3975): n is a, c, g, or t
  misc_feature (3981)..(3981): n is a, c, g, or t
  misc_feature (3983)..(3983): n is a, c, g, or t
  misc_feature (3985)..(3986): n is a, c, g, or t
  misc_feature (3994)..(3995): n is a, c, g, or t
  misc_feature (3997)..(3998): n is a, c, g, or t
nnnnnnnnnnnncnnnnnnnncnncnnnnnngcnntnnnnncnntngnnttnntnnnnnnnntnannnnnnnnnnncttnnnnnnnnnnnntnnnnnnnnngnnnnnnanncnnnnnnnngnnnannnnnnnnttncnntnnnnnnnnnnnnnnnnnnncnnnnngnnannntnnancnncnnnnnnnnnnnnnnannnnnnnnnnnnncnnnnncnnnnnnnnnnanancanngnnnnannnnnnnncntnnnnnnnannnnnntnnnnnnngnnnnnaaannnntnnnnnnnnnnnnnnnnnnnnnnnnnnnnnnnnnnnnnatnnnnnnnntnnnncnnnnnnnnannnnnnnnnnnnngnnnnannnnnncnnnnnnnnnnnnatnnnnnnnnncgnnnnnnnnnantnncnangnnnnantnnntnnnnngtnnnnnnnnnnnnnnnnntcnncnnnnnggcnnanncnnannnnnnnntcnnnnncnntcaaancnntnnnnnnnnnnncnncntntncnnannnntncatnnngcnnnnnttntntatannnnnnntnnnnnannnnnnannnntnnnnnnnnnntnnnnnnnntncnnnnnnntnnnnnnntnnannnngnnngnnnnnnnnannnnnnnnncnnnnnnnnnnnnnnnnnnnnnnnnnnttnnnnnnannnnnncnnnnaanntnntnntnnnnannnnnnntnnnnnnnnnnnnnnnacnnnnnnntnnnnnnnnnnannannnannnncnnnnnnnnnnnnannnnnntannnnnnnnnngnannnnnnnnnnnannnnnnnnnnnnnnnnnnnnnnnntcncnnnnntnnannnnnnnnnnnnnnanannnnnannnnnnnnnnnnncnntntnntnnngnnnnanannntngnnnnnnnnncnnnnnnnannntannnntnannnngnnnnnnnnnnnnatnngnnnnnnnnnnnnnntnnnnnnnnannnnnnnnnnnnnnntnngnnnnannngnnnnnnnnnnnnnnannngnnnnnnnananngnnnannannaanaaannannaannnnncnnnnnngnnnngnnggntttttnntnnanaanannnnnnnnncnacnnnctcnccnnnnnnaannnannnnnnncnncnnnnnnnnnnnnnnnnnctnnnnnnnnnnggnnnngnngnnnnnnnnnnnnannannnnnnnnnnnnannnncnnnnanannannnacnntannnnnnnnnntnnttnnnaanntnnnaannttncnnncnttngnnangnagagactcaacactaataaaaaatggttaagtcgatcggcttattagtactactcggctaaacacattactgtgcgtacacctgtagcctatcaaccangtcatcttcntggagcctgatggggaaatctcatcttgaggcgagtttcgcacttagatgctttcagcgcttacctcaaccaaacgtagctacccagctatgccactggcgtgacaactggtgcactagaggtttgttcgtcccggtcctctcgtactaaggacaagccctctcaaatttcctgcgctcgcatcggatagggaccgaactgtctcacgacgttctgaacccagctcacgtaccactttaaccggcgaacagccggacccttgggaccttctccagccccaggatgtgatgagccgacatcgaggtgccaaaccccctcgtcgatatgaactctcggaggggatcagcctgttatccctagcgtaccttttatcctatgagcgatggcccttccatgcgggaccaccggatcactatgaccaactttcgttcctgttcgacctgtcagtctcacagtcaagctcacttataccattatgctctacgttccattaccgacggaactgagtgaacctttgtaagcctccgttactttttaggaggcgaccgccccagtcaaactacccgcctgacattgtccttagacaggatcaactgnccgaagttaggactcaaacacaaccagggtggtatttcacattgcgactccacggangctnacgcccccgcttcaaagtctcccacctattctacacaaatcatgctcaagcccaatgccaggttatagtaaaggtgcatagggtctttccgtccagatgcgagtagccggcatcttcaccggcactacaatttcgccgagcgcgcagccgagacagtagtcaaatcgttacaccattcgtgcaggtcggaacttacccgacaaggaatttcgctaccttaggaccgttatagttacggccgccgtttactggggcttcggttcaaagcttcgcctnnnnnntnanannnncnnntnnccttnnnnnnccngnnnngngnnnntnncnntncntnnacntnnannnnnntngnnnngnnnnnnnnntntgttnnnnnnnnncnnnnnnnnnnncnntnnnncnnngnnnnnnnnnncnnnnnnnccnnannnnnnngnnnnnnnnnnnnnnnnncnnnnncnnnnnctnnntcnnncncnnnnnnntnnnnatncnnnnnncntntnncngtntnngntnnngnnannnnnngttnnnnnnnnnnnnnnnnnnnnnnnnncnnnannangnnnagnnanngntntnncnnnnacnnnnnncntnttnnngnttnnannnngnnnnnntnngnntnnncntnnncntnngcnnnnnnacnnnnacnnccnnnnnnnnncnntnnntnnncttnnncntcnncnnnnnnnnannnnnnntnannntcnngnacnggnanannaanntnnnnnnnntnnncnncgnctnnnnnnntcnncntnnnnnnngnnnnnnnctnannnnnnnannattnnnnnngnnnnnnnannnttnnnntnncnnngnnnnnnnntntnnntntnnntannnntncnnannnntncntntncntnnncnnnngcnncngnnaccnntnncnntcaccnncnnngnnnnnnnnnnnnnccnctannnnnannnntaannctaannntnngnnncngnntnagncnnngnnnnnnnnnnnnnnnnnncnnntnnnnnnnnnnnnnnnncnnnnncnnnnnntnnnnnnngnnnctnnnncnannncnnnnnnntnnctgnnnnnnnanannnnnnanntnnanntancctngnnttnnnnnnnnnanctntagctntggnttnnntnnctntcnnncnnggacntnancnntnnngccctnncnccnnnnnntnnnatnncnnnannngnantnnanntnnnttnggtnnngttnngnnngnncnngcccnannnntannnntacctcnnncnnnnnnaaccnnaanncnnnncctnnnnncannncnnnnngnnngagnnnnnncnnnnnnngattngnnttncncnncnancctnanntcannnnaacnnnnnnnnnnncanacnnntncggnncnnnanntnnttttnnnnntacnnnancntnatcnngnnnannnnannnnnnnncgnntcnncgncangnnantnttcnntnnnntnnaantcgnnttcgctncggctccggctcnnannnnnnnanccttncnnnnnancantancnnnnannctnannntnnnaangnnangnnnncncanccancccnannnctngtnngntnnnncnnttnngtnnnngtanggttncngntncnnttncantnccntcnnnnnnntannnttcnnnttnccctnncnntacnngtncantntcnntnncnnnanannannnnnnnttacnnnanggnnntngntnnnncnnnnnnnaccnnacntncccnnnncnnntcnnnntcnnnntntncnnttnnngnttnngnntncgnnacngnnacnntcnnnnnttnnnnttnncngntnannntgntntnncnntctntcacgttanggagtccnacnncnccgncncngccgnnncngnanccggnttgggntngnnccttttcnntnncc

SEQ ID NO: 1116 - DNA, 4000 bp, Escherichia coli
  misc_feature (416)..(416): n is a, c, g, or t
  misc_feature (539)..(539): n is a, c, g, or t
  misc_feature (975)..(975): n is a, c, g, or t
  misc_feature (1160)..(1160): n is a, c, g, or t
  misc_feature (1164)..(1164): n is a, c, g, or t
  misc_feature (1344)..(1344): n is a, c, g, or t
  misc_feature (1389)..(1389): n is a, c, g, or t
  misc_feature (1413)..(1413): n is a, c, g, or t
  misc_feature (1446)..(1446): n is a, c, g, or t
  misc_feature (1452)..(1452): n is a, c, g, or t
  misc_feature (1624)..(1624): n is a, c, g, or t
  misc_feature (1686)..(1686): n is a, c, g, or t
  misc_feature (1818)..(1818): n is a, c, g, or t
  misc_feature (1825)..(1825): n is a, c, g, or t
  misc_feature (1923)..(1923): n is a, c, g, or t
  misc_feature (1965)..(1965): n is a, c, g, or t
  misc_feature (1980)..(1980): n is a, c, g, or t
  misc_feature (1992)..(1992): n is a, c, g, or t
  misc_feature (2037)..(2037): n is a, c, g, or t
  misc_feature (2118)..(2118): n is a, c, g, or t
  misc_feature (2148)..(2148): n is a, c, g, or t
  misc_feature (2172)..(2172): n is a, c, g, or t
  misc_feature (2217)..(2217): n is a, c, g, or t
  misc_feature (2337)..(2337): n is a, c, g, or t
  misc_feature (2684)..(2684): n is a, c, g, or t
  misc_feature (2717)..(2717): n is a, c, g, or t
  misc_feature (2720)..(2720): n is a, c, g, or t
  misc_feature (2768)..(2768): n is a, c, g, or t
  misc_feature (2849)..(2849): n is a, c, g, or t
  misc_feature (2852)..(2852): n is a, c, g, or t
  misc_feature (2886)..(2886): n is a, c, g, or t
  misc_feature (2972)..(2972): n is a, c, g, or t
  misc_feature (3146)..(3146): n is a, c, g, or t
  misc_feature (3299)..(3299): n is a, c, g, or t
  misc_feature (3398)..(3398): n is a, c, g, or t
  misc_feature (3437)..(3437): n is a, c, g, or t
  misc_feature (3464)..(3464): n is a, c, g, or t
  misc_feature (3654)..(3654): n is a, c, g, or t
  misc_feature (3662)..(3662): n is a, c, g, or t
  misc_feature (3707)..(3707): n is a, c, g, or t
  misc_feature (3719)..(3719): n is a, c, g, or t
  misc_feature (3884)..(3884): n is a, c, g, or t
  misc_feature (3911)..(3911): n is a, c, g, or t
gaagatcactgttgtctactattttcataacagactccattgataattcttcatgcttagaactgaatttctctaaaataggatcatcaggagatatttcacgactaaatgttgtatcaacgtcgtaatatgcttctgtgataactttatcggtagtctgatttgcactaatgaagtattctatattaagacgaatcgcatctataactgtaatttctttagattcatcattatctttatatgttagtttagaaagagctaacttttctaaatcttcatcagttttacattcttgtaatgtaaacgtaggcataagttcacgtatccattctacgtcacctctagaactaaccccaaatggagatatcattaatatactacgattagttatcacgattggtatataacaatgcganggttcaaaggtttcaaatagaaataacggaattattatgttattagctggttctacgaataagaatctcttacacatagctccaggactacatatttctataagttttttaagcttagcattnataagaactagctctttattaaccgaactaaagtctaaatttactaatcctatagaaatatcttcagacccattatcagtactagcggtataagaacgtttattaactataaaagatttaactatactagtcgctcttctagctgctatatactcaggtaaattatacataaaattccctcctttcttataagataattaacagtccggttgtttttacccgaaaaacaaggcggtgttaaacaatatatattaaaatgtaaacctaaaggagggttatgatgtttataactaattatgctaaaaagtatgaagaatgtaataactatggctattataaagatttctttaatgaaaactatgaagcggctgaagttattagaaaatgtgaagctatggccagagaaaaatatggtaagtttaaaagtatcatatanaataagaacaaatatgaaataatggaagatcttaaagaagctggattattacaatgtttaagtccagacgtaattgaagaaattaaaaagtatacagaacttcctaatgactgtgctcatgctttcaataacattggattatcatataatttatctgctagtgcaaaatttataccagaagaatncttnaatatttatggacttcttaaaattaaagaaagaagtaaaactgatttatttgccgatagtcatttctttattctaaatggagataatggaaagggactgtttgctcatattgatatcagcagacttattggtattggtgtagatattagaaagtctgacatatatagaagatatatgggntattctacaaatacagactcagatacttctacaaaatatagtagngactttggactaggtatgtatgangattcttatccagttgcatggtttaatacaganttagantataatgcactattactaagaataattacacataaaatgatacatggtgatagagaaatatttgcagaagctatagtaaatgctatattagataagtttataagattacaattaactttatatacttatgtagtatacatatatggtaatagagatatcgtatctaataacntagaaacatttgttaaacttgcattcttatttaaacttgtatataatagtgtaaatggaatngatacagatgatataggtgatagtattaaaaagcttatgagagactttagttattgtgttcaaaatagaggagcatttgatagtgttataatgactgcagacttatggagaaatagattaattaaaggatancaagacntaccaagctttagtgatgatgctataaatgaagttcttgaaatgtatcaaaagaaaagacatgctgttataactataaataaaatgaatagacctgtntatgctaataagattataacaggaattaaattagtttcattngaaagtcttcaagangatatattatcngaatataatttaaagaaatcttataatgcatttaaaaatgcaccngctagatatgctacaattggtatggaatctgttagtgataaatcagaattcatggttactagaagtaaattactagctaanttaaaacctaaagatagagaaacttatatngatcttgaaaatgatcttatgaanataaagtctgatgcaatgaattgtaagacaactgatggaatgaangttcttatgaataaaataaatactcttggtagtataatatctgtagaaatggatactaaagatgaatttctaagagaagctttaggacttttagatgcacaacgtataatactagcaganatgatggctagtcgtagtgtaataaaagaaaattctggaatattatatggtatggtaaagctataaaataacagcgggggcgaaagctcccgtttatgtacggaggtattatggttagttacgaagaaattatgcataataaacatgagaaatttgataacttccttaaggatcttggtatagaaaaagatgtattggtaaactttgttgatagtacatatgatcaatttatacgtaacactagagaagaaatagccaagtatagaaatgaaggtatagaaccacctgaaaatttggtaatagataataatatatcatttcaggaatataatgagaataagcaaaangtattggaagctataagtaattttattgaagcnganaatgagaatgaaggtaaagaagatgactttagatttccatattgtganatatttaatggtaacttccctaaacttgataaaactaaattatcagaccaggctaaagttgcacttaaagtagatggtctnccngattttgcttatgatatttattataatgccgaanataaaaaagctattcctatatattatgattatagtacagtcaatcatcaatgggttgaatttagttttatgttagagaagatgggngatttcttaggtattaatataaaccataaagctcctcttataactcttaatagaatgttacttggtatagatatagataatcctgtcattagtagtgaaattcagatagcagctgctattgaatgtgaacagaatcctatttatatggttagagaagctggtcgtataatggangaagctacaggagaaagaataccatatgaaatgactattgcaacatggacgttcttatggttatatgctcaaagatttaatatctatcgggaacagtcaagacaaacaggtaaaacattcgaccttactaaagtattaggaatggactggggngctggtcttcgtaatgctaagatgttagtagtacactttaaccaagatgaagctggtaagaacagacggggaatgatagatgctgctaatatgctaccnagatttcttaaatttcatacaataaagacaaaaaaagtnaaaggtaagcaaatgctagtagaagangaagatttttctccttctcttaaagctagagaagtaaagaatgaagaaagaaataacttcttaaagatattcgcagtaggtacaagtgaaactcaagcagaaagaaccgggcggggagactcacctagatttgtatacgtagacgaaattaactttatacgtcatacaactgcaatgcttggaggtatantatttgcncatggtactgctagactacttgctatacgtagtaatcaaagacanggtatatacttnacatctacaccaggtaaacttaatactacaagtggaagacttatgtatgaacttgtatttaaggaaatggctcaatttgatatagagttctttggatatacatatgaagaactatgtaaagtaatgaataatagtaagaaacatttctggactatgagttatgantactttgaacttggatttaatgaagcntggcttgaaaaatctattaatgaaagtaatgatagagaagtatttatgacagatatgttgaatcgttggcttgaagttgatagtgaaag

SEQ ID NO: 1117 - DNA, 4000 bp, Escherichia coli
  misc_feature (19)..(19): n is a, c, g, or t
  misc_feature (1378)..(1378): n is a, c, g, or t
  misc_feature (1631)..(1631): n is a, c, g, or t
  misc_feature (1925)..(1925): n is a, c, g, or t
  misc_feature (1942)..(1942): n is a, c, g, or t
  misc_feature (1985)..(1985): n is a, c, g, or t
  misc_feature (1991)..(1991): n is a, c, g, or t
  misc_feature (1997)..(1997): n is a, c, g, or t
  misc_feature (2351)..(2351): n is a, c, g, or t
  misc_feature (2672)..(2672): n is a, c, g, or t
  misc_feature (2804)..(2804): n is a, c, g, or t
  misc_feature (2834)..(2834): n is a, c, g, or t
  misc_feature (3091)..(3091): n is a, c, g, or t
  misc_feature (3553)..(3553): n is a, c, g, or t
  misc_feature (3585)..(3585): n is a, c, g, or t
  misc_feature (3637)..(3637): n is a, c, g, or t
  misc_feature (3779)..(3779): n is a, c, g, or t
cacacccgaggggcatgtngtcatacaggccaaacacgacaggcagcgatctatatgtttaaccgtcttttcatccggcgtccgctgattttccagcatatccttaataagataaattcggccgcgtgggctgtccaactcatcacccagcacttgataagtgggacaagtcgccgtgcaaaagccacaatggatacagctgcgcagaatatcattggtacgtttgatttgcgggtccaacagctgcgtttcggtaaaatgtgtttgcatcagctcatccgtcccgggtttaagatgccacgcggatcaaattttttgcgcagggtttgagaaacatgctcaattgcgcgtccgagtggctggaagtggcacagctcttgatcacgcaaaaaacccgatttcaccaaagtcgcatgaccactcagctgcgccacatgtgtctgcaaggcctgatgcaatgctaggccggcctgtgcatttgcaatctgtgccgcctccagcccaagccagatcaatcccccaccccaatccaattgacagtgaaacccgggttctttctgcaggtcttgcatcagatcaatgaccctcaaactgtctgtaggacgcactgaaatacgccacactgtgtcgagggctgcccaagaccttaggtctttcacctcagcccaaggatcatcaaccacatcaaccgcaccaaatttcgcaaggcgttgcgtcaattcggacgcgcggtattgaaccgaggtctcaaacccctcaacccggatcaaacagtcaaagccgccgtcttccgcctgcacggttgcagcgccgctgacgtcaaacggcgtgcccaacgccgccgacatacagccgaccgcatctgcccaggtggtgacgtgaattttcaaagtggcctgggtctcactgacaggcagaaccttcaacgccacctcagtgagcaccccaagcgtgccccaagagccggacatcaatttcacaagatcatagccggtgacattcttcatcacccggccaccattgctcagcacttgccccgtcccatccacaaaggtcacgcccagcgcaaaatcacgcgcggcgcccacttgaatgcggcgcggacccgagacattggcggcgatcaccccgccaagggttggctgacccgatgtgcccaagatcgcgcggtgatccatcggctcaaaggcaagtcgctgcttttccgccgccagaacggcctcaatgtcttcaatagctgtcccagttttggccaccagggtcatggcgccgggttcataaagagtgatcccctgcacgcgacgcgtactcagggcttgcgccggcgcaatacggccaatttggcgtgtcccgccgcccatgatctgcaaaggacccntggcctcacggagcgcagcggcaagggccgcctcatcttcaggatagagtatttcgctcatgacgcccgccgcgattgggaaaccgacagggggaagactttggaggggttgagaagccaggccggatcaaacacatctttgaccgccatttggatctccagatcttctgcactgtattggtcttccatcaaatcgcgtttttcaatgcccacaccgtgctcaccggtcaaacagccgcccacctcaacacanagccgcaacacatccgcccccatcgcttcacagagctcaagatcgccctctttgttggcatcaaacatgatcagcgggtgcatgttgccatcgcccgcatgaaacacattgcccacacgcaggccataatgatccgacagctctttgatccgccgcagaacttctggcaaggcagaaacaggaatggttccatccaaacacatatagtctgcaacttggcccaccgcgccaaaggcggattttcggcccaaccaaatcgcagcactttccgcggcagattggctttgacgcagntcgaccggattgtgttnttgcgcaatcgcactgatgcgatccagttgatcttgaatttcngcctcngatccntcgacctcgacaatcaacagcgcttcacagtctggatatcccgccttggcgaaattctcacaaatttcaataattggacggtccatgaattcaattgcgacaggcaaaacaccggctttgataatgtccgccacacaggcacctgccacttcattgctgtcaaaagcgatcatcaccggacgcgcgccctcgggtttgggcaaaatccgcaaggtggcctctgtgaccacgcccagctggccctctgacccgcagatcacccccagaatatcgagcccagaggcatcaaggtagccaccgccgatctcaacaatctcaccatccatcatcaccatggtcacgcccatcagattnttggtggtcaccccatatttcaaacaatgcgccccgccggagttcatcgcgatattgccggcaatggcgcaggccaattggctggaaggatcgggggcataaaagaaatcttcttcctccacagcgccagacacgctgaggttggtccggccgctttgcacccggatcaggcggttctcgtagtctgtttctaaaactttattcatctttgccacgcccaggatgacgcaatctgccgttggcagcgcaccgcccgccaaagatgtgcccgacccccgtggcacgaccggcacgccttcgcggtggcaaatcttcaaaatntctgagacttcctgcgtggttgcgggcaagactgcgatcatcggcgggcagcgatatgcggtgagcgcgtcacattcataggcccgcgtttcagaagggtcatcaatcaccgcatcatagggcaaaacagcncgcaacgccgccgcaattttcgcctttttngacaggatttccgaatttggttgtggcatttccatgtttaaccctccaattggtaaataattataaccaattttgggggatcgcaagggcaaatcctctgctacactgaaggcatgatatttgatgtaatcctctcccaactcaccacttttgatctttttgtcgtcggatttggccttctcgccgcctttctgatcggccatgtgatcgaaaaccctcccaagtcacgcgcttcagtcaccgccctgatgtcctantatcggcgcgcttggatgctcaatttcgtagaccgcgatccccgtatttttgattctcaaacactggcctctctgcgccaaagcactgccttttttggatccacagctttgatttccattggcgggcttttggcaatcatgggcacgccagatcgcctgcttgaatttacccatgccgtcacccaatcgcaggaggccactgcgctcaaattgcaattcaaattggcctttgccgctctgtttttggtgcatgcctttttgaaatttgtatggtccagtcgcctgtttggctattgcgccgtcttaatggcagccgtgccgaatgatccagatcatccccaagcgatcccgcgcgctattatggccggtgagatcaatatccgcgctgccttgagctttaaccgcgggttgcgcgccatgtatttcgcgcttgcatctctggcctggctggctggcgccccngttatgctggcggcctttgtgattacgctttntatgctctggaaccgtgagttttcctcacaggccagcgcacttttgaaaacngggataatggagaccgacacatcatttatcccagcgcccttcgcgcaaccaaccgatcaaaagaccaagagcggcaaaaatgaggtagacccaagcgggtaagaactgcctaatctcgacgccctgcaccacataggcctcncgcgagacaagcccgatccacccgcgcccatgggccggccggccactgcgcacattgcgaaatgttggcagaccctcagataaggccaaagctcccccattggttttggccaaaatgggtgccatcacccgatcggtggcgatggtctgtacaaactcccgcggtgctgccggccccagcgcagccacgatctgcaaatcccctgagctcaaacgataaag

SEQ ID NO: 1118 - DNA, 4000 bp, Escherichia coli
  misc_feature (1985)..(1985): n is a, c, g, or t
  misc_feature (1988)..(1988): n is a, c, g, or t
  misc_feature (1991)..(1991): n is a, c, g, or t
  misc_feature (3053)..(3053): n is a, c, g, or t
ggtcttagccggcattaatttgccgatgttaatgcgtgctatttcttatcgtgctgacggcctagaatccttggcactcaaggccttgcagggtggccaaaatggcattattcgtttaggtgcaccgccgattaatgtagagctagccatcaacgagaaggcgggagactcatagtgcctaagcttgatatagagatcatcaataagttaggcttacatgcacgagcctcggccaagctatcccaattagccagtgagtatccttgcgaagtttttctgagtaagaatgggcgcaggattaatgcaaaaagtattatgggtgtaatgatgttggccgccggaatgggtagtgtcgtcacattagaaacggttggcgagcaggaagataaagcgctcaccgcgatagttgcccttatcaatgaccgctttggcgagggtgagtaagtatgagttttgcgctccacggcgtatcggtctctaaaggaattgctattggtaaagcagtactaatatcacgcgcagcactcgaggttagtcactatttagtacagccaggtacggaagagcttgaggctaataggttgctacaagcttttgagcaagttcgcaatgagctatctacccttaaagcggttttaccaaaagatgctccgcaagagatggcagcattcttagatgttcatcaaatgattttgtcagatccagccttggcacaaaagccgctcgagttaattcgtcaaaaacgtttaaatgctgcgtgggccctcactacagagcttaatgatttgcttgagcaattttctgagatcgatgatccgtatctcaaggagcggggtaatgatattcggcaggttgctgaacgtgttattaaggcaatccattcacaaaatcgtcaaacagtgatcgggggagagggcttaatttcgggtgattttgatgatggttccattgtggtggcccatgatattgcgccgcatgacatggtgcgctttaaagagaatgccttaagtggatttgtaactgatttaggtggcaagacctcacacacagcaattgttgcgcgtagtttagagattccggccttagtcggcattcgtcatgccagtgagattattgagcacggcgattggttaatcattgatggagatactgggattgtgattgtggctcccgatgaggcgctattgaagcaatatcgcaccctgcaagcccaacaggatcgcgatacgcaaaagttacaggagatcaaatatagtccaactaaaacaagggatggcattgagattgaactctttgccaatattgagctacccgaggatgctagacatgcgattgaattgggtgcagtagggattggtttatttcgttctgaatttctatttatgaaccaagaacatggtttgcccgatgaagaaaatcaatatcaagaatatactcgcgcagttgaggctatgtttggcttacccgtgaatattcgaacgattgatattggctctgataaatcagtatcgggggcggagactggaagtactggtacatcaccacttggcttgcgagcaattcggtggtccttatccgagccagagatctttttaacccagctacgcgctattttgcgagcatccgcacatggtcaggtacggcttttattaccgatggttgcgcatgcacaggaaatctatgagagtttgcgcctgattgataaggcaaaacaacagctacgcgagcgaggtcaagcgtttaatcccaatgtacaggtaggggccatgattgaggttccagcagcagcattaatgatgcctctttttgtaaaacactttgattatttatcgattggtaccaatgatttaattcaatacaccctagcaatcgatcgcgctgatcacgctgttgcccatttgtatgatccattaaatccagcagtattaaatttgattgcttccattattcggcaggctcaaaaggctaaggtgccaattgcagtntgnggngagatggctggagaccctgcattgacaaagctattgttagcgatgggcttaaccgatttctcaatgcactttagtcaattactattggttaaacgtgaaattttacaagctgacacacgcaagctgaaaacacatattgatgaactcttggctacgtttgatcctgtggagcaaggtgtgttgttcaatcgtctaaattcagtacattaaagctaaacttagtgcgccccacatacagggcagtctagattacgttgtatcttaatttcatcgatttgtgaattacgggcattccaaatcaataatcgccccagtaagggttctccaaagccaatcaagatctgtaaggcctgtgctgcttggagagatccaatgattccaacgagcggtgagaagacgcccatactcgcacaacttgtttctacaaaatgagggtctggtggaaaaacgcaggcataacagggtgagcttgcttgcctaaaatcaaatacgctgatttgtgcatcaaatccaattgcagcacccgagaccagcgtttttccgtgcttaaggctgattcgattgatgaggtgacgggttataaagttatcggtgcaatcgatcactaccgatacttgcattacaagctcttcgagtaatgcctcatccgctttttgttcgatcgcatgaatagtgattccaggattgaggttatttaaaaatcgttttcctgaccaaaccttgctcattccgacactattattttgatgcatgatttgacgctgcaagttggtaagctcaacccgatcatgatccacgagggtaatttgacccactcctgccgcagctaggtagggtgcacaagcagagcctaaaccgcccgcgccaataattaatacatggctatttagcagcttttcctgaccagcaatatcaatatcttccagtagaagatgcctggagtaacgcagtagttgctcgtcattcatgagcaaaggcgcttactcaagcttggatgctgagcgcttcacggtttggccgttcagaaaagcaacggcctgttgcaacatgaaatcctcattnctaccaaattcagggggacgtttacccttttctttttcgcgctcctcaggtgttttctttgcattgcgctcctcaattaactgtagctcttgcaagcggcgcttctcacgatctttaattaaggcttcttcagaggattgcttattccgtaaatgtttttcactatcgatctcccgcgtgatcagaacatcgtcgggatcaccatctttattctgatcaaccggaatatcaggcttaatcccgaaggcttgaattgaacgaccattcggtgtgtagtagtaggcggttgtaattttgagtgcagagtcactgctcagcggcctaacggtttgtacggaacctttgccaaacgtagtcttaccgatgatggtcgcacgtttaaagtcttgcaaagcgccggcaacgatttcggaagcggaggcggagtacgcattgactaaaacaaccatcgggattttcttaaagagtgggggtacttcatctaaaggatcaccagattcattcagtttgtacatggcaggcactgcattaaatacctgcctagagtctggggcctgacccttagtagagacaataaccgctcctggaggcaggaaggccgcagcaacgccaacggcgccttgaagaagaccgccaccattattgcgtagatcaagaaccaagcccttgagttttggatctttattcgcaagctcggctaactttttagcaagatccggaatagtacgctcttgaaaactggtgatgcgaacccatgcaatattgttatctacaatttttgctttgatcgattgcactttaatttctgcgcgtgtaatggttactggaaaagtgcgctcttcacttttacggaaaatggtgagagtaatcttggtgccgggagtaccgcgcatagtgcgaactgctttatctaaggacatgccgcgtacaggcttatcatctaggcg

SEQ ID NO: 1119 - DNA, 4000 bp, Escherichia coli
  misc_feature (3)..(4): n is a, c, g, or t
  misc_feature (6)..(8): n is a, c, g, or t
  misc_feature (11)..(11): n is a, c, g, or t
  misc_feature (15)..(15): n is a, c, g, or t
  misc_feature (18)..(18): n is a, c, g, or t
  misc_feature (20)..(20): n is a, c, g, or t
  misc_feature (25)..(25): n is a, c, g, or t
  misc_feature (28)..(28): n is a, c, g, or t
  misc_feature (30)..(30): n is a, c, g, or t
  misc_feature (32)..(34): n is a, c, g, or t
  misc_feature (43)..(43): n is a, c, g, or t
  misc_feature (45)..(45): n is a, c, g, or t
  misc_feature (47)..(47): n is a, c, g, or t
  misc_feature (51)..(52): n is a, c, g, or t
  misc_feature (67)..(68): n is a, c, g, or t
  misc_feature (71)..(72): n is a, c, g, or t
  misc_feature (77)..(79): n is a, c, g, or t
  misc_feature (82)..(82): n is a, c, g, or t
  misc_feature (85)..(85): n is a, c, g, or t
  misc_feature (88)..(88): n is a, c, g, or t
  misc_feature (90)..(90): n is a, c, g, or t
  misc_feature (96)..(96): n is a, c, g, or t
  misc_feature (98)..(98): n is a, c, g, or t
  misc_feature (100)..(102): n is a, c, g, or t
  misc_feature (105)..(105): n is a, c, g, or t
  misc_feature (111)..(111): n is a, c, g, or t
  misc_feature (114)..(114): n is a, c, g, or t
  misc_feature (121)..(121): n is a, c, g, or t
  misc_feature (125)..(125): n is a, c, g, or t
  misc_feature (128)..(128): n is a, c, g, or t
  misc_feature (134)..(134): n is a, c, g, or t
  misc_feature (137)..(137): n is a, c, g, or t
  misc_feature (141)..(143): n is a, c, g, or t
  misc_feature (145)..(145): n is a, c, g, or t
  misc_feature (152)..(152): n is a, c, g, or t
  misc_feature (158)..(159): n is a, c, g, or t
  misc_feature (165)..(165): n is a, c, g, or t
  misc_feature (169)..(169): n is a, c, g, or t
  misc_feature (171)..(171): n is a, c, g, or t
  misc_feature (174)..(174): n is a, c, g, or t
  misc_feature (178)..(178): n is a, c, g, or t
  misc_feature (182)..(182): n is a, c, g, or t
  misc_feature (184)..(185): n is a, c, g, or t
  misc_feature (188)..(188): n is a, c, g, or t
  misc_feature (191)..(192): n is a, c, g, or t
  misc_feature (200)..(201): n is a, c, g, or t
  misc_feature (207)..(209): n is a, c, g, or t
  misc_feature (211)..(212): n is a, c, g, or t
  misc_feature (214)..(218): n is a, c, g, or t
  misc_feature (221)..(221): n is a, c, g, or t
  misc_feature (223)..(223): n is a, c, g, or t
  misc_feature (225)..(225): n is a, c, g, or t
  misc_feature (236)..(236): n is a, c, g, or t
  misc_feature (241)..(241): n is a, c, g, or t
  misc_feature (243)..(244): n is a, c, g, or t
  misc_feature (249)..(250): n is a, c, g, or t
  misc_feature (252)..(252): n is a, c, g, or t
  misc_feature (256)..(256): n is a, c, g, or t
  misc_feature (259)..(259): n is a, c, g, or t
  misc_feature (265)..(266): n is a, c, g, or t
  misc_feature (274)..(276): n is a, c, g, or t
  misc_feature (278)..(278): n is a, c, g, or t
  misc_feature (281)..(282): n is a, c, g, or t
  misc_feature (284)..(284): n is a, c, g, or t
  misc_feature (288)..(288): n is a, c, g, or t
  misc_feature (290)..(290): n is a, c, g, or t
  misc_feature (292)..(293): n is a, c, g, or t
  misc_feature (300)..(300): n is a, c, g, or t
  misc_feature (308)..(308): n is a, c, g, or t
  misc_feature (311)..(311): n is a, c, g, or t
  misc_feature (316)..(316): n is a, c, g, or t
  misc_feature (322)..(322): n is a, c, g, or t
  misc_feature (324)..(324): n is a, c, g, or t
  misc_feature (326)..(326): n is a, c, g, or t
  misc_feature (336)..(336): n is a, c, g, or t
  misc_feature (339)..(339): n is a, c, g, or t
  misc_feature (345)..(346): n is a, c, g, or t
  misc_feature (350)..(350): n is a, c, g, or t
  misc_feature (353)..(354): n is a, c, g, or t
  misc_feature (357)..(357): n is a, c, g, or t
  misc_feature (361)..(361): n is a, c, g, or t
  misc_feature (365)..(365): n is a, c, g, or t
  misc_feature (373)..(373): n is a, c, g, or t
  misc_feature (376)..(377): n is a, c, g, or t
  misc_feature (379)..(379): n is a, c, g, or t
  misc_feature (382)..(382): n is a, c, g, or t
  misc_feature (386)..(386): n is a, c, g, or t
  misc_feature (388)..(389): n is a, c, g, or t
  misc_feature (395)..(396): n is a, c, g, or t
  misc_feature (400)..(403): n is a, c, g, or t
  misc_feature (405)..(406): n is a, c, g, or t
  misc_feature (410)..(410): n is a, c, g, or t
  misc_feature (412)..(412): n is a, c, g, or t
  misc_feature (417)..(417): n is a, c, g, or t
  misc_feature (425)..(426): n is a, c, g, or t
  misc_feature (429)..(430): n is a, c, g, or t
  misc_feature (432)..(432): n is a, c, g, or t
  misc_feature (437)..(437): n is a, c, g, or t
  misc_feature (440)..(441): n is a, c, g, or t
  misc_feature (444)..(444): n is a, c, g, or t
  misc_feature (449)..(450): n is a, c, g, or t
  misc_feature (454)..(454): n is a, c, g, or t
  misc_feature (458)..(458): n is a, c, g, or t
  misc_feature (463)..(463): n is a, c, g, or t
  misc_feature (469)..(470): n is a, c, g, or t
  misc_feature (472)..(472): n is a, c, g, or t
  misc_feature (474)..(474): n is a, c, g, or t
  misc_feature (479)..(479): n is a, c, g, or t
  misc_feature (485)..(487): n is a, c, g, or t
  misc_feature (489)..(489): n is a, c, g, or t
  misc_feature (491)..(491): n is a, c, g, or t
  misc_feature (498)..(498): n is a, c, g, or t
  misc_feature (505)..(505): n is a, c, g, or t
  misc_feature (508)..(508): n is a, c, g, or t
  misc_feature (515)..(515): n is a, c, g, or t
  misc_feature (518)..(518): n is a, c, g, or t
  misc_feature (523)..(523): n is a, c, g, or t
  misc_feature (529)..(529): n is a, c, g, or t
  misc_feature (531)..(532): n is a, c, g, or t
  misc_feature (543)..(545): n is a, c, g, or t
  misc_feature (548)..(551): n is a, c, g, or t
  misc_feature (556)..(556): n is a, c, g, or t
  misc_feature (566)..(569): n is a, c, g, or t
  misc_feature (571)..(572): n is a, c, g, or t
  misc_feature (580)..(581): n is a, c, g, or t
  misc_feature (584)..(584): n is a, c, g, or t
  misc_feature (586)..(586): n is a, c, g, or t
  misc_feature (589)..(589): n is a, c, g, or t
  misc_feature (591)..(591): n is a, c, g, or t
  misc_feature (593)..(594): n is a, c, g, or t
  misc_feature (602)..(602): n is a, c, g, or t
  misc_feature (609)..(610): n is a, c, g, or t
  misc_feature (612)..(612): n is a, c, g, or t
  misc_feature (614)..(614): n is a, c, g, or t
  misc_feature (619)..(619): n is a, c, g, or t
  misc_feature (621)..(623): n is a, c, g, or t
  misc_feature (627)..(627): n is a, c, g, or t
  misc_feature (638)..(638): n is a, c, g, or t
  misc_feature (646)..(647): n is a, c, g, or t
  misc_feature (650)..(650): n is a, c, g, or t
  misc_feature (652)..(658): n is a, c, g, or t
  misc_feature (662)..(662): n is a, c, g, or t
  misc_feature (667)..(669): n is a, c, g, or t
  misc_feature (671)..(671): n is a, c, g, or t
  misc_feature (678)..(679): n is a, c, g, or t
  misc_feature (681)..(682): n is a, c, g, or t
  misc_feature (686)..(686): n is a, c, g, or t
  misc_feature (692)..(692): n is a, c, g, or t
  misc_feature (708)..(709): n is a, c, g, or t
  misc_feature (714)..(714): n is a, c, g, or t
  misc_feature (716)..(716): n is a, c, g, or t
  misc_feature (718)..(718): n is a, c, g, or t
  misc_feature (720)..(720): n is a, c, g, or t
  misc_feature (722)..(723): n is a, c, g, or t
  misc_feature (727)..(728): n is a, c, g, or t
  misc_feature (730)..(731): n is a, c, g, or t
  misc_feature (734)..(734): n is a, c, g, or t
  misc_feature (736)..(736): n is a, c, g, or t
  misc_feature (738)..(742): n is a, c, g, or t
  misc_feature (744)..(744): n is a, c, g, or t
  misc_feature (754)..(754): n is a, c, g, or t
  misc_feature (756)..(757): n is a, c, g, or t
  misc_feature (759)..(759): n is a, c, g, or t
  misc_feature (761)..(761): n is a, c, g, or t
  misc_feature (764)..(764): n is a, c, g, or t
  misc_feature (770)..(773): n is a, c, g, or t
  misc_feature (777)..(778): n is a, c, g, or t
  misc_feature (780)..(780): n is a, c, g, or t
  misc_feature (782)..(783): n is a, c, g, or t
  misc_feature (787)..(788): n is a, c, g, or t
  misc_feature (790)..(790): n is a, c, g, or t
  misc_feature (796)..(796): n is a, c, g, or t
  misc_feature (799)..(799): n is a, c, g, or t
  misc_feature (802)..(802): n is a, c, g, or t
  misc_feature (804)..(804): n is a, c, g, or t
  misc_feature (806)..(806): n is a, c, g, or t
  misc_feature (810)..(810): n is a, c, g, or t
  misc_feature (814)..(815): n is a, c, g, or t
  misc_feature (818)..(818): n is a, c, g, or t
  misc_feature (821)..(821): n is a, c, g, or t
  misc_feature (826)..(826): n is a, c, g, or t
  misc_feature (828)..(829): n is a, c, g, or t
  misc_feature (831)..(832): n is a, c, g, or t
  misc_feature (835)..(835): n is a, c, g, or t
  misc_feature (840)..(840): n is a, c, g, or t
  misc_feature (849)..(849): n is a, c, g, or t
  misc_feature (853)..(853): n is a, c, g, or t
  misc_feature (856)..(856): n is a, c, g, or t
  misc_feature (860)..(860): n is a, c, g, or t
  misc_feature (867)..(867): n is a, c, g, or t
  misc_feature (870)..(870): n is a, c, g, or t
  misc_feature (872)..(872): n is a, c, g, or t
  misc_feature (874)..(874): n is a, c, g, or t
  misc_feature (876)..(876): n is a, c, g, or t
  misc_feature (880)..(881): n is a, c, g, or t
  misc_feature (884)..(884): n is a, c, g, or t
  misc_feature (886)..(886): n is a, c, g, or t
  misc_feature (888)..(888): n is a, c, g, or t
  misc_feature (894)..(895): n is a, c, g, or t
  misc_feature (901)..(901): n is a, c, g, or t
  misc_feature (904)..(904): n is a, c, g, or t
  misc_feature (911)..(911): n is a, c, g, or t
  misc_feature (913)..(913): n is a, c, g, or t
  misc_feature (916)..(917): n is a, c, g, or t
  misc_feature (920)..(920): n is a, c, g, or t
  misc_feature (923)..(924): n is a, c, g, or t
  misc_feature (926)..(927): n is a, c, g, or t
  misc_feature (930)..(930): n is a, c, g, or t
  misc_feature (932)..(932): n is a, c, g, or t
  misc_feature (934)..(934): n is a, c, g, or t
  misc_feature (936)..(938): n is a, c, g, or t
  misc_feature (940)..(940): n is a, c, g, or t
  misc_feature (944)..(944): n is a, c, g, or t
  misc_feature (947)..(947): n is a, c, g, or t
  misc_feature (949)..(950): n is a, c, g, or t
  misc_feature (959)..(959): n is a, c, g, or t
  misc_feature (965)..(966): n is a, c, g, or t
  misc_feature (969)..(969): n is a, c, g, or t
  misc_feature (971)..(971): n is a, c, g, or t
  misc_feature (977)..(977): n is a, c, g, or t
  misc_feature (980)..(980): n is a, c, g, or t
  misc_feature (983)..(983): n is a, c, g, or t
  misc_feature (987)..(989): n is a, c, g, or t
  misc_feature (991)..(992): n is a, c, g, or t
  misc_feature (995)..(998): n is a, c, g, or t
  misc_feature (1004)..(1005): n is a, c, g, or t
  misc_feature (1008)..(1008): n is a, c, g, or t
  misc_feature (1010)..(1010): n is a, c, g, or t
  misc_feature (1013)..(1013): n is a, c, g, or t
  misc_feature (1015)..(1015): n is a, c, g, or t
  misc_feature (1019)..(1021): n is a, c, g, or t
  misc_feature (1023)..(1025): n is a, c, g, or t
  misc_feature (1031)..(1031): n is a, c, g, or t
  misc_feature (1035)..(1036): n is a, c, g, or t
  misc_feature (1042)..(1042): n is a, c, g, or t
  misc_feature (1047)..(1049): n is a, c, g, or t
  misc_feature (1051)..(1052): n is a, c, g, or t
  misc_feature (1054)..(1057): n is a, c, g, or t
  misc_feature (1060)..(1060): n is a, c, g, or t
  misc_feature (1072)..(1072): n is a, c, g, or t
  misc_feature (1075)..(1075): n is a, c, g, or t
  misc_feature (1084)..(1084): n is a, c, g, or t
  misc_feature (1092)..(1092): n is a, c, g, or t
  misc_feature (1097)..(1099): n is a, c, g, or t
  misc_feature (1101)..(1102): n is a, c, g, or t
  misc_feature (1107)..(1107): n is a, c, g, or t
  misc_feature (1109)..(1109): n is a, c, g, or t
  misc_feature (1115)..(1116): n is a, c, g, or t
  misc_feature (1122)..(1122): n is a, c, g, or t
  misc_feature (1124)..(1124): n is a, c, g, or t
  misc_feature (1130)..(1130): n is a, c, g, or t
  misc_feature (1133)..(1133): n is a, c, g, or t
  misc_feature (1135)..(1136): n is a, c, g, or t
  misc_feature (1138)..(1138): n is a, c, g, or t
  misc_feature (1141)..(1141): n is a, c, g, or t
  misc_feature (1146)..(1146): n is a, c, g, or t
  misc_feature (1148)..(1149): n is a, c, g, or t
  misc_feature (1151)..(1152): n is a, c, g, or t
  misc_feature (1155)..(1156): n is a, c, g, or t
  misc_feature (1160)..(1160): n is a, c, g, or t
  misc_feature (1169)..(1169): n is a, c, g, or t
  misc_feature (1173)..(1173): n is a, c, g, or t
  misc_feature (1177)..(1178): n is a, c, g, or t
  misc_feature (1180)..(1181): n is a, c, g, or t
  misc_feature (1187)..(1188): n is a, c, g, or t
  misc_feature (1190)..(1190): n is a, c, g, or t
  misc_feature (1193)..(1195): n is a, c, g, or t
  misc_feature (1197)..(1197): n is a, c, g, or t
  misc_feature (1207)..(1207): n is a, c, g, or t
  misc_feature (1209)..(1209): n is a, c, g, or t
  misc_feature (1211)..(1212): n is a, c, g, or t
  misc_feature (1215)..(1215): n is a, c, g, or t
  misc_feature (1219)..(1219): n is a, c, g, or t
  misc_feature (1223)..(1223): n is a, c, g, or t
  misc_feature (1225)..(1225): n is a, c, g, or t
  misc_feature (1229)..(1229): n is a, c, g, or t
  misc_feature (1233)..(1233): n is a, c, g, or t
  misc_feature (1236)..(1240): n is a, c, g, or t
  misc_feature (1248)..(1248): n is a, c, g, or t
  misc_feature (1252)..(1254): n is a, c, g, or t
  misc_feature (1263)..(1264): n is a, c, g, or t
  misc_feature (1269)..(1271): n is a, c, g, or t
  misc_feature (1274)..(1275): n is a, c, g, or t
  misc_feature (1277)..(1277): n is a, c, g, or t
  misc_feature (1280)..(1280): n is a, c, g, or t
  misc_feature (1284)..(1286): n is a, c, g, or t
  misc_feature (1288)..(1288): n is a, c, g, or t
  misc_feature (1290)..(1290): n is a, c, g, or t
  misc_feature (1296)..(1296): n is a, c, g, or t
  misc_feature (1300)..(1300): n is a, c, g, or t
  misc_feature (1302)..(1302): n is a, c, g, or t
  misc_feature (1315)..(1316): n is a, c, g, or t
  misc_feature (1318)..(1318): n is a, c, g, or t
  misc_feature (1320)..(1321): n is a, c, g, or t
  misc_feature (1323)..(1324): n is a, c, g, or t
  misc_feature (1330)..(1332): n is a, c, g, or t
  misc_feature (1335)..(1335): n is a, c, g, or t
  misc_feature (1337)..(1337): n is a, c, g, or t
  misc_feature (1341)..(1341): n is a, c, g, or t
  misc_feature (1347)..(1348): n is a, c, g, or t
  misc_feature (1361)..(1361): n is a, c, g, or t
  misc_feature (1363)..(1364): n is a, c, g, or t
  misc_feature (1366)..(1366): n is a, c, g, or t
  misc_feature (1368)..(1368): n is a, c, g, or t
  misc_feature (1371)..(1371): n is a, c, g, or t
  misc_feature (1373)..(1373): n is a, c, g, or t
  misc_feature (1375)..(1375): n is a, c, g, or t
  misc_feature (1377)..(1377): n is a, c, g, or t
  misc_feature (1379)..(1379): n is a, c, g, or t
  misc_feature (1384)..(1385): n is a, c, g, or t
  misc_feature (1389)..(1389): n is a, c, g, or t
  misc_feature (1392)..(1392): n is a, c, g, or t
  misc_feature (1395)..(1395): n is a, c, g, or t
  misc_feature (1398)..(1400): n is a, c, g, or t
  misc_feature (1404)..(1410): n is a, c, g, or t
  misc_feature (1416)..(1418): n is a, c, g, or t
  misc_feature (1420)..(1423): n is a, c, g, or t
  misc_feature (1429)..(1429): n is a, c, g, or t
  misc_feature (1432)..(1432): n is a, c, g, or t
  misc_feature (1435)..(1439): n is a, c, g, or t
  misc_feature (1443)..(1445): n is a, c, g, or t
  misc_feature (1448)..(1448): n is a, c, g, or t
  misc_feature (1451)..(1457): n is a, c, g, or t
  misc_feature (1461)..(1461): n is a, c, g, or t
  misc_feature (1463)..(1476): n is a, c, g, or t
  misc_feature (1478)..(1481): n is a, c, g, or t
  misc_feature (1483)..(1490): n is a, c, g, or t
  misc_feature (1493)..(1499): n is a, c, g, or t
  misc_feature (1501)..(1501): n is a, c, g, or t
  misc_feature (1503)..(1503): n is a, c, g, or t
  misc_feature (1505)..(1505): n is a, c, g, or t
  misc_feature (1509)..(1510): n is a, c, g, or t
  misc_feature (1514)..(1515): n is a, c, g, or t
  misc_feature (1517)..(1517): n is a, c, g, or t
  misc_feature (1519)..(1521): n is a, c, g, or t
  misc_feature (1523)..(1524): n is a, c, g, or t
  misc_feature (1526)..(1543): n is a, c, g, or t
  misc_feature (1545)..(1547): n is a, c, g, or t
  misc_feature (1549)..(1552): n is a, c, g, or t
  misc_feature (1554)..(1554): n is a, c, g, or t
  misc_feature (1556)..(1556): n is a, c, g, or t
  misc_feature (1558)..(1558): n is a, c, g, or t
  misc_feature (1560)..(1566): n is a, c, g, or t
  misc_feature (1568)..(1568): n is a, c, g, or t
  misc_feature (1570)..(1570): n is a, c, g, or t
  misc_feature (1572)..(1572): n is a, c, g, or t
  misc_feature (1574)..(1577): n is a, c, g, or t
  misc_feature (1579)..(1582): n is a, c, g, or t
  misc_feature (1584)..(1606): n is a, c, g, or t
  misc_feature (1608)..(1616): n is a, c, g, or t
  misc_feature (1618)..(1621): n is a, c, g, or t
  misc_feature (1623)..(1623): n is a, c, g, or t
  misc_feature (1626)..(1632): n is a, c, g, or t
  misc_feature (1634)..(1634): n is a, c, g, or t
  misc_feature (1636)..(1636): n is a, c, g, or t
  misc_feature (1640)..(1640): n is a, c, g, or t
  misc_feature (1642)..(1642): n is a, c, g, or t
  misc_feature (1650)..(1650): n is a, c, g, or t
  misc_feature (1652)..(1652): n is a, c, g, or t
  misc_feature (1654)..(1674): n is a, c, g, or t
  misc_feature (1676)..(1680): n is a, c, g, or t
  misc_feature (1682)..(1684): n is a, c, g, or t
  misc_feature (1686)..(1690): n is a, c, g, or t
  misc_feature (1693)..(1703): n is a, c, g, or t
  misc_feature (1708)..(1712): n is a, c, g, or t
  misc_feature (1714)..(1714): n is a, c, g, or t
  misc_feature (1716)..(1726): n is a, c, g, or t
  misc_feature (1728)..(1739): n is a, c, g, or t
  misc_feature (1742)..(1748): n is a, c, g, or t
  misc_feature (1750)..(1757): n is a, c, g, or t
  misc_feature (1760)..(1761): n is a, c, g, or t
  misc_feature (1763)..(1764): n is a, c, g, or t
  misc_feature (1767)..(1770): n is a, c, g, or t
  misc_feature (1775)..(1779): n is a, c, g, or t
  misc_feature (1783)..(1791): n is a, c, g, or t
  misc_feature (1794)..(1797): n is a, c, g, or t
  misc_feature (1799)..(1800): n is a, c, g, or t
  misc_feature (1802)..(1812): n is a, c, g, or t
  misc_feature (1814)..(1823): n is a, c, g, or t
  misc_feature (1827)..(1827): n is a, c, g, or t
  misc_feature (1830)..(1830): n is a, c, g, or t
  misc_feature (1833)..(1837): n is a, c, g, or t
  misc_feature (1841)..(1846): n is a, c, g, or t
  misc_feature (1849)..(1857): n is a, c, g, or t
  misc_feature (1860)..(1860): n is a, c, g, or t
  misc_feature (1862)..(1862): n is a, c, g, or t
  misc_feature (1864)..(1866): n is a, c, g, or t
  misc_feature (1869)..(1885): n is a, c, g, or t
  misc_feature (1888)..(1888): n is a, c, g, or t
  misc_feature (1921)..(1921): n is a, c, g, or t
  misc_feature (1923)..(1924): n is a, c, g, or t
  misc_feature (1926)..(1927): n is a, c, g, or t
  misc_feature (1929)..(1935): n is a, c, g, or t
  misc_feature (1937)..(1938): n is a, c, g, or t
  misc_feature (1940)..(1945): n is a, c, g, or t
  misc_feature (1949)..(1952): n is a, c, g, or t
  misc_feature (1954)..(1954): n is a, c, g, or t
  misc_feature (1958)..(1958): n is a, c, g, or t
  misc_feature (1961)..(1961): n is a, c, g, or t
  misc_feature (1964)..(1968): n is a, c, g, or t
  misc_feature (1972)..(1977): n is a, c, g, or t
  misc_feature (1980)..(1984): n is a, c, g, or t
  misc_feature (1987)..(1988): n is a, c, g, or t
  misc_feature (1990)..(1996): n is a, c, g, or t
  misc_feature (1998)..(2003): n is a, c, g, or t
  misc_feature (2005)..(2012): n is a, c, g, or t
  misc_feature (2014)..(2018): n is a, c, g, or t
tgnntnnnatnaaanccntnagcanccngnannnctctcacantntncaanntgtcccgaaattttnnttnngcatnnnttnttntananacttcngncnnntcntcgcanatnattttantcanatnttcctntgngacnnnancatttanaaattnnaccatntccntntcncttncatntnnctngtnnatatgtcnnacaaannncnnannnnnacntntnttaatgccaantaatntnntatcnncntcanatntgccannatatattnnntnaanntnatcngngnncattgtnatcccganttnttttngaccantnanactcatatgnatntaaacnntatntannccntaantttnagcctgantcnnanaanttcnanntatatnntttnnnntnntttntnctacntaaatcgnnctnncngtcgnatnnatntatannccanattnacaancggccnngntnttatnttaatnnnancntgccctnctctctncanatttganatnatatntatcanannattctttgacnnnatnnnntattnatccaaaatnnnntnncacagctnnttnancantnanncaacattntgtgaanntntnaagantnnnatgntaataattttntttacacnncantnnnnnnnacgnctgtnnnancactcannannactnatcttnaagcctttcaatcaannttccnangnantnnttcnncnnttntntnnnnngngcatattcangnncntnaanttcccnnnncgcnntnannagcnnanacaccnttnccntngnaatntatnnatnctnttatncnntnnttnaatcngacctctcncganaanaaanatctctncantnantncaannttnancngtcatnnattcgnatnaacgttnangcnnaangannannccntntngnnnanacantangnnctgctaaanaatttnnatncnagcttncanganaatnnncnnatnnnntgattnntancnacntntttnnnannnaattanaatnnactctncatcnnncnntnnnncanaatatgatgatngtntatccattnccatgctntttcnnnannccctncnacgacnngagcancnatatcnaantnntnaanttttncnntnnttnnagtntttaatccnaccncccnngnnaagaannanctnnntngtcatagctncntnnaangatnttcntntttnaatnccnnnnncccccaanggannngcctgcctnngcaannnctnncncanattnnncntntttttnactncnctcccacaagagnngngnntnntattannnatncncgangttatnncgataaagatatntnnancnacncncncncnagagnngcgncanatnatnnntttnnnnnnnttcatnnncnnnntatttnaanccnnnnncccnnnagnggnnnnnnnagtncnnnnnnnnnnnnnncnnnnannnnnnnnatnnnnnnncncncncccnngagnngngnnncnntnnnnnnnnnnnnnnnnnngnnntnnnntntntntnnnnnnncncncncnnnngnnnngnnnnnnnnnnnnnnnnnnnnnnnannnnnnnnngnnnnanttnnnnnnncncncccncnagaggagngncnnnnnnnnnnnnnnnnnnnnntnnnnncnnntnnnnnttnnnnnnnnnnnccccnnnnngngnnnnnnnnnnntnnnnnnnnnnnngcnnnnnnnannnnnnnnttnnannccnnnnccccnnnnngggnnnnnnnnntannnntnntnnnnnnnnnnntnnnnnnnnnntttnaanccnnnnncccnnnnnnggnnnnnnnnntanangnnntannnnnnnnnnnnnnnnnaanatttcaatccacgctcccacgagaggagcgacntnntnngnnnnnnntnntnnnnnnatannnnantttnaanccnnnnncccnnnnnnggnnnnnctnntnnnnnnngnnnnnntnnnnnnnntnnnnntatttcaatccacgctcccacgagaggagcgacagcaatattgcacaaaaaatttgtttatttttatacaataccgacaataaatatataataagataaataacaagtaaaaccaaaaacctattattcattttattgtacaaatttacaagtaatttcaggtgcgagacaaccggtacattcatgtttacttatctttcgcaccacattttataatatcaatgtctgatcagcaggaatcccacggtcaacaccaacatgttctatcttcgtctgataacgatttcctaaataatagaatctgagactatccacatctttatcaataagatccgttaatatggcctttagcatcacacattgagcattatctagtatacattcaaacacagaattctgaactcttcgcccataatttacacattgtttagctacttttctcaacctggtttttccttcagcagtttcagtattcacatcatatgtaatcaatacaagcacgccatcacctcatttccataaaaatacagggtactcatccaaatctccccttaaatatcttgccaacagcattgcctgtacaaatggaaccattccccattccaccttttcattaagatatgggtgtgtaataatctcctttttcttgttttgccattctgatagtaattttttacgaatatctgtatccatcaatacagcaccgttttctttttttgtaaaactcttgccatttacaatctttttattaatcaatgataaaacaaatctatcagccatgactgctcgcaattcttctataagatctaatgaaagtgatactctaccgggacgttccgtgtgcatgtaaccaacatagggatctaaccctacaacctctagcgctgatgtaatttgagttgtaagcaatgtatacgtaaacgacaacattgcatttacattatcaagaggcggacgccgatttctcccttgaaagaaaaaatctttcttttgttgtaaaatcaactcatcaaatacgccaaaatatatacttgctgcttcaccttcatatcctcttaactgattcatagactgtgaattttggatataatcaagaaattctttcagttttatagatgctttttttaccttatccacatctatctgcattgaatgatctctaattgctctttctagaacccatcttgaattatacacttttccaagaatacagttttttgcgatttccaggcactttatatcttcactactgctttggaattgttgtttccttagcacgacattccccttaactttgcctgaaactcttgcaagaaattttccctgtggtgtcagataacaaagagaaatatttctatccgcacaagctcccattaatgccggacttgttcctctatatccaaatgaaattattgcttcgagattgtgtaaaggtaatctgcctatttcatttttatcatcatatacaacaacattttctccatccaaccccagataactattttccgatgtaacatacaatgtattcaataatttcttcataacgtttcccccagcatcttattgatatacgatttcaccgaaccacttttatcaatctttggcatacaaatatcttttaaagagcaagatacacaccttttcgacgttttgaccttaggtgtataatttcgatcataataatcatgcatttctccaaatatttttttcacttcatcccgaagttcatctgtaaacactatcggtttgcgtcttcttgtctcaccataaaatatagcaccctccgttatttttgttgaaaacatttcttccagacacatagcctgcgccattagctgaagttcatcttcgtttgacgctttgggtttcccctttttgtactcaattggatataatgaataggttccacgatgtccatagagcttcactccatcttcacatttgtgaaattcaacaatatcacactccccactcacacccat

SEQ ID NO: 1120 - DNA, 4000 bp, Escherichia coli
  misc_feature (2)..(2): n is a, c, g, or t
  misc_feature (5)..(5): n is a, c, g, or t
  misc_feature (10)..(13): n is a, c, g, or t
  misc_feature (15)..(18): n is a, c, g, or t
  misc_feature (21)..(22): n is a, c, g, or t
  misc_feature (24)..(24): n is a, c, g, or t
  misc_feature (26)..(32): n is a, c, g, or t
  misc_feature (36)..(36): n is a, c, g, or t
  misc_feature (39)..(39): n is a, c, g, or t
  misc_feature (41)..(41): n is a, c, g, or t
  misc_feature (43)..(47): n is a, c, g, or t
  misc_feature (49)..(53): n is a, c, g, or t
  misc_feature (56)..(58): n is a, c, g, or t
  misc_feature (61)..(61): n is a, c, g, or t
  misc_feature (63)..(64): n is a, c, g, or t
  misc_feature (67)..(67): n is a, c, g, or t
  misc_feature (69)..(70): n is a, c, g, or t
  misc_feature (72)..(75): n is a, c, g, or t
  misc_feature (78)..(78): n is a, c, g, or t
  misc_feature (81)..(81): n is a, c, g, or t
  misc_feature (83)..(85): n is a, c, g, or t
  misc_feature (88)..(88): n is a, c, g, or t
  misc_feature (91)..(98): n is a, c, g, or t
  misc_feature (102)..(107): n is a, c, g, or t
  misc_feature (110)..(111): n is a, c, g, or t
  misc_feature (114)..(114): n is a, c, g, or t
  misc_feature (120)..(120): n is a, c, g, or t
  misc_feature (122)..(122): n is a, c, g, or t
  misc_feature (126)..(126): n is a, c, g, or t
  misc_feature (128)..(128): n is a, c, g, or t
  misc_feature (132)..(137): n is a, c, g, or t
  misc_feature (139)..(139): n is a, c, g, or t
  misc_feature (141)..(144): n is a, c, g, or t
  misc_feature (146)..(153): n is a, c, g, or t
  misc_feature (156)..(157): n is a, c, g, or t
  misc_feature (159)..(162): n is a, c, g, or t
  misc_feature (164)..(166): n is a, c, g, or t
  misc_feature (168)..(168): n is a, c, g, or t
  misc_feature (170)..(170): n is a, c, g, or t
  misc_feature (173)..(173): n is a, c, g, or t
  misc_feature (175)..(177): n is a, c, g, or t
  misc_feature (179)..(180): n is a, c, g, or t
  misc_feature (182)..(182): n is a, c, g, or t
  misc_feature (184)..(195): n is a, c, g, or t
  misc_feature (198)..(200): n is a, c, g, or t
  misc_feature (203)..(212): n is a, c, g, or t
  misc_feature (214)..(214): n is a, c, g, or t
  misc_feature (216)..(216): n is a, c, g, or t
  misc_feature (218)..(220): n is a, c, g, or t
  misc_feature (225)..(225): n is a, c, g, or t
  misc_feature (229)..(229): n is a, c, g, or t
  misc_feature (233)..(233): n is a, c, g, or t
  misc_feature (238)..(238): n is a, c, g, or t
  misc_feature (240)..(244): n is a, c, g, or t
  misc_feature (246)..(257): n is a, c, g, or t
  misc_feature (261)..(261): n is a, c, g, or t
  misc_feature (263)..(267): n is a, c, g, or t
  misc_feature (270)..(273): n is a, c, g, or t
  misc_feature (276)..(277): n is a, c, g, or t
  misc_feature (281)..(281): n is a, c, g, or t
  misc_feature (284)..(284): n is a, c, g, or t
  misc_feature (289)..(289): n is a, c, g, or t
  misc_feature (292)..(292): n is a, c, g, or t
  misc_feature (295)..(298): n is a, c, g, or t
  misc_feature (300)..(300): n is a, c, g, or t
  misc_feature (302)..(302): n is a, c, g, or t
  misc_feature (304)..(306): n is a, c, g, or t
  misc_feature (308)..(310): n is a, c, g, or t
  misc_feature (312)..(316): n is a, c, g, or t
  misc_feature (319)..(319): n is a, c, g, or t
  misc_feature (321)..(321): n is a, c, g, or t
  misc_feature (326)..(331): n is a, c, g, or t
  misc_feature (334)..(336): n is a, c, g, or t
  misc_feature (338)..(342): n is a, c, g, or t
  misc_feature (345)..(346): n is a, c, g, or t
  misc_feature (348)..(353): n is a, c, g, or t
  misc_feature (355)..(356): n is a, c, g, or t
  misc_feature (358)..(358): n is a, c, g, or t
  misc_feature (360)..(363): n is a, c, g, or t
  misc_feature (365)..(365): n is a, c, g, or t
  misc_feature (368)..(368): n is a, c, g, or t
  misc_feature (370)..(370): n is a, c, g, or t
  misc_feature (372)..(372): n is a, c, g, or t
  misc_feature (376)..(385): n is a, c, g, or t
  misc_feature (387)..(388): n is a, c, g, or t
  misc_feature (393)..(396): n is a, c, g, or t
  misc_feature (400)..(400): n is a, c, g, or t
  misc_feature (403)..(403): n is a, c, g, or t
  misc_feature (407)..(408): n is a, c, g, or t
  misc_feature (411)..(416): n is a, c, g, or t
  misc_feature (418)..(423): n is a, c, g, or t
  misc_feature (426)..(427): n is a, c, g, or t
  misc_feature (1095)..(1095): n is a, c, g, or t
  misc_feature (1098)..(1098): n is a, c, g, or t
  misc_feature (1257)..(1257): n is a, c, g, or t
  misc_feature (1854)..(1854): n is a, c, g, or t
  misc_feature (1991)..(1991): n is a, c, g, or t
  misc_feature (2320)..(2320): n is a, c, g, or t
  misc_feature (2797)..(2797): n is a, c, g, or t
  misc_feature (2977)..(2977): n is a, c, g, or t
  misc_feature (3130)..(3130): n is a, c, g, or t
  misc_feature (3154)..(3154): n is a, c, g, or t
  misc_feature (3163)..(3163): n is a, c, g, or t
  misc_feature (3198)..(3198): n is a, c, g, or t
  misc_feature (3313)..(3313): n is a, c, g, or t
gnttnaaaannnntnnnnggnntngnnnnnnntttnggntngnnnnnannnnnttnnnttntnnaananntnnnnttnttncnnnaanccnnnnnnnnaaannnnnnggnnttntttttnantttngnaaannnnnngncnnnntnnnnnnnnaanncnnnnannnantnaanannnanngnannnnnnnnnnnnttnnnccnnnnnnnnnnancnannnaaaanaaanaaanaaaanannnnncnnnnnnnnnnnnaaangnnnnnttnnnnggnntttnaanaaaanaanaannnntnangnnnannncnnnnnccntnaaaannnnnnaannngnnnnnaannannnnnnanncntnnnnanttnantnaaannnnnnnnnnannttttnnnnaaanaanaaannccnnnnnntnnnnnnggnnttttttttgtagcgaggagcagacttgaactgccgacctctgggttatgaatccagtgctctaaccagctgagctacctcgccaaatgttactggttgtgctttgttatgcattatgtataccaaagcggctgcaaagataaaaacaaaataatgtagggcaaacaatccaccattttttattctattttatttctgttaaaatttctgaagaaataaaccgtacatttgtcgctcattaagaataggttcttgcctattcttttaacattatttatgtcatttcaatcactagggctttctgatgccttgcttaaagcaattagcaaaaaaggatacactacaccaagtccaattcaacaaaaagcaatccccaaaatacttgacggtagagacgttttagcctctgctcaaactggaacaggaaaaactgctggctttacattaccaatgctacaacagtttttagctaaacccggccagcatcaaggaagaagaaaaataaaatctttaatcttaactccaactagagaacttgctgcgcaggtacttgaagatgttaagacctactcagagtttacagatcttaaaagtacggtagtatttggtggcgttaacgccaatcctcaaataaaaacactgcgccaaggcgtggatatattggtagcnacncctggtaggttactagatttgcacaatcaaggtgttattaatttttctggaattcagttcttggttttggatgaggcagacagaatgctagacatgggttttttaagagacataaaaagaattttagcgctgttgccaagtaaacgccaaaacctgttnttttctgcaactttttcaaaagaaatcaaaacccttgcaaatagctttttaaataatcctgctatggtggaggcagctccacaaaatacaactgcagagaaagtagatcaaataatttacagaactaacaaaggcttaaaaactaatcttgtaatcaaactcataacggaaggaaactggaatcaagtattggtatttactagaactaaacatggcgccaacaagctatcacaaaaattagaaaaagcaaacattaaagctgcggccatacacggtaataaaagtcagggagcaagaacaagagcactcgctggttttaaagagggtagcatatctgttttggtagctacagatatcgcagcacgcgggcttgatattccattgcttcctcatgtaataaactttgagttgcctaacataccggaagattatgttcacagaataggacgtacaggtagggcgggagccagtggaaaagcaatttccatagtaagcgttgatgaatatgcttacgcaagaggtatagaaaagttgcttaacattaagcttgaaagcactgtaatacctggttttgaaccaaccgaatcactacatgangtagaagctaaaaaagcagaaaacaaagctgctcataatagaggaagacgcaacaataatcgttctcaaccaagttcatcttctcaagatggtgccaaaaagagacgtaaatttagaagatagtatactgtcatagnaataagaatattctattactgccagatattatttcttaggcgtaaataataggtttctttcttttggtttttatatttaatatctatattggactaactaacaaacaacaatggaagaaaaaataaaatatgaaatggaaattccaatacaagtttccccttcattattgtacacgtatatatctacaccatctggactctctgaatggtatgcagataacgtaaactctagaggagaaaattttgaatttatttgggatggtgccgaagaaaaagctgttttgctaacaaaaaagaacgccgaacgaattaaatttaggtgggatgtngatgcaggtacagattattattttgaattgcgtattcaagtagatgagattaccaaagatgtttcactgatgatcacagactttgctgaggatggtgaagttgaagaggggaaaatgctttgggaaaacatggtttctgagctaaaacaaatattgggatcaacctaaaaaataaatatagatactcgtatctttgtgccactctataataaattagagtggcatttttttatgataaatttaaatggtaccattctcgaaaagcacaaggcagctatatctatttctaatagagggttaaattatggcgacgcgctttttgaaaccctccgcgttagcgggggtaaaatttatttttgggaggatcattactttaggctaatggcctctatgcgtatattacgcatggaaattcctatgaattttactcaagaatacttagagaagcaaattttagcaaccatagaggctaacggngctataactggggcctatagagttaaaattcttgtatggcgccaagaaggtggtttttatagcccaacaattaacgaaattcaattttccgtagcgtgtagtgatttacaaaatcctttttacttattaaggcaaaatcagtacgaagtagaactatttaaggatcattacattacatcnggactactctcaacattaaaaacaaataataaagtcataaacgttttgggcagtatttatgctaaagaaaataagtatgataattgcttacttttgaatgaaaaaaagcaaattgtagaagccttaaacggaaatatttttttagtaaaaggngatactataaaaaccccaccactnaaagatggntgtttaaaaggcataatgcgtaaacaaattctcgncatcctggctgatttgtacgattatgatgtgcaagaagtatctatatcaccttttgaattgcaaaaggccgatgaaatgtttgtcaccaacgtaattacaggaattcaatctatnacaaagtatagaaagaaacaatacaccaacattatagcaaaagaattattgggcaagcttaatgcaaaagccagactcggataatcttgttacataaacaagatatttaattgtaagaagggttttggggggcgttagaccacaacatgtagttgcctccaagttctaacattttttctttccacagattgttattgttattaccaatgatgttgtttttgtagtcatttggtgcaaccacccagctatttaattcaagctcctggtctagttgttgtttagaccaaccagaataacccaagaaaaaacgtatctgtgattgagttagtttgtcctgtattagcaatttagagatagctttaaagtctcctccccaaaagataccttgggatatttcaacacttccaggaattagttctggtattttatgaataaagtacagattatcttgctctactggaccaccgttgtaaactggtaggttagagttaatctcaggtataaagtctttaagagtatattcaagtggtttgttgagaataaaacccacagaaccattttctgtattatactctgtcaataatataacagatctattaaaggacacatctccaattatggatggctttgcaactagtaaatgacctttatcgggtttaagtagtgtcattgttggtggttaggtta

SEQ ID NO: 1121 - DNA, 4000 bp, Escherichia coli
accaccaccgatagcttctgaaacacggttaccgaattccaaaataagcgcttgtggcagacgcgcaatgataccaatcataatgataatagagataccgtttccgacacctttatccgtaatacgctcaccgagccaaagaatgaacattgaaccagctgcaagaataattgtagctggaatcataaatgtagtccaatcaatacctgatgctaacgcaccagcggcctgcatttttaagttcatcaggtaagacggtgcctgaaacagtaggatcactactgtcaggacacgcgtataccaatttatcttcttatggccactctcgccttcacgctgcatcttctgaaaataaggtacagcgacagcaaggagctgcataacgatagaagctgagatgtatggcataattcctaatgcgaagattgacgcatgagaaaatgcaccaccggagaacatgtccaaaagtgacataagaccgcccttggtctgtgcctgcaatttttccaacagggtaggattgatgccaggaagcaccacaaacgacccaaaccggtaaatagctgtgaacagaatagtaatgagaagtcgctgacgcaaatcctcaattttccaacagttcttcagtgtctcaataaactttttcattaacttagattatagttgtgttaccacctactgccttgatagcctcttcagcagtcttagagaaggcatttgctgaaacctccaacttagccttcaattcaccattaccgagaaccttaacaagttccttaccattggtaagtccagcagccttaagctcctcaacaccaatcttagtaagattgttcttctcagcaagtgcctgaagagtagaaagatttacagcgaaatattccttgtggttgatgttcttgaaaccagccttcggtacacgacgctggagaggcatctgaccaccctcaaagccaatcttcttcttataaccagaacgtgactttgcacccttatgaccacgagtagaagtaccaccgagtccagaacctggaccacgaccaatacgacgacgtgaatgtgtagagccaacagctggtttcaaattatttaatttcataattactgttttctttaaaagattaattaatcaattactgataccaggtgatgcaccttacggatcatacctcggcagcttggagtatcctctacctcaacaacctgagaaatcttacgaagtcccaatgcctgcaaagtttccttctggtccttaggagcaccaatacggctcttaatctgcttaatcttaattgttgccataatttaatacctcctaaaattaaccgttaaatactttatccatgctaataccacgctcaccagcgattgtatatgcgtcacgcatatcagcgagtgcagcgatagtagcctttacaaggttatgagggttagaagagccctttgactttgcaatcacgtcagtaacacctgcgctctcaagaacagcacgcatagcaccaccggccttcaaaccagtaccggcagcagctggcttaaggagaacatgagcaccgctaaagcgagcctctgcctcatgaggaacagtacccttcaaaacaggaaccttaacaaggttcttctttgctgaatctgtacccttctggatagcagcagtaacctcaccagccttaccaagaccccagccaataacgcccttaccgtcacctacaacgacgatagctgcgaatgtgaaagtacgaccaccctttgtaaccttagttacacggttgatagcaaccaagcgatctttcagttctacatcactatttacttttactctattcattgccataatcgtttagaatttaagtcctccctcacgtgcagcatcagccaaagcctgtacacgtccgtgatagagataaccgttacggtcaaaaacaacctgctctacgccagcagccttagcatgctcagcaacgagtgcacctaccttcttagcctgttcaatcttagccatcttatcaaggccaagtgaagaagcagaagcgagtgttgttcctgtcagatcgttaataacctgtgcataaatctgcttattactgcggaaaacgctcaaacgtgggcgctcagcagtaccgttcacactcttacgaatgcggaactttatcttaattcttctttgttctttctttgttgtcataatcgtaatgatgtattaaagttacttagctgcagctgtcttaccagactttctgcgaataacctcaccctggaacaggacacccttacccttgtaaggctcaggcttacggaaagaacgaatctttgcacagatgagaccaagcagctgcttgtcagctgattcaagagtgatgattggattctggttacgctcgctctttgtctcaaccttaacttctgaaggaagctgaataaagattgggtgagtataaccaagagagaactctaccaagttaccctggttagaaacacgataacctacaccaacaagttccaatgtctttttgtaaccctcacttacaccaacaaccatattgttaacaagtgaacgataaagaccgtggaaagcctgcttctgcttgtagtttactgggctattctcatcaatttcgaatgttacctgaccgtcctcgatgatagtcttaatagaagaatctaccttctgagaaagttcacccttaggaccctttactgtaacaacaccattgttaagagcaactgtaacgccagctggaacactaattggtaattttcctattcttgacatattcaatcctccaattaataaacatagcaaagaacctcaccaccgatcttctctgcagcagcttccttgtctgtcattacacctttagacgtggaaaggatagcaattccaagtccgttaattactctcggcatgtctttgtaaccagtatactggcgaagacctggggtagaaacacgcttcaacttcttgatagcgctctgctttgttacaggatcgtacttaagtgcgaccttgattgaaccttggggaccatcctcaatgaacttatagttcaagatgtaacccttctcgaagagaatcttagtaatagacttcttcaagttagacgcaggaacctcaacaacacggtgatgagccatgattgcgtttctgagtcttgtcagataatctgctattggatctgtcataaaaatataaagtttaattaatcgggactaccccgacaatattaaaaaatcgcttgaaagcggataatgaactgcaaagatacaaaataaatttcacaattcactatccgcgtcgatatatttgcttaccagcttgccttcttaactcctggaatgagtccctgagatgccatctcacggaactgaatacgagagagaccgaactgacgaatgtaaccctttggacgtcctgttatcttgcaacgattgtgcaaacggattggattagcattcttaggaatagactgcaacttgcgagcagcctcataagcctcttcaggatcatttgaagtagcgataatcttcttcagagcagcgcgtttctcagcatagcgagcaacaagctttgcacgctttacctcgcgagctttcattgattcttttgccatatcaattaatcgtttttagcattcttgaatggaagtccgaagcccttcagcaaagcataaccctcttcatcagtcttagctgatgtaacgaaggtaatgttcataccctggatgcggtcaacctgatcgatattaatctctgggaaaataatctgctcggtgataccgagagtataatttccacgaccatcgaacttgctctcgatacccttgaagtcacggatacgtggcaaagatacgcgaacgagtttctcgaggaactcatacatacgctcacgacgcagagttaccataacgccaataggcatcttcttacgcaacttgaagtttgcaatatcctttttagaatatgttgcaacagccttctgacctgtgatagaagaaatctc

SEQ ID NO: 1122 - DNA, 4000 bp, Escherichia coli
  misc_feature (1045)..(1045): n is a, c, g, or t
  misc_feature (1099)..(1099): n is a, c, g, or t
  misc_feature (1108)..(1108): n is a, c, g, or t
  misc_feature (1986)..(1987): n is a, c, g, or t
  misc_feature (1989)..(1991): n is a, c, g, or t
  misc_feature (2056)..(2056): n is a, c, g, or t
  misc_feature (2070)..(2070): n is a, c, g, or t
  misc_feature (2276)..(2277): n is a, c, g, or t
  misc_feature (2281)..(2281): n is a, c, g, or t
  misc_feature (2284)..(2285): n is a, c, g, or t
  misc_feature (2290)..(2292): n is a, c, g, or t
  misc_feature (2294)..(2296): n is a, c, g, or t
  misc_feature (2299)..(2300): n is a, c, g, or t
  misc_feature (2304)..(2305): n is a, c, g, or t
  misc_feature (2308)..(2311): n is a, c, g, or t
  misc_feature (2313)..(2313): n is a, c, g, or t
  misc_feature (2318)..(2318): n is a, c, g, or t
  misc_feature (2320)..(2329): n is a, c, g, or t
  misc_feature (2331)..(2334): n is a, c, g, or t
  misc_feature (2336)..(2337): n is a, c, g, or t
  misc_feature (2339)..(2340): n is a, c, g, or t
  misc_feature (2342)..(2346): n is a, c, g, or t
  misc_feature (2348)..(2349): n is a, c, g, or t
  misc_feature (2351)..(2354): n is a, c, g, or t
  misc_feature (2356)..(2361): n is a, c, g, or t
  misc_feature (2364)..(2366): n is a, c, g, or t
  misc_feature (2368)..(2368): n is a, c, g, or t
  misc_feature (2370)..(2370): n is a, c, g, or t
  misc_feature (2372)..(2372): n is a, c, g, or t
  misc_feature (2375)..(2379): n is a, c, g, or t
  misc_feature (2382)..(2383): n is a, c, g, or t
  misc_feature (2385)..(2389): n is a, c, g, or t
  misc_feature (2391)..(2391): n is a, c, g, or t
  misc_feature (2393)..(2395): n is a, c, g, or t
  misc_feature (2399)..(2409): n is a, c, g, or t
  misc_feature (2411)..(2412): n is a, c, g, or t
  misc_feature (2414)..(2416): n is a, c, g, or t
  misc_feature (2418)..(2418): n is a, c, g, or t
  misc_feature (2420)..(2426): n is a, c, g, or t
  misc_feature (2429)..(2436): n is a, c, g, or t
  misc_feature (2438)..(2438): n is a, c, g, or t
  misc_feature (2440)..(2448): n is a, c, g, or t
  misc_feature (2450)..(2451): n is a, c, g, or t
  misc_feature (2453)..(2457): n is a, c, g, or t
  misc_feature (2460)..(2461): n is a, c, g, or t
  misc_feature (2463)..(2464): n is a, c, g, or t
  misc_feature (2466)..(2466): n is a, c, g, or t
  misc_feature (2468)..(2472): n is a, c, g, or t
  misc_feature (2475)..(2476): n is a, c, g, or t
  misc_feature (2478)..(2480): n is a, c, g, or t
  misc_feature (2482)..(2483): n is a, c, g, or t
  misc_feature (2485)..(2488): n is a, c, g, or t
  misc_feature (2490)..(2490): n is a, c, g, or t
  misc_feature (2492)..(2494): n is a, c, g, or t
  misc_feature (2496)..(2496): n is a, c, g, or t
  misc_feature (2498)..(2502): n is a, c, g, or t
  misc_feature (2504)..(2507): n is a, c, g, or t
  misc_feature (2512)..(2514): n is a, c, g, or t
  misc_feature (2516)..(2516): n is a, c, g, or t
  misc_feature (2518)..(2521): n is a, c, g, or t
  misc_feature (2523)..(2525): n is a, c, g, or t
  misc_feature (2528)..(2531): n is a, c, g, or t
  misc_feature (2533)..(2540): n is a, c, g, or t
  misc_feature (2542)..(2548): n is a, c, g, or t
  misc_feature (2550)..(2553): n is a, c, g, or t
  misc_feature (2555)..(2558): n is a, c, g, or t
  misc_feature (2563)..(2564): n is a, c, g, or t
  misc_feature (2566)..(2569): n is a, c, g, or t
  misc_feature (2571)..(2572): n is a, c, g, or t
  misc_feature (2574)..(2574): n is a, c, g, or t
  misc_feature (2576)..(2576): n is a, c, g, or t
  misc_feature (2578)..(2583): n is a, c, g, or t
  misc_feature (2585)..(2589): n is a, c, g, or t
  misc_feature (2591)..(2591): n is a, c, g, or t
  misc_feature (2593)..(2593): n is a, c, g, or t
  misc_feature (2595)..(2600): n is a, c, g, or t
  misc_feature (2602)..(2603): n is a, c, g, or t
  misc_feature (2605)..(2605): n is a, c, g, or t
  misc_feature (2607)..(2608): n is a, c, g, or t
  misc_feature (2610)..(2610): n is a, c, g, or t
  misc_feature (2612)..(2622): n is a, c, g, or t
  misc_feature (2625)..(2625): n is a, c, g, or t
  misc_feature (2627)..(2628): n is a, c, g, or t
  misc_feature (2630)..(2633): n is a, c, g, or t
  misc_feature (2635)..(2637): n is a, c, g, or t
  misc_feature (2639)..(2640): n is a, c, g, or t
  misc_feature (2642)..(2643): n is a, c, g, or t
  misc_feature (2645)..(2646): n is a, c, g, or t
  misc_feature (2648)..(2649): n is a, c, g, or t
  misc_feature (2651)..(2659): n is a, c, g, or t
  misc_feature (2661)..(2662): n is a, c, g, or t
  misc_feature (2664)..(2668): n is a, c, g, or t
  misc_feature (2671)..(2672): n is a, c, g, or t
  misc_feature (2674)..(2675): n is a, c, g, or t
  misc_feature (2681)..(2681): n is a, c, g, or t
  misc_feature (2683)..(2691): n is a, c, g, or t
  misc_feature (2693)..(2697): n is a, c, g, or t
  misc_feature (2699)..(2700): n is a, c, g, or t
  misc_feature (2702)..(2703): n is a, c, g, or t
  misc_feature (2705)..(2705): n is a, c, g, or t
  misc_feature (2707)..(2715): n is a, c, g, or t
  misc_feature (2717)..(2721): n is a, c, g, or t
  misc_feature (2723)..(2723): n is a, c, g, or t
  misc_feature (2725)..(2729): n is a, c, g, or t
  misc_feature (2731)..(2733): n is a, c, g, or t
  misc_feature (2735)..(2739): n is a, c, g, or t
  misc_feature (2741)..(2743): n is a, c, g, or t
  misc_feature (2745)..(2745): n is a, c, g, or t
  misc_feature (2747)..(2748): n is a, c, g, or t
  misc_feature (2750)..(2751): n is a, c, g, or t
  misc_feature (2753)..(2753): n is a, c, g, or t
  misc_feature (2755)..(2761): n is a, c, g, or t
  misc_feature (2765)..(2769): n is a, c, g, or t
  misc_feature (2771)..(2774): n is a, c, g, or t
  misc_feature (2776)..(2777): n is a, c, g, or t
  misc_feature (2779)..(2781): n is a, c, g, or t
  misc_feature (2783)..(2783): n is a, c, g, or t
  misc_feature (2785)..(2786): n is a, c, g, or t
  misc_feature (2788)..(2790): n is a, c, g, or t
  misc_feature (2792)..(2795): n is a, c, g, or t
  misc_feature (2797)..(2802): n is a, c, g, or t
  misc_feature (2804)..(2804): n is a, c, g, or t
  misc_feature (2806)..(2810): n is a, c, g, or t
  misc_feature (2814)..(2816): n is a, c, g, or t
  misc_feature (2819)..(2820): n is a, c, g, or t
  misc_feature (2822)..(2823): n is a, c, g, or t
  misc_feature (2825)..(2829): n is a, c, g, or t
  misc_feature (2831)..(2832): n is a, c, g, or t
  misc_feature (2835)..(2840): n is a, c, g, or t
  misc_feature (2843)..(2847): n is a, c, g, or t
  misc_feature (2850)..(2850): n is a, c, g, or t
  misc_feature (2852)..(2852): n is a, c, g, or t
  misc_feature (2854)..(2856): n is a, c, g, or t
  misc_feature (2858)..(2865): n is a, c, g, or t
  misc_feature (2867)..(2868): n is a, c, g, or t
  misc_feature (2870)..(2876): n is a, c, g, or t
  misc_feature (2878)..(2882): n is a, c, g, or t
  misc_feature (2884)..(2892): n is a, c, g, or t
  misc_feature (2894)..(2895): n is a, c, g, or t
  misc_feature (2897)..(2898): n is a, c, g, or t
  misc_feature (2900)..(2900): n is a, c, g, or t
  misc_feature (2902)..(2907): n is a, c, g, or t
  misc_feature (2909)..(2910): n is a, c, g, or t
  misc_feature (2912)..(2913): n is a, c, g, or t
  misc_feature (2915)..(2915): n is a, c, g, or t
  misc_feature (2917)..(2919): n is a, c, g, or t
  misc_feature (2921)..(2921): n is a, c, g, or t
  misc_feature (2923)..(2924): n is a, c, g, or t
  misc_feature (2926)..(2927): n is a, c, g, or t
  misc_feature (2929)..(2932): n is a, c, g, or t
  misc_feature (2935)..(2949): n is a, c, g, or t
  misc_feature (2951)..(2951): n is a, c, g, or t
  misc_feature (2954)..(2955): n is a, c, g, or t
  misc_feature (2959)..(2965): n is a, c, g, or t
  misc_feature (2968)..(2969): n is a, c, g, or t
  misc_feature (2971)..(2972): n is a, c, g, or t
  misc_feature (2974)..(2983): n is a, c, g, or t
  misc_feature (2985)..(2985): n is a, c, g, or t
  misc_feature (2987)..(2991): n is a, c, g, or t
  misc_feature (2993)..(2993): n is a, c, g, or t
  misc_feature (2996)..(3000): n is a, c, g, or t
  misc_feature (3003)..(3003): n is a, c, g, or t
  misc_feature (3005)..(3006): n is a, c, g, or t
  misc_feature (3008)..(3015): n is a, c, g, or t
  misc_feature (3017)..(3021): n is a, c, g, or t
  misc_feature (3023)..(3024): n is a, c, g, or t
  misc_feature (3026)..(3028): n is a, c, g, or t
  misc_feature (3030)..(3036): n is a, c, g, or t
  misc_feature (3038)..(3046): n is a, c, g, or t
  misc_feature (3048)..(3054): n is a, c, g, or t
  misc_feature (3057)..(3057): n is a, c, g, or t
  misc_feature (3059)..(3062): n is a, c, g, or t
  misc_feature (3064)..(3064): n is a, c, g, or t
  misc_feature (3067)..(3067): n is a, c, g, or t
  misc_feature (3069)..(3072): n is a, c, g, or t
  misc_feature (3074)..(3078): n is a, c, g, or t
  misc_feature (3080)..(3081): n is a, c, g, or t
  misc_feature (3083)..(3084): n is a, c, g, or t
  misc_feature (3087)..(3089): n is a, c, g, or t
  misc_feature (3092)..(3099): n is a, c, g, or t
  misc_feature (3102)..(3107): n is a, c, g, or t
  misc_feature (3109)..(3114): n is a, c, g, or t
  misc_feature (3116)..(3116): n is a, c, g, or t
  misc_feature (3118)..(3118): n is a, c, g, or t
  misc_feature (3120)..(3122): n is a, c, g, or t
  misc_feature (3124)..(3125): n is a, c, g, or t
  misc_feature (3127)..(3129): n is a, c, g, or t
  misc_feature (3131)..(3132): n is a, c, g, or t
  misc_feature (3136)..(3141): n is a, c, g, or t
  misc_feature (3143)..(3143): n is a, c, g, or t
  misc_feature (3145)..(3150): n is a, c, g, or t
  misc_feature (3152)..(3156): n is a, c, g, or t
  misc_feature (3158)..(3158): n is a, c, g, or t
  misc_feature (3160)..(3166): n is a, c, g, or t
  misc_feature (3169)..(3170): n is a, c, g, or t
  misc_feature (3172)..(3174): n is a, c, g, or t
  misc_feature (3177)..(3182): n is a, c, g, or t
  misc_feature (3184)..(3189): n is a, c, g, or t
  misc_feature (3191)..(3195): n is a, c, g, or t
  misc_feature (3197)..(3201): n is a, c, g, or t
  misc_feature (3204)..(3204): n is a, c, g, or t
  misc_feature (3206)..(3207): n is a, c, g, or t
  misc_feature (3209)..(3210): n is a, c, g, or t
  misc_feature (3212)..(3215): n is a, c, g, or t
  misc_feature (3217)..(3218): n is a, c, g, or t
  misc_feature (3221)..(3225): n is a, c, g, or t
  misc_feature (3227)..(3228): n is a, c, g, or t
  misc_feature (3230)..(3232): n is a, c, g, or t
  misc_feature (3234)..(3237): n is a, c, g, or t
  misc_feature (3239)..(3250): n is a, c, g, or t
  misc_feature (3252)..(3254): n is a, c, g, or t
  misc_feature (3256)..(3259): n is a, c, g, or t
  misc_feature (3261)..(3261): n is a, c, g, or t
  misc_feature (3263)..(3263): n is a, c, g, or t
  misc_feature (3266)..(3269): n is a, c, g, or t
  misc_feature (3271)..(3274): n is a, c, g, or t
  misc_feature (3276)..(3277): n is a, c, g, or t
  misc_feature (3279)..(3279): n is a, c, g, or t
  misc_feature (3281)..(3284): n is a, c, g, or t
  misc_feature (3965)..(3966): n is a, c, g, or t
  misc_feature (3970)..(3973): n is a, c, g, or t
  misc_feature (3976)..(3977): n is a, c, g, or t
  misc_feature (3979)..(3979): n is a, c, g, or t
  misc_feature (3983)..(3983): n is a, c, g, or t
  misc_feature (3985)..(3985): n is a, c, g, or t
  misc_feature (3987)..(3991): n is a, c, g, or t
  misc_feature (3993)..(3994): n is a, c, g, or t
  misc_feature (3996)..(3996): n is a, c, g, or t
  misc_feature (3999)..(4000): n is a, c, g, or t
gtaataataaagagtgtgacacgtgtgctcggggcactaatggagtaacccaaaattctcttgaagtcagtgaatccattatttccaccaaagcccgtttcatttctgaagaacaaaagcatggcagcgtatgtgagggcttgtgtaatgatggagaaatacactcctttaatcctggatcggaaagcaaagtatccgaatatccaagaaataacaccaggcaccaaaattaacatcatgagcatccaccaaaaatgctcgctacctttccagaaccaaggcaaatctttccagtctaagaaaaccatgaagtcgggtaattcacttttgtaaacaccgtcagtaccgatctgacgcatgagatacatgcccatgatgtacccaccgatggcgaagaataagccatggcccagactcaagattccgcagtagccccaaactaagtcgagcgctaatgccgctatcgcaaagcacatgatcttgccaattaaagtcagcgcataagctgacatataaaacatgctggtatcgggaaccaacaatgagaagattggcacaccaatcaatacgcacaacgtaagcgcagccaatgcaatataggatcgcttgctcagaatggattcacgctctggcaccaaaagactaaagctggatgaaggggcaagttttctaatatccatactaatcaacgctcctgccttttaatgcgaagaggccttgaggacgtctctggatgaagatgatgatgaacactaagatagcaatcttggccaatacagcgccgataaagggttctagtagcttgctcgtaatgccaagtccaaatgcgccatatattgtgccggcaagttgaccgacaccaccaagcactaccaccatgaatgaatcgacgatatagctttgacctagatcaggtccaacgttaccgatttgtgaaagtgcaaccccacctaatccagcaatgcctgccccaaaggcaaaagcatacatatctacgcgaactgttttaacaccaacacaggccgccattgtccgattttgagtnaccgctctaacgaaaagcccaagccgggttttgttaagcactagccaggtaacngcgaccacngcaatcgcaaatccaaaaataatgatgcggttatatggcaccactaaatttggcagtacctgcaaagcgcctgacatccatgtcgggttagcaacttctacgttttgagcaccaaaaatagttctagtcatttggatcattagcaaactaacgccaaatgttgccaacaaagtttctagtgggcggccatataaaaacttaatgaccgttctttcgattaagatgccgaccaaagcggccgcaagaaaggctacaggtagtgcgaatagcaaataccaatccaggtagcctggggcatattgcctaaagaagccctgaacaacataagttgcataagcacccaccatcaagaactcaccatgggccatattaatgacgccaatcaaaccatacgtaatcgctaggcccaatgcacacagcaaaaggatgctgccgtaactaaagccggcaatgacattacctaaaatctcgccactaaactcagatttcttaattttggctagagccttctcggcagcttcctgaactggaccgccctctttagctagcggagccaataaagcagcgacttgagggtcaccactatcacccaataaggcaatagctttcaattttgattcttgattatctgattgcaacgccaatagcgcccaaagcttttctacttttggctttagcactggatcgttttcagttgaaagtaatttttcaaccactggaaaagtatcgggctcaggatccttaatcaaagcatcaacagctttggtacgaatctgtgaatctgtggatgcaagctgcaagcccagcaaagcattatcaaccttgccacgcaattggttgttcaaaattacgtcttgtaattcgtcagattttacggnnannntttgccctgtaagcacatcaacataatgatcgcctttttggacaaccgcaccctgaggtgatagnaacagcacctctgnactcaatgcttgaagaatttctatagcttcaggactatcttctttagataagacttgaactacttttacttttgcatcaaagttttcaccgaataatggctttaaatctgtgactgtaatctttgcaaaaacaaacccacaactcagaagacaaatcgccgaaaggagtggttttagaaaaaaggaggatctcattaagatttttnnaaanccnnccccnnntnnnggnngggnnttnnnntnaaaantnnnnnnnnnnannnngnntnncnnnnntnncnnnnannnnnnggnnncnangnttnnnnnggnntnnnnntngnnntttnnnnnnnnnnntnnannngncnnnnnnnttnnnnnnnncnannnnnnnnngnntnnnnnaanngnngntnnnnnccnntnnntnnannnnancnnntngnnnnntnnnnttttnnncnannnntnnnttnnnnannnnnnnnannnnnnntnnnncnnnnttttnnannnncnncntncnnnnnnannnnncngntnnnnnngnntncnntngnnnnnnnnnnnaangnntnnnngnnncnngnnanntnntnnnnnnnnnannannnnnccnntnntttttncnnnnnnnnntnnnnngnntnntnannnnnnnnnannnnntncnnnnngnnnannnnncnnncnanngnntngnnnnnnncccnnnnnannnntnntnnncnanngnnnannnnannnnnngnannnnntttnnnttnnanncnnnnntnnccnnnnnnttnnnnnaangnannntnnnnnnnncnntnnnnnnngnnnnnannnnnnnnntnncnncntnnnnnnanntnntnannntngnnannannnnttnnnnnnnnnnnnnnncnaanngggnnnnnnnttnntnnannnnnnnnnncntnnnnncnttnnnnnttnannannnnnnnnannnnntnntnnntnnnnnnngnnnnnnnnnannnnnnnccnannnnanccnannnntnnnnncnncnnccnnnttnnnnnnnnaannnnnnannnnnngnantnnntnntnnntnngggnnnnnncngnnnnnnannnnntncnnnnnnnttnntnnnccnnnnnntnnnnnngnnnnnannnnnaancnntnnannnntnnaannnnngnnannncnnnntnnnnnnnnnnnnannncnnnnancnaannnnannnncnncntnnnnttggttagcatttggcgggctttctcggcaaataaaggccagttagaagctgggtcaacaactaccggctctaatttacgacctaaaacaccaccacttttgttgatctgatcaataaccatcaaatccatatctttcagtgatgtttcagaaatagccattgttccagacagtgaatgcaagatacccaccttaattggctccttactttgagccattgctaaatgacttaagcctgtaaaacttaaagccgctgctaaagctgacaacttcaatattgatctacgtttcatatctcacctcttgagtaaattaatcatgtgggcaggaatacctaatgcctacagtcattagagaatggttcaagttggtgcaaatttaacaaatccccaaaagagagcacatgcaccagaaaaaggcataaaaattaggtagatcgcacgatacgagaatatttgctgcggttgcaaatgaaaaagtcagaataccgcagtctaaaagtagttcattgctccaatggcagacctatatgtttattggggttgccatggaggatgtatcaagattgtttgcacaccgactacacattaaagaaaaatgacctagcgttctcacgctaagtcattgattttgttggtgggcccagctggactcgaaccagcgaccaaaggattatgagtnntgtnnnntanncnactncntnnnnnanncnttnn

SEQ ID NO: 1123 - DNA, 4000 bp, Escherichia coli
  misc_feature (1)..(2): n is a, c, g, or t
  misc_feature (4)..(14): n is a, c, g, or t
  misc_feature (16)..(19): n is a, c, g, or t
  misc_feature (21)..(45): n is a, c, g, or t
  misc_feature (47)..(67): n is a, c, g, or t
  misc_feature (69)..(100): n is a, c, g, or t
  misc_feature (102)..(125): n is a, c, g, or t
  misc_feature (127)..(138): n is a, c, g, or t
  misc_feature (140)..(183): n is a, c, g, or t
  misc_feature (185)..(193): n is a, c, g, or t
  misc_feature (195)..(212): n is a, c, g, or t
  misc_feature (214)..(221): n is a, c, g, or t
  misc_feature (224)..(226): n is a, c, g, or t
  misc_feature (230)..(240): n is a, c, g, or t
  misc_feature (242)..(249): n is a, c, g, or t
  misc_feature (252)..(253): n is a, c, g, or t
  misc_feature (255)..(275): n is a, c, g, or t
  misc_feature (277)..(294): n is a, c, g, or t
  misc_feature (296)..(301): n is a, c, g, or t
  misc_feature (303)..(303): n is a, c, g, or t
  misc_feature (305)..(306): n is a, c, g, or t
  misc_feature (308)..(311): n is a, c, g, or t
  misc_feature (313)..(314): n is a, c, g, or t
  misc_feature (316)..(319): n is a, c, g, or t
  misc_feature (321)..(328): n is a, c, g, or t
  misc_feature (330)..(380): n is a, c, g, or t
  misc_feature (382)..(383): n is a, c, g, or t
  misc_feature (385)..(414): n is a, c, g, or t
  misc_feature (416)..(425): n is a, c, g, or t
  misc_feature (427)..(427): n is a, c, g, or t
  misc_feature (429)..(447): n is a, c, g, or t
  misc_feature (449)..(449): n is a, c, g, or t
  misc_feature (451)..(452): n is a, c, g, or t
  misc_feature (454)..(463): n is a, c, g, or t
  misc_feature (467)..(467): n is a, c, g, or t
  misc_feature (469)..(476): n is a, c, g, or t
  misc_feature (479)..(479): n is a, c, g, or t
  misc_feature (482)..(483): n is a, c, g, or t
  misc_feature (485)..(491): n is a, c, g, or t
  misc_feature (493)..(497): n is a, c, g, or t
  misc_feature (499)..(499): n is a, c, g, or t
  misc_feature (502)..(505): n is a, c, g, or t
  misc_feature (512)..(512): n is a, c, g, or t
  misc_feature (515)..(515): n is a, c, g, or t
  misc_feature (519)..(519): n is a, c, g, or t
  misc_feature (521)..(537): n is a, c, g, or t
  misc_feature (539)..(540): n is a, c, g, or t
  misc_feature (543)..(544): n is a, c, g, or t
  misc_feature (546)..(551): n is a, c, g, or t
  misc_feature (557)..(558): n is a, c, g, or t
  misc_feature (560)..(563): n is a, c, g, or t
  misc_feature (567)..(570): n is a, c, g, or t
  misc_feature (574)..(580): n is a, c, g, or t
  misc_feature (586)..(587): n is a, c, g, or t
  misc_feature (592)..(596): n is a, c, g, or t
  misc_feature (598)..(598): n is a, c, g, or t
  misc_feature (600)..(606): n is a, c, g, or t
  misc_feature (611)..(612): n is a, c, g, or t
  misc_feature (615)..(615): n is a, c, g, or t
  misc_feature (617)..(617): n is a, c, g, or t
  misc_feature (619)..(619): n is a, c, g, or t
  misc_feature (621)..(623): n is a, c, g, or t
  misc_feature (625)..(626): n is a, c, g, or t
  misc_feature (628)..(631): n is a, c, g, or t
  misc_feature (633)..(633): n is a, c, g, or t
  misc_feature (635)..(636): n is a, c, g, or t
  misc_feature (638)..(640): n is a, c, g, or t
  misc_feature (643)..(643): n is a, c, g, or t
  misc_feature (645)..(646): n is a, c, g, or t
  misc_feature (649)..(650): n is a, c, g, or t
  misc_feature (656)..(656): n is a, c, g, or t
  misc_feature (659)..(660): n is a, c, g, or t
  misc_feature (671)..(671): n is a, c, g, or t
  misc_feature (677)..(677): n is a, c, g, or t
  misc_feature (857)..(857): n is a, c, g, or t
  misc_feature (1988)..(1988): n is a, c, g, or t
  misc_feature (2417)..(2417): n is a, c, g, or t
  misc_feature (2436)..(2436): n is a, c, g, or t
  misc_feature (2481)..(2481): n is a, c, g, or t
  misc_feature (2775)..(2775): n is a, c, g, or t
  misc_feature (2853)..(2853): n is a, c, g, or t
  misc_feature (3050)..(3050): n is a, c, g, or t
  misc_feature (3147)..(3147): n is a, c, g, or t
  misc_feature (3435)..(3436): n is a, c, g, or t
  misc_feature (3440)..(3441): n is a, c, g, or t
  misc_feature (3444)..(3445): n is a, c, g, or t
  misc_feature (3447)..(3447): n is a, c, g, or t
  misc_feature (3450)..(3451): n is a, c, g, or t
  misc_feature (3453)..(3453): n is a, c, g, or t
  misc_feature (3457)..(3457): n is a, c, g, or t
  misc_feature (3459)..(3459): n is a, c, g, or t
  misc_feature (3462)..(3468): n is a, c, g, or t
  misc_feature (3470)..(3473): n is a, c, g, or t
  misc_feature (3475)..(3478): n is a, c, g, or t
  misc_feature (3481)..(3489): n is a, c, g, or t
  misc_feature (3491)..(3491): n is a, c, g, or t
  misc_feature (3493)..(3493): n is a, c, g, or t
  misc_feature (3495)..(3497): n is a, c, g, or t
  misc_feature (3499)..(3506): n is a, c, g, or t
  misc_feature (3508)..(3512): n is a, c, g, or t
  misc_feature (3514)..(3516): n is a, c, g, or t
  misc_feature (3519)..(3525): n is a, c, g, or t
  misc_feature (3527)..(3531): n is a, c, g, or t
  misc_feature (3533)..(3537): n is a, c, g, or t
  misc_feature (3539)..(3544): n is a, c, g, or t
  misc_feature (3546)..(3551): n is a, c, g, or t
  misc_feature (3553)..(3555): n is a, c, g, or t
  misc_feature (3557)..(3563): n is a, c, g, or t
  misc_feature (3565)..(3566): n is a, c, g, or t
  misc_feature (3568)..(3573): n is a, c, g, or t
  misc_feature (3575)..(3576): n is a, c, g, or t
  misc_feature (3578)..(3586): n is a, c, g, or t
  misc_feature (3588)..(3609): n is a, c, g, or t
  misc_feature (3611)..(3611): n is a, c, g, or t
  misc_feature (3613)..(3614): n is a, c, g, or t
  misc_feature (3616)..(3621): n is a, c, g, or t
  misc_feature (3623)..(3641): n is a, c, g, or t
  misc_feature (3643)..(3650): n is a, c, g, or t
  misc_feature (3652)..(3681): n is a, c, g, or t
  misc_feature (3683)..(3728): n is a, c, g, or t
  misc_feature (3730)..(3745): n is a, c, g, or t
  misc_feature (3747)..(3757): n is a, c, g, or t
  misc_feature (3759)..(3765): n is a, c, g, or t
  misc_feature (3767)..(3780): n is a, c, g, or t
  misc_feature (3782)..(3794): n is a, c, g, or t
  misc_feature (3796)..(3799): n is a, c, g, or t
  misc_feature (3801)..(3817): n is a, c, g, or t
  misc_feature (3819)..(3822): n is a, c, g, or t
  misc_feature (3824)..(3845): n is a, c, g, or t
  misc_feature (3847)..(3897): n is a, c, g, or t
  misc_feature (3899)..(3901): n is a, c, g, or t
  misc_feature (3903)..(3906): n is a, c, g, or t
  misc_feature (3908)..(3965): n is a, c, g, or t
  misc_feature (3967)..(3985): n is a, c, g, or t
  misc_feature (3987)..(3987): n is a, c, g, or t
  misc_feature (3989)..(4000): n is a, c, g, or t
nncnnnnnnnnnnncnnnngnnnnnnnnnnnnnnnnnnnnnnnnnannnnnnnnnnnnnnnnnnnnncnnnnnnnnnnnnnnnnnnnnnnnnnnnnnnnngnnnnnnnnnnnnnnnnnnnnnnnngnnnnnnnnnnnngnnnnnnnnnnnnnnnnnnnnnnnnnnnnnnnnnnnnnnnnnnnnannnnnnnnncnnnnnnnnnnnnnnnnnncnnnnnnnnacnnnacannnnnnnnnnncnnnnnnnnccnncnnnnnnnnnnnnnnnnnnnnncnnnnnnnnnnnnnnnnnnannnnnngngnncnnnncnnannnngnnnnnnnnannnnnnnnnnnnnnnnnnnnnnnnnnnnnnnnnnnnnnnnnnnnnnnnnnncnncnnnnnnnnnnnnnnnnnnnnnnnnnnnnnnannnnnnnnnncntnnnnnnnnnnnnnnnnnnngnannannnnnnnnnnaaanannnnnnnnccnggnncnnnnnnncnnnnngnggnnnnaaaaaanagngaanannnnnnnnnnnnnnnnngnnaannannnnnnaaaaannannnnaaannnngggnnnnnnnaccccnnaaaannnnncngnnnnnnncggcnncancngncnnngnnannnncnanncnnnccncnnccnnaaccgnacnnaaccggaaaancgcggnggcgccctcaccagggcgcctccgcgcacaaaagctaactagctcaccgaaacagccggggaaccctcgggaacatactcgcccgaagcctccatctcagcagcaatacgggtcgcctcttcaatcagagtctcaacgatctgatcctcaggcacagtcttaatgacctcacccttcacnaaaatctggcccttaccgttaccggacgccacacccaggtcagcctcacgagcctcacccggaccgttcaccacgcaacccatcacggcaacacgcagcggaaccttcatgtgctccaggcccttagtcacgttctcagcaagctcccacacgttcacctgcgcacgaccacacgacgggcaagaaacgatatccagcttgcgggggcgaaggttcagcgactccaggatcttggtgcccaccttcacctcctcaaccggaggagcagacagcgacacgcgaatagtatcgccaataccctgagacagcagagtaccgaacgccaccgagctcttaatagtgccctggaacgccggaccagcctcagtcacacccaagtgcaggggccagtcaccgcgctcagccagctgacggtacgcctccaccatcaccacagggtcattatgcttcacagaaatcttgaaatcacggaaaccgtgctcctcaaagagcgaagcctcccacacagcagactcaaccagagcctccggagtagccttaccgtacttctccaacagacgcttatccagcgaaccagcattcacaccaatacgcagagaaacgccgtggtccgaagccatctgagcgatttccttcacctggtcatcgaacttacggatattacccgggttcacacgcacagcaccgcaaccagcctgaatagccgcatacacgtacttcggctggaagtgaatatcagcaatcaccggaatacgggactgcttcgcaataatgggcagagcctccgcatccttatcagtcgggcacgccacacgcacaatatcgcaaccggcagcggtcaactcagcaatctgctgcagagtcgcaccaatgtcgtgggtcttagtggtcgtcatcgactgcaccgaaatcggagattcagaaccaacaccgacagaacccaccttaaactggcgagtcttacgacgcggggacagaaccgcgggagcgggcttcggcataccaaggctgaccgacaaggttttcctccatacatgggttatgaaggacgtacgacgcatccttcgttcaactttttattgtgccactgacgcgaaagaaagcactaatacgggtacccttaccgcgcgnaacaacacactaaaacagggtgatgggcttaacaatatccgccacaatcagaatgacagacatcacaataaacgcgcccgccaccacatacgtcaacggcaacaacttcaccggatcaaacggacccggatccttacgcccagtcaaacgtgcaaagaaacgacgcacaccctcccagagcgcacccaacacgtggccaccatccagaggcagaagcggaatcagattaaacgcaaaaagcatcaaattcatattcgccaccagcgagaccaacatcgcagccttcgccttcacatcaatacggtcagtagccgtcacctcaccggcaatacgactcacaccaaccacagacaccggcgactcaacactacgctcaccaccagtcaccaaagtcaccgtcaactcccacacacgctgcggcaacgacancatcgacgaacccacacgngagagcgtatcgcccaccatcgcaggcacctcagtaatagaaccnggcaccaactcactcgacggcgaaacacccacaaaaccgccgcgagtcgtcgcaatcgaaccatccgcagcacgcgcatactggcccttaccatcagaaaccgggcggatcatctcaaccggagtcaccgacaaatccagacgctgaccattacgctccaccgtcaaagtgctcgggtgagaacccgccgcacgaatcgccgaagacacagcctcccacgaacccgtcgacgcaccattcacagcaaccacacggtcacccacctgcacaccagcagccttcgcaggcgacggngtggacttatccgtacactcgccatagctaatcgaatcatgagtgacattcacgctcggcacgcactcagacaccgcngacaccttattcgtcacctgcgccgtaccaaaaccacaaatcagcacagcagtacacaccacaccaatcagcaggttcatggtcgggccacccagcataatcaccatgcgcttgagcaccggcaacttatagaacaggcggtcctcatcaccgggcttcaggcgctcagcatccgccgcacgcgcctcctcagccanggacgcaaacgggctggtactgcccgaatggccctcctcatggtgctccttcacctcagcagggctcggcgggtacatgccaatcatcgaaatgtanccgcccaacgggatcgccttgaaaccgtactcagtctcgccgcggcggaaagagaacacggtcttaccgaagccaatcatgtactgcgggacgcgcacattgaacagcttcgcgggcaccagatgccccacctcgtgcagggcaatcgagacggcaatagcgattgccatgaggataatgcccacagcgtacagcaggatttccacgctttttctcgtttcggttcggggatacgaagcttctaggatactcgcttagcctgtgaaggcgccctcccccgctttctgnngggnntgnngncgnngngggngngtnnnnnnnannnntnnnncgnnnnnnnnngngnannngnnnnnnnngnnnnngnnnccnnnnnnncnnnnncnnnnncnnnnnntnnnnnncnnncnnnnnnntnncnnnnnngnncnnnnnnnnncnnnnnnnnnnnnnnnnnnnnnncngnngnnnnnngnnnnnnnnnnnnnnnnnnncnnnnnnnngnnnnnnnnnnnnnnnnnnnnnnnnnnnnnngnnnnnnnnnnnnnnnnnnnnnnnnnnnnnnnnnnnnnnnnnnnnnnannnnnnnnnnnnnnnncnnnnnnnnnnncnnnnnnncnnnnnnnnnnnnnncnnnnnnnnnnnnngnnnncnnnnnnnnnnnnnnnnncnnnngnnnnnnnnnnnnnnnnnnnnnncnnnnnnnnnnnnnnnnnnnnnnnnnnnnnnnnnnnnnnnnnnnnnnnnnnncnnncnnnncnnnnnnnnnnnnnnnnnnnnnnnnnnnnnnnnnnnnnnnnnnnnnnnnnnnnnnnnnngnnnnnnnnnnnnnnnnnnncncnnnnnnnnnnnn

SEQ ID NO: 1124 - DNA, 4000 bp, Escherichia coli
  misc_feature (1484)..(1484): n is a, c, g, or t
  misc_feature (1956)..(1956): n is a, c, g, or t
  misc_feature (2641)..(2641): n is a, c, g, or t
  misc_feature (2656)..(2656): n is a, c, g, or t
  misc_feature (2956)..(2956): n is a, c, g, or t
  misc_feature (3715)..(3715): n is a, c, g, or t
  misc_feature (3730)..(3730): n is a, c, g, or t
  misc_feature (3800)..(3800): n is a, c, g, or t
  misc_feature (3802)..(3802): n is a, c, g, or t
  misc_feature (3905)..(3905): n is a, c, g, or t
  misc_feature (3916)..(3916): n is a, c, g, or t
  misc_feature (3970)..(3970): n is a, c, g, or t
gcgatctcggctcgggtcgtgccgatgcgcgcgccgagcacgcgcccggcagaagcgacgatcgacaggcgcggaccctcgatgcgcacgtcgccgacgatctcggtgatcggcggccacgcgtcggcgtactgcagcgtggcgtcctgcgccttcgcggcgaacacgaactggccgcccttccccgcggcaaacggaaactgcgcgagatcgccggcgagcgtcagcttcgcgtcgctcgacgtgcctttcacgagagcatggcgcagccagtccttgacaccctgtcctgcgtcaagcggcaggtaccggtacgtgctgccgagattgacgcgcgacagttgcgccttgatgtcgacgtcgccgggactgccggcgcgcgggcgccagctgccggcggtcgtccccgcggcatcgccgttggcaaacgcgacgtccttgaactgcaagtgcgattcgctgccgtcgttctgccaggcgacgtcgccgcgcagcgtgtcgaacgcgatgggctccgcgaagagcttcggcagcgtgaacgatgccgcacgcgtgtcgatgtgcaggcgtccgtcgcgatcgttcgcgtcgagcgttcccgcgaggttgctcgcaccgggcatgccgtcgtgcgccgcaacggccaatgcgcggaattctgttttcaccgcatagccggacatggcatcgatgtcacccgtccactgtacggcgccgttgcgcagcgtgccgcgaggatcgaaccgtgcgatgtcgcggcgaacgccctccgggatcggcaggtgcggcgcaatcgcgaccagcggccgcagttcgagctcgccgaacgagaagctcccaccggcacccgcgccacttgccagcgccatccgcacgtccgcggcggcctgcgtcgttccgtccggcagcgtgaacgtcaattccttcgatgcaaccgtcgtctgcgctgcggtgcgctgccattgcatccgcccgccaagatgcgcgagagccagcggtgccaagccttcgcccagcgtcgcgcgcacgtcctcgagctccacgtcggccgtgacgtcgaccggctgagcctcagcgaaatccatccagacgcgcaacgcacccttgccactttcgatcggcaacgcaagcggaagccagtcgcgccacgcggcgacgtcggcgtaatcgaggcgcaggtacagcttgcccttcagctggttccagtccttcagcgattcaccggtcacgtcggcacgaagctcgattggcgcggcgacgtcggcgggcggtattcccgtcaggccggcctgatggcggccaaatcgctgctcgagacgaaacgcgacatgatcgagcagcagttgcggcgccttgcggtattcgtcgtcccacgcgaccagtgcatcacggacgacgacttgcggctggcgcatcagccagtccgcgacggcggtatcgtcggtgccctcgtcgggttcgcgctcgatgccggcgaggtgcanccgtcccgccgtatcgcgccgcagcgaaagccgcggaccttcgatcagcagttccttgaggcgcaggtcgaggagcggcagcgacgtccacgcaacgagcaggtccacgcgcggcagcgccagcaaaacgctgccatcgggcgcgcgcgcgcggacgcgaaatccgcgcacggataacttcggattccagccgtcccagccggtgacgagggcatcgatctcgaccggctggccgatgcgcttggccatccattgggcgatgtcgtcacggcgcgcttcgatcgccgggaacgcaacgagccgaaccgcgagtagcagcgcgcagaacgcgcccgccagcagcagcgccgacatcgcgacgagccgcacggcgcgcgcagcgaaggacggcgtcgacaagtgcgcaggcataatgaaggtcgttgacccgacgacgattgtagcggaagcatcgctggcagagtgcgaccancgccgctgcaccgcgtaaccctgttccccgccccgtgatggacctcgatcgcgcccttgcgttcagccgctacgcggaccgggtcttcgccgtgtcgcccgcgctgcgcgacgaaatcgtcgccgcgctggacacatcgttcgactggaccggcgcggacgccgcccttgacgattgcatcgacaccggcaacccggtcgcgctcgcaacggcgatgcggcggttgcgccgtcgcgtgttcgtgcattcgatgcttcgcgacctgaccggtcgcgcgacgctcgtcgaagtcgtgcaggcagtcagcacgctggccgagcgcacgctggccgccgccatcgccgtgcacacgcgcgtgctgaccgaggcgcatggccggcccatcggcgatgaaaccggtcttgcgcaggcgcttgtcgtcatcggcatgggaaagctcggcgggcgcgagctcaacgtctcgtccgacatcgatctcgtgttcgcttatcccgaggatggcgacaccgacggacagcggcgcatctccaatcgcgagttcttcgatcggctgggccagcgtgtcatcgcgtcgatatcgcatgtcgatgccgacggctacgtgttccgcgtcgacatgcggctgcgaccttatggcgaaagcggaccgctgaccgtctcgttcgcggcgctcgagcactatctngtctcgcaggggcgngcgtgggagcggtacgcatggctcaaggcgcggccgttgaccggagagcggcacgacgagctcgcggctctcgtgacgccgttcgtctatcgcaagtacctcgactacgacgcctacgacgggctgcgcggcatccatcgccagatccgcgagcaggagaagcggcgcgactatgcgcaggacatcaagctcggcgcgggcggcatccgcgagatcgagttcgtcgtgcaggcgctgcagatcgttcgcggcggacgcgagcctgcgctgcggatcgccggcacgctgccggcattgagngcgctcgcctaccgcggtgcgatcgcaccgcacacggccagcgtgctgcgcgacggctacgccttcttgcgaatgctcgagcaccggcttcagtatcgcgacgaccgccagacgcaaatcgttcccgtcgacgcgagcgagcgcgcgttgatcgcggaagcgctggattgcgccagcgtcgcagcattcgacgatcgactccgagagcatcgagacacgatctcgcggcagttcaatgccgtgttcgacgcgcccggcggcggcgagcagtcgagcgacgccgaccagcgttaccgtgcgctatgggacgatccgtcgcccggtgccgacgccgtcgccgatctcgccgaagcgggcttcgacgatccggcgggtctcgtccaaacgctcgtgcggatgcggcggagccgacgctacctgcagttgccagcgctgtcgcgcgatcggttcgaccggctggtcccgcggctgctcgccgttgcggccgagcatcgcagcccgctggccagtcccaacgcggtggtccagcgactgctcggcctgctcgacgcagtcggcgggcgcagtgcctatcttgcgctgctgatcgagcatccaccgcttctgccccggctcgcccaattgatgggggcgtcagcgtgggcggccgactacctgacgcgcaggccgctgctgctcgacgaactgctcgatgcgcgcgtgctgcttgccgaagcggactgggatgcatggcgcgccgagctcgatcgggtgctcgcngcgcatcgcgacgangccgaggcggcgatggacgcgctacgccacttccagcatgcgcacacgttcaggctgctcgcgcaggacntngcgggccagctgacgatcgagcggctggccgaccatctgtcggcgctcgcggacacgatcctcgatgcgacgctcgcccgttgctggcaggaattgcgcaagngcgcgcaagcnccgccgcgcttcgcgatcatcggctacggcaagctcggcggcaaggaactcggntacgcgtccgacctcgacctcgtcttcctt

SEQ ID NO: 1125 - DNA, 4000 bp, Escherichia coli
  misc_feature (121)..(122): n is a, c, g, or t
  misc_feature (995)..(995): n is a, c, g, or t
  misc_feature (1112)..(1112): n is a, c, g, or t
  misc_feature (1226)..(1226): n is a, c, g, or t
  misc_feature (1797)..(1797): n is a, c, g, or t
  misc_feature (1985)..(1985): n is a, c, g, or t
  misc_feature (2009)..(2009): n is a, c, g, or t
  misc_feature (2032)..(2032): n is a, c, g, or t
  misc_feature (3111)..(3111): n is a, c, g, or t
  misc_feature (3351)..(3351): n is a, c, g, or t
  misc_feature (3353)..(3354): n is a, c, g, or t
  misc_feature (3357)..(3361): n is a, c, g, or t
  misc_feature (3363)..(3366): n is a, c, g, or t
  misc_feature (3369)..(3371): n is a, c, g, or t
  misc_feature (3374)..(3377): n is a, c, g, or t
  misc_feature (3379)..(3387): n is a, c, g, or t
  misc_feature (3390)..(3391): n is a, c, g, or t
  misc_feature (3393)..(3401): n is a, c, g, or t
  misc_feature (3404)..(3405): n is a, c, g, or t
  misc_feature (3407)..(3408): n is a, c, g, or t
  misc_feature (3413)..(3415): n is a, c, g, or t
  misc_feature (3417)..(3417): n is a, c, g, or t
  misc_feature (3419)..(3421): n is a, c, g, or t
  misc_feature (3423)..(3425): n is a, c, g, or t
  misc_feature (3427)..(3430): n is a, c, g, or t
  misc_feature (3432)..(3437): n is a, c, g, or t
  misc_feature (3439)..(3444): n is a, c, g, or t
  misc_feature (3447)..(3451): n is a, c, g, or t
  misc_feature (3453)..(3453): n is a, c, g, or t
  misc_feature (3457)..(3461): n is a, c, g, or t
  misc_feature (3463)..(3464): n is a, c, g, or t
  misc_feature (3466)..(3466): n is a, c, g, or t
  misc_feature (3469)..(3470): n is a, c, g, or t
  misc_feature (3473)..(3473): n is a, c, g, or t
  misc_feature (3475)..(3484): n is a, c, g, or t
  misc_feature (3486)..(3494): n is a, c, g, or t
  misc_feature (3496)..(3498): n is a, c, g, or t
  misc_feature (3501)..(3502): n is a, c, g, or t
  misc_feature (3505)..(3510): n is a, c, g, or t
  misc_feature (3512)..(3512): n is a, c, g, or t
  misc_feature (3514)..(3514): n is a, c, g, or t
  misc_feature (3516)..(3519): n is a, c, g, or t
  misc_feature (3522)..(3524): n is a, c, g, or t
  misc_feature (3526)..(3535): n is a, c, g, or t
  misc_feature (3537)..(3540): n is a, c, g, or t
  misc_feature (3542)..(3542): n is a, c, g, or t
  misc_feature (3544)..(3546): n is a, c, g, or t
  misc_feature (3548)..(3549): n is a, c, g, or t
  misc_feature (3552)..(3553): n is a, c, g, or t
  misc_feature (3555)..(3556): n is a, c, g, or t
  misc_feature (3558)..(3562): n is a, c, g, or t
  misc_feature (3564)..(3564): n is a, c, g, or t
  misc_feature (3566)..(3566): n is a, c, g, or t
  misc_feature (3569)..(3571): n is a, c, g, or t
  misc_feature (3573)..(3573): n is a, c, g, or t
  misc_feature (3576)..(3578): n is a, c, g, or t
  misc_feature (3580)..(3581): n is a, c, g, or t
  misc_feature (3583)..(3586): n is a, c, g, or t
  misc_feature (3588)..(3590): n is a, c, g, or t
  misc_feature (3593)..(3595): n is a, c, g, or t
  misc_feature (3602)..(3602): n is a, c, g, or t
  misc_feature (3607)..(3610): n is a, c, g, or t
  misc_feature (3612)..(3616): n is a, c, g, or t
  misc_feature (3620)..(3621): n is a, c, g, or t
  misc_feature (3623)..(3625): n is a, c, g, or t
  misc_feature (3627)..(3636): n is a, c, g, or t
  misc_feature (3638)..(3646): n is a, c, g, or t
  misc_feature (3649)..(3649): n is a, c, g, or t
  misc_feature (3651)..(3661): n is a, c, g, or t
  misc_feature (3663)..(3668): n is a, c, g, or t
  misc_feature (3670)..(3670): n is a, c, g, or t
  misc_feature (3673)..(3675): n is a, c, g, or t
  misc_feature (3677)..(3677): n is a, c, g, or t
  misc_feature (3680)..(3681): n is a, c, g, or t
  misc_feature (3684)..(3684): n is a, c, g, or t
  misc_feature (3686)..(3687): n is a, c, g, or t
  misc_feature (3690)..(3693): n is a, c, g, or t
  misc_feature (3697)..(3700): n is a, c, g, or t
  misc_feature (3702)..(3702): n is a, c, g, or t
  misc_feature (3704)..(3706): n is a, c, g, or t
  misc_feature (3708)..(3709): n is a, c, g, or t
  misc_feature (3711)..(3719): n is a, c, g, or t
  misc_feature (3722)..(3724): n is a, c, g, or t
  misc_feature (3726)..(3726): n is a, c, g, or t
  misc_feature (3729)..(3739): n is a, c, g, or t
  misc_feature (3742)..(3743): n is a, c, g, or t
  misc_feature (3745)..(3747): n is a, c, g, or t
  misc_feature (3749)..(3753): n is a, c, g, or t
  misc_feature (3755)..(3758): n is a, c, g, or t
  misc_feature (3760)..(3765): n is a, c, g, or t
  misc_feature (3769)..(3775): n is a, c, g, or t
  misc_feature (3777)..(3777): n is a, c, g, or t
  misc_feature (3781)..(3781): n is a, c, g, or t
  misc_feature (3783)..(3795): n is a, c, g, or t
  misc_feature (3797)..(3804): n is a, c, g, or t
  misc_feature (3806)..(3817): n is a, c, g, or t
  misc_feature (3819)..(3821): n is a, c, g, or t
  misc_feature (3823)..(3824): n is a, c, g, or t
  misc_feature (3826)..(3830): n is a, c, g, or t
  misc_feature (3832)..(3842): n is a, c, g, or t
  misc_feature (3844)..(3844): n is a, c, g, or t
  misc_feature (3846)..(3849): n is a, c, g, or t
  misc_feature (3851)..(3851): n is a, c, g, or t
  misc_feature (3853)..(3857): n is a, c, g, or t
  misc_feature (3859)..(3862): n is a, c, g, or t
  misc_feature (3864)..(3873): n is a, c, g, or t
  misc_feature (3875)..(3875): n is a, c, g, or t
  misc_feature (3880)..(3885): n is a, c, g, or t
  misc_feature (3887)..(3894): n is a, c, g, or t
  misc_feature (3896)..(3896): n is a, c, g, or t
  misc_feature (3898)..(3900): n is a, c, g, or t
  misc_feature (3902)..(3907): n is a, c, g, or t
  misc_feature (3911)..(3915): n is a, c, g, or t
  misc_feature (3917)..(3919): n is a, c, g, or t
  misc_feature (3922)..(3922): n is a, c, g, or t
  misc_feature (3924)..(3924): n is a, c, g, or t
  misc_feature (3926)..(3926): n is a, c, g, or t
  misc_feature (3928)..(3928): n is a, c, g, or t
  misc_feature (3930)..(3930): n is a, c, g, or t
  misc_feature (3932)..(3934): n is a, c, g, or t
  misc_feature (3937)..(3940): n is a, c, g, or t
  misc_feature (3944)..(3946): n is a, c, g, or t
  misc_feature (3949)..(3949): n is a, c, g, or t
  misc_feature (3996)..(3997): n is a, c, g, or t
gggggccgccgggggtaagcgcgttgaaccctgcaattgcgcgggccacttcgggggcgcatttgtcgccctgcacagccacgggccaaatcaacaccttgcgcggaaaccggtcgcgtanncggtgcaaaatatcacggatcaccgcccccgagggcgatgtgacaaccccaataatttcaggcaaatagggcagcgggcgtttgcgcgccgggtcaaacagcccctcggcggccaatgcggccttgcgcttttccagcatcgccatcagcgcgcccatgccggcgggtttgatatcgtcgatcacgatttggtattttgactggccgggaaaggtggtcagccgcccggtggccaccacttccatgccctcttcgggctgcacagacagccgctgcgcgacgcccttccagatgaccccggaaatcaccgcgcggtcgtctttcagatccagatagatatggcccgatcgtggcagcgatacgcgccccacctcgcctttgatgcgcacatgggcaaactcgccctcgatcatgcgtttgatcgcgcccgaaagctcggataccgaaaattccggggcgtttgtgccttcgggggcctcgtcgatcaggtcggacattgtgcctcgcttgctcttgcctttggtgcagcttagaacgcccgggaacaaaggccaagacggagtgcgccagatgaatatcttgatccttggaagcggtgggcgtgaacatgccttggcctgggctgtgctgcaaaaccccaaatgcgaccggctgatcgtggcgcccggcaatgctggcattgcccagatcgcggaatgcgccgatatcgacacgcttgatggcggtgcagtggccagtttttgcgaggccgaggcggtggatttcgtcatcatcggccccgaggcgcctttggcggctggggtggccgaccggctgcgccaagcggggctgttggtgtttggcccctcggctgcggcggcgcggttggaggcntcgaaaagctttaccaaggaaatttgcgatgcggcgggcgcccccacggccgcctatggccatttcaccgatgccaacgccgcgcgcgcccatattcgtgcccatggggcgcccatngtggtaaaggccgatggtttggcggccggcaagggggtgatcgtggctgaaaccgaggcccaagcgctggctgcgattgatgacatgttcggcggcgagttcggcgcggcgggngccgaggtggtgattgaagaatttatggagggcgaggaggcatcgtttttcgtgctatgcgatggcaccgatgtgctgcccatcggcaccgcgcaagaccacaagcgcgtgggcgagggcgataccggccccaacaccggcggcatgggcgcatatagccccgcgccggtgctgagcgatgcgatcgccgctttggcgatggagcaaatcgtaaagcccacaatggcggaaatggcgcgccgcggcatgccctatcaaggggtgctttacgcggggctgatgatcaaagatggccagcctaggttggtggaatacaacgtgcgctttggtgacccggaatgccaagtgctgatgatgcggctgggcgcgcaagccttggatctgatgcaggccgcagccgaggggcggctggccgaggcgcaggtaaattgggccgacgaccacgccatgactgtggttatggctgcaaacggatacccgggcgcttatgaaaaaggttctgttatcaacggtctgggggatattgccgaaagctctagccagattgtgtttcatgctggcaccagcctgnacgaggggcaggtggtggccacgggcgggcgggtgctgaacgtgaccgcgcgtggtgccagcttggccgaggcagcccagcgggcctatgcgatggtcgattgcatcgattggcccgaaggcttttgccgccgtgacattggctggcgcgccttgggttgacacgctttatgggtgtcgaaacccgcncgtaatactctttaagatgtattngttgctctaagggatatgtgttnctacccacttggataatgtgggtgagagcatgttaatgagtgatgagtttttgtgctgcatgggcgcgcgcctgtgtggtcaggtgttgtcgggccttgatcggggtggggccgcgtggagcgtagagctgcaaaatgtgcggcgcttggtctattccgagcggcgcacccgaaatagcacgatttatagcctgcgcttaaaagacaaagccgggtggcacacgatcagcgtggatattccgcgccagcgtatggcgcccagcatcgatctgatcgaacatcgcgccctttcggcgcgggtggccgaggtgctggccgatttgcggcccgggttccgggtgcgctacgaggtggtgcagggcgggcgttttctgccggtttgggttggtttgggcgcaggtgcgctggttggggcgctggtgtggctttgggcgtttttcgcccaagtgcaaggcccgcccgtgggcgcgtttccggccatcacgctgggggcggggctggtcagcggggttggcgccgggctggtgatggggctggccatgcgccaccgcgtgccagatgtcagcgccagcgccttgccggggctgttgacggctgcgtcgcggcgcggttaggggcggggttgcacagggccggggcaacgctgcgcctttgccatgctggcaggcccgtcataggggccaaggcgacggctgtgcaagcgcccgtcgcggcccaaactggtggcaaggacgtggcgccaactggcgtctgcggtaatgatctggggcaggcccccgcagcggcgcaggccgccttcgatttgggccgcgcgcagctggtggttgctgtgcccctgttgctgggcaatttcggttagctgccagcctgtggcaccggccatgggatagacccgcacaacccgtaacacccgcgccagatgcgggcgatccacataagcgatctcgatctgcccgtcgccatccagatcggcgatgcctgcaatggccagccagcggtggcgttggccaatgggggccgtggcggcgatgggcgccagatgggccaaactggaatcgggttgggcataaatctgaatncgggcgcccttggcgaaatcggccaccaccgtcaccagctcgggccgcccgtcgccgtttagatcggccagccggggctgggtatcttcgaaaatgcccccgcttgggcgcaaaacatggcgctgcccggttgtccaggtgatctcaagcccgtcatattcgcccccggccacagcgccatggccataggcatctgtgggcccgacatagcgcgctgtggcgatttgcgggggcgtttgngnnggnnnnngnnnnggnnnggnnnngnnnnnnnnngcnnannnnnnnnncanncnngcaannngncnnncnnngnnnntnnnnnngnnnnnnttnnnnngntgcnnnnncnncngcnncancnnnnnnnnnntnnnnnnnnntnnncanncannnnnncnancnnnncgnnnannnnnnnnnngnnnntnannngnnagnncnngnnnnngngntgnnngncgnnntnnannnngnnntcnnncatgtcntcttnnnngnnnnntttnncnnncnnnnnnnnnncnnnnnnnnnatngnnnnnnnnnnngnnnnnngngcnnncncanncgncnncgnnnncggnnnngntnnngnngnnnnnnnnntcnnncncgnnnnnnnnnnnggnnannncnnnnncnnnntnnnnnncatnnnnnnngncatngnnnnnnnnnnnnntnnnnnnnncnnnnnnnnnnnntnnngnntnnnnntnnnnnnnnnnntngnnnngngnnnnngnnnntnnnnnnnnnntntggcnnnnnntnnnnnnnngntnnnannnnnnatcnnnnntnnnatntntntncncnnntcnnnncccnnntcngccccccagtctgcaccccagtctgccgcgccatattgcccggcccnntca

SEQ ID NO: 1126 - DNA, 4000 bp, Escherichia coli
  misc_feature (488)..(488): n is a, c, g, or t
  misc_feature (1985)..(1985): n is a, c, g, or t
tttgtcagtccatgtgtatactttttgatcgagttctattgttgcaccaaagttagaagtatagacagtcaagccaatatcttcatcctcttgtccaacatagtcagctccggctggaccccagtcggtatattctaagtcgattttctctcctctatctaagttatttgaactaattgctgcagggatttctaggactacttggaagattccagtagagtcaccagtttctctgagctcagatggttcaggatcaaaggtagtggattggtcttgaatagatacggttgcagcatcactgtcccactcgattaaatcaagtgttaaggattgtgctccgtcattatcaagatcaaagtctggctcaattaaggttaagatcatatctgaaccaattaagtagactgatttatcggattgtaatacaccgtttctaaggtcaaaagtagcagagtcagttacagtttgtttcttaccagaagcatcgnagttatctgtgtattctacagtgataatatcaccttgtaagatacaaccatcactaaatacacttggacaatcagttgctggtccagatgtatatgtgactgtttgatcccactcgaatacaccagaatctggcgatacttctacgatagcaccattaccggttaacccatcaagggatccggatgtagtgttaccagcagtggcaaggaacttacttgaagaacctctttcaatattaattgtaacgttagcatctgtgattttatcttcaccagaggcggagacattgtaatcagcatctgttactctaacgtgtatgacgacatcaccttgggctaatgctgcactaccagttgcagtagcgtgctctgcaaatctagtatcagcggcatctgcaccataaggtactggataaacagttctatcaaaagcaacagaaccggtgtttgcattaatgcttgcacctgctccaacttcaatagattcaccagaagcgtttctgaaatcttgatagttaacttccatatctgtaccagttactccattaatggtatcatcaccactatgacagaaattggttgggacttggaaggtacctacaaagagaccagaatcagcagcagtctctactaatgtaaagcctgttgcttcaagaccgttgtcaccgactattgtgccagtggtttcggtacatgcagcgtcatctgtatttacccagtattgatcgtcaaatgtaatatcgagaactaatccagcggtcgtagcatcaccaactttatcgtcagtagatgttatgtacacatcgattagtgaggtatctgtattcatatcttgatcatctaatgtaacaacaacagtatctgcaatcttgtaattctctgaatcaaatgaaactacaccattatgtgttggagcttcttgttgatcagcgatttgtgtactaacaccatctgctcctaaatcataataattgattcttggagaatcctcgtcagtcatatcttgttcaacaataatgttgacagaagatgagattgaatcaagggttgtgtaggttgcatcggcattaatgttaagttgatttaacattgtatactcgacggtaccttcaaatgttgatgtgttatcaccagtttcctctaattggagtctgtagattgcattattgacacctgcaccaaaactaaatacatcagccacgaatggtgctgtatttaatgttgcatcagcagtaagtgttacgttaacattcattgcagcactagtttgttggtctgctgcgaagatttctacaattcctttgctttcaaagtcagcgccgcaagcgacgttaagcattgaaccagcagtgccgttcactaagcaaacttttgctactgtttgtgttgcattgaaagatgtgaaatcgaagttaaagtaagtatttactgtgtcaatgccatttatgtcagcaccactatatccagtattaatagtcacattttgactattacctnctttgatatcactaccataaccacctccaccaagactattactaggattatcataccatgtaatattgctgaatttggatgttatagatacttgagcatcatcgacagccacggttagtggactaccaatgactaatgctggtactaaatgaccttgtgttgtattcactaagagtagatcttcatcaacaagagtgttcttgttaagatcgtgatcaattaatgtaactgttatctcttcaccggaattccactcatcaccaacagaggtttcatccatgtcaatgacaccaaagtcatttgtgacaacgaatgattgtgcactatcgttataatcgatagttgcagttgttcctcttttagcgttaagtgcaacttctagattagaagcataaagatcatcagtattgtagaacataccactgttttcaccaccttcaaagaagacaaggaatttgtctgcttgtgggtcgtctgcagttgctttatctacaaatacatctctaccgatacttgaagcatcgtagttaatgatcaatttaccgttatcaccaaaagtattactccatgctctaaaggtacctgctccttcgccaattacacctggtacagtaccattagtaaatgacatagattcagcacctgaagttaccttgaatattactttatcttcagaagttggatcaatgtttagttgattatcagtaatgattaaatgaacatcagattcctgagaagctgcatttctatctaattcaattcctgcgaaatcatctaaatcaccagaattatagtctaatgtgactacttcatctgatccggcttgttcgtaaacaacattaaaggtatattcacctgttgtaaaatcatacaattgtacaaatggccaatcacctgttgtgattacaccaatctgtccttgtgtgaagttggcactagttcctgatagatagtcacccgtacctgtaccagtaccattccatgcggaaagggctgggaagttatggattgcaccagagccatcggaattgagtacattggtggattgataaacattagttgcttcagcaaagtcacctaaatgtaaggtaggattagcatccgtaccaaagtctaagttatttgcgaaagaatctgctgctgctactttggttttatcaccaaagtaaccataccaattaccatcaacaccttgtgccattctaagttgattttcatcaactttgacgacaggttcaccaactgattcgttagttgctgatctgttaggatcaataactacaacttctacaatttgtgctcctccaaatgtgttaccgaacattgcgttttctgcggagacatataatgagcctgcggctgcggcttctggcaccattgaaggtgcggcaataaccataccaccggctaacattattgtcattagcgtaagactagttaatttacgtcctatttcgttattcatgttattagttatttttgccaaaaattagtatataacactaatggacgatacgtccacaaaaaggtggttttttgtagttatttcaccatatttgaaatattgttattaatattatattttattaaagaattttttgaattaattctatttttatatctatgatctaattatattataaaaataatattataattatcaaaattttagagactatttttgtaattttttgataaaaaattattttttggttttactttggttttaatccatattacggccttttagtgtaaaaatagacatattggttttggttttatcagatacaccacaatttaacactgaactaggcacaaattactccattttggtgttaccataccatttggttttgagtggtttacagttggttttagccaaaaaaaggaccttttagaatcgtgccggtatgcaaattacactaaaaccacttggtttgcatttggttttacggtttattgtttgaaaacgatagaatgtaaagaatttcactatgttaaaatcagaatagaat

SEQ ID NO: 1127 - DNA, 4000 bp, Escherichia coli
  misc_feature (7)..(7): n is a, c, g, or t
  misc_feature (1322)..(1322): n is a, c, g, or t
  misc_feature (1830)..(1830): n is a, c, g, or t
  misc_feature (1971)..(1971): n is a, c, g, or t
  misc_feature (2332)..(2332): n is a, c, g, or t
  misc_feature (2389)..(2389): n is a, c, g, or t
  misc_feature (2910)..(2910): n is a, c, g, or t
  misc_feature (3051)..(3051): n is a, c, g, or t
  misc_feature (3429)..(3429): n is a, c, g, or t
  misc_feature (3435)..(3435): n is a, c, g, or t
  misc_feature (3462)..(3462): n is a, c, g, or t
  misc_feature (3594)..(3594): n is a, c, g, or t
  misc_feature (3951)..(3951): n is a, c, g, or t
agttttntgaaatgttatgtcagtacttgttcctaaaaattcacttttttttaaattaaaaaagccagtttcaaaataatattcatcttctttattttcttgttcatttcttctataaaatactctttctcctttaagaacctcatcatttactgagtattcaaattgatcaagtttataaacatttgaattaatatcagtaataatagttttattatttgacatcaatatcatttcattttttaagaaggtcaagtctgaacccacaacgttatattgatcgtctacatttaccaatgttttacccacagtataaattatctcttcagacttgagataaaacattttgtcagcattgatagtaatattatttttgatatcagttaattcaacattgccatttgtttcaaggcgattaattttttttaaatatataaaattatcagacattaattcaacttgagtgtctgttacaactttacctctattattacctttgtagacagtgttattttctaagatctctaaatcagtaacttcaaatgtaaattcatcactattagcaaaacttagtgggcttatgttaaatattaatattaaaaaaataataattattctatttttcattaatctttattatagaagtaaaattaattattgctaacataccaaggggcataaaaatcgataatactaaaggaattttttgatttgtacctaaaatatttaaaaaataatttatataataaatgatcacggataaaaaaattcctaatgttattttgtagaatgtatttttttggtatccaatattaaacatgataattgatgataaaatagtaattaaagttaaataaactgggtaagagataactctataaaaatgagagtcaatatccactaaagaataatttagagttttataactttttcttaattcaattaatttaaatactgtaagcgaagatagatttgagaataaactattaatcttcttgagatcaaaatttgatttaaaaattaactcacttaagtcataatcttgattgttgtttaaaattaaaggtttaattattttccattcaaaagaggatatatcaactttatcactctgtatcatgttcaaaacatcaaaatttttattaagctgtgttattgaaacatttaataaaaactgattgttaactttacctgcattaattatatttatcttgttttcaatctcgtctttaatccataacccattttctgtaattacagctaaatatttattatcacttgaatatttattttttattaataaataagaatttttcatgacngctgaaacattatagaaaagaagaataaaaattattccaataaaaaaagtataaaaaccaatgatcttaatgatcataaaattagttaagccattatatttaaaaatttctaactcttttttatctataagataaataaaaaaaacttgtgttgataataaaaaaataaatggaagtatttcaaatacaatagcaggtgtatttaaaaatgataaaaaaataaggtacaaaaaactaatatctagatttttaaaaaattctatctgttctaaaatattagttattagaattattataaaaaaagaaaaaaaaactttcaaaaaagagatattaaaaagattaattaaaaatttaatataaactttcatatttttttgactttcatagttattaaaaaataaaaatatatcattaatatcaaaacaaggggtagtactgataaaaacgaattttgtattaagttattggaaataaattttgaagaagactctataaagataatagatanaaaacctaaagaatatgttttaattttttgtgtcttaaatgtcggatcacttttagattttaatattaataaaagtgaaatagatataagaagcgtaatatataaaggttttattaatcttgagtatatctccttatatanatttgtcatattcattgaggtacaattgttaagttcagattttattttgttaccaatatcttttttaaaattattgatgatcaataaacataataccagctctttagttgaagtttcttgtgttttttgatgagtaacagtttgtgtgctaaaattggaaatattaaaatctgttttagaaaaattgaattcagaagtttttctattgacattattgattgtttttccatcatataagacaagtatttttttgtctccacgtatttcaaatttaccagtttttgcaattgtggtttgagattcattagggctagatttgtcatttaaaaacatgttttctagctctccattttcatttttnctatcataataaattgttaaatttttaactatatctacaaatgtttttggttttaangcactttcaaaaaaatctagatctgaagatcgtataaaagatcttgctttatcttgagctgtgggcacaattaaagcatttaatagtaggctaaaaattacaaataaaaatgagacttttataaagaaatttataagatgaattttttttattccaaaattccaaaatataagcagttcatttttgtcttcatattttagcaatatgtatgaaaaacttaaaaaaactgcaaaggggtaaattctgctaagtatttttgggaaactaagtaatgtgaagttaaaataaacaaaaaaaccatgaccatcttcaatcacaaagtctaaataattgactgcctgtaaaacccagataattgtactgatggtaaatatagttaatagaaaaaactttacacaatcagtagctaaatttctgtaaatgatttttttcattgaaatatgataatttaactcatatatagcactcaacccgtatagagtgtattaaaatttatgtctattaagatcaattacaaaaanatcatttctaccaaatctacaataaatcttgtcttatttgttaatgaaaatttcaatattaaagatattaagaaatatatttcaaattctgaattttcttacatagcagatttactaaaaaatagtgatttaaaaaaaganacacttttttttgaagttaattcaaaaaaaacaatattcttagtatctgttaagaaaaacataaaaatatcagatatagaaaatttaggagcaaaatttcacagttatataaattttgataagaaagatgattactttataaactcagacacagttaatgataaaactaaaaattttataggtcattttctacatggactgaagttaaagtcatatgaatttaatatttataaatcaaaaataaataaaaaaattgtttctataaatgttataggaaaaaagaataaaatatctactaaagatcatttaagatttaaagctctagaagaaggaagtttttttgcaagagaccttgtgtctgaaccaggaaatgttttncacccngatgaatatgcaaagagaataaatacncttaaaaaatttggattaaaaataaatatctacgatgaaaaaaaattaaaaaaacttggaatgaacgccttacttggtgtagggcaaggtagtattagaggatcatatcttgtaacaatggaatggaatggngcaaaaaataattctaatcctttagcttttgttggaaaaggtgtttgttttgataccggtggttactctttaaaaccagcaaagtttatggaagatatgacttatgatatggcaggttctgctacggttgtgggattaatgaaaaatttagcaattagaaaagcaaaaattaacgctgttggcgttgtagggcttgttgagaatatggttagtggaaatgctcaaagacctggtgatatagtaaaatcttatagtggtaaaacaatagaggtattaaatacagatgctgaaggtagattagttttggctgatgctttaacttttactgagaaaaaatttaaacctaagtttatggtngatctagcaactttaacaggtgctattatagtttcattaggctctgaat

SEQ ID NO: 1128 - DNA, 4000 bp, Escherichia coli
  misc_feature (1)..(7): n is a, c, g, or t
  misc_feature (9)..(15): n is a, c, g, or t
  misc_feature (17)..(18): n is a, c, g, or t
  misc_feature (20)..(20): n is a, c, g, or t
  misc_feature (22)..(23): n is a, c, g, or t
  misc_feature (25)..(25): n is a, c, g, or t
  misc_feature (27)..(27): n is a, c, g, or t
  misc_feature (30)..(30): n is a, c, g, or t
  misc_feature (32)..(33): n is a, c, g, or t
  misc_feature (62)..(62): n is a, c, g, or t
  misc_feature (285)..(285): n is a, c, g, or t
  misc_feature (688)..(688): n is a, c, g, or t
  misc_feature (3200)..(3200): n is a, c, g, or t
  misc_feature (3203)..(3203): n is a, c, g, or t
  misc_feature (3213)..(3214): n is a, c, g, or t
  misc_feature (3228)..(3228): n is a, c, g, or t
  misc_feature (3243)..(3243): n is a, c, g, or t
  misc_feature (3252)..(3253): n is a, c, g, or t
  misc_feature (3257)..(3257): n is a, c, g, or t
  misc_feature (3260)..(3262): n is a, c, g, or t
  misc_feature (3277)..(3277): n is a, c, g, or t
  misc_feature (3973)..(3973): n is a, c, g, or t
nnnnnnnannnnnnntnngngnnananttngnnaaaaaagatgctccaggattgacctccgntaagtatgacattttaacctatattttgtagtaatatcttcatggggagaatagagctatgtcgttaatgaataaaattagtgaattgcccagagcaccgcaacctccgatagcatggaaggtgttgtggattacttctcttggttccgtgattggtatagggattacggcgtttcttgcttttgcttggaaatgtcccctgctattagggccttttggtgcnacagcagttttggtttatggcgcctacaaggctccgctggcacaaccaaggaatgtcctattagggcattttctaggtgcattgatgggtgttgccatatatgacttttttggtctctcatggtggtcgctaacacttggagttgttctgacaatcgttttcatggcagtgacatattcggttcatccccctgcaggcgctactgcgtatgtggctattcagaccggtggtttgggtatggattattggtatatcttaaaccctgttcttcttggggccgtcattttagttgttgttgccatcgttgtaaataggatgggcaaaagggattatcctgtagcttggtggtgatatctggtaaagctaactgctcaggctaccgagtatgatgtggttggtgggntaatcgcttgtaaatgggtttcctgctatgtgtagactcttttttagtacgtcataaattagggagttaggttgcgccaagcggcgcttgaatattttaacttcagactggcaaaacgcccttgagattcaacagaaaattctaaatatgcattttatggagaaaaataatgaaaatatcgcttaaaaattacatcatactaatgctgattttcttcactctgctaccgtttgttttgcttaggattattgcatatccgaaaatacagtccgatcttaagacggtaataatggataatcttgaaactgtaggcaacaagcaggcggacatcgtgtcatcatggatgacggaaagaaaaacagatgtcatcgttgttgcaaacaatccgtatattgctgatagcttgaaaggtgcaggaaggaatggcgatagtgatgctaccgcatatttagagttggttgttaatgaatatggctacaagggcgcatttgtaagtaatgcagacggaatagtcacgcttgctacgtcggaagaggatgttggagctgatctgtctggaagagattttttccaacaatcgatgcagggaaatgcatacgccacaagtatcataccatctgaaatcgcccttacgaatgagtttgatgagaaggaagtaggcttgcctacaatgttcgtgtctgcgcccttaaaagacggtgatactgtgattggtgttgttgctttcaggatccatgttgctactttgagtaatttgctgcaaagtcaaaaatttgggaagacaggtgaaacgttcattgtcggtaaagatgggtatatgcttacggaatccagatttagctcaaatttaatgaaaacgggagcgattcaggtaagaagcgctttggagttgaaagtggttaatcccgataacggaaagatgacctatgctgttaaccagtgccttaagggcaaagacggttctagttccaagggctataaagattatgccggtatatccgtactgggagtatggcactggctacctgagcttgattgggctgttattacagagatagacaaggctgaagtttacggagtggcttataatctcaatacgcttggttgggtgttgctgtttggaatcgcattcccgattgtgttttttgcatatatagttggtaaaaaaatatctgcaccaatagttgagctgactgaggcgactgaaaagatgtcagcaggagatctgacccagcgggtaaatattgataggggggatgagcttggtgttttggcaacatcgtttaatgcaatggctggggctctcgataaaaagacaaaagaggttgaggaatccgagagaacatacagggaattatttaatgctctccaggctggtatttatcagtgtgagccaggagttgaaggcaagtttgcatgggtaaatcagtcttgtgcggaaatgtttggctatgaatcacctgaagagatggaaggtacgaaggtaaaagatatctatgtggatcaagccgatagaaaaaaacttgtagataagcttgaaaaagacggtgtctggaaagactttacgtcctattgtgtaaacaaaaaaggagggaaattttacactgagcgtacatcaaatatggtgaaggacgaaaaaggaaaacctgtccgtattgagggtgtgatcagggacattagtgatcgaaagaaaaaggaagatgatctgcaaaagaaagccagaaagaagtccgattgataagagttgaaaaggtgtatgctgtaaggatttaggcaaattattatgtaagcttgttttgtcaacgaatttaaatatataacactacactaacaaggagtaggaaattatgggtaatggaaactctaagggtctttcagtaaatgcgaagaccattattctgctgatattgtttttggatgtcggatttacggttaagatgatacacaaatacaacgagatgaaggatgctggttttgtaagggaaaaaacctttgctgaaaatatggaaaaaagggttatgaaagcttttggttcggcagaaggggcacaaaaactggttcaagatgcagttctacagaagcaagaagctgagaaaattgcagcatctctaagaacagagaatgccgctttgaagagcaaaaaccgacagcttacagaagagaatgagaagcttaaacagtgacgtgtcgaaagtaacaaaaaataaaaggacttaagggaaagcattgaactgacaggcagagaacgcgtactagtaggtctctgttgtcgctagtccagggtttcaaattacagggttaacgtatcaaccgcaattcataagccgtgagctaggctaagcatatgcagttacggatcttacgtgacctgtgtttacttaaattatggcactccttatcgcgcacaagggtagatgttgctccaatcaaagtaggagtacctctgtagcaataaatacggatatcgctttggataaaaacctcatatttaggttgaaaagttgattgtttnttntaaatggggnngttttaaaatttanttttaaataattatnaaggtgttnnaatnaannnttctatgatttgttntgacataatttttttttaaagttttgggaggatgaatctgtggcatatttaaaaggtaagaaaggaattagtgaaaaaagcaatttgttctggaagagcattcttttcagtgcagttgttgctgtttttgtttccatgctgtgccttggtaattcagcatcagcaggaggcggtcttgaagggaaagacctttataataaatactgtgcaccgtgtcacggtgaagaaggtgacgggtatggtccattatatggagcgctttatccaaaacctagagattttacgaagggtcagtacaagattcgtactaatgcgacaggttctttgcctacggatgcagatcttattcatgtaatttctgttggaattcatggaacttctatgatgccatgggatatccttgataaagaccagatcgcgtctctgctaccggtattaaagagtttttctgaagcctggcagtacagaaaacctgaagcagcagtagttttaggaactgaattgagagcgacacagaagacgattgcaaggggtaaagaactttatcagcagaaagagtgctttaagtgtcatggcgagacaggaaatggcgatggccctagtagttacgatcttgaggatgaatgggaaattcctattttgccttatgattttacccgtgctggcaagtttaaaggcggggcaacaaacaagganatctatatgagatttacaacaggtatg

SEQ ID NO: 1129 - DNA, 4000 bp, Escherichia coli
  misc_feature (1251)..(1251): n is a, c, g, or t
  misc_feature (1303)..(1303): n is a, c, g, or t
  misc_feature (2328)..(2328): n is a, c, g, or t
  misc_feature (2419)..(2419): n is a, c, g, or t
  misc_feature (2421)..(2421): n is a, c, g, or t
  misc_feature (2598)..(2598): n is a, c, g, or t
  misc_feature (2629)..(2629): n is a, c, g, or t
  misc_feature (2652)..(2652): n is a, c, g, or t
  misc_feature (2655)..(2655): n is a, c, g, or t
  misc_feature (2658)..(2658): n is a, c, g, or t
  misc_feature (2745)..(2745): n is a, c, g, or t
  misc_feature (2774)..(2774): n is a, c, g, or t
  misc_feature (3113)..(3113): n is a, c, g, or t
  misc_feature (3251)..(3251): n is a, c, g, or t
  misc_feature (3401)..(3401): n is a, c, g, or t
  misc_feature (3437)..(3437): n is a, c, g, or t
  misc_feature (3633)..(3633): n is a, c, g, or t
  misc_feature (3639)..(3639): n is a, c, g, or t
  misc_feature (3753)..(3753): n is a, c, g, or t
  misc_feature (3809)..(3809): n is a, c, g, or t
  misc_feature (3812)..(3812): n is a, c, g, or t
ggcaagataaaaattgcgtaaaacttggatccaaaacattgctagagcatgttttgttcaaaattagcaataaatttgaagaaatattgattgtctcaagtaatccattgaagatagaagaagcaaaaaataccacagtaattccagattgttttaatgatctaggacctttagcaggagtgctaagttccatgaagtgggtaaaagaaaataaaaaatcatacaaatggattgcaacttttccatctgatactccattttttgatccaattattattgaagaatacaaagcaagaattgaacaaagtaaaagcagtttatattttgttaaatctaacgaaaaaagacataatatttttggtttatggtcaattgatttaatggaaaaattagaagaagatttaataataaataattatcgaaaagttgaggaatgggctaataaagttggtgtgagcacaattgatattaaaataaaaaattacgatcctttttttaatataaataccaaagaagaccttgatgttgctcaaactattttaaatcttgataaaaatgattgattacaaaaaagcaaaaaatattttaataaaatcaaaaataaacattaaagatgaagttataaacacatcaaaatcattaaatagaattaatgttcaagatatttattgtcctgtgaattatcctgcaggaactaatgctgcatttgacggttttgccattaattctaaagatacatctacgattaataaaaaaaatcctaaagaatttaaaattttaaaatcaatatcagcaggtgataatcctaaattaaataaagtaaaaaaatttcaagctgttgaagtgatgacgggtgctctaattcctaaatattttgacaccattattcccatagaaaaaattgtgtttactaacaataaaaagtctatcgtaataaatgaaaagattaaaactaatcaacatataagacatgcaggatctgattataaaaaaaaggaattagttattaataaaggaactattattcagccatcgcatatcttagcctttaaaacattaggtattaaaagcattaaggttaaaaagaagcttaatattttatttttttcaacaggaaatgaaatttcaaataacgtagatattgctgattggaaggttagaaattcaaacagtcattatataaaatctttatctaataattttttgtttaattatatagaaggtggaattttgagagataaagatgaacanttttttaaaaaacaaattgataaaaatcttagatcaaaaatagatatcatanttacctcaggtgctgtttcagcaggtaaacatgattttatcccctctgtagtaaaaaaatttaatttatcaaattttttcaaaggggtggctattagaccgggtaaaccaattttatttgctaaatttaaaggaagtgaaaaggctttctttgggcttccaggtaatcctatttcttcttccgcctgctttagattttttgtatatccctatattttaaatatccttggagttaaggaggaaaaaccttttaaagctaagttaaaaaattctttctttaagaaaaaaaattttactagatttataaaagcaaggcttactacaactcataatggaaatttagaaatcaaggtactcaaaggtcaggaatcttttagaataaaatcttttgtagagtctaatatttggggcctatttaaacatggtcagtcaaattttaaaaagagcgaacttattgattgctattctccaattggttcaaatattaatatttttaaatagatctcatttttattgtagtgccaattaataagcattaagtatcgaattatgattgagctaaaaaatgaaaaaattgcaattccagtagttttattagcaggtcttatatggtcctttggacctttggttgtaagatacatggatcaacccaatttagttccatggcaatatatttttgcaagaggcttaacaatttttttgattttaaatctttatcttttttttgaagaaggaaaagatttttataagaattatttaaaaattggaatgtcgggtgttattggtggaactggactaggtattgcaatgattacctttatttattcaataacaaatactagtgcggctgttactttactctgtttagctgcaatgccattttttacagctttattaggtttcttatttttaaaagaaaaaatttcacttaatgtttggatagctatatttattgcaacagttggaataataattatagccattggtaatactgaaaaaaattctttattagggcttatttttggnatgacttcttcaattgggttttctgttttttcagtgactttgagatggaaaaaagaaacaccaaaatttacaacagtagcttttgcaggtntnttttgctttgtagttgctgcaatagttattttatctaatgatatggttttcttgtcttcaagttataacggagcattattttctatacatggaacgttagtttgtatgggtttaattttatattctattggatcaaaagcaatccctgctgcagaacttactttattgtcactaacngaagttataggaggaattttttgggtatggnttccaattttaggaattaatganatnccntcgactaatacgataataggtggcttctttctttttatgtctatcatttattatagtcttacaattaaaactaatagacggtttatngctcttaattaattataatggaaagaccnaatttttttactctaaagaatggtgaaaaggctaaactaccttttacagatcaagaatatcaaagtcgattaactaaattaagaaccacaatgagtaaaaataatcttgatatgattattttaacttcaatgcacaacattgcttactatacaggatttatttattgttcttttggtagaccttatggctgtgtagtaacggctaataaaatttcaacaatttcagcaaacattgatgctagtcaaccttggcgtagatctcatagtgataatgttatttatactgattggaaaagagataattttttaaaagcaattgtttcaattattggaagagangaacctcctaagaatattggtattgaaaatgatcatgtaaccttagatgttaaagaaaagcttacgtctatttttactttttcagttttcagcgatgtttcaaaagatttaatgcaacttagaatgattaaatctgcngaagaaatagaaattattaaaaatggtgcaagaattgctgatcttgggggcgaagagattgtcaaaaatattaaagttggagaaagcgagcttgaaattgcaatagccggtagagatagaatggagcgtgaaattgcaaaaacgtatccngatgctgaatatatggatacctgggtttggtttcantcaggacttaatacggatggtgctcataacccaaaaaccaatagaaaattaaaatcaggagatattctttctttaaatactttccctatgatctcagggtactacacagctttagagagaactctttttttagataaaattgatgatgcatccttaaaagcttgggaagcaaatgttaaagttcataaaagaggantagagntaattaaaccaggtgtaaaatgttctgatatttgtcatgagttgaatgaactatttgctgagcttggttatcttcattatcgaacatttggttatggtcattcatttggtgtcntatctcatttctatggaagagaagcaggattagaacttcgtgaagatatagatacngtnttagaggaaaacatggtggtttctatggaaccaatgatcatgataccagagggtaaaccaggagctggtggatatagagagcatgatatcttggttataggaaaagataatgctgaaaacattactaagtttccttttggtccagaacataatattatcaaatcataaattatgagtgaaaaaactgt

SEQ ID NO: 1130 - DNA, 4000 bp, Escherichia coli
  misc_feature (206)..(206): n is a, c, g, or t
  misc_feature (426)..(426): n is a, c, g, or t
  misc_feature (568)..(568): n is a, c, g, or t
  misc_feature (640)..(640): n is a, c, g, or t
  misc_feature (643)..(643): n is a, c, g, or t
  misc_feature (646)..(646): n is a, c, g, or t
  misc_feature (648)..(649): n is a, c, g, or t
  misc_feature (651)..(653): n is a, c, g, or t
  misc_feature (656)..(657): n is a, c, g, or t
  misc_feature (659)..(659): n is a, c, g, or t
  misc_feature (662)..(662): n is a, c, g, or t
  misc_feature (665)..(665): n is a, c, g, or t
  misc_feature (667)..(669): n is a, c, g, or t
  misc_feature (671)..(678): n is a, c, g, or t
  misc_feature (680)..(681): n is a, c, g, or t
  misc_feature (683)..(683): n is a, c, g, or t
  misc_feature (685)..(685): n is a, c, g, or t
  misc_feature (687)..(688): n is a, c, g, or t
  misc_feature (691)..(691): n is a, c, g, or t
  misc_feature (694)..(695): n is a, c, g, or t
  misc_feature (698)..(698): n is a, c, g, or t
  misc_feature (705)..(709): n is a, c, g, or t
  misc_feature (711)..(712): n is a, c, g, or t
  misc_feature (714)..(714): n is a, c, g, or t
  misc_feature (716)..(718): n is a, c, g, or t
  misc_feature (721)..(723): n is a, c, g, or t
  misc_feature (725)..(725): n is a, c, g, or t
  misc_feature (728)..(729): n is a, c, g, or t
  misc_feature (731)..(732): n is a, c, g, or t
  misc_feature (735)..(735): n is a, c, g, or t
  misc_feature (737)..(741): n is a, c, g, or t
  misc_feature (743)..(743): n is a, c, g, or t
  misc_feature (746)..(750): n is a, c, g, or t
  misc_feature (752)..(752): n is a, c, g, or t
  misc_feature (755)..(756): n is a, c, g, or t
  misc_feature (758)..(759): n is a, c, g, or t
  misc_feature (761)..(761): n is a, c, g, or t
  misc_feature (764)..(765): n is a, c, g, or t
  misc_feature (770)..(771): n is a, c, g, or t
  misc_feature (773)..(775): n is a, c, g, or t
  misc_feature (778)..(778): n is a, c, g, or t
  misc_feature (780)..(781): n is a, c, g, or t
  misc_feature (784)..(784): n is a, c, g, or t
  misc_feature (786)..(789): n is a, c, g, or t
  misc_feature (792)..(797): n is a, c, g, or t
  misc_feature (800)..(800): n is a, c, g, or t
  misc_feature (806)..(808): n is a, c, g, or t
  misc_feature (810)..(810): n is a, c, g, or t
  misc_feature (813)..(814): n is a, c, g, or t
  misc_feature (817)..(818): n is a, c, g, or t
  misc_feature (821)..(822): n is a, c, g, or t
  misc_feature (830)..(830): n is a, c, g, or t
  misc_feature (833)..(834): n is a, c, g, or t
  misc_feature (837)..(840): n is a, c, g, or t
  misc_feature (842)..(843): n is a, c, g, or t
  misc_feature (845)..(849): n is a, c, g, or t
  misc_feature (851)..(852): n is a, c, g, or t
  misc_feature (854)..(854): n is a, c, g, or t
  misc_feature (856)..(857): n is a, c, g, or t
  misc_feature (859)..(859): n is a, c, g, or t
  misc_feature (861)..(861): n is a, c, g, or t
  misc_feature (864)..(867): n is a, c, g, or t
  misc_feature (874)..(874): n is a, c, g, or t
  misc_feature (877)..(877): n is a, c, g, or t
  misc_feature (880)..(880): n is a, c, g, or t
  misc_feature (882)..(882): n is a, c, g, or t
  misc_feature (885)..(885): n is a, c, g, or t
  misc_feature (887)..(893): n is a, c, g, or t
  misc_feature (896)..(896): n is a, c, g, or t
  misc_feature (898)..(898): n is a, c, g, or t
  misc_feature (900)..(902): n is a, c, g, or t
  misc_feature (904)..(908): n is a, c, g, or t
  misc_feature (911)..(911): n is a, c, g, or t
  misc_feature (913)..(913): n is a, c, g, or t
  misc_feature (916)..(920): n is a, c, g, or t
  misc_feature (922)..(922): n is a, c, g, or t
  misc_feature (926)..(926): n is a, c, g, or t
  misc_feature (928)..(929): n is a, c, g, or t
  misc_feature (931)..(932): n is a, c, g, or t
  misc_feature (936)..(936): n is a, c, g, or t
  misc_feature (939)..(940): n is a, c, g, or t
  misc_feature (943)..(943): n is a, c, g, or t
  misc_feature (945)..(950): n is a, c, g, or t
  misc_feature (953)..(953): n is a, c, g, or t
  misc_feature (955)..(955): n is a, c, g, or t
  misc_feature (957)..(959): n is a, c, g, or t
  misc_feature (961)..(961): n is a, c, g, or t
  misc_feature (963)..(963): n is a, c, g, or t
  misc_feature (965)..(965): n is a, c, g, or t
  misc_feature (967)..(968): n is a, c, g, or t
  misc_feature (971)..(971): n is a, c, g, or t
  misc_feature (973)..(976): n is a, c, g, or t
  misc_feature (978)..(978): n is a, c, g, or t
  misc_feature (982)..(982): n is a, c, g, or t
  misc_feature (984)..(984): n is a, c, g, or t
  misc_feature (988)..(990): n is a, c, g, or t
  misc_feature (992)..(992): n is a, c, g, or t
  misc_feature (994)..(994): n is a, c, g, or t
  misc_feature (996)..(996): n is a, c, g, or t
  misc_feature (998)..(1000): n is a, c, g, or t
  misc_feature (1002)..(1002): n is a, c, g, or t
  misc_feature (1006)..(1007): n is a, c, g, or t
  misc_feature (1012)..(1013): n is a, c, g, or t
  misc_feature (1015)..(1017): n is a, c, g, or t
  misc_feature (1019)..(1021): n is a, c, g, or t
  misc_feature (1023)..(1025): n is a, c, g, or t
  misc_feature (1029)..(1029): n is a, c, g, or t
  misc_feature (1275)..(1275): n is a, c, g, or t
  misc_feature (1284)..(1284): n is a, c, g, or t
atggatgaaaatctaacttcctaaggcatgagaataatattgcatcctcaacaacaacttttatgatagattgatcaaattgctcctttactaatctctattaagctattaggtcacagcatggatatgccgaagttatgagattatttaatccaagttgctgcagagcgctgaaacgttatcatacttgaggattacgcttgganaattctaagttcgtacctagaatatataaagcgtgtgttatttttatatcctagttcttatataaatgcaacaatgttcaacagagtaggcgcagttatacttcttgtttccgatatgaagaaatcaaaggaattttataataatgtgatgggtatggaaataaagctgcagactgatgattgggttgaattttcaaaacagggaactgttatcgctctncacccggcaaagaaaaagaagcaaaacaaatcgataaagaataagagcatgttgataggattcaacgttagcgatctggaggcagtttgtagtgaccttgaaagtaaaaaagtaaagttctacaagaaactgactcaagaanaatttggaaaacatgctattatagaagatccagatgaacacctaatttcgttagtagaaatggctccaaaanaanaantnntnnnganncnttnttntnnngnnnnnnnncnnananannganaannggnagtaaannnnnannanannnaannntnaannannttntnnnnnanatnnnnnanaanntnncnganncaacnnannnccnanntanannnnccnnnnnnganaaagcnnntngannagnnctnnaaatgctntgnntannnnannannnnntnntntnnananacnnnnttacaanaanttnanttncnnnnnnntantntnnntnnnnnaanantannnnntntgananntnntttnaannganannnnnnccnanannntngnananngantnnnnanggananccannngnanangnnncngganngccannannntnnntnnnatcnaataaattaaagatccttgcaggcatagtgacgtttatagttatagtcatagtaatggctgaatcagtagttatagtacaagcaggacataggggtgtagttctttatttaggtgcagtcgaaaatcgcgtccttggagaaggagtacacttcattgttccatttgccgaacaagtaatacaattagaagtacgtacactcaagtttcaagccgaagcaacagctgcatctaatgacctacaggangtacaaacngttatagctttaaactatcatattgatccaaatgatgcaaacgtaatatatcagcaacttggagaaaattatgcagatagaataatagctcctactatacaagaatcagttaaagcaagtgttgcaaaatttaatgcagaggagctcataactaagagagaaacagctaaaggtgttatagccaatactattcgtaatactttatcagccagaaatataatcgttgaaacggtatttataactgactttaaattctcacagtcatttgctgatcagatcgaagcaaaagtagtagcattccaaaagtttctgacagagcagaataatctaaaggccatccaagtagtcgcaaaccaaacagttgtacaagctcaagcacaagcaagagcaaatgtagctaaagctggtggtgaatcacaagcaatcaaaattattactgagcaactaagacaaagcccacaatacttgcaatggcaggctatcaatagatggaacggtcaaatgccctatgctcttggtagtagtggatttccttttttccagctgccaacaataccccagtcatcacaaccacaacagcaacaacaacaacagcaacagccgctgctgcagcaaaatcaaacaagataattgcaaacaacttccctcccttgcaacgctaccagaaacagaagttttttgatattgagcatagttcaaaagacataaatccatttttctaaccgctagcagctcatcagctatttaatattctgtctaatcggctcaatagctcttgattttctattggctttcggatgaactcatttttatcaaatataccttgatatattccataaggcatttcaccagctgtcagaaaacataccttaactttatcatctatcctctttatctccttgtataattcaaagccattcattttgggcattctgatatcaagtatcagcaagtcatatgaaccagcttcaaaattttctaatgctagcagggagtcattgaatgcatcaactttgagtccattttcttctaaagcttcctttaatgctaaattgacatctggttcatcgtctactaccaaaattctctttttcattatcgacgattaattctctcttttaggtctatagtctgtggctcctgcttgatctcatgctgtttttcatttaatggcaggctgaacgtaaaggtagctcctttttctacttgccctctcccatctttaataattttgttattctcagcccatatccttcctccatgagcttctatgatgcttttggatatgaataacccgagccctgtcccttgataagattttgaggtaaactttgaaaataacctgggcattatttcaggatctatgccaataccagtgtctgtgacgctgacaagagcctcggcgtcaatatttttcacgctaatacttatagttcccgctcttccatctttctcctttgcttcagtaaatttaatagcgttgtttaaaaggttagaaatcacttgggttatccttgctttatctgcctctacaaaaatatcatagggctgatataataattttatcatatttttctgttggatgttcttaataaagtctatatttgctacaatatcctctatagtatttgatattacatcatttagattaaattgctccttttttagatttagtgattggctctcaatctttgtaacgtctaatatatcatttgtaagtctccctaaccttcttgcatttcttacaatggcatccaaaagttcgctctgtttggtatcctttatttttgactgaagaatttgtgtcaagccaagtattggctgtattggcgttcttaattcatgtgcagctacattgataaattcattcttcatgttatccgcttcttttagcttttcatattgaatacgaattaattcttctctttgccttaacctttcattggtttctctcaaccttgcattatactgaatacttgataatgccagtgctataatattaatgaagtaaccagcatctttgagaacatgagccacgttgtgtgctgtatcaaaagatgcagcagaataagacattatgatttgagaaaagatatctactatcaaataacctaatattcctttatagaagacgtcagttctttcatataacttatttttataaaaataaaataaagctatcaaaaatagcacaagcgaaggaagctcatatggtctatgtacaggagaattatccagtacgctggcaggaaaaaccaagaatagtgaacttatggcagcacttgcagcaagaatagcaaggactgttaaataaactttgagagtattttgtaatttcacccgtcttcctgcttcttcatgttgctcttgttcgtcttttagtgaggataaagttgggtatttaacaattgcaataaccaggatggcactaagaaatattcttccagcaaaccaggtctgaggaatgaagtattttagaaatataggattatcaattgagctataagatattatcacatgcaataaatcaatcaaggcactggttaggaatccaattcctacaaagaggctgaatttatcgtctaatgtaagagctcttgaaagataagagaatgccaataccgcagcaagtattactgcaaacaactctatgtagaaatgatgaatctcagatgacagccaagtattaggattagcagatagaaccgctattatt

SEQ ID NO: 1131 - DNA, 4000 bp, Escherichia coli
  misc_feature (213)..(213): n is a, c, g, or t
  misc_feature (240)..(240): n is a, c, g, or t
  misc_feature (1240)..(1240): n is a, c, g, or t
  misc_feature (1684)..(1684): n is a, c, g, or t
  misc_feature (1985)..(1985): n is a, c, g, or t
  misc_feature (1988)..(1988): n is a, c, g, or t
  misc_feature (2545)..(2545): n is a, c, g, or t
  misc_feature (2614)..(2614): n is a, c, g, or t
  misc_feature (2800)..(2800): n is a, c, g, or t
  misc_feature (3112)..(3112): n is a, c, g, or t
  misc_feature (3970)..(3970): n is a, c, g, or t
ttgatacggctgctatacacgcttactccgtcaatatggctgtcaggtcttgcgaaataaatgtattcaaacacgcatctggcctgtttttcaggggcaagtgccatagtcatatcagactcaatgcccttttcaggagtgatggtgataacctctcccggctctatatccctgacaaactctgcaccgattgtatcaagtgcacaggtctcngatgtaacgatatatgcattgtctctntttccgatgcaaagaggcttaaaaccaaatgggtctctggctgcaataagctttctcgggctctcaaccacaagtgcataggctcccttaagcttctggcaggcacgtctgaccgcctcctccgctgtttttgagttaagacgctctctggcgatatgataagctataacctcagagtcgattgtggtctggaaaattgctcctgtatactcaagctccttgcgaagctcctttgcgttaatgaggtttccgttgtgtgccatggcaagtgtgcccttgacataatttaatacgagaggctgtgcattctcacgtgttgatgagcctgctgttgaatagcgcacatgtcccactccgatatcacccttcataggctctaaaatatcaggagtaaatacctcatttacaaggcccatacccttgtgtgtggtcacctttccctttggtccgtgtgtatcactcactgcaataccacagctttcctgtcctctgtgctgaagcgcaaaaaggccataatagatagtggatgcgacatttcctccatcaaaatcatacatgccgaacacaccacactcctcatgaagctcatcaaatacatggttatgctcgtcaatatcagaacacctttttaattttgtaccggtatgactttttgtatctatactagtatttatatactgatttatgttattgtcctggttcataatatctccgtttataattgcgaaatagtaacgcggaataaataatatattagcggctgaatttgcttcctgtaagaagctcaaatgcctctttatatttctctacagtcttcacaacaacctcatcaggtaaaagaaggtcattgtccggatttgccttgagccagtctcttacatactgcttgtcaaatgaaggctgtccctgtccaggcttatatccatcaagtggccagaagcgtgagctgtcaggtgtgagcatctcatcggcaagcactacctcaccctgctcatttaanccaaactcaaacttggtatctgcgatgatgatgccctttgtaagagcatactctgcacatttcttgtagagagcaattgtataatcgcgaatcttctctgcgtactctctgcccttctcaggataaatcttctctaatacttctactgatttttcgaatgagatattttcatcatgatctccaagatcagccttggtagatggtgtataaataggctcagggagcttatcagactcaacaagtccctccggaagtctgattccgcagactgtaccgttctcctggtagcttgcccagccgcttcctgtgatatatccacgaactatacactcgattggaagcatctcaagcttcttgcagagcatgctgtttccgttgaacctgtcctgaccgaagaactccggcatatcctttgcgtctactgaaatcatatggttaggaacnacatcctttgtgaattcaaaccagaacttagacatctgtgtgaggatggctcccttgtctgtaattttattctttaaaatatggtcaaaagcggaaatacgatctgttgcgaccataataaggctgtccccgttatcatatacttctcttacttttccttctttgaatggtttaaattcctgcatgattgtcctccatcttatgtgtaatttattttacaaatcaaatgctacccttaaattatataccagctcaatttgtaaagtcaacgtatattataagtttttttaaataattttgnacnatttataagcaattcttatatttattattatatctttaatatatcaaaacaaaagctccggttcaaaccctttgtctgcgccggagcctatataatacaaattttatttaacgataagtgactttcctgtcatctcttttggctgtggaagtcccataatctcaagcagtgttggagcgatatctgcaagacatccgccctcacgaagcttgtaagaagggtcagcgtttacaagaatgaaaggaacaggattggttgtatgagctgtatgaggttttcctgtctcataatcaatcatcttctctgcgtttccgtggtcagcacagatgaataatactccatccacatccttgattgcctgaactgcatcacctacgagtgaatcaactctctcaacagcctttacagcagccggaatcacacctgtatgtccaaccatgtcagggttagcaaagttgatgataataacatcatacttatctgacttgatagcctcaacaagatccattccaacctcaggagcgctcatctcaggctttaagtcatatgttgcaacntccttaggactgtttacaagaagacgtgcctcatcgatattcggctcctctactccaccattaaagaanaaggttacgtgtgcatacttctctgtctctgcgagacgaagctgtttcttgccatttgctgcaagatactcaccaaatgtattcttgatttcttccttctcaaaagcgataagcttgttaggaattgactcgtcataatccttgaagcatacaaatgttgtcttaaggaatgggcgctcaaagccngtaaacttatcatcgcaaaatgctcttgtcatctcacgagcacggtccggacggaagttgaagaagataacagaatcattgtcctttacaacagataccggtgtgccatcctcgtttgtgataactgtaggaagcacgaactcatctgtaacgtcatttgcgtatgactcctccatagcctttacagggcatgtagcttttacgccttcacccttagtgagtgaatcataagccttctgcacacgatcccagttgttatctctgtccattgcatagtaacgtcctgaaagagatgcaatctttcctacaccnatttccttcatcttggcgagaagctgctcgatatagtccttgcctgatgcaggaggtgtatcacgaccatcaaggaatgcgtgtacatatactctgtcaaaattctctttcttgcaaagctcaagaagtccgtaaagatgctcgatatggctgtgaactccaccatctgaaagaagtccccaaagatgcagatcggagtcattcttcttgcagttttcgattgcagaaattaataccttgttcttgaagaaatcaccatcagcaattgcctttgtgattcttgtaagatcctgatatatgatacggcctgcgccgatattcatatgtcctacctcagagtttcccatctgtccgtcaggaagtccaactgcaagacctgaagctgcgccctttacaaaaggacactctgccatcaatttatccataacaggggtatttgccatagctatggcatttccctctttgtggtcacttaagccgtaaccatcaagtaccattaatactaccggtttcttactcatttatatttcctctattcttcatatgaggcttgcaaaatgctctattacagtgacatatgcaagctcacaaaaaatttcattacataataaatgccactaaatgcagctaagctggtgaatttagtgacatttagttattgtgattgtcaaatcaaatattaaattatgatttaataattacttgtagtttacgatctttccaaaatcagccttgagtgaagcgccaccaactaatccaccgtcgatgtcaggctttgcaaaaagctctgctgcatttcctgcatttacagatccgccgtactggatacgaactgaatctgctgtagcctgatcatanatctcagctacacactcacgaattgcaccg

SEQ ID NO: 1132 - DNA, 4000 bp, Escherichia coli
  misc_feature (63)..(63): n is a, c, g, or t
  misc_feature (148)..(148): n is a, c, g, or t
  misc_feature (154)..(154): n is a, c, g, or t
  misc_feature (406)..(406): n is a, c, g, or t
  misc_feature (861)..(861): n is a, c, g, or t
  misc_feature (874)..(874): n is a, c, g, or t
  misc_feature (1554)..(1554): n is a, c, g, or t
  misc_feature (2016)..(2016): n is a, c, g, or t
  misc_feature (2053)..(2053): n is a, c, g, or t
  misc_feature (2142)..(2142): n is a, c, g, or t
  misc_feature (2304)..(2304): n is a, c, g, or t
  misc_feature (2346)..(2346): n is a, c, g, or t
  misc_feature (2358)..(2358): n is a, c, g, or t
  misc_feature (2379)..(2379): n is a, c, g, or t
  misc_feature (2388)..(2388): n is a, c, g, or t
  misc_feature (2408)..(2408): n is a, c, g, or t
  misc_feature (2484)..(2484): n is a, c, g, or t
  misc_feature (2547)..(2547): n is a, c, g, or t
  misc_feature (2769)..(2769): n is a, c, g, or t
  misc_feature (2943)..(2943): n is a, c, g, or t
  misc_feature (2952)..(2952): n is a, c, g, or t
  misc_feature (2984)..(2984): n is a, c, g, or t
  misc_feature (3024)..(3024): n is a, c, g, or t
  misc_feature (3072)..(3072): n is a, c, g, or t
  misc_feature (3255)..(3255): n is a, c, g, or t
  misc_feature (3432)..(3432): n is a, c, g, or t
  misc_feature (3435)..(3435): n is a, c, g, or t
  misc_feature (3525)..(3525): n is a, c, g, or t
tctactgcggggactgatgtagctcgtcgtaagtccataacccgctgcggccaaacttttttnaagggccggcacatccaatagctccttatccacggtggctttaaaactcccactggcatagcgcacctgaatttgttccataccnggagtnccctcagcaatgctatgcgcactgtgcgcgcagccggcgcaggtcattcctgataaagcccattgaatttgctcttttgccatggttcaaaggtaggtattgcgaatggtaaaaagtatctttgaatatccgcataactagttacacctttcatgaatccacttatagattttcccgcaacgccgcatcaagcacttgcttttgaccgtattgatccagaacattttttacccgcattggaacattggattnaggtatcaaaggagcgtcaggatgccattgtggctaattctgaggcacccacatttgaaaataccgtggccgctctagaattctcatcgctggaattgaataaagtaagcagttgtttttttaacctcaatagtgcagagacgaacgacgcaattcaagaaattgcgcgcactttttcgccgaagttgacggcatttagtagcgagactttgttgaatgagcctttgtttttgcgcattcagactgtctatgaatccgagggtaaggacctagcgttagaagcacagcgtttattgaaggaaacctatgagagttttgtccgtaatggtgcggctttaaaaggcgatgaccggaatagattaactgttctaaatgaagaattaagcacgttgtcattgacgtttggggagcatattttgtccgaaacgaaggcgtttcattaccatactacttcngccgaggaccttnaaggaattcctgaagacgtggttgaatctgccgctcaactcgccgaacagcaggggaaagaaggctatgtattgggtttagatatgcccacctacatggcagtgatgaaatatgccgaccgctccgaattgcgcgcgcatttttaccgcgcttatggctctcgtggtgctaaagagaacgaaaacaacaatgagcaagtcatcacagacctcgtgaacaaacgtatggagcgcgcacaattgcttgggttcgattctcatgcccagctcaccttgagcaagcgtatggcgaaaacgccgcatacggtgcttaactttttggaccacctacttgcggtcgctaaaccagccgcagagaaagatttggaagcggtggctgactatgcttcagcacaaggtgctgaacttccacttcagccttgggattttagttattggtctgaaaaattcaagatggagcgtctttccctagacgatcaggcgttgaagccctattttaaacttgaaaatgttttagcgggtgcctttaccgttgcggcccgattgtttggactccgtttcgaacacaataccgagctccccgtgtaccataaggacgttgatgcctatgaagtttttgatgccaacggtaattttttaagtctcttttacgcggactttttccctcgagacggaaagcgngcaggagcttggatgaccagctaccaaagcatgcatacgatgaagggacaggaagtacgaccacacattagtattgtgtgcaacttcaccaagcctacagcatcaaagccatcactactgaccttcaatgaagtcacaaccttattccatgagtttggacatgccttgcacggaatgatggcgcgtgggacgtacccgtcactcacgggtaccagtgtttattgggattttgtggaacttccgtctcaaatcatggaaaattggtgctaccagcctgaagctttggcgctcttcgctaaacattaccagaccggtgcagtgctgccaacagaatttattgataagataaaagaaagtcagacctttttagaggggtacatgacgctgcgtcagctcaactttggctatttagatatgagttggcaccacaggactgaccgcttcgaaggcagtgtggctgcncatgaaaaggcggcaacggagcgaacttccttatttncagaagttgccggaaccctttcgagcaccgcatttagtcatattttccagggcgggtatagtgccggctactacagttacaaatgggcngaggtattagatgcagatgcttttgaacggtttgaagaggaaggattgttcaatccaaacgtagctgccgatttctcggttgtcttacaaagtggtggtacggttccaccggatgaactgtatcgaaactttagaggacgtgatccaaaggtagacgccctnttaaagcgtgcgggaatttcggcttaatgcaaactacgcacnttgtactgaaancgccaatacaaagcaattgcngcgagtaanagtcctatagccaacccaanccaaacgcctaaaggacctatggccattaccacgcccaggtagtagcacagcggtacagcaacaacccaataggcnataaaggcaataatggtaggaatgttaacgtcctgaacacctcgaagcgcgcctaaggttgtngcttggagtccatctggcaattggaaaataccagcggcaatcatcagcacggcagtgtattgcaatacttcaggatcggagctgtaaaattcgggtacaatattgcgcaatgcaatgagcagtcccatggtcaataccatcatggccagagttaggtggaacaagctttggccagctaagcgaagcataggaaagtctttcttgcccaattgattccccacnctaatggttgctgctgccccaagtccgcttaccatcatgtagctgacagaagcgatgttgagtgcgatctgatgtgcggcttgttgcacaggacctatcatcccgacgatcactccgctcatagcaaaagcaccagcttcaaatacatattgcaaaccacttgggacaccaatnactaatatntctcgaatgcttttccatgagatttggctgtngcgccaatggctccagtaactggcaaatttttggtgcttncggatgtacaaagccatccccgcaagcattaagaaacgagtgcttaangtagctatagcagcaccggctaggcccaactccgggaacggtccccaacctgtaattagtggatagttcaataatatgttcagcaaattggctaccagactaacgcgcataccggccttcgtatcgctcaatccttccgcgaattgcttaaaggcaaaaaagctcatcatggggacgatcganagcccaaccaaatggatatatggcaatgaagcctcaacgacacgtgcatcctgacctaaaaggtgcgcaaattgagcaaaaagggccagaacaccgtatacgagtaatcccaatatggaatttaaaacaagcccgttcttgaagtatttcacggcctctgcaggatcttctttgccntcngcacccgcaattaaaggggtaaggccgtacgcaacaccaatagcaaaaaccatgggtatgatgagtatagaaacggctagggaaacggcngctaaaggaatagtgcctaagaacttacccaccatgatagaatctgcaacagagacaagaatttgtcctaattgcccgatcatgaccgggtaggccaattttagactaatcccgtattgggatttatatgtattccattgataggccaattcggcttagagattatagcgctctacctcacgggtataaaacacctctgcctctgcgatcaatccttctagaattttggtcaaatcaccttcactttcatcgccgatatcatccaaccactttatctcatcgttctcgagattgagaatgaaggcaggaaactctgtgtgaacgatataaaccgcatccggtagatcggtattgtctgcaactaagaatttaggaaagtccatttgtatccgttttgaaaggcaaaagtacgtctatttacgtgcgtatgtgcttacgtcgtcagcactaatttctgaaccgcctaaaatatgta

SEQ ID NO: 1133 - DNA, 4000 bp, Escherichia coli
  misc_feature (146)..(146): n is a, c, g, or t
  misc_feature (407)..(407): n is a, c, g, or t
  misc_feature (1985)..(1985): n is a, c, g, or t
  misc_feature (1993)..(1993): n is a, c, g, or t
  misc_feature (2931)..(2931): n is a, c, g, or t
  misc_feature (2947)..(2947): n is a, c, g, or t
  misc_feature (2989)..(2989): n is a, c, g, or t
  misc_feature (2998)..(2998): n is a, c, g, or t
  misc_feature (3027)..(3029): n is a, c, g, or t
  misc_feature (3033)..(3034): n is a, c, g, or t
  misc_feature (3037)..(3038): n is a, c, g, or t
  misc_feature (3043)..(3043): n is a, c, g, or t
  misc_feature (3046)..(3047): n is a, c, g, or t
  misc_feature (3050)..(3050): n is a, c, g, or t
  misc_feature (3053)..(3053): n is a, c, g, or t
  misc_feature (3055)..(3058): n is a, c, g, or t
  misc_feature (3062)..(3062): n is a, c, g, or t
  misc_feature (3065)..(3066): n is a, c, g, or t
  misc_feature (3068)..(3069): n is a, c, g, or t
  misc_feature (3076)..(3077): n is a, c, g, or t
  misc_feature (3079)..(3079): n is a, c, g, or t
  misc_feature (3081)..(3081): n is a, c, g, or t
  misc_feature (3084)..(3084): n is a, c, g, or t
  misc_feature (3089)..(3092): n is a, c, g, or t
  misc_feature (3095)..(3095): n is a, c, g, or t
  misc_feature (3098)..(3099): n is a, c, g, or t
  misc_feature (3102)..(3102): n is a, c, g, or t
  misc_feature (3104)..(3104): n is a, c, g, or t
  misc_feature (3107)..(3109): n is a, c, g, or t
  misc_feature (3112)..(3112): n is a, c, g, or t
  misc_feature (3114)..(3114): n is a, c, g, or t
  misc_feature (3116)..(3117): n is a, c, g, or t
  misc_feature (3120)..(3120): n is a, c, g, or t
  misc_feature (3122)..(3125): n is a, c, g, or t
  misc_feature (3128)..(3129): n is a, c, g, or t
  misc_feature (3131)..(3131): n is a, c, g, or t
  misc_feature (3134)..(3136): n is a, c, g, or t
  misc_feature (3142)..(3143): n is a, c, g, or t
  misc_feature (3146)..(3147): n is a, c, g, or t
  misc_feature (3149)..(3150): n is a, c, g, or t
  misc_feature (3152)..(3153): n is a, c, g, or t
  misc_feature (3155)..(3155): n is a, c, g, or t
  misc_feature (3158)..(3161): n is a, c, g, or t
  misc_feature (3163)..(3163): n is a, c, g, or t
  misc_feature (3165)..(3165): n is a, c, g, or t
  misc_feature (3168)..(3168): n is a, c, g, or t
  misc_feature (3170)..(3173): n is a, c, g, or t
  misc_feature (3176)..(3176): n is a, c, g, or t
  misc_feature (3179)..(3180): n is a, c, g, or t
  misc_feature (3182)..(3183): n is a, c, g, or t
  misc_feature (3185)..(3190): n is a, c, g, or t
  misc_feature (3192)..(3192): n is a, c, g, or t
  misc_feature (3194)..(3195): n is a, c, g, or t
  misc_feature (3199)..(3199): n is a, c, g, or t
  misc_feature (3201)..(3203): n is a, c, g, or t
  misc_feature (3209)..(3210): n is a, c, g, or t
  misc_feature (3213)..(3216): n is a, c, g, or t
  misc_feature (3219)..(3219): n is a, c, g, or t
  misc_feature (3222)..(3222): n is a, c, g, or t
  misc_feature (3224)..(3227): n is a, c, g, or t
  misc_feature (3229)..(3231): n is a, c, g, or t
  misc_feature (3233)..(3233): n is a, c, g, or t
  misc_feature (3238)..(3240): n is a, c, g, or t
  misc_feature (3242)..(3242): n is a, c, g, or t
  misc_feature (3244)..(3244): n is a, c, g, or t
  misc_feature (3247)..(3251): n is a, c, g, or t
  misc_feature (3253)..(3254): n is a, c, g, or t
  misc_feature (3257)..(3258): n is a, c, g, or t
  misc_feature (3261)..(3261): n is a, c, g, or t
  misc_feature (3264)..(3266): n is a, c, g, or t
  misc_feature (3269)..(3272): n is a, c, g, or t
  misc_feature (3275)..(3275): n is a, c, g, or t
  misc_feature (3278)..(3279): n is a, c, g, or t
  misc_feature (3281)..(3281): n is a, c, g, or t
  misc_feature (3285)..(3288): n is a, c, g, or t
  misc_feature (3291)..(3291): n is a, c, g, or t
  misc_feature (3293)..(3293): n is a, c, g, or t
  misc_feature (3296)..(3296): n is a, c, g, or t
  misc_feature (3298)..(3300): n is a, c, g, or t
  misc_feature (3306)..(3307): n is a, c, g, or t
  misc_feature (3312)..(3314): n is a, c, g, or t
  misc_feature (3316)..(3316): n is a, c, g, or t
  misc_feature (3320)..(3321): n is a, c, g, or t
  misc_feature (3326)..(3327): n is a, c, g, or t
  misc_feature (3329)..(3329): n is a, c, g, or t
  misc_feature (3332)..(3332): n is a, c, g, or t
  misc_feature (3341)..(3341): n is a, c, g, or t
  misc_feature (3344)..(3344): n is a, c, g, or t
  misc_feature (3348)..(3350): n is a, c, g, or t
  misc_feature (3352)..(3352): n is a, c, g, or t
  misc_feature (3356)..(3357): n is a, c, g, or t
  misc_feature (3359)..(3359): n is a, c, g, or t
  misc_feature (3361)..(3362): n is a, c, g, or t
  misc_feature (3364)..(3369): n is a, c, g, or t
  misc_feature (3371)..(3372): n is a, c, g, or t
  misc_feature (3376)..(3376): n is a, c, g, or t
  misc_feature (3381)..(3381): n is a, c, g, or t
  misc_feature (3383)..(3386): n is a, c, g, or t
  misc_feature (3389)..(3390): n is a, c, g, or t
  misc_feature (3392)..(3393): n is a, c, g, or t
  misc_feature (3395)..(3397): n is a, c, g, or t
  misc_feature (3399)..(3400): n is a, c, g, or t
  misc_feature (3405)..(3405): n is a, c, g, or t
  misc_feature (3408)..(3408): n is a, c, g, or t
  misc_feature (3414)..(3414): n is a, c, g, or t
  misc_feature (3416)..(3417): n is a, c, g, or t
  misc_feature (3419)..(3421): n is a, c, g, or t
  misc_feature (3423)..(3423): n is a, c, g, or t
  misc_feature (3425)..(3428): n is a, c, g, or t
  misc_feature (3431)..(3431): n is a, c, g, or t
  misc_feature (3433)..(3437): n is a, c, g, or t
  misc_feature (3441)..(3441): n is a, c, g, or t
  misc_feature (3443)..(3443): n is a, c, g, or t
  misc_feature (3446)..(3448): n is a, c, g, or t
  misc_feature (3450)..(3451): n is a, c, g, or t
  misc_feature (3453)..(3456): n is a, c, g, or t
  misc_feature (3458)..(3458): n is a, c, g, or t
  misc_feature (3461)..(3462): n is a, c, g, or t
  misc_feature (3464)..(3464): n is a, c, g, or t
  misc_feature (3466)..(3467): n is a, c, g, or t
  misc_feature (3470)..(3471): n is a, c, g, or t
  misc_feature (3473)..(3473): n is a, c, g, or t
  misc_feature (3475)..(3476): n is a, c, g, or t
  misc_feature (3478)..(3478): n is a, c, g, or t
  misc_feature (3481)..(3481): n is a, c, g, or t
  misc_feature (3485)..(3485): n is a, c, g, or t
  misc_feature (3487)..(3487): n is a, c, g, or t
  misc_feature (3489)..(3491): n is a, c, g, or t
  misc_feature (3493)..(3494): n is a, c, g, or t
  misc_feature (3496)..(3496): n is a, c, g, or t
  misc_feature (3499)..(3499): n is a, c, g, or t
  misc_feature (3502)..(3502): n is a, c, g, or t
  misc_feature (3509)..(3510): n is a, c, g, or t
  misc_feature (3515)..(3515): n is a, c, g, or t
  misc_feature (3517)..(3521): n is a, c, g, or t
  misc_feature (3524)..(3524): n is a, c, g, or t
  misc_feature (3528)..(3528): n is a, c, g, or t
  misc_feature (3530)..(3530): n is a, c, g, or t
  misc_feature (3533)..(3533): n is a, c, g, or t
  misc_feature (3536)..(3536): n is a, c, g, or t
  misc_feature (3539)..(3539): n is a, c, g, or t
  misc_feature (3543)..(3543): n is a, c, g, or t
  misc_feature (3545)..(3546): n is a, c, g, or t
  misc_feature (3550)..(3550): n is a, c, g, or t
  misc_feature (3552)..(3552): n is a, c, g, or t
  misc_feature (3554)..(3555): n is a, c, g, or t
  misc_feature (3560)..(3561): n is a, c, g, or t
  misc_feature (3563)..(3566): n is a, c, g, or t
  misc_feature (3569)..(3569): n is a, c, g, or t
  misc_feature (3575)..(3578): n is a, c, g, or t
  misc_feature (3581)..(3582): n is a, c, g, or t
  misc_feature (3584)..(3584): n is a, c, g, or t
  misc_feature (3586)..(3586): n is a, c, g, or t
  misc_feature (3588)..(3590): n is a, c, g, or t
  misc_feature (3592)..(3596): n is a, c, g, or t
  misc_feature (3599)..(3599): n is a, c, g, or t
  misc_feature (3604)..(3604): n is a, c, g, or t
  misc_feature (3606)..(3606): n is a, c, g, or t
  misc_feature (3608)..(3608): n is a, c, g, or t
  misc_feature (3610)..(3612): n is a, c, g, or t
  misc_feature (3616)..(3616): n is a, c, g, or t
  misc_feature (3619)..(3622): n is a, c, g, or t
  misc_feature (3624)..(3624): n is a, c, g, or t
  misc_feature (3627)..(3628): n is a, c, g, or t
  misc_feature (3631)..(3631): n is a, c, g, or t
  misc_feature (3638)..(3641): n is a, c, g, or t
  misc_feature (3646)..(3646): n is a, c, g, or t
  misc_feature (3648)..(3651): n is a, c, g, or t
  misc_feature (3653)..(3654): n is a, c, g, or t
  misc_feature (3656)..(3656): n is a, c, g, or t
  misc_feature (3660)..(3660): n is a, c, g, or t
  misc_feature (3667)..(3668): n is a, c, g, or t
  misc_feature (3672)..(3673): n is a, c, g, or t
  misc_feature (3675)..(3675): n is a, c, g, or t
  misc_feature (3677)..(3680): n is a, c, g, or t
  misc_feature (3682)..(3684): n is a, c, g, or t
  misc_feature (3687)..(3688): n is a, c, g, or t
  misc_feature (3690)..(3690): n is a, c, g, or t
  misc_feature (3692)..(3692): n is a, c, g, or t
  misc_feature (3695)..(3696): n is a, c, g, or t
  misc_feature (3700)..(3700): n is a, c, g, or t
  misc_feature (3703)..(3704): n is a, c, g, or t
  misc_feature (3706)..(3707): n is a, c, g, or t
  misc_feature (3710)..(3713): n is a, c, g, or t
  misc_feature (3715)..(3716): n is a, c, g, or t
  misc_feature (3718)..(3718): n is a, c, g, or t
  misc_feature (3721)..(3722): n is a, c, g, or t
  misc_feature (3725)..(3725): n is a, c, g, or t
  misc_feature (3729)..(3730): n is a, c, g, or t
  misc_feature (3732)..(3732): n is a, c, g, or t
  misc_feature (3734)..(3735): n is a, c, g, or t
  misc_feature (3737)..(3738): n is a, c, g, or t
  misc_feature (3740)..(3740): n is a, c, g, or t
  misc_feature (3742)..(3742): n is a, c, g, or t
  misc_feature (3744)..(3745): n is a, c, g, or t
  misc_feature (3747)..(3748): n is a, c, g, or t
  misc_feature (3750)..(3751): n is a, c, g, or t
  misc_feature (3753)..(3753): n is a, c, g, or t
  misc_feature (3756)..(3756): n is a, c, g, or t
  misc_feature (3758)..(3759): n is a, c, g, or t
  misc_feature (3761)..(3761): n is a, c, g, or t
  misc_feature (3763)..(3765): n is a, c, g, or t
  misc_feature (3768)..(3768): n is a, c, g, or t
  misc_feature (3770)..(3770): n is a, c, g, or t
  misc_feature (3772)..(3772): n is a, c, g, or t
  misc_feature (3774)..(3778): n is a, c, g, or t
  misc_feature (3780)..(3782): n is a, c, g, or t
  misc_feature (3785)..(3786): n is a, c, g, or t
  misc_feature (3789)..(3789): n is a, c, g, or t
  misc_feature (3791)..(3791): n is a, c, g, or t
  misc_feature (3793)..(3793): n is a, c, g, or t
  misc_feature (3795)..(3795): n is a, c, g, or t
  misc_feature (3797)..(3799): n is a, c, g, or t
  misc_feature (3801)..(3801): n is a, c, g, or t
  misc_feature (3806)..(3809): n is a, c, g, or t
  misc_feature (3817)..(3817): n is a, c, g, or t
  misc_feature (3820)..(3820): n is a, c, g, or t
  misc_feature (3822)..(3822): n is a, c, g, or t
  misc_feature (3824)..(3824): n is a, c, g, or t
  misc_feature (3826)..(3827): n is a, c, g, or t
  misc_feature (3830)..(3835): n is a, c, g, or t
  misc_feature (3837)..(3837): n is a, c, g, or t
  misc_feature (3841)..(3841): n is a, c, g, or t
  misc_feature (3845)..(3845): n is a, c, g, or t
  misc_feature (3848)..(3848): n is a, c, g, or t
  misc_feature (3855)..(3855): n is a, c, g, or t
  misc_feature (3864)..(3864): n is a, c, g, or t
  misc_feature (3866)..(3867): n is a, c, g, or t
  misc_feature (3869)..(3870): n is a, c, g, or t
  misc_feature (3873)..(3873): n is a, c, g, or t
  misc_feature (3875)..(3875): n is a, c, g, or t
  misc_feature (3878)..(3883): n is a, c, g, or t
  misc_feature (3885)..(3885): n is a, c, g, or t
  misc_feature (3887)..(3887): n is a, c, g, or t
  misc_feature (3891)..(3893): n is a, c, g, or t
  misc_feature (3895)..(3895): n is a, c, g, or t
  misc_feature (3899)..(3903): n is a, c, g, or t
  misc_feature (3905)..(3905): n is a, c, g, or t
  misc_feature (3911)..(3912): n is a, c, g, or t
  misc_feature (3915)..(3916): n is a, c, g, or t
  misc_feature (3918)..(3918): n is a, c, g, or t
  misc_feature (3922)..(3925): n is a, c, g, or t
  misc_feature (3927)..(3927): n is a, c, g, or t
  misc_feature (3929)..(3932): n is a, c, g, or t
  misc_feature (3934)..(3938): n is a, c, g, or t
  misc_feature (3945)..(3947): n is a, c, g, or t
  misc_feature (3949)..(3949): n is a, c, g, or t
  misc_feature (3951)..(3951): n is a, c, g, or t
  misc_feature (3954)..(3955): n is a, c, g, or t
  misc_feature (3957)..(3958): n is a, c, g, or t
  misc_feature (3960)..(3961): n is a, c, g, or t
  misc_feature (3963)..(3971): n is a, c, g, or t
  misc_feature (3973)..(3973): n is a, c, g, or t
  misc_feature (3976)..(3977): n is a, c, g, or t
  misc_feature (3980)..(3982): n is a, c, g, or t
  misc_feature (3984)..(3987): n is a, c, g, or t
  misc_feature (3990)..(3992): n is a, c, g, or t
  misc_feature (3995)..(3996): n is a, c, g, or t
cgagcacggttccggccagccccgcgagccgatcgtagacccgacgcgtgaccgcctccgcatacacctccgccatggccgcctggtttgccggccgctccgtgggccgcatcccggcgagccgcttcctttccacgtcgctgcgnatccgcacggcggcgagcggtcccaccaactccgccgccaccgacgacttgccgctgcccgatgcgccgctggtcaccaccatcaccggccgccggccgaccgcgagccgctcagcgaggtcgacataacgcaaggcctcgtcccgcgacgtggcgtccccctgccccgcgcggatcgcggcgatcgacgcccgcacgaccgcccggtaggcctcgtagacgggcatcacggcgatcgactggtgatcggcggcggcctcnacccagctactgagcacctctgccgccaggtcggcgcggccccgtgacttgaggtccattgtcaagaaggccacgtcgttggccacgtcgatccatcgcaggttgtcgctgaactcgatcgcgtcgaatggcgtcatccgaccgtcgtggagcacgatgttggcgaggtgcaggtcgccatggcactcgcgaatgcggcccgctgcctgccgcgcggcgaggagcggagtcgcggcaaggagccggcatcgcagccagtcgtcgaggcggtcggcgcggtccgcggcctgcggcaggtgcgtgcggagggcagcgaggttgactgccactgcctcgcacaccgagtcggccgtgccccatggctccccctcgcgggccaccggcaggcacgcctcgatcgccgcgatcgcctcgcccagtgttcggcagtcagccgcggtcagtcggccggcctcgaaccgggcgtcgagccggtcgccctcgtcgaactgcacgagcttcaccgcccattcgactggttcgccgtcgccgctcacgcggggcgcgtcgccgctgccggtgattggcacggccgccacgtagagctccggcgcaaaccggctgctcacgcggacctcgccctcgcacgaccgccgtcgccgatcaaccgtagagtaatcgacgaaccccagcgacaccggcttcttgagcttgtaggcgaagggccccgtgaggatcacccacgagatgtgcgtctccaccagccgaatgcggcccgtcggatgcgggtacgccgccggatcgagcagccgctcaatgagcacgggcctcggaaacgggggcgtcatcatgagggaagtttacgtcgccggcccctgcccctcgggctcaagtgcgtcgattacctcgatcatcgacgccacatccccagacgacactcgggccgttcgccgcgtggcggtcgccacgcaggtctcgtggagcatcgccggatcgaccgccgcgaggccacggtagcggcgaaccgtcatctcgcccgactcgcggccgcggtcggccaaggcggcgagttccggctccgaaaacgcgatctcgatctctcccgacaccaccacctcgccccacggcggacgcacgacctcgatcctccccgcatcgaggagcggccgcatccagcggtggaagaagaggagcaccaggtatccgcagtggatgccgtcggcgtcggggtcggtgagcacgagcacgcggtcgtaccggagccgccgcgggtcgcacgtcgcctcgaaaccggcgccaagcgccgccgccagcgggccgaagaagggatggctctcgaccttggcccgcgacgcccgggccgcgttgagcggcttgccctgcatcggcagcaccgcctggcagagggggtcgcggacgagggccacagcagatgcggcggagtctccctccaccacgaagagttccgcaccggagccgcggccgtgcgtggcggaatcgtccagtttcgcaggggccccgtagcggtcgcgaaaaaccttcgtcatggcttctccacccaattgttgcaggccgggccgtggttcggcatactggaanagaacacngcgatcaaccactgatcgcccacttttttggaaccgctcctgaccgcgtgaacctcccgtcgactgcctccgtccggaatcccggacgacgcgatgggatgtggtcagcgttcgcaggttccctggtggccatgccgcccgttcctcgctgcccccatccctcgcccgtccctgccggcccgaaggcatcgcggtgttcgcggtcccttcccgaggtcgtgccatgttcgtcgcgattcgccaggtcatccttccgctcgtagccgccatgctggttgccggcagcgcgccggccggcacgttcgtccacttcgacacgaacgtggcctccttcgacgtcgaactctacgacaccgcgatgccgaccacggtcgcgaacttcctctcgtacgtcaacgcgggcagctacacgtcgtcgctcatccatcggagcaccacctacaacccgtctgacatccagatcgtgcaggggggcggctactacctatccggcaaccaacttctctccattcccaccaacgcgccgatcatcctcgaatcaggcagcgtgggaaacatccgcggcacgatcgcgatggcccgcggggccgcgaccaacagcgccacgagccagttctttttcaacgttcagagcaaccccgccctcgacggcaactacgctgtgttcggcaacgtggtcggagcgactgggctcgccgcgctcgacgcgatcggggcggtgccggtgtacgactgcaccgctcaactcggctcggcgttcggcgaaatgccgctgaccgcaccgtcgctcgatgccgctagtgtggtgatggtcaatagcgtggtgcccgtgccggagccatcgccactcgtgcttgccgccgtcggcctggctgcggcggcattcgcccgccgccgcgcgtagctgcctcagtagcacaggttgtcaacctgtgccncccgtagcacaggttnccaacctgtgcctcaccgcaggttaccaacctgcggctacgnttcgctccncgtagcacaggttgtcaacctgtgcctgnnnctcnncannccacntgnngcnatncnnnnccgnggnnannccaggcnncntncanccgtnnnngcnccnngancnccnnnccngncnnccncnnnnacnncnccnnnagcgcnnccnncnncnncngcnnnncnancgncnnnnccncgnncnngnnnnnncncnngccnannntcacanncgnnnncgncgncnnnntnnngncaaannngncnggnnnnncnnacnncgncgnnncgnnnntgnccnncncgannnngancnccncnnnatcccnnttgcnnnancgcnnaccgnncnccncgacgtccncgngcgnnnancgcnngnanntnnnnnncnnggcntcgancnnnngcnncnncnnnanntggcncgnggcgtncnngnnnancnnnnccncnnnnnccgncnccnnntnnannnncnctnncncnncgnngncnngngcntgcncngnnncnncntgnccngcgttgnncagcngnnnnnccntcgncncgnccncgncgtngnncagncngnngcccnngnnnncgntcgccnnnnccnncngngnnngnnnnnccncgttngncncnnngcgncgnnnngncannaantcccgcnnnngcgcngnnnncnngncggncgccgcnnccgnncngnnnncnnnccnncngncgnngcgngcnngnnagnnnncnncnatnncgngcgnncngnngnncnantnngnngnnanccngnncngnnnccngngnannnnngnnntcnngcncncngncnnngncgcgnnnnagtcggcnacnangncnnagnnnnnngncgcngcgnagncgtcgangaggtcgtngnncnnccncncgnnnnnngngncgannngntccnnnnncngcggcnnganngncgcnnnnangnnnncnnnnngccgcgnnngncncgnngnntnnannnnnnnnngnganngcnnntnnnnggnnnggnngggc

SEQ ID NO: 1134 - DNA, 4000 bp, Escherichia coli
  misc_feature (234)..(234): n is a, c, g, or t
  misc_feature (423)..(423): n is a, c, g, or t
  misc_feature (519)..(519): n is a, c, g, or t
  misc_feature (1985)..(1985): n is a, c, g, or t
ggcttaggcgtagactattttgcgaggtcgttgcccggcaagcaggttgaggctaggtcagacgacaatacagcatgtttaatgttgcaggggcctgatgcggaaaagctattaaccaatgaagttttggcgtctcctcctgccctcactcctgctcggcttaaacggttcgaacatggtctattttctattcaaaattctgaagtgatgattgcgcgtaccagctattctggngaggatggatttgaaatttttgccgggcgtgaggacgcaaaaaagatttggaatatttttgccactctgggggccctgccagttggatttgacgcgattgatattgctagaattgaggctggactactattttttggtaaggatatgaccggagtagaaaccccaacggaacttggactcgactttatngtagatttctcaaagcgaaattttcgcggcaaaacgggccttcaaaaaaaatcgcaaaagccgaggtttaagactgttggtttggctcttgatggntttgcccctttgtctggcaaagcgtcggtgtggatgagcggtgtctttgctggtagtgtaagcagtcatgctaccagtgcatggcttggtaagacggttgcgatagcacacattaaatcagatttagccacaaatggacgtgaaattaacgtctttgatgaaggctttttcgcaactgaaggttgcacaggctttgtttgccctcgtaagttctacactaacgtataaaaaaatgttgagattgtcgttttgtatattcaaaacagacgattttagacatttagattagtctaacgacgcaattgcgattgccgcaagtcgcgcagcaggcgggtctgaacgactagtcaaaacgattggcaccgcgccacctgccaccaaccctgctgctacaccgccagcacaccaaacaagagacttaaatagtatgtttcctgagacaatatctggaacaaccagagcgttggcctggccggcaactgggtttgtcatgcctttttcggtggtggctttgggtgaaattgcaagatcaaaagataaaggcccaaaaaaatctgcgttggggtcttgcttacctgctaattgcgcaattttgagcgcttcgacactcgacggaatgtttggtaaaatactctcagtggctgataagattgctatttttggtcgcgcaagaccaagttttcgtgacatttttgccatcaaaagagctgcctcaacacgcgtgtcaatgtctggttgtatatttattgctgcatcacttattaaaagtggtttgcctccattcggcggtagcatgacaaagacatgtacaagccgttggccaactcttattcctgcgtctcgttttacaaggccgcccataaatatatctgtgtgcagattacccttgacaaagcccgccacatcgccggctttgtgtcgagctatagaggcagcaatagcgtcctcttctccttttgtatcaatgatttccagcttgctaagcgaccaatcaataattttggcttcgcgctcaattacttcttgttcgccaactaaaatgggtttgaccagatttaactgatgagatttttgggcagtttctataacagttatgccggtcgcacggacaaaaacaaattcttttggattgttactgcgcgcttttttaaacaatagctcctgactattcaaagaccccttgaataaaaagtcgctgactaaattttcaaactctcgttttggcatcaggaatgtcccacgtggttgtgtcagttctgccgcccgctcaccgcatcgctaattcataaatgtcaaaccgtctccggtaaaactattttcagactatcgcacatagaaacatcaaccaactttaagtcatgaagagatatggttttttggcataatgttaggctttatctatgagcctatttttctgaatgggtagcgtcaagattgacaaaaatgctttttacgcagaataatancacttaaatacagttttagtgtaaatgggagttaacaaatggcgccgagaaaccataaagcctggctgaaatcgcctgaaattgagttcatctcaagtgagtgttacaacaatcacagcatttaccaacaagaaatcgagcaaatttttgcaaaagtatgggtgcctgtttgccacaccagtgaaatgtcgaacaacggtgatttcagagctagtcaaatcgctcatcaaaatgtagttgtcattaaccgcggagatggcgttgaagcgtttttatgtccctcgattgatagaccatccggtaacggtctcgacacagatgggctccagaaactccacagcgaggttaagcacggtggcatgatttgggttactctggatcctaatccgtcgcaaagtgttgaagaatggacttgtggcgctttcgactgtatcgcagatgcgatcgacacagaagagttggaggtttttcactaccacaaggcgataattgacaccaattacaagctatggcacgacactaatagtgaattttaccacgactttatgcattactttaaccgggtgtctggttttaacgatgaatattttgcgcgtaaaaatattccgtttgacaacggtcacgtgaatgtcagcagctttaccgtgaactatgaagagtatgatggtttcgaagatagaggagaactatcattcccaaatcttccacctaatcagtggtatatggttgatctctttccggggtttaactttaatttaagaggtagtgcttacagaagcgatagtgtaactccgctaggcccgaataaagttcttattgagtttagagggtatggtctgaaaagcgactcggatgaagatcgcgcgacccgcatcaagcatcataattcgatatggggtccatttggtcggaacctgcacgaagatttgatcggtgttgcaggtcaagggacgacaatgcgagagggcacagaagctcgtaacattttacatgggcgccatgagaactcaacaattcatgacgaagtggggatgcgtcactattatgaggcatggggcaatttcatgggaatttcctcattggctaacccgctgggcttagcggatgaaagtgtaatagccgccgaatagtaataactcttaatctgaactgaaaaacgggggtctccaacccccgtttttttgactgtattttttggagcaatatgttcatttgcggtcgttcgaggcgttaagatacaggaatttttgcaactcgttgttctcagccagcgagcgaccgacttcttcagcgatttttgttacaggaattactgtgtcggtttttaaccagaataagccaataccttttttgatgattgggtcctttagcaataacgcctttgtgcccgagtgaagccccggcattctggtgtagtgggtcggtataatggtgcagagttccgtaaactgtgtttgaaacatgagatgaagaatcgactccgactcaattttaggtgtaacttttttacctgtagctaagaaagtctcttctgcgatcgagcgctcatacattgacggccttagcagtgccagtggtaaatcacctgcttggttccaactgatttcctccatattctcgaattcaaatgagtcgggtacgagcagactccaggtttcctcaaatattggtagtgactcacaccacggcatgtcagatgactgatccatatatgttatgccgcagtcgattgaaaagttatccaatccggttcgcagttcttcattgcctacaaagcggacatcaactgatactaaaggataggcctttcgtatcctttgcaatataatcggcaaaacgggggacatagtggttatggcccccaggcgaatagttccgctcaggttgtctcgcatttcagcaattgtgtcacgcatggatgtgcaatttgccaatattatgcgtgcccattctgcgacttttttgccttcttcggtaaccccatacaagcgctgtcctcgtccccgtttaaaaag

SEQ ID NO: 1135 - DNA, 4000 bp, Escherichia coli
  misc_feature (2)..(3): n is a, c, g, or t
  misc_feature (5)..(6): n is a, c, g, or t
  misc_feature (8)..(10): n is a, c, g, or t
  misc_feature (13)..(14): n is a, c, g, or t
  misc_feature (16)..(16): n is a, c, g, or t
  misc_feature (22)..(23): n is a, c, g, or t
  misc_feature (29)..(29): n is a, c, g, or t
  misc_feature (31)..(32): n is a, c, g, or t
  misc_feature (35)..(35): n is a, c, g, or t
  misc_feature (37)..(38): n is a, c, g, or t
  misc_feature (41)..(42): n is a, c, g, or t
  misc_feature (44)..(44): n is a, c, g, or t
  misc_feature (46)..(48): n is a, c, g, or t
  misc_feature (50)..(51): n is a, c, g, or t
  misc_feature (58)..(63): n is a, c, g, or t
  misc_feature (70)..(70): n is a, c, g, or t
  misc_feature (72)..(72): n is a, c, g, or t
  misc_feature (74)..(74): n is a, c, g, or t
  misc_feature (76)..(76): n is a, c, g, or t
  misc_feature (78)..(79): n is a, c, g, or t
  misc_feature (83)..(83): n is a, c, g, or t
  misc_feature (92)..(93): n is a, c, g, or t
  misc_feature (96)..(96): n is a, c, g, or t
  misc_feature (100)..(102): n is a, c, g, or t
  misc_feature (104)..(105): n is a, c, g, or t
  misc_feature (107)..(107): n is a, c, g, or t
  misc_feature (114)..(114): n is a, c, g, or t
  misc_feature (117)..(117): n is a, c, g, or t
  misc_feature (119)..(121): n is a, c, g, or t
  misc_feature (124)..(124): n is a, c, g, or t
  misc_feature (128)..(128): n is a, c, g, or t
  misc_feature (131)..(131): n is a, c, g, or t
  misc_feature (133)..(137): n is a, c, g, or t
  misc_feature (142)..(142): n is a, c, g, or t
  misc_feature (145)..(145): n is a, c, g, or t
  misc_feature (147)..(148): n is a, c, g, or t
  misc_feature (150)..(150): n is a, c, g, or t
  misc_feature (152)..(152): n is a, c, g, or t
  misc_feature (155)..(155): n is a, c, g, or t
  misc_feature (161)..(163): n is a, c, g, or t
  misc_feature (165)..(167): n is a, c, g, or t
  misc_feature (170)..(171): n is a, c, g, or t
  misc_feature (173)..(173): n is a, c, g, or t
  misc_feature (177)..(177): n is a, c, g, or t
  misc_feature (181)..(181): n is a, c, g, or t
  misc_feature (185)..(185): n is a, c, g, or t
  misc_feature (190)..(190): n is a, c, g, or t
  misc_feature (195)..(196): n is a, c, g, or t
  misc_feature (201)..(202): n is a, c, g, or t
  misc_feature (206)..(207): n is a, c, g, or t
  misc_feature (209)..(209): n is a, c, g, or t
  misc_feature (215)..(215): n is a, c, g, or t
  misc_feature (217)..(218): n is a, c, g, or t
  misc_feature (226)..(229): n is a, c, g, or t
  misc_feature (231)..(232): n is a, c, g, or t
  misc_feature (234)..(234): n is a, c, g, or t
  misc_feature (236)..(236): n is a, c, g, or t
  misc_feature (241)..(241): n is a, c, g, or t
  misc_feature (247)..(250): n is a, c, g, or t
  misc_feature (252)..(254): n is a, c, g, or t
  misc_feature (258)..(258): n is a, c, g, or t
  misc_feature (262)..(263): n is a, c, g, or t
  misc_feature (266)..(266): n is a, c, g, or t
  misc_feature (268)..(268): n is a, c, g, or t
  misc_feature (270)..(271): n is a, c, g, or t
  misc_feature (273)..(273): n is a, c, g, or t
  misc_feature (276)..(276): n is a, c, g, or t
  misc_feature (278)..(279): n is a, c, g, or t
  misc_feature (281)..(281): n is a, c, g, or t
  misc_feature (283)..(283): n is a, c, g, or t
  misc_feature (286)..(287): n is a, c, g, or t
  misc_feature (290)..(290): n is a, c, g, or t
  misc_feature (293)..(293): n is a, c, g, or t
  misc_feature (295)..(298): n is a, c, g, or t
  misc_feature (301)..(301): n is a, c, g, or t
  misc_feature (303)..(303): n is a, c, g, or t
  misc_feature (305)..(308): n is a, c, g, or t
  misc_feature (310)..(310): n is a, c, g, or t
  misc_feature (312)..(313): n is a, c, g, or t
  misc_feature (315)..(315): n is a, c, g, or t
  misc_feature (320)..(320): n is a, c, g, or t
  misc_feature (322)..(322): n is a, c, g, or t
  misc_feature (326)..(326): n is a, c, g, or t
  misc_feature (329)..(329): n is a, c, g, or t
  misc_feature (333)..(333): n is a, c, g, or t
  misc_feature (335)..(336): n is a, c, g, or t
  misc_feature (338)..(342): n is a, c, g, or t
  misc_feature (345)..(345): n is a, c, g, or t
  misc_feature (347)..(347): n is a, c, g, or t
  misc_feature (354)..(354): n is a, c, g, or t
  misc_feature (359)..(359): n is a, c, g, or t
  misc_feature (361)..(361): n is a, c, g, or t
  misc_feature (363)..(367): n is a, c, g, or t
  misc_feature (369)..(369): n is a, c, g, or t
  misc_feature (376)..(376): n is a, c, g, or t
  misc_feature (378)..(378): n is a, c, g, or t
  misc_feature (382)..(382): n is a, c, g, or t
  misc_feature (391)..(391): n is a, c, g, or t
  misc_feature (393)..(393): n is a, c, g, or t
  misc_feature (395)..(396): n is a, c, g, or t
  misc_feature (398)..(398): n is a, c, g, or t
  misc_feature (400)..(400): n is a, c, g, or t
  misc_feature (402)..(402): n is a, c, g, or t
  misc_feature (404)..(404): n is a, c, g, or t
  misc_feature (406)..(409): n is a, c, g, or t
  misc_feature (413)..(413): n is a, c, g, or t
  misc_feature (416)..(416): n is a, c, g, or t
  misc_feature (419)..(420): n is a, c, g, or t
  misc_feature (423)..(423): n is a, c, g, or t
  misc_feature (425)..(425): n is a, c, g, or t
  misc_feature (431)..(433): n is a, c, g, or t
  misc_feature (436)..(437): n is a, c, g, or t
  misc_feature (440)..(446): n is a, c, g, or t
  misc_feature (450)..(451): n is a, c, g, or t
  misc_feature (453)..(454): n is a, c, g, or t
  misc_feature (457)..(458): n is a, c, g, or t
  misc_feature (461)..(462): n is a, c, g, or t
  misc_feature (464)..(465): n is a, c, g, or t
  misc_feature (468)..(468): n is a, c, g, or t
  misc_feature (470)..(471): n is a, c, g, or t
  misc_feature (473)..(478): n is a, c, g, or t
  misc_feature (485)..(486): n is a, c, g, or t
  misc_feature (488)..(488): n is a, c, g, or t
  misc_feature (490)..(491): n is a, c, g, or t
  misc_feature (494)..(494): n is a, c, g, or t
  misc_feature (496)..(498): n is a, c, g, or t
  misc_feature (500)..(500): n is a, c, g, or t
  misc_feature (503)..(503): n is a, c, g, or t
  misc_feature (508)..(509): n is a, c, g, or t
  misc_feature (513)..(515): n is a, c, g, or t
  misc_feature (519)..(519): n is a, c, g, or t
  misc_feature (521)..(522): n is a, c, g, or t
  misc_feature (527)..(528): n is a, c, g, or t
  misc_feature (533)..(533): n is a, c, g, or t
  misc_feature (535)..(535): n is a, c, g, or t
  misc_feature (537)..(539): n is a, c, g, or t
  misc_feature (541)..(541): n is a, c, g, or t
  misc_feature (546)..(546): n is a, c, g, or t
  misc_feature (548)..(549): n is a, c, g, or t
  misc_feature (553)..(554): n is a, c, g, or t
  misc_feature (591)..(591): n is a, c, g, or t
  misc_feature (725)..(725): n is a, c, g, or t
  misc_feature (731)..(731): n is a, c, g, or t
  misc_feature (786)..(786): n is a, c, g, or t
  misc_feature (821)..(821): n is a, c, g, or t
  misc_feature (836)..(836): n is a, c, g, or t
  misc_feature (848)..(848): n is a, c, g, or t
  misc_feature (863)..(863): n is a, c, g, or t
  misc_feature (884)..(884): n is a, c, g, or t
  misc_feature (893)..(893): n is a, c, g, or t
  misc_feature (926)..(926): n is a, c, g, or t
  misc_feature (1077)..(1077): n is a, c, g, or t
  misc_feature (1079)..(1079): n is a, c, g, or t
  misc_feature (1115)..(1115): n is a, c, g, or t
  misc_feature (1118)..(1118): n is a, c, g, or t
  misc_feature (1187)..(1187): n is a, c, g, or t
  misc_feature (1640)..(1640): n is a, c, g, or t
  misc_feature (1854)..(1854): n is a, c, g, or t
  misc_feature (1991)..(1991): n is a, c, g, or t
  misc_feature (2031)..(2031): n is a, c, g, or t
  misc_feature (2130)..(2130): n is a, c, g, or t
  misc_feature (2193)..(2193): n is a, c, g, or t
  misc_feature (2223)..(2223): n is a, c, g, or t
  misc_feature (2265)..(2265): n is a, c, g, or t
  misc_feature (2914)..(2914): n is a, c, g, or t
  misc_feature (2917)..(2917): n is a, c, g, or t
  misc_feature (2971)..(2971): n is a, c, g, or t
  misc_feature (3082)..(3082): n is a, c, g, or t
  misc_feature (3106)..(3106): n is a, c, g, or t
  misc_feature (3118)..(3118): n is a, c, g, or t
  misc_feature (3247)..(3247): n is a, c, g, or t
  misc_feature (3260)..(3260): n is a, c, g, or t
  misc_feature (3613)..(3613): n is a, c, g, or t
  misc_feature (3622)..(3622): n is a, c, g, or t
  misc_feature (3643)..(3643): n is a, c, g, or t
  misc_feature (3903)..(3903): n is a, c, g, or t
gnntnnannnatnngnatttgnngagggngnngancnngannangnnntnntttttannnnnngccttgncntngncnntganggcgaagcnnagnttgnnnanngngaaaagnagntnnngcntggncgngnnnnngcctnccntnncnangcnaaaacnnngnnnaanntnaaanttanaaanaaaanaaaanntttannaatnnantttaangnnaatgttannnnanntnanttagncaaagnnnntnnntttngccnngcngntnncnttngnnangngannggnaanannnntancnannnncntnncnaaaangnaaanggntcgntnncnnnnnttngntttgacnaagancnannnnncncaacccncnctgnccctggcgntncnntncntntngnnnntganggngannttnanttaaannnagnngannnnnnntttnntnnagnnaanngnnatngnntnnnnnntccaggnnanannccncnnngnctnaaagnnaaannnaaantnnaaatnnttctnancnnnanaaaanannaaanntaaaaataagccctattttagggcttttctcttttanaaatcacattaaatttacccttaataacccaaaaagcaaagtcataatataatccctttaaaatttaaagaagagctatgaaaaaagaaaattccaaactatttttactactatttttgggcgcgctttcagcntttggnccatttgtcacagacctttacctgccagcacttccagccataactgagtggtttngcacaagcgtttcagcaacccagctaacccttacnacctcgatggcaggncttgcgataggncagctaatagttggnccaatcagcgataaatttggncgaaaaacnccacttaccatctcgctcatcatctacacgatnagcacgatttttatattttttgcgcaaaatatccagttttttatctttatgcgcatcatccaagggcttgcaagtgcgggcagtctggttatctcaagagccgttgtgagcgacctttacaagggtcacgagatgactaaattttttagtntnatgatggttgtaaatggtcttgctccgatattttcnccnataggcggcagcttgctacttaaatttaccgactggcgcggcatctttatggcgctaacgatcattggnattttgctatttatcgcaaatttttacttcaaagagagcctaagccctgctaaccgcctaaaagtgcctttgcttcagacctacagcgtctttggcaaaattttaagaaaaaagaaatttatgctatttattgcgatccagacatttacgatggctgcgatgtttgcctatatcgcggcatcttcttttatcttacaagagttttacctgctaagcccagtaagctacagcttttgctttgcggcaaatggcctagccatcgtcataggtgctaggcttgcaagcttgctaaatgaacgaaaagcgctaaaaactgggctttttggcaccttgcttgctagcatttttatagcgtttatgctttgctttaaatttgaagtgatcggcgttatcatcgcatttttcttgcttttgctctttactggctttatcttaccaacggcctcatcactngcgatgaatgagggcagagagtacgctggctcggcctcagcggtgcttggattttgcccatttttcttaggcggcatcatctcgccactagttggtcttggtgacattttttactcgacttcaatagctattttagcttgcagcgtgcttgcctttatctcatttttagggctaaaaagagttgcgtaaaatttatcttgtctcaaacacaaanacggctgatgagagcgttgtaaatttaagcgttagcaagatagagtttttgaaatttgagataaatttaagcgaatttgacgcgcttgtggcaacctccaaaaatgcctttaaggctttaaaatttaatggcatttngcctataaatttaccagtttttgctatcgcaaatagttgngcagcggctgcaagagagtttggttttagtgaaatttacactgggcaaaatgctcatggagatgactttgcaagagaaattttgccacttttaaagggnaaaaaggttctttatctaaaaggcaaagatagcgcttcaaatttcttagaaattttacaaaanggtggcgtaaatataaaggcggtcattgcntatgaaaatgtcttaaatccttgcaaaatggagctaaaaccnccaaaaaatagcattttgatcttcgcatctccgataaatgtgagaaattttctaactaattttggctgggacgagagctatcagacgataagcatcggaaaggtcactgcaaaagagctaaaatttagcacgccacttgttagtcaaagtcaagatataaacgcttgtatcgcacttgccaaaacgttactttaagcaaagaatttatataattttattgcctgagtgaagcgagtcagcattttacggggtccaacacttttttgttagcgaaaaggtatgggtgccttgcgatgtggcttcgtttgagccttaaacagcgagaagttgcaaccttttggtatccatctatttgcaagattggctttgtttatgggccactcttctatgcgacgcccacttgggtttttaaatttacggagataatatgaacattctcataataggaagtggcggccgcgaatacgccattgctctaaaactaaaaagcgaaaaaaatataaatttatactttgcgcctggaaatggtgcgacctcacgccttggtgagaatttaaacataaaagactttcatgagctagcaaattttgccaaaaaaaatagtatcgagctaactatcgtgggacctgaagcgcctcttagcgaaggngtngtagatatctttaaaaaagagggtttgctcatctttggaccaagcaaagcagcngctagacttgaggctagcaaggcctatatgaaggactttttagctagaaataatataaaaactgcaaaatatttaaacacagacgacaaagaaaaagcatttaaatttatngataccctaagcgctccgatggtngtaaaggctganggactttgcgctggaaaaggcgtgatcatcgcaaattccaaagaagaagccaaagaggcagttagcgacatgctaagtggggctagctttggtgatgctggtaaatttgtggtggttgaagagtttttngacggctttgagntaagcttttttgccatttgtgacggcgaaaattttgtaagcttgccagtggcacaagaccacaaacgcctacttgataacgacgagggtccaaatactggcggcatgggcgcttatgctccaagtccgcttgcttcaaaagagcttataaaaagggtcgaagaagaggttgtaaaacctacgttaaaagggatgaaaaacgagggcagtccgttttgtggagtgctttttgtggggctgatgatcgtgaaaaatgagccttatgtgcttgagtttaacgtgagatttggcgatcctgagtgcgaggtcttgatgccattaatcgacggaaatttgagtgaaattttactaaangctgcaaanggcgagctaaagcctatcagnttaaaagatgaatttgctgttggcgtcgtgatgtctagcaaaaattatccttataaaagtagcccaaaggctaaaatttcagttttaaatgatgtaaaagatgcccatatagcttacgcaggcgtgagcaaagagggtgatgaaatttacgcagatgggggcagagtgctagtctgcgtggcgactgcaaagagcataaaagaggcacgtgataaggcctatgagctttgcgaaaatgtcaaatttgacggagcacactntagaaaagatatcgcgtggcaggctctaaaatgagtatgcagatagaagagaagcttcaaaacgaagaaatttcacttgctccttttgctaagagga

SEQ ID NO: 1136 - DNA, 4000 bp, Escherichia coli
  misc_feature (78)..(78): n is a, c, g, or t
  misc_feature (409)..(409): n is a, c, g, or t
  misc_feature (499)..(499): n is a, c, g, or t
  misc_feature (520)..(520): n is a, c, g, or t
  misc_feature (2489)..(2489): n is a, c, g, or t
  misc_feature (3230)..(3230): n is a, c, g, or t
  misc_feature (3238)..(3238): n is a, c, g, or t
  misc_feature (3247)..(3247): n is a, c, g, or t
  misc_feature (3249)..(3255): n is a, c, g, or t
  misc_feature (3259)..(3259): n is a, c, g, or t
  misc_feature (3265)..(3265): n is a, c, g, or t
  misc_feature (3267)..(3269): n is a, c, g, or t
  misc_feature (3271)..(3277): n is a, c, g, or t
  misc_feature (3281)..(3283): n is a, c, g, or t
  misc_feature (3285)..(3287): n is a, c, g, or t
  misc_feature (3292)..(3301): n is a, c, g, or t
  misc_feature (3303)..(3303): n is a, c, g, or t
  misc_feature (3306)..(3306): n is a, c, g, or t
  misc_feature (3309)..(3311): n is a, c, g, or t
  misc_feature (3314)..(3320): n is a, c, g, or t
  misc_feature (3322)..(3322): n is a, c, g, or t
  misc_feature (3324)..(3324): n is a, c, g, or t
  misc_feature (3326)..(3327): n is a, c, g, or t
  misc_feature (3330)..(3330): n is a, c, g, or t
  misc_feature (3337)..(3338): n is a, c, g, or t
  misc_feature (3341)..(3344): n is a, c, g, or t
  misc_feature (3347)..(3347): n is a, c, g, or t
  misc_feature (3349)..(3350): n is a, c, g, or t
  misc_feature (3352)..(3352): n is a, c, g, or t
  misc_feature (3354)..(3356): n is a, c, g, or t
  misc_feature (3358)..(3360): n is a, c, g, or t
  misc_feature (3362)..(3362): n is a, c, g, or t
  misc_feature (3366)..(3366): n is a, c, g, or t
  misc_feature (3368)..(3368): n is a, c, g, or t
  misc_feature (3370)..(3374): n is a, c, g, or t
  misc_feature (3376)..(3377): n is a, c, g, or t
  misc_feature (3379)..(3379): n is a, c, g, or t
  misc_feature (3382)..(3382): n is a, c, g, or t
  misc_feature (3384)..(3384): n is a, c, g, or t
  misc_feature (3387)..(3387): n is a, c, g, or t
  misc_feature (3390)..(3391): n is a, c, g, or t
  misc_feature (3393)..(3393): n is a, c, g, or t
  misc_feature (3395)..(3398): n is a, c, g, or t
  misc_feature (3400)..(3400): n is a, c, g, or t
  misc_feature (3403)..(3404): n is a, c, g, or t
  misc_feature (3406)..(3406): n is a, c, g, or t
  misc_feature (3408)..(3414): n is a, c, g, or t
  misc_feature (3416)..(3416): n is a, c, g, or t
  misc_feature (3418)..(3419): n is a, c, g, or t
  misc_feature (3423)..(3423): n is a, c, g, or t
  misc_feature (3425)..(3426): n is a, c, g, or t
  misc_feature (3429)..(3429): n is a, c, g, or t
  misc_feature (3431)..(3432): n is a, c, g, or t
  misc_feature (3434)..(3434): n is a, c, g, or t
  misc_feature (3437)..(3438): n is a, c, g, or t
  misc_feature (3440)..(3441): n is a, c, g, or t
  misc_feature (3443)..(3444): n is a, c, g, or t
  misc_feature (3446)..(3446): n is a, c, g, or t
  misc_feature (3450)..(3450): n is a, c, g, or t
  misc_feature (3452)..(3453): n is a, c, g, or t
  misc_feature (3456)..(3456): n is a, c, g, or t
  misc_feature (3461)..(3461): n is a, c, g, or t
  misc_feature (3463)..(3463): n is a, c, g, or t
  misc_feature (3465)..(3465): n is a, c, g, or t
  misc_feature (3468)..(3468): n is a, c, g, or t
  misc_feature (3473)..(3473): n is a, c, g, or t
  misc_feature (3477)..(3477): n is a, c, g, or t
  misc_feature (3479)..(3480): n is a, c, g, or t
  misc_feature (3482)..(3484): n is a, c, g, or t
  misc_feature (3487)..(3489): n is a, c, g, or t
  misc_feature (3492)..(3493): n is a, c, g, or t
  misc_feature (3495)..(3495): n is a, c, g, or t
  misc_feature (3498)..(3498): n is a, c, g, or t
  misc_feature (3500)..(3501): n is a, c, g, or t
  misc_feature (3503)..(3503): n is a, c, g, or t
  misc_feature (3510)..(3510): n is a, c, g, or t
  misc_feature (3512)..(3512): n is a, c, g, or t
  misc_feature (3515)..(3516): n is a, c, g, or t
  misc_feature (3518)..(3522): n is a, c, g, or t
  misc_feature (3524)..(3524): n is a, c, g, or t
  misc_feature (3526)..(3527): n is a, c, g, or t
  misc_feature (3533)..(3535): n is a, c, g, or t
  misc_feature (3537)..(3539): n is a, c, g, or t
  misc_feature (3541)..(3541): n is a, c, g, or t
  misc_feature (3543)..(3544): n is a, c, g, or t
  misc_feature (3546)..(3546): n is a, c, g, or t
  misc_feature (3549)..(3550): n is a, c, g, or t
  misc_feature (3554)..(3554): n is a, c, g, or t
  misc_feature (3556)..(3556): n is a, c, g, or t
  misc_feature (3558)..(3558): n is a, c, g, or t
  misc_feature (3560)..(3560): n is a, c, g, or t
  misc_feature (3562)..(3562): n is a, c, g, or t
  misc_feature (3564)..(3564): n is a, c, g, or t
  misc_feature (3568)..(3568): n is a, c, g, or t
  misc_feature (3571)..(3571): n is a, c, g, or t
  misc_feature (3574)..(3577): n is a, c, g, or t
  misc_feature (3580)..(3580): n is a, c, g, or t
  misc_feature (3582)..(3583): n is a, c, g, or t
  misc_feature (3585)..(3586): n is a, c, g, or t
  misc_feature (3589)..(3590): n is a, c, g, or t
  misc_feature (3593)..(3593): n is a, c, g, or t
  misc_feature (3595)..(3595): n is a, c, g, or t
  misc_feature (3597)..(3597): n is a, c, g, or t
  misc_feature (3599)..(3599): n is a, c, g, or t
  misc_feature (3601)..(3601): n is a, c, g, or t
  misc_feature (3603)..(3605): n is a, c, g, or t
  misc_feature (3607)..(3610): n is a, c, g, or t
  misc_feature (3612)..(3612): n is a, c, g, or t
  misc_feature (3614)..(3614): n is a, c, g, or t
  misc_feature (3618)..(3618): n is a, c, g, or t
  misc_feature (3620)..(3621): n is a, c, g, or t
  misc_feature (3624)..(3628): n is a, c, g, or t
  misc_feature (3633)..(3640): n is a, c, g, or t
  misc_feature (3642)..(3642): n is a, c, g, or t
  misc_feature (3644)..(3648): n is a, c, g, or t
  misc_feature (3651)..(3651): n is a, c, g, or t
  misc_feature (3653)..(3658): n is a, c, g, or t
  misc_feature (3660)..(3660): n is a, c, g, or t
  misc_feature (3662)..(3664): n is a, c, g, or t
  misc_feature (3666)..(3667): n is a, c, g, or t
  misc_feature (3671)..(3671): n is a, c, g, or t
  misc_feature (3674)..(3674): n is a, c, g, or t
  misc_feature (3677)..(3680): n is a, c, g, or t
  misc_feature (3682)..(3686): n is a, c, g, or t
  misc_feature (3688)..(3688): n is a, c, g, or t
  misc_feature (3690)..(3692): n is a, c, g, or t
  misc_feature (3694)..(3694): n is a, c, g, or t
  misc_feature (3702)..(3702): n is a, c, g, or t
  misc_feature (3704)..(3704): n is a, c, g, or t
  misc_feature (3706)..(3709): n is a, c, g, or t
  misc_feature (3712)..(3713): n is a, c, g, or t
  misc_feature (3725)..(3727): n is a, c, g, or t
  misc_feature (3734)..(3734): n is a, c, g, or t
  misc_feature (3740)..(3740): n is a, c, g, or t
  misc_feature (3745)..(3747): n is a, c, g, or t
  misc_feature (3749)..(3751): n is a, c, g, or t
  misc_feature (3756)..(3757): n is a, c, g, or t
  misc_feature (3759)..(3761): n is a, c, g, or t
  misc_feature (3768)..(3768): n is a, c, g, or t
  misc_feature (3773)..(3773): n is a, c, g, or t
  misc_feature (3778)..(3779): n is a, c, g, or t
  misc_feature (3781)..(3781): n is a, c, g, or t
  misc_feature (3785)..(3786): n is a, c, g, or t
  misc_feature (3789)..(3792): n is a, c, g, or t
  misc_feature (3796)..(3796): n is a, c, g, or t
  misc_feature (3799)..(3800): n is a, c, g, or t
  misc_feature (3804)..(3805): n is a, c, g, or t
  misc_feature (3807)..(3808): n is a, c, g, or t
  misc_feature (3812)..(3812): n is a, c, g, or t
  misc_feature (3816)..(3816): n is a, c, g, or t
  misc_feature (3819)..(3823): n is a, c, g, or t
  misc_feature (3826)..(3826): n is a, c, g, or t
  misc_feature (3829)..(3831): n is a, c, g, or t
  misc_feature (3833)..(3834): n is a, c, g, or t
  misc_feature (3836)..(3839): n is a, c, g, or t
  misc_feature (3843)..(3846): n is a, c, g, or t
  misc_feature (3850)..(3851): n is a, c, g, or t
  misc_feature (3853)..(3853): n is a, c, g, or t
  misc_feature (3857)..(3859): n is a, c, g, or t
  misc_feature (3863)..(3863): n is a, c, g, or t
  misc_feature (3866)..(3866): n is a, c, g, or t
  misc_feature (3871)..(3873): n is a, c, g, or t
  misc_feature (3875)..(3879): n is a, c, g, or t
  misc_feature (3883)..(3883): n is a, c, g, or t
  misc_feature (3889)..(3889): n is a, c, g, or t
  misc_feature (3898)..(3898): n is a, c, g, or t
  misc_feature (3901)..(3901): n is a, c, g, or t
  misc_feature (3908)..(3912): n is a, c, g, or t
  misc_feature (3915)..(3915): n is a, c, g, or t
  misc_feature (3917)..(3918): n is a, c, g, or t
  misc_feature (3920)..(3920): n is a, c, g, or t
  misc_feature (3922)..(3923): n is a, c, g, or t
  misc_feature (3926)..(3927): n is a, c, g, or t
  misc_feature (3932)..(3932): n is a, c, g, or t
  misc_feature (3940)..(3941): n is a, c, g, or t
  misc_feature (3944)..(3944): n is a, c, g, or t
  misc_feature (3946)..(3946): n is a, c, g, or t
  misc_feature (3956)..(3956): n is a, c, g, or t
  misc_feature (3961)..(3965): n is a, c, g, or t
  misc_feature (3974)..(3974): n is a, c, g, or t
  misc_feature (3978)..(3979): n is a, c, g, or t
  misc_feature (3983)..(3984): n is a, c, g, or t
  misc_feature (3988)..(3988): n is a, c, g, or t
  misc_feature (3990)..(3990): n is a, c, g, or t
  misc_feature (3996)..(3996): n is a, c, g, or t
  misc_feature (3999)..(3999): n is a, c, g, or t
tccttacatgaccgggtttgccggttagttagaactcgctcggtctatagttttacaccatatcggctcgctgctgtngttcagcagggagaaataatcacatcacaatgaggcgccaaggaacgttgagcgagcgaatcgccgacttaagtcggcggtagcctttggccaaagagtaacccactgcagcttggcgatgacacgtcgaattcattcgacttgtacggtttaaactactgccttaacggccgtggttgtcagttgctttgggaccttgatagagatcaggaggaagacggtggctaacaaatgggacgagcggaagaaagcaaaagaagatgagtatttcgttaagcaagagcgggagttgctggccaagctcaaggctaaacaggaaggcgaggctaangtctccgcacagaaagcctgttatatgaaatgcccgaagtgcggcgagcctttgaaagaacgtaaatttcagaagatcctcatcgaccantgcaccggctgtaacggcatntggctcgatgcgggcgaaatggagcaggtcgccgggcgagacaatgagagttggttagccaggttttggatgaagaatggctagccggatagatttcgcgcgtgatgccggtggttggcgttttaggtggctctgggcgaccaccgggggtcgcccctactatttttgcacaactagatcgtcatttgacgcataatttcataataaggaggtcaagatggggaagctaggcttattcttgttcgctggtttgttgggtctcctttcaagcgtaggaagcttcgactcacgatcttggttgacgccttcacaagcgctcgcgcaggccgcgcgtgattcggacgaaggtaagaagatcgtcccttacgttccgacgcctcaagaagtagtcgagaggatgttagagctcgccggcgtgaaaaagggcgacgtggtttatgatcttggctccggcgacggcagaattgtcgtcaccgccgcgaagaaatatggcgtcaaggccatcggttttgaaattgatccggagcgcatcaaagaatctcacgagaacatcaaaaaggccggcgtcggtaacctagtggagattcgccagcaggacatcagaacggtggatttgtctcaggcttcggtcttgaccatgtatctgctgccggaagtgaatctgatgattcggcccaatatctggaaacagatgaagccgggctcccgcgtggtttcgcacgatttcgacatgggggattggaagccgctcaagactgaaagtatcaaagactcatcgagctgggaccacacgctctatttatggcatgtggaggcgaataagaaatagagatgggtttccgggagtctgaccacaataggaagtgaccaaagcatgaacgcgctgatcgccgttgttttcggggccattacggtctacttgacttacacgcgctatgcgcggcgaatagaccgcgatgtcattcagtccgatcccaaacgggcgacgccggcgaccctttatatggacggcgtggatttcatgccgaccaaccgcaacattcttttcggctaccacttcaaatcgattgcggcggccggcccgattgtcggcgcgatcgtcgcggcgacgttgtggggttggttgccggcgatgatttggctcatcgtgggcgttgccttcatgggttgggtcagcgattacagcgccatcgttctgtcggtacggaacgaaggacatagcctttcggcggtggcgcaccgtctgatatcgccaagaacccggaccatcctctttctcttcatctttttttaccttttattagtcgcgggcgcctttgttggaatcatggcaacggttatggaaacccagccacggacgtacatgggaatgatcttgctcgtaatcatggggctactcctgggacagatgctttatcgatggcgcgttggtttggtgccggcaacgatgataaccgtcgggattaccctggttgcaatcatgaccggacacgcgagcgagccaatcttcaaaggcttgaacgatggcttgaattctttaaccggcggcgcgccgctggtcacttacttcgatccgacgcttgcgggcttcaaaggggcggaggcgaagatcatgccgactctccttttctgggcgctggcgatcagtattttttgctatgccggctctgtgctgccgatctggcggatggcccagcccgtggtctacgtcggattttggattacggcattggctatggtcctggggctgagcggcgcggccatcgggacattcacgaagccagaggtggcttatttttccattcccgccttcaaaggctggaacccgcagatgggtcctgcgggcgtgatgcctctgtggccgatgcttttcgtaacgatcgcgtgcggcgcgatttccggttggcacgcgctcttcggctcggtcggcacggcgcggcagatcgagaacgaagccgacatgcttccngtcggcgcaggttcgatgctcgccgagtttctgcttggaatgttggccctgttggcgatttcgataggggcaaaggggaatccggtggcggccttcgccagtggccttggcggtttcatcagcgtctggggttttccaccggattacgccgtatcgcttgcgttcgccgccttcatcgtgattgtcctggtcgtcacgcagctcttatttcgtgtcatgcgcgtaacgttaaccgaatggttaggggagatcatcccgccgctgcgtaatcagcacgtcgcatctcttgtttccatcggcatggctatcctgctggtcatgacgggcacgtggatctatctctggcagcttttcggcgcggctaatcaactcatggcggccctttctctgctcttggtgactgtgtggctcgtatccgtgggcaagcattggctgtttgccggaataccaatgatcttcatgtacctaaccacggtcgcgtcgatcttggtcacggcatacaatctctatttcaacgtttatctgccgaatctcgatgccggcagactactcccgacaatcggctcgggactgatggttttagtggctgtcctgcttgtgttcgcgtctgttttcatcggtatcgacgggtttcgtgctttcttcaaatatttgggcaaaccggcgccttccgcgcgacccgcgccagcggaaggttagccgccgccgggtaagtgcgaggggcattcacgcgaggaaagncgatgcangggtggcangnnnnnnnagantttttntnnngnnnnnnnggcnnncnnnttttnnnnnnnnnncncgnaannnaannnnnnncngnanngcnttttttnnccnnnncantnngngnnntnnnangggngncnnnnntnncnccngngtnttnncntnnnntnttnncntnnnnnnntncnnaganannggncnngnaanngnnanncncccncnnaanagaantntnggnaaaanaggngnntnnnttnnncanngnttnanngngcgcccncnccnntnnnnngntnnagaggnnntnnncnanngnggnnaaanancnancnanaaanggnggnnnnttncnngnnttnnaananantntntnnngnnnntncncccncnngannnnncgccnnnnnnnncncnnnnnggncnnnnnngngnnncnntttnttntcnnnncnnnnngngnnntntttggggngncnnnnttnncccccttttttnnnctccccntttttnccttnnngnnnccccnnannnccccccnggaangcccnntntttnncgnnnngggnatnncccnnannctcngggnaannnnnaantcnnntnncnnnngggnnnntttnngngggnnncccnaangggcnnnannnnntttngggggnaaggggggntcnggaaaannnnnctntnngngnnccnngcccntttggttnnccnanaaaggaaaanggggnnnnnttttttccngggnncccnngggngncctttnggna

SEQ ID NO: 1137 - DNA, 4000 bp, Escherichia coli
  misc_feature (370)..(370): n is a, c, g, or t
  misc_feature (2864)..(2864): n is a, c, g, or t
  misc_feature (2873)..(2875): n is a, c, g, or t
  misc_feature (2880)..(2882): n is a, c, g, or t
  misc_feature (2884)..(2885): n is a, c, g, or t
  misc_feature (2888)..(2893): n is a, c, g, or t
  misc_feature (2897)..(2899): n is a, c, g, or t
  misc_feature (2901)..(2901): n is a, c, g, or t
  misc_feature (2906)..(2909): n is a, c, g, or t
  misc_feature (2912)..(2912): n is a, c, g, or t
  misc_feature (2914)..(2918): n is a, c, g, or t
  misc_feature (2921)..(2921): n is a, c, g, or t
  misc_feature (2923)..(2924): n is a, c, g, or t
  misc_feature (2929)..(2931): n is a, c, g, or t
  misc_feature (2938)..(2939): n is a, c, g, or t
  misc_feature (2941)..(2945): n is a, c, g, or t
  misc_feature (2947)..(2947): n is a, c, g, or t
  misc_feature (2952)..(2952): n is a, c, g, or t
  misc_feature (2955)..(2964): n is a, c, g, or t
  misc_feature (2966)..(2968): n is a, c, g, or t
  misc_feature (2970)..(2970): n is a, c, g, or t
  misc_feature (2973)..(2973): n is a, c, g, or t
  misc_feature (2976)..(2976): n is a, c, g, or t
  misc_feature (2979)..(2981): n is a, c, g, or t
  misc_feature (2986)..(2986): n is a, c, g, or t
  misc_feature (2988)..(2989): n is a, c, g, or t
  misc_feature (2991)..(2991): n is a, c, g, or t
  misc_feature (2993)..(2993): n is a, c, g, or t
  misc_feature (2995)..(2996): n is a, c, g, or t
  misc_feature (2999)..(2999): n is a, c, g, or t
  misc_feature (3001)..(3002): n is a, c, g, or t
  misc_feature (3005)..(3005): n is a, c, g, or t
  misc_feature (3008)..(3012): n is a, c, g, or t
  misc_feature (3016)..(3018): n is a, c, g, or t
  misc_feature (3020)..(3020): n is a, c, g, or t
  misc_feature (3022)..(3024): n is a, c, g, or t
  misc_feature (3026)..(3027): n is a, c, g, or t
  misc_feature (3029)..(3029): n is a, c, g, or t
  misc_feature (3031)..(3031): n is a, c, g, or t
  misc_feature (3033)..(3035): n is a, c, g, or t
  misc_feature (3037)..(3038): n is a, c, g, or t
  misc_feature (3040)..(3040): n is a, c, g, or t
  misc_feature (3042)..(3042): n is a, c, g, or t
  misc_feature (3044)..(3044): n is a, c, g, or t
  misc_feature (3046)..(3050): n is a, c, g, or t
  misc_feature (3052)..(3053): n is a, c, g, or t
  misc_feature (3055)..(3055): n is a, c, g, or t
  misc_feature (3057)..(3057): n is a, c, g, or t
  misc_feature (3059)..(3064): n is a, c, g, or t
  misc_feature (3066)..(3071): n is a, c, g, or t
  misc_feature (3073)..(3078): n is a, c, g, or t
  misc_feature (3080)..(3080): n is a, c, g, or t
  misc_feature (3082)..(3083): n is a, c, g, or t
  misc_feature (3085)..(3087): n is a, c, g, or t
  misc_feature (3090)..(3098): n is a, c, g, or t
  misc_feature (3102)..(3111): n is a, c, g, or t
  misc_feature (3113)..(3117): n is a, c, g, or t
  misc_feature (3119)..(3124): n is a, c, g, or t
  misc_feature (3126)..(3131): n is a, c, g, or t
  misc_feature (3134)..(3138): n is a, c, g, or t
  misc_feature (3142)..(3144): n is a, c, g, or t
  misc_feature (3146)..(3156): n is a, c, g, or t
  misc_feature (3158)..(3172): n is a, c, g, or t
  misc_feature (3174)..(3174): n is a, c, g, or t
  misc_feature (3176)..(3178): n is a, c, g, or t
  misc_feature (3181)..(3183): n is a, c, g, or t
  misc_feature (3185)..(3185): n is a, c, g, or t
  misc_feature (3187)..(3187): n is a, c, g, or t
  misc_feature (3189)..(3189): n is a, c, g, or t
  misc_feature (3193)..(3194): n is a, c, g, or t
  misc_feature (3197)..(3197): n is a, c, g, or t
  misc_feature (3199)..(3199): n is a, c, g, or t
  misc_feature (3201)..(3202): n is a, c, g, or t
  misc_feature (3204)..(3204): n is a, c, g, or t
  misc_feature (3209)..(3209): n is a, c, g, or t
  misc_feature (3214)..(3222): n is a, c, g, or t
  misc_feature (3224)..(3228): n is a, c, g, or t
  misc_feature (3230)..(3231): n is a, c, g, or t
  misc_feature (3238)..(3238): n is a, c, g, or t
  misc_feature (3240)..(3245): n is a, c, g, or t
  misc_feature (3247)..(3248): n is a, c, g, or t
  misc_feature (3250)..(3256): n is a, c, g, or t
  misc_feature (3258)..(3261): n is a, c, g, or t
  misc_feature (3263)..(3264): n is a, c, g, or t
  misc_feature (3266)..(3272): n is a, c, g, or t
  misc_feature (3274)..(3276): n is a, c, g, or t
  misc_feature (3278)..(3278): n is a, c, g, or t
  misc_feature (3280)..(3281): n is a, c, g, or t
  misc_feature (3283)..(3283): n is a, c, g, or t
  misc_feature (3285)..(3285): n is a, c, g, or t
  misc_feature (3287)..(3287): n is a, c, g, or t
  misc_feature (3289)..(3292): n is a, c, g, or t
  misc_feature (3294)..(3294): n is a, c, g, or t
  misc_feature (3296)..(3297): n is a, c, g, or t
  misc_feature (3299)..(3299): n is a, c, g, or t
  misc_feature (3301)..(3302): n is a, c, g, or t
  misc_feature (3304)..(3306): n is a, c, g, or t
  misc_feature (3310)..(3312): n is a, c, g, or t
  misc_feature (3315)..(3315): n is a, c, g, or t
  misc_feature (3317)..(3320): n is a, c, g, or t
  misc_feature (3322)..(3322): n is a, c, g, or t
  misc_feature (3330)..(3335): n is a, c, g, or t
  misc_feature (3337)..(3337): n is a, c, g, or t
  misc_feature (3340)..(3342): n is a, c, g, or t
  misc_feature (3344)..(3344): n is a, c, g, or t
  misc_feature (3347)..(3347): n is a, c, g, or t
  misc_feature (3350)..(3350): n is a, c, g, or t
  misc_feature (3354)..(3354): n is a, c, g, or t
  misc_feature (3356)..(3358): n is a, c, g, or t
  misc_feature (3360)..(3360): n is a, c, g, or t
  misc_feature (3362)..(3362): n is a, c, g, or t
  misc_feature (3365)..(3365): n is a, c, g, or t
  misc_feature (3367)..(3367): n is a, c, g, or t
  misc_feature (3373)..(3374): n is a, c, g, or t
  misc_feature (3377)..(3384): n is a, c, g, or t
  misc_feature (3386)..(3389): n is a, c, g, or t
  misc_feature (3392)..(3392): n is a, c, g, or t
  misc_feature (3395)..(3395): n is a, c, g, or t
  misc_feature (3400)..(3400): n is a, c, g, or t
  misc_feature (3402)..(3403): n is a, c, g, or t
  misc_feature (3408)..(3408): n is a, c, g, or t
  misc_feature (3410)..(3410): n is a, c, g, or t
  misc_feature (3415)..(3416): n is a, c, g, or t
  misc_feature (3422)..(3423): n is a, c, g, or t
  misc_feature (3427)..(3429): n is a, c, g, or t
  misc_feature (3432)..(3432): n is a, c, g, or t
  misc_feature (3434)..(3436): n is a, c, g, or t
  misc_feature (3438)..(3438): n is a, c, g, or t
  misc_feature (3444)..(3444): n is a, c, g, or t
  misc_feature (3447)..(3449): n is a, c, g, or t
  misc_feature (3451)..(3452): n is a, c, g, or t
  misc_feature (3454)..(3455): n is a, c, g, or t
  misc_feature (3459)..(3459): n is a, c, g, or t
  misc_feature (3464)..(3466): n is a, c, g, or t
  misc_feature (3469)..(3470): n is a, c, g, or t
  misc_feature (3472)..(3472): n is a, c, g, or t
  misc_feature (3474)..(3474): n is a, c, g, or t
  misc_feature (3476)..(3476): n is a, c, g, or t
  misc_feature (3480)..(3481): n is a, c, g, or t
  misc_feature (3483)..(3488): n is a, c, g, or t
  misc_feature (3492)..(3496): n is a, c, g, or t
  misc_feature (3498)..(3498): n is a, c, g, or t
  misc_feature (3500)..(3511): n is a, c, g, or t
  misc_feature (3513)..(3536): n is a, c, g, or t
  misc_feature (3538)..(3538): n is a, c, g, or t
  misc_feature (3544)..(3544): n is a, c, g, or t
  misc_feature (3549)..(3549): n is a, c, g, or t
  misc_feature (3557)..(3557): n is a, c, g, or t
  misc_feature (3570)..(3571): n is a, c, g, or t
  misc_feature (3573)..(3575): n is a, c, g, or t
  misc_feature (3577)..(3577): n is a, c, g, or t
  misc_feature (3582)..(3582): n is a, c, g, or t
  misc_feature (3584)..(3584): n is a, c, g, or t
  misc_feature (3586)..(3599): n is a, c, g, or t
  misc_feature (3601)..(3607): n is a, c, g, or t
  misc_feature (3610)..(3612): n is a, c, g, or t
  misc_feature (3615)..(3619): n is a, c, g, or t
  misc_feature (3621)..(3622): n is a, c, g, or t
  misc_feature (3624)..(3624): n is a, c, g, or t
  misc_feature (3626)..(3629): n is a, c, g, or t
  misc_feature (3631)..(3632): n is a, c, g, or t
  misc_feature (3635)..(3637): n is a, c, g, or t
  misc_feature (3639)..(3640): n is a, c, g, or t
  misc_feature (3642)..(3642): n is a, c, g, or t
  misc_feature (3644)..(3645): n is a, c, g, or t
  misc_feature (3650)..(3650): n is a, c, g, or t
  misc_feature (3652)..(3652): n is a, c, g, or t
  misc_feature (3655)..(3656): n is a, c, g, or t
  misc_feature (3658)..(3661): n is a, c, g, or t
  misc_feature (3663)..(3663): n is a, c, g, or t
  misc_feature (3665)..(3665): n is a, c, g, or t
  misc_feature (3668)..(3674): n is a, c, g, or t
  misc_feature (3976)..(4000): n is a, c, g, or t
ttgctggtcggcgatgcggcccgtatccgtccgttattagccaaaacgcaacatctcaaagatgctgaaatactgcatactgatgtggcggttgcggccgaggatacggcgtcgcaggcggtgcgtcgggggcgcgatagctcgatgtggattgctatcgcccaggtcgccgagaaaaacgctgacgccgttgtatcggctggcaacaccggtgcgctgatggcgatgtcaaaattgcagttacgcacgatgccgggggtcacgcggcctgccattgccgggtttttcccgaccgagcaaaagcgcatgtgcatgcttgatcttggcgcgaatctcgaatgtgacgaagacaatctggtgcagtttgcgntgatgggacaggcattttatgcgtcgctggttggcaagcataacccatcggtggcgctgctcaatgtcggggctgaagagcaaaaggggcatgaatatttgcgtctggctgcacaagaactggcagatccggagctgggggtcaattatatcggctttgtcgagggctctgatctggtcaaaggtggcgttgacattgttgtcaccgatggattttcgggcaatatcgcattgaaaacagccgaaggtgtggccgggttatttgcaactttgctgcgacgcagcttcaaagcctcactctcggcaaagcttggttatttgctggcgcaaggcgcgttaaagaatttcagaacaaagatggatccgcgtcgctacaacggcgcggtttttctggggctgaacggaattgcggtaaaatcgcatggcggcacagatgccgttggttttgccaatgccattgatgtcgcgatgaatttagtggggcacggatttattcctgatgtgagtgctgcgatcgaaaaagccgaccggattcgggcggaacggaagagtgtagatgagtaaacaaacggtattgatgacatctgtgggcgcctatctgccagccaatgttgtgacaaatgaagatttatccgcctatgtcgatacaagcgatgagtggattcaacgccgtacgggcataacccaaaggcattttgtggcggatggcgagaccacagctgatttggccagtcacgcggcaaatcaggcgctggccaatgcggcgatgcagccacaggacattgatctgatcattgtcgccacgacaacgccggataacacatttccatcaaccgccacaaaagttcagcatcaaattggcgcgacgggtgccattgcctttgatgtacaggctgtttgtgccggttttatctatgctgttgatgtcgctgaggcgatgttgcgtggcgggcgcgggcgtcgggcgctggttattggcgccgaaagcttttcaaaattgctggattggcaggatcgtaccacatgcgtgttatttggtgatggcgctggcgcggtgattctggaaattaccgatgaggccagcgattggggcattcgttcgtcggtgctgcatgcggatggggcgcatcgcgatattctatatgtcgatggtggcccatccagtacaaatgatgtcgggcatgtgcggatggaaggtaaagaagtgttccggcatgctgtggaaaaactggcggcggtgatggatgaagcattggccgcggctgatatgcagccacaagacattgactggctggtgccgcatcaggccaatatccgcatcattgatgcgatgcagaaaaaaatgcagttgcctagcgaaaaagtcatccgcaccgttgcggcgcatgcgaatacatcggcggcctcgattccgctggcattagccaccgcggttggggacgggcgtgtgcaaaatggcgatctattggcaatggaggcgattggcggcgggcttgtctggggcgcggcgctggtcaaatttgggcgcccatcctgacattattttcaagcaataagaagaattgtggcaataatgcgactacagccttgtatttttgttctaaatgtttttatgattaaagggtggccgcgcgtgcatcagcacctttttgaagtggataaggcaaattatggctaaaactgtgacccgagcagacctgactgagtcagtctatcgcagcattgggctgtccagaaacgaatcgtctgatcttgtcgagtccgttcttgaagaaatctgcgcctgtctggaagctggcgaagatgtcaagctgtcgtcttttggcacgttttctgtgcaatcaaagcgccagcgagtcggacgtaacccgaaaaccggggttgaggcggtcatcacgccacgccgggtgctgtcgtttcgcccgtcgcatatcctgaaagatcgcgttgacaacgcctgatgactgataaagccagcgacgcctttagaaccatttccgaagtatcgaccgagcttgatgtcccgccgcatgtgttacgattctgggagagcaaattcaccagtttgcgcccgctaaagcgcagcggtggtcgacgctattatcgcccggatgatgtggcgatgatcattaaaatccgagatttgctctataaagagggctttaccatcaaaggcgcacaacggtttttaaaatcgaaagaggccggggcgccgtcggacataaacccggctgcggcggatcacggaacaacgccggatctgctggccgtgcaggcgctattgcaaacggcacgcaaacgtctgtctgacgtcaaacaacagcttggcagctaggcagccgccgcgcgcataaagatgtctgtatcgaaaagccgattgcatgcgaccagggctgcggctataatcgcggcggccggagcgtagcgcagcctggtagcgcactatactgggggtgtaggggtcgtgggttcaaatcccgccgctccgaccaatnttttcaatnnnttaannnannatnnnnnnagcnnntngaacnnnntgngnnnnnttntnngtcannnttgtctnnannnnntntccanttnnnnnnnnnntnnngncantgncgnnngcgancnntntnannttngnnccntgnnnnnaagnnngngnnntnnanantnnngnngntnancnnnnncnntntncnnnnnngnnnnnntnnnnnngntnnannnttnnnnnnnnngccnnnnnnnnnngnnnnngnnnnnngnnnnnntgnnnnntttnnnannnnnnnnnnnannnnnnnnnnnnnnntnannntannngnantngccnnatntntnngnatttntctgnnnnnnnnntnnnnngnnaagcggnannnnnncnnannnnnnnannnngnngnnnnnnnannngncnncnangngnnnntnannancnnannngtannngcngnnnntntatttgcnnnnnnantcnnncnctntgntgtnannntngnggncntttttnnaannnnnnnnannnnctngcnacttntnngaacncntttanngctatnnccgnnngcngnnnanaaatgngannngnntnngaantttannnaanngntntntatnntnnnnnnaaannnnnanannnnnnnnnnnnannnnnnnnnnnnnnnnnnnnnnnnanattatngcgtntttacatngcattcgaatgtnntnnncnccccncnannnnnnnnnnnnnngnnnnnnntgnnnatnnnnncnncncnnnngnnctnnngnngngnnttttntnttnncnnnncncncannnnnnnagcgtaaaatgcaaagaagccgtaggggagaggtttctttgcacccagtaattcacgacgctatctaattgaatttctgaaacacgcaaaattgtggcaaattcaacaaagttgataccttaatccctgttaatgaatttttgagggcaagacatggctggcactctgattgcgatagcttctggaccagcgattttatgcttatacttaacctacaaagctcgtatgcctgaagcattttcccattgggtgttcatatcgaatggttttttttattatctattagtcttagtaacgtttgnnnnnnnnnnnnnnnnnnnnnnnnn

SEQ ID NO: 1138 - DNA, 4000 bp, Escherichia coli
  misc_feature (2)..(5): n is a, c, g, or t
  misc_feature (8)..(10): n is a, c, g, or t
  misc_feature (13)..(16): n is a, c, g, or t
  misc_feature (19)..(20): n is a, c, g, or t
  misc_feature (23)..(27): n is a, c, g, or t
  misc_feature (31)..(36): n is a, c, g, or t
  misc_feature (38)..(39): n is a, c, g, or t
  misc_feature (42)..(42): n is a, c, g, or t
  misc_feature (44)..(44): n is a, c, g, or t
  misc_feature (48)..(48): n is a, c, g, or t
  misc_feature (50)..(52): n is a, c, g, or t
  misc_feature (55)..(56): n is a, c, g, or t
  misc_feature (58)..(58): n is a, c, g, or t
  misc_feature (60)..(61): n is a, c, g, or t
  misc_feature (64)..(64): n is a, c, g, or t
  misc_feature (67)..(67): n is a, c, g, or t
  misc_feature (69)..(70): n is a, c, g, or t
  misc_feature (72)..(72): n is a, c, g, or t
  misc_feature (75)..(78): n is a, c, g, or t
  misc_feature (82)..(82): n is a, c, g, or t
  misc_feature (85)..(86): n is a, c, g, or t
  misc_feature (91)..(92): n is a, c, g, or t
  misc_feature (94)..(95): n is a, c, g, or t
  misc_feature (97)..(98): n is a, c, g, or t
  misc_feature (105)..(106): n is a, c, g, or t
  misc_feature (108)..(108): n is a, c, g, or t
  misc_feature (110)..(111): n is a, c, g, or t
  misc_feature (113)..(113): n is a, c, g, or t
  misc_feature (115)..(119): n is a, c, g, or t
  misc_feature (121)..(123): n is a, c, g, or t
  misc_feature (125)..(132): n is a, c, g, or t
  misc_feature (134)..(135): n is a, c, g, or t
  misc_feature (137)..(142): n is a, c, g, or t
  misc_feature (144)..(144): n is a, c, g, or t
  misc_feature (146)..(151): n is a, c, g, or t
  misc_feature (154)..(155): n is a, c, g, or t
  misc_feature (157)..(158): n is a, c, g, or t
  misc_feature (160)..(160): n is a, c, g, or t
  misc_feature (165)..(165): n is a, c, g, or t
  misc_feature (167)..(169): n is a, c, g, or t
  misc_feature (171)..(173): n is a, c, g, or t
  misc_feature (175)..(179): n is a, c, g, or t
  misc_feature (182)..(185): n is a, c, g, or t
  misc_feature (187)..(190): n is a, c, g, or t
  misc_feature (192)..(197): n is a, c, g, or t
  misc_feature (199)..(199): n is a, c, g, or t
  misc_feature (201)..(201): n is a, c, g, or t
  misc_feature (204)..(205): n is a, c, g, or t
  misc_feature (207)..(207): n is a, c, g, or t
  misc_feature (209)..(209): n is a, c, g, or t
  misc_feature (212)..(222): n is a, c, g, or t
  misc_feature (224)..(227): n is a, c, g, or t
  misc_feature (229)..(230): n is a, c, g, or t
  misc_feature (233)..(234): n is a, c, g, or t
  misc_feature (237)..(237): n is a, c, g, or t
  misc_feature (240)..(241): n is a, c, g, or t
  misc_feature (243)..(246): n is a, c, g, or t
  misc_feature (248)..(249): n is a, c, g, or t
  misc_feature (252)..(252): n is a, c, g, or t
  misc_feature (255)..(255): n is a, c, g, or t
  misc_feature (257)..(257): n is a, c, g, or t
  misc_feature (259)..(260): n is a, c, g, or t
  misc_feature (264)..(264): n is a, c, g, or t
  misc_feature (268)..(269): n is a, c, g, or t
  misc_feature (273)..(276): n is a, c, g, or t
  misc_feature (279)..(280): n is a, c, g, or t
  misc_feature (282)..(282): n is a, c, g, or t
  misc_feature (285)..(285): n is a, c, g, or t
  misc_feature (287)..(290): n is a, c, g, or t
  misc_feature (292)..(292): n is a, c, g, or t
  misc_feature (294)..(294): n is a, c, g, or t
  misc_feature (297)..(297): n is a, c, g, or t
  misc_feature (299)..(301): n is a, c, g, or t
  misc_feature (303)..(303): n is a, c, g, or t
  misc_feature (305)..(306): n is a, c, g, or t
  misc_feature (308)..(308): n is a, c, g, or t
  misc_feature (311)..(311): n is a, c, g, or t
  misc_feature (313)..(314): n is a, c, g, or t
  misc_feature (318)..(320): n is a, c, g, or t
  misc_feature (322)..(322): n is a, c, g, or t
  misc_feature (324)..(328): n is a, c, g, or t
  misc_feature (330)..(331): n is a, c, g, or t
  misc_feature (335)..(336): n is a, c, g, or t
  misc_feature (339)..(342): n is a, c, g, or t
  misc_feature (344)..(346): n is a, c, g, or t
  misc_feature (349)..(352): n is a, c, g, or t
  misc_feature (354)..(361): n is a, c, g, or t
  misc_feature (363)..(365): n is a, c, g, or t
  misc_feature (367)..(367): n is a, c, g, or t
  misc_feature (371)..(372): n is a, c, g, or t
  misc_feature (375)..(381): n is a, c, g, or t
  misc_feature (385)..(385): n is a, c, g, or t
  misc_feature (389)..(392): n is a, c, g, or t
  misc_feature (395)..(396): n is a, c, g, or t
  misc_feature (398)..(398): n is a, c, g, or t
  misc_feature (402)..(403): n is a, c, g, or t
  misc_feature (405)..(405): n is a, c, g, or t
  misc_feature (407)..(409): n is a, c, g, or t
  misc_feature (414)..(415): n is a, c, g, or t
  misc_feature (419)..(423): n is a, c, g, or t
  misc_feature (425)..(425): n is a, c, g, or t
  misc_feature (427)..(430): n is a, c, g, or t
  misc_feature (438)..(438): n is a, c, g, or t
  misc_feature (440)..(440): n is a, c, g, or t
  misc_feature (442)..(443): n is a, c, g, or t
  misc_feature (445)..(447): n is a, c, g, or t
  misc_feature (449)..(449): n is a, c, g, or t
  misc_feature (452)..(453): n is a, c, g, or t
  misc_feature (456)..(456): n is a, c, g, or t
  misc_feature (458)..(459): n is a, c, g, or t
  misc_feature (461)..(461): n is a, c, g, or t
  misc_feature (463)..(463): n is a, c, g, or t
  misc_feature (468)..(468): n is a, c, g, or t
  misc_feature (470)..(471): n is a, c, g, or t
  misc_feature (473)..(476): n is a, c, g, or t
  misc_feature (478)..(478): n is a, c, g, or t
  misc_feature (481)..(481): n is a, c, g, or t
  misc_feature (484)..(484): n is a, c, g, or t
  misc_feature (487)..(489): n is a, c, g, or t
  misc_feature (500)..(500): n is a, c, g, or t
  misc_feature (504)..(506): n is a, c, g, or t
  misc_feature (509)..(509): n is a, c, g, or t
  misc_feature (517)..(517): n is a, c, g, or t
  misc_feature (519)..(521): n is a, c, g, or t
  misc_feature (526)..(526): n is a, c, g, or t
  misc_feature (528)..(528): n is a, c, g, or t
  misc_feature (530)..(531): n is a, c, g, or t
  misc_feature (534)..(534): n is a, c, g, or t
  misc_feature (538)..(538): n is a, c, g, or t
  misc_feature (544)..(544): n is a, c, g, or t
  misc_feature (547)..(547): n is a, c, g, or t
  misc_feature (549)..(549): n is a, c, g, or t
  misc_feature (553)..(553): n is a, c, g, or t
  misc_feature (556)..(557): n is a, c, g, or t
  misc_feature (559)..(559): n is a, c, g, or t
  misc_feature (566)..(566): n is a, c, g, or t
  misc_feature (569)..(569): n is a, c, g, or t
  misc_feature (572)..(572): n is a, c, g, or t
  misc_feature (574)..(575): n is a, c, g, or t
  misc_feature (580)..(581): n is a, c, g, or t
  misc_feature (585)..(586): n is a, c, g, or t
  misc_feature (590)..(590): n is a, c, g, or t
  misc_feature (592)..(594): n is a, c, g, or t
  misc_feature (597)..(597): n is a, c, g, or t
  misc_feature (599)..(599): n is a, c, g, or t
  misc_feature (601)..(601): n is a, c, g, or t
  misc_feature (603)..(605): n is a, c, g, or t
  misc_feature (608)..(608): n is a, c, g, or t
  misc_feature (610)..(610): n is a, c, g, or t
  misc_feature (614)..(615): n is a, c, g, or t
  misc_feature (619)..(620): n is a, c, g, or t
  misc_feature (622)..(623): n is a, c, g, or t
  misc_feature (625)..(625): n is a, c, g, or t
  misc_feature (627)..(627): n is a, c, g, or t
  misc_feature (631)..(632): n is a, c, g, or t
  misc_feature (634)..(635): n is a, c, g, or t
  misc_feature (639)..(639): n is a, c, g, or t
  misc_feature (642)..(642): n is a, c, g, or t
  misc_feature (647)..(647): n is a, c, g, or t
  misc_feature (649)..(650): n is a, c, g, or t
  misc_feature (654)..(657): n is a, c, g, or t
  misc_feature (659)..(660): n is a, c, g, or t
  misc_feature (662)..(662): n is a, c, g, or t
  misc_feature (667)..(667): n is a, c, g, or t
  misc_feature (679)..(680): n is a, c, g, or t
  misc_feature (682)..(683): n is a, c, g, or t
  misc_feature (689)..(690): n is a, c, g, or t
  misc_feature (692)..(692): n is a, c, g, or t
  misc_feature (698)..(698): n is a, c, g, or t
  misc_feature (700)..(701): n is a, c, g, or t
  misc_feature (704)..(705): n is a, c, g, or t
  misc_feature (709)..(713): n is a, c, g, or t
  misc_feature (718)..(718): n is a, c, g, or t
  misc_feature (720)..(720): n is a, c, g, or t
  misc_feature (722)..(722): n is a, c, g, or t
  misc_feature (724)..(724): n is a, c, g, or t
  misc_feature (726)..(727): n is a, c, g, or t
  misc_feature (729)..(729): n is a, c, g, or t
  misc_feature (733)..(734): n is a, c, g, or t
  misc_feature (738)..(738): n is a, c, g, or t
  misc_feature (744)..(744): n is a, c, g, or t
  misc_feature (747)..(750): n is a, c, g, or t
  misc_feature (752)..(752): n is a, c, g, or t
  misc_feature (754)..(754): n is a, c, g, or t
  misc_feature (761)..(762): n is a, c, g, or t
  misc_feature (765)..(765): n is a, c, g, or t
  misc_feature (768)..(768): n is a, c, g, or t
  misc_feature (774)..(774): n is a, c, g, or t
  misc_feature (777)..(777): n is a, c, g, or t
  misc_feature (781)..(781): n is a, c, g, or t
  misc_feature (789)..(790): n is a, c, g, or t
  misc_feature (792)..(792): n is a, c, g, or t
  misc_feature (796)..(796): n is a, c, g, or t
  misc_feature (798)..(798): n is a, c, g, or t
  misc_feature (801)..(801): n is a, c, g, or t
  misc_feature (803)..(803): n is a, c, g, or t
  misc_feature (809)..(809): n is a, c, g, or t
  misc_feature (815)..(815): n is a, c, g, or t
  misc_feature (826)..(826): n is a, c, g, or t
  misc_feature (828)..(828): n is a, c, g, or t
  misc_feature (831)..(832): n is a, c, g, or t
  misc_feature (834)..(834): n is a, c, g, or t
  misc_feature (845)..(845): n is a, c, g, or t
  misc_feature (848)..(848): n is a, c, g, or t
  misc_feature (851)..(857): n is a, c, g, or t
  misc_feature (862)..(862): n is a, c, g, or t
  misc_feature (864)..(864): n is a, c, g, or t
  misc_feature (866)..(867): n is a, c, g, or t
  misc_feature (869)..(869): n is a, c, g, or t
  misc_feature (873)..(873): n is a, c, g, or t
  misc_feature (880)..(880): n is a, c, g, or t
  misc_feature (884)..(884): n is a, c, g, or t
  misc_feature (888)..(888): n is a, c, g, or t
  misc_feature (892)..(892): n is a, c, g, or t
  misc_feature (894)..(894): n is a, c, g, or t
  misc_feature (897)..(899): n is a, c, g, or t
  misc_feature (901)..(901): n is a, c, g, or t
  misc_feature (907)..(907): n is a, c, g, or t
  misc_feature (910)..(911): n is a, c, g, or t
  misc_feature (915)..(915): n is a, c, g, or t
  misc_feature (926)..(926): n is a, c, g, or t
  misc_feature (929)..(929): n is a, c, g, or t
  misc_feature (1160)..(1160): n is a, c, g, or t
  misc_feature (1682)..(1682): n is a, c, g, or t
  misc_feature (1697)..(1697): n is a, c, g, or t
  misc_feature (1722)..(1722): n is a, c, g, or t
  misc_feature (1870)..(1870): n is a, c, g, or t
  misc_feature (1879)..(1879): n is a, c, g, or t
  misc_feature (1882)..(1882): n is a, c, g, or t
  misc_feature (1938)..(1938): n is a, c, g, or t
  misc_feature (1950)..(1950): n is a, c, g, or t
  misc_feature (1988)..(1988): n is a, c, g, or t
  misc_feature (1993)..(1993): n is a, c, g, or t
  misc_feature (2003)..(2004): n is a, c, g, or t
  misc_feature (2007)..(2007): n is a, c, g, or t
  misc_feature (2009)..(2009): n is a, c, g, or t
  misc_feature (2011)..(2011): n is a, c, g, or t
  misc_feature (2076)..(2076): n is a, c, g, or t
  misc_feature (2682)..(2682): n is a, c, g, or t
  misc_feature (2938)..(2938): n is a, c, g, or t
  misc_feature (2940)..(2941): n is a, c, g, or t
  misc_feature (2973)..(2973): n is a, c, g, or t
  misc_feature (3111)..(3111): n is a, c, g, or t
  misc_feature (3118)..(3118): n is a, c, g, or t
  misc_feature (3601)..(3601): n is a, c, g, or t
  misc_feature (3715)..(3715): n is a, c, g, or t
  misc_feature (3720)..(3720): n is a, c, g, or t
  misc_feature (3726)..(3726): n is a, c, g, or t
  misc_feature (3728)..(3728): n is a, c, g, or t
  misc_feature (3868)..(3868): n is a, c, g, or t
  misc_feature (3879)..(3879): n is a, c, g, or t
  misc_feature (3891)..(3891): n is a, c, g, or t
  misc_feature (3894)..(3894): n is a, c, g, or t
  misc_feature (3898)..(3898): n is a, c, g, or t
  misc_feature (3921)..(3921): n is a, c, g, or t
  misc_feature (3948)..(3948): n is a, c, g, or t
  misc_feature (3955)..(3955): n is a, c, g, or t
gnnnnccnnnagnnnncgnnggnnnnnaaannnnnngnnggntnggangnnnttnncngnnggntcncnncnttnnnngggnaanngttcnncnncnnccccgcnnangnncnannnnngnnncnnnnnnnngnncnnnnnncngnnnnnncgnngnngnaaaantnnnannngnnnnnggnnnngnnnnannnnnnancnacnncnanaannnnnnnnnnnannnntnnccnnccnggnngnnnncnnccnccncncnngggngggnntttnnnnccnncnaangnnnngngnccnannncnanntnccngnncccnnnangnnnnnannaaannccnnnnannnccnnnnannnnnnnngnnncngggnnaannnnnnncccnggcnnnnttnnancccnnangnnncccgnncccnnnnncncnnnnaaaaaccngnanntnnncnctnnccngnnancnggcgnanntnnnnanaanttntannnggtggcgggcncccnnnatnttggcaancnnnccgcncncnntgngctntcgagngtncncacnganntncgttttnatnttngnncgctnntcgnnaaanannnctngnanannnccnangagnnccgnncnnancncgtnncnncccncancgcgntnnaacnnnncnngnttctnatcacccacggnncnnacacanngngcgaancnnccnnatannnnnccgancncncngnncngggnncaanggttgnggnnnngncnggtgccnngcngcnggcggncanggcncattcggnngngggntncancntggggnctgcgntttccgcgctnanccnncngaaaccgggcnttnacnnnnnnntgagngncnnantttncccggcncacnccgngcgnanggnnngngcccgnggnntttncgagggataanctntgaaatttttgctgcgttctgcaagctcttggtgacgcttcagtaaacagggcgtaaatctcagcgttatctcagtttcatctcgtaccgtagtattgagtgctttctcgatggcgcctccggcagtgcttcacaacgccagcggcagacagggtacctatgagcgaacaatataacccgggtttttgggatcaggcttgttccacgccgccacccgtgcggcgcctgtancttgtccgcatgcttttcctcgtggtgcctgcactgacgctggtgtattttttcgaggctatcgggcttgaccctatcggcgcggttcccctcatgtacctgtctctgcacggctggtttgcggtcgcgtatgcgcgcaataaatctatggggctcgtcatggtgggaaacctgctcagcgccttggcggcatccgtcatcaccggatttttcgcctatattttggtttttattcacgggccaagaacactatggaaactcctggggggctcgtaccccattctgaccatttggattatggcctccttcgtgatcgagattttatgctccctcatattcgtcttcctgatcttccgcaggttcccctcccgtgccgaacgtgaagctcaagagactcgcgaactgtcacaagaatcttccctgtctgaagaccaggcagtcaacgaccacacgctgactaagaccgaagcacagagcacccaccgctcagactcggatataccataatgagttcctgagctnatccgttccccaacntgccatgattgcagccgttactccntgcaagcgtggtagtgtatgacataacccaacgttggtgtagcgaggcacccgcgcgccgggctacacaaaaattaccggtaacgaggatgtacatatgagcacagaccccatgaaaaacgatgattcttcccgtcagcctgaggaanctagaactncgncgcaggaatcttcggcaacgtcgcatgtagacgatcattcgggggacagcaccgcncataaaaccganggaaccggcggcgcatcgcagcacgaacatagcgggcncaccncaaagtcggnnccntnanccgaggataaacaaaaccccaacaactccggcaacacccagaaccaacagactcctccgtcagcnccagggtatgtcgggttacaaccgggctatcctgcgccgagtccatcgacgcctccaaatccctatgcgaatccgcatgtcgtacccggatattcgggatatgcagtgccgagcccaaccgcatacccgtacactgcatatccggcaaacccgcacgatgagattgtccgcaaacgttcgctgatgtacctgctgcgcctgtgtattgtgggtgctcttattgcgatcggtattgttgcgacgactttcaaccttatcggtgcgatcatcgaacttagcgactgcggaaccggcagctactcatggagtgaatactcgcagcgagtatgccgtgaggataacacctcagcaatcacgggggcgtcgattttccttgtcattttaatcgcgtacccgatatgtcatatttttgggctgcttgccgttaggaaaaatcagcaccacgtgagggtgcttgtcattaacattattggcattgtgctttcgtctttggggattgtgcttgctggtttaatgctcttgggcggtatagccatgataacggcgtttggatcctcgggattacttgccattcttatcatattcctcgtggctggggcagtaccngtggcagagcttattttctcgattattttcgtccggcatgcctcgtggatgaaccataaggactacttcacgaaacccggtgtataaccactgcggggtgccacaccgtgccccattcgagtgctcctggcgtgaaaggtaaaatgtggctcacgagccggtagaaaacgtatctggcaataattctgatatacagtcgatgggtcggggtgcggaacaccatgtggcgcatccagccttgtcggcgggttatccngnncagggtcagcctggtgtgcccgcttatgcagnaccccagaacccctatactgtcgggtctgcagcgtacggtatgcctggtaccttcgggtactctggtgcattatcaacgggtcctgataactccgaaatcagaaaatatgcatcgatatatctggtgcgtctaggtantgtaggngcgcttcttgccctgtatgcgatgggtattatttcaggtattaatgacacgtttgattcgtgcagaggggcgttgaatcaggatgaatgccttgcacgtgaacgtatagtcgttgcacctgggtatattttagtaatatttatcgcggcctttatgatctgcaatatttttggctggttagccgttaaaaataaccgccattatctgatggtgcgcgttatcaacattattgggattgtactttcagccttgggaactatgggaggagccctagttttactcatagcagttggaagtatggcgacctggggacataacgggggtagaggggcattagtcgccctcctggcgacagttgcacctgcggttgatttagctttctcgatcgtatttgttgtgtatgcatcgcgcatgaaacgaggtatatattccccgaagaatacctaccaaccgtgatagggtatgcgtagataaaaaactcangcggcttcgggaatttatacgtcggaaaatccgtataaatccttaggattaggatatatggggaggaggaaactgctgtggatcacgaatctcgcgtgcatgatgccgatgcgnttccntctgcncncatgaacgccgaagatgcttcgcctcgggacgaagccccgccggccggtcaggatgcggtgcccacccgctacacggcaccgattcgccacgcggttccggcagcgccgcccgcatacgcccttgagcatgcacgacagnattcggggganccggaaccagcnccncagncgccgcagcccaagaaacagggngcggttcgtcaggcgcttcgggcagcnacgaaancgaaaactgccgagcctcaggcacctcaggatgcgcctgccccac

SEQ ID NO: 1139 - DNA, 4000 bp, Escherichia coli
  misc_feature (1921)..(1921): n is a, c, g, or t
  misc_feature (1926)..(1927): n is a, c, g, or t
  misc_feature (1929)..(1930): n is a, c, g, or t
  misc_feature (1938)..(1938): n is a, c, g, or t
  misc_feature (1959)..(1960): n is a, c, g, or t
  misc_feature (1965)..(1965): n is a, c, g, or t
  misc_feature (1968)..(1969): n is a, c, g, or t
  misc_feature (1972)..(1972): n is a, c, g, or t
  misc_feature (1980)..(1981): n is a, c, g, or t
  misc_feature (1992)..(1993): n is a, c, g, or t
  misc_feature (1995)..(1995): n is a, c, g, or t
  misc_feature (2207)..(2207): n is a, c, g, or t
  misc_feature (2480)..(2480): n is a, c, g, or t
  misc_feature (2500)..(2500): n is a, c, g, or t
  misc_feature (2562)..(2562): n is a, c, g, or t
  misc_feature (3039)..(3039): n is a, c, g, or t
  misc_feature (3041)..(3041): n is a, c, g, or t
  misc_feature (3044)..(3044): n is a, c, g, or t
  misc_feature (3046)..(3054): n is a, c, g, or t
  misc_feature (3058)..(3064): n is a, c, g, or t
  misc_feature (3066)..(3066): n is a, c, g, or t
  misc_feature (3068)..(3070): n is a, c, g, or t
  misc_feature (3073)..(3073): n is a, c, g, or t
  misc_feature (3075)..(3077): n is a, c, g, or t
  misc_feature (3080)..(3090): n is a, c, g, or t
  misc_feature (3093)..(3099): n is a, c, g, or t
  misc_feature (3101)..(3106): n is a, c, g, or t
  misc_feature (3109)..(3115): n is a, c, g, or t
  misc_feature (3118)..(3119): n is a, c, g, or t
  misc_feature (3122)..(3125): n is a, c, g, or t
  misc_feature (3127)..(3130): n is a, c, g, or t
  misc_feature (3132)..(3134): n is a, c, g, or t
  misc_feature (3136)..(3141): n is a, c, g, or t
  misc_feature (3144)..(3146): n is a, c, g, or t
  misc_feature (3150)..(3155): n is a, c, g, or t
  misc_feature (3159)..(3164): n is a, c, g, or t
  misc_feature (3167)..(3167): n is a, c, g, or t
  misc_feature (3169)..(3172): n is a, c, g, or t
  misc_feature (3174)..(3177): n is a, c, g, or t
  misc_feature (3179)..(3180): n is a, c, g, or t
  misc_feature (3184)..(3186): n is a, c, g, or t
  misc_feature (3189)..(3189): n is a, c, g, or t
  misc_feature (3191)..(3191): n is a, c, g, or t
  misc_feature (3193)..(3193): n is a, c, g, or t
  misc_feature (3195)..(3198): n is a, c, g, or t
  misc_feature (3200)..(3205): n is a, c, g, or t
  misc_feature (3207)..(3207): n is a, c, g, or t
  misc_feature (3211)..(3214): n is a, c, g, or t
  misc_feature (3216)..(3220): n is a, c, g, or t
  misc_feature (3222)..(3224): n is a, c, g, or t
  misc_feature (3229)..(3231): n is a, c, g, or t
  misc_feature (3233)..(3234): n is a, c, g, or t
  misc_feature (3236)..(3236): n is a, c, g, or t
  misc_feature (3238)..(3241): n is a, c, g, or t
  misc_feature (3243)..(3245): n is a, c, g, or t
  misc_feature (3247)..(3253): n is a, c, g, or t
  misc_feature (3256)..(3257): n is a, c, g, or t
  misc_feature (3260)..(3261): n is a, c, g, or t
  misc_feature (3264)..(3265): n is a, c, g, or t
  misc_feature (3268)..(3274): n is a, c, g, or t
  misc_feature (3276)..(3277): n is a, c, g, or t
  misc_feature (3279)..(3283): n is a, c, g, or t
  misc_feature (3285)..(3285): n is a, c, g, or t
  misc_feature (3287)..(3295): n is a, c, g, or t
  misc_feature (3297)..(3297): n is a, c, g, or t
  misc_feature (3299)..(3301): n is a, c, g, or t
  misc_feature (3304)..(3317): n is a, c, g, or t
  misc_feature (3319)..(3320): n is a, c, g, or t
  misc_feature (3322)..(3323): n is a, c, g, or t
  misc_feature (3325)..(3325): n is a, c, g, or t
  misc_feature (3327)..(3329): n is a, c, g, or t
  misc_feature (3331)..(3331): n is a, c, g, or t
  misc_feature (3333)..(3342): n is a, c, g, or t
  misc_feature (3344)..(3345): n is a, c, g, or t
  misc_feature (3348)..(3353): n is a, c, g, or t
  misc_feature (3357)..(3358): n is a, c, g, or t
  misc_feature (3360)..(3360): n is a, c, g, or t
  misc_feature (3362)..(3363): n is a, c, g, or t
  misc_feature (3365)..(3366): n is a, c, g, or t
  misc_feature (3368)..(3369): n is a, c, g, or t
  misc_feature (3372)..(3372): n is a, c, g, or t
  misc_feature (3374)..(3374): n is a, c, g, or t
  misc_feature (3376)..(3377): n is a, c, g, or t
  misc_feature (3379)..(3382): n is a, c, g, or t
  misc_feature (3386)..(3389): n is a, c, g, or t
  misc_feature (3391)..(3392): n is a, c, g, or t
  misc_feature (3394)..(3396): n is a, c, g, or t
  misc_feature (3398)..(3398): n is a, c, g, or t
  misc_feature (3400)..(3405): n is a, c, g, or t
  misc_feature (3408)..(3409): n is a, c, g, or t
  misc_feature (3411)..(3412): n is a, c, g, or t
  misc_feature (3414)..(3416): n is a, c, g, or t
  misc_feature (3418)..(3418): n is a, c, g, or t
  misc_feature (3421)..(3421): n is a, c, g, or t
  misc_feature (3423)..(3423): n is a, c, g, or t
  misc_feature (3426)..(3431): n is a, c, g, or t
  misc_feature (3433)..(3436): n is a, c, g, or t
  misc_feature (3438)..(3440): n is a, c, g, or t
  misc_feature (3442)..(3444): n is a, c, g, or t
  misc_feature (3446)..(3450): n is a, c, g, or t
  misc_feature (3452)..(3453): n is a, c, g, or t
  misc_feature (3456)..(3457): n is a, c, g, or t
  misc_feature (3459)..(3469): n is a, c, g, or t
  misc_feature (3471)..(3472): n is a, c, g, or t
  misc_feature (3474)..(3479): n is a, c, g, or t
  misc_feature (3481)..(3488): n is a, c, g, or t
  misc_feature (3490)..(3495): n is a, c, g, or t
  misc_feature (3498)..(3501): n is a, c, g, or t
  misc_feature (3504)..(3504): n is a, c, g, or t
  misc_feature (3506)..(3507): n is a, c, g, or t
  misc_feature (3509)..(3510): n is a, c, g, or t
  misc_feature (3512)..(3513): n is a, c, g, or t
  misc_feature (3515)..(3518): n is a, c, g, or t
  misc_feature (3520)..(3525): n is a, c, g, or t
  misc_feature (3527)..(3528): n is a, c, g, or t
  misc_feature (3530)..(3538): n is a, c, g, or t
  misc_feature (3540)..(3540): n is a, c, g, or t
  misc_feature (3542)..(3545): n is a, c, g, or t
  misc_feature (3548)..(3548): n is a, c, g, or t
  misc_feature (3551)..(3565): n is a, c, g, or t
  misc_feature (3567)..(3570): n is a, c, g, or t
  misc_feature (3573)..(3574): n is a, c, g, or t
  misc_feature (3577)..(3577): n is a, c, g, or t
  misc_feature (3579)..(3580): n is a, c, g, or t
  misc_feature (3582)..(3583): n is a, c, g, or t
  misc_feature (3585)..(3589): n is a, c, g, or t
  misc_feature (3591)..(3591): n is a, c, g, or t
  misc_feature (3596)..(3598): n is a, c, g, or t
  misc_feature (3600)..(3600): n is a, c, g, or t
  misc_feature (3602)..(3604): n is a, c, g, or t
  misc_feature (3607)..(3610): n is a, c, g, or t
  misc_feature (3612)..(3613): n is a, c, g, or t
  misc_feature (3615)..(3631): n is a, c, g, or t
  misc_feature (3633)..(3633): n is a, c, g, or t
  misc_feature (3637)..(3641): n is a, c, g, or t
  misc_feature (3643)..(3644): n is a, c, g, or t
  misc_feature (3646)..(3654): n is a, c, g, or t
  misc_feature (3656)..(3657): n is a, c, g, or t
  misc_feature (3659)..(3660): n is a, c, g, or t
  misc_feature (3662)..(3665): n is a, c, g, or t
  misc_feature (3667)..(3667): n is a, c, g, or t
  misc_feature (3669)..(3669): n is a, c, g, or t
  misc_feature (3671)..(3672): n is a, c, g, or t
  misc_feature (3674)..(3676): n is a, c, g, or t
  misc_feature (3680)..(3682): n is a, c, g, or t
  misc_feature (3685)..(3687): n is a, c, g, or t
  misc_feature (3693)..(3693): n is a, c, g, or t
  misc_feature (3695)..(3695): n is a, c, g, or t
  misc_feature (3697)..(3697): n is a, c, g, or t
  misc_feature (3699)..(3702): n is a, c, g, or t
  misc_feature (3704)..(3713): n is a, c, g, or t
  misc_feature (3715)..(3715): n is a, c, g, or t
  misc_feature (3717)..(3718): n is a, c, g, or t
  misc_feature (3722)..(3722): n is a, c, g, or t
  misc_feature (3724)..(3730): n is a, c, g, or t
  misc_feature (3732)..(3732): n is a, c, g, or t
  misc_feature (3736)..(3736): n is a, c, g, or t
  misc_feature (3738)..(3740): n is a, c, g, or t
  misc_feature (3742)..(3742): n is a, c, g, or t
  misc_feature (3746)..(3748): n is a, c, g, or t
  misc_feature (3750)..(3750): n is a, c, g, or t
  misc_feature (3752)..(3753): n is a, c, g, or t
  misc_feature (3757)..(3757): n is a, c, g, or t
  misc_feature (3759)..(3759): n is a, c, g, or t
  misc_feature (3761)..(3761): n is a, c, g, or t
  misc_feature (3763)..(3763): n is a, c, g, or t
  misc_feature (3767)..(3767): n is a, c, g, or t
  misc_feature (3770)..(3770): n is a, c, g, or t
  misc_feature (3773)..(3773): n is a, c, g, or t
  misc_feature (3775)..(3775): n is a, c, g, or t
  misc_feature (3777)..(3779): n is a, c, g, or t
  misc_feature (3782)..(3783): n is a, c, g, or t
  misc_feature (3785)..(3787): n is a, c, g, or t
  misc_feature (3789)..(3789): n is a, c, g, or t
  misc_feature (3793)..(3793): n is a, c, g, or t
  misc_feature (3795)..(3795): n is a, c, g, or t
  misc_feature (3797)..(3800): n is a, c, g, or t
  misc_feature (3802)..(3803): n is a, c, g, or t
  misc_feature (3805)..(3805): n is a, c, g, or t
  misc_feature (3807)..(3808): n is a, c, g, or t
  misc_feature (3817)..(3818): n is a, c, g, or t
  misc_feature (3821)..(3821): n is a, c, g, or t
  misc_feature (3827)..(3827): n is a, c, g, or t
  misc_feature (3831)..(3833): n is a, c, g, or t
  misc_feature (3835)..(3837): n is a, c, g, or t
  misc_feature (3839)..(3839): n is a, c, g, or t
  misc_feature (3842)..(3842): n is a, c, g, or t
  misc_feature (3846)..(3847): n is a, c, g, or t
  misc_feature (3849)..(3850): n is a, c, g, or t
  misc_feature (3852)..(3852): n is a, c, g, or t
  misc_feature (3854)..(3855): n is a, c, g, or t
  misc_feature (3859)..(3860): n is a, c, g, or t
  misc_feature (3864)..(3866): n is a, c, g, or t
  misc_feature (3869)..(3872): n is a, c, g, or t
  misc_feature (3874)..(3875): n is a, c, g, or t
  misc_feature (3877)..(3877): n is a, c, g, or t
  misc_feature (3880)..(3880): n is a, c, g, or t
  misc_feature (3882)..(3883): n is a, c, g, or t
  misc_feature (3885)..(3885): n is a, c, g, or t
  misc_feature (3888)..(3890): n is a, c, g, or t
  misc_feature (3895)..(3895): n is a, c, g, or t
  misc_feature (3900)..(3902): n is a, c, g, or t
  misc_feature (3905)..(3907): n is a, c, g, or t
  misc_feature (3912)..(3912): n is a, c, g, or t
  misc_feature (3914)..(3914): n is a, c, g, or t
  misc_feature (3917)..(3918): n is a, c, g, or t
  misc_feature (3920)..(3921): n is a, c, g, or t
  misc_feature (3923)..(3924): n is a, c, g, or t
  misc_feature (3926)..(3926): n is a, c, g, or t
  misc_feature (3940)..(3940): n is a, c, g, or t
  misc_feature (3948)..(3948): n is a, c, g, or t
  misc_feature (3952)..(3952): n is a, c, g, or t
  misc_feature (3957)..(3957): n is a, c, g, or t
  misc_feature (3959)..(3960): n is a, c, g, or t
  misc_feature (3964)..(3964): n is a, c, g, or t
  misc_feature (3966)..(3966): n is a, c, g, or t
  misc_feature (3971)..(3971): n is a, c, g, or t
  misc_feature (3973)..(3973): n is a, c, g, or t
  misc_feature (3980)..(3980): n is a, c, g, or t
  misc_feature (3982)..(3982): n is a, c, g, or t
  misc_feature (3985)..(3986): n is a, c, g, or t
  misc_feature (3993)..(3993): n is a, c, g, or t
  misc_feature (3996)..(3996): n is a, c, g, or t
gtatagagggaaatatcctgatgatatgttgaaggactttttcgagtattggactgaatgcggaggacggaaaatgcgctttgagaaggaacgtacatttgaagtttccaaacgtttagtcagatggtctaataatgattttaacaagtatgggaaacaacttaattcaagtcaacagcaatctcccggcaaccgaaaagaaagcgttgaaagacttgctgaccttgcaagcggagtattacaagggattgcacgtaagttcgattaaagaagctgttctcaacactcctaacctaccactctccgttataagaaaagaaatcacattggctggcgcaagagccatactggtaattgcgattaacgagcttgtgtcttttttcaatgttggaaaaacgatgaatgatgttcaagtggcacttaccgctgatctaataatagacagattctattatctcaaattggaggaaatcaaattgtgtttccgtaatgctatggcttccggtaagatttacgatagactggacggtaatatcattctcggctggttaaatgaatacgatgcacagcgtgatgaaattgtttcttctctttcaattaatgaagcccatgaacaaaataataacagcactggaatgttctacggagaatatatcaaacatctaactgaaagatcggaaaatggagatgaagaggccaaagaattattggaatcccatcaatcattcatacaaaggatgaaatcaaatgataaagaagccgctttcaaaaaatggaaagaagaatattatggaagaactaagagacaaactacttgactgggcgaaacaatttgaaacacctgattttataaaagatgatcctatattttttccacataagtacaatgataaaaaggacatagaaatcagtgcctttcttacttcatggatagctttcgggaatcgcaaactgataatgcagcaagcagaaattttggataatctaatgggtaattctccttatgccttcattatgaacaaagtatgggaacaatacaaagaaaatacaaataccttctaccgtatgttcacctaccatgacttcttctgcatttgccagcggttgtacaacatatatcaggaatgggatgatttggaagtattttatgagggttacaacaatgttatccgtgaaatacaaacagattttggtggcgtaaaaggtattccaaaattggagcgtgattctccatgcaagcgtatttgtctgtttctacggtgggtagtacgaaaatcgccggtggatttaggtatttggaatattattcacccgacagaattatacataccattggatgcacatgttgcaaaaatggcacaccagcttgggataacaacacgcaaaacagaggactggaaaatggttcaacaagtaaccaattacatgaaaacaattttcccggatgatccgtgccggggagattttgcattattcggatatagtattaacaataaataatttacattatgtcagaacttaaaatcacacaagaaaaggtaacagccgcttttagtgaagcaaacgactgtcctaaagcaattagtattctaacagccctattcggaaagcaaaagccggattatacagattatcacaatattaaaacctacgaagatgcttgtgaagcaataggtgtaaaacctattgttcgcctacttgttgaggatgaagacggacacaaagaagaagtggctgatattgcacacctcgcctacatcaaactatgcacaattgctcgtgcattgaacaacgatcctgattttccacgatttactaaagatgaataccgttatacgccgtggttttatctttataatcagaaagaaattgatgaaatggacgaagaggatcgtaatcagctggttctttggggcggtantgcgnntnncggtgcgnattgcggcctcgcttatgcgnnctcgnatnncgnttggtcgnnctcgtatgcgnntntcggctctcgccttgctgtaaaatcaagtgaaatcgcaatttactttggagaacaattcaaagaattgtggaaagactttctgattggaaaaaagtaatcacactggggaggccgcatcaaagcggccttttccataccttttaaatctatgactccaaaagaatttttcgacaaagtggtggaaatgcgccgttgccaaaaagaatatttnaaaaataagagacagatagatttacgaataagtaaacaaattgagcgtgaagtagatgaagaaattgaacgtgttcaaaaaatccttcacgacaaacagaatccgcaactcttttagactatggttaatatgaaaatccttgacctgccattaaaagcaaaatggtatgaaatgatcgaatccggaaataagaaagaagaatacagagagatcaagaaatactggatcggaagattagcaaaatgtggaggtcgcaattcctatgaaaagacnggtttctattgtaagaaagntatttgtttttcttgtattacacgtggaaacggctttcaccccaaagaatacactcatgttngcttccgttttggctacaccaaacggacaatgctttttgaacttgaatctataaccatcggagttggtaacaccaattggggagcaccggataacgaatgtgtatttatacttaaactgggaaaatgtatcaaaaaaaatgaaagtaaggactcaacagaatttcaaccgaaaaactcgtgaaacagtattcggtatcagcatcatgcctgacggtggcagaagatattgtaaatacccaataggccaccaagaatacaaagactatacccaagcacaccaagctatgaaagatgtacaaaagatattggataatggaggccgattagtgtattctcccaaaggtagtgccgggattaataaaaatgaatatgtaaaaattgaaatgacataaaaatgaaaatattagtaagtttttcaggtggtaaggattcacaagcatgtttgatccaagccttcaaacaatatgggggggggnanttnannnnnnnnntttnnnnnnncngnnnggnannnccnnnnnnnnnnnaannnnnnnannnnnnttnnnnnnnaannggnnnnannnntnnnannnnnnaannnaaannnnnntttnnnnnnttngnnnntnnnnannaaannnttncntncnnnnannnnnngntttnnnncnnnnnannnaaaannnanncnannnntnnntnnnnnnnttnnttnnaannaannnnnnntnntnnnnnangnnnnnnnnncngnnnaannnnnnnnnnnnnngnnanngnannngnannnnnnnnnntnnaannnnnntttnnancnnannannaangnannannnnaaannnncnnannnangnnnnnnaannanngnnntnccnanttnnnnnntnnnntnnnannncnnnnntnnaanngnnnnnnnnnnnanntnnnnnntnnnnnnnngnnnnnnggnnnnaancnnanncnntnnnntnnnnnngnntnnnnnnnnntngnnnnttnccnnnnnnnnnnnnnnngnnnnaannaantnnanntnnnnncnaaaannnancnnnaannnngnnannnnnnnnnnnnnnnnnanaaannnnngnnannnnnnnnntnncnncnnnnanananncnnnaaannntcnnnaaaaanananannnncnnnnnnnnnngnanntttngnnnnnnntnaaanannntncccnnnanannttcnancngnaaantgnatntncnnncannannntntttnangnnnnanncnannaaataaaannatnatgaanaaannncnnntnatntttnnanncntnntttnnttannnggnnnnanngnacnannanttnnnaaaangaacnnnttnnnaaaananttnnannanncngattcaatgtttantcaaaaanattnattananngaananattanangaaaagncngcnnaatatgnagnaggg

SEQ ID NO: 1140 - DNA, 4000 bp, Escherichia coli
  misc_feature (4)..(4): n is a, c, g, or t
  misc_feature (55)..(55): n is a, c, g, or t
  misc_feature (100)..(100): n is a, c, g, or t
  misc_feature (329)..(329): n is a, c, g, or t
  misc_feature (459)..(459): n is a, c, g, or t
  misc_feature (624)..(624): n is a, c, g, or t
  misc_feature (1189)..(1189): n is a, c, g, or t
  misc_feature (1237)..(1237): n is a, c, g, or t
  misc_feature (1492)..(1492): n is a, c, g, or t
  misc_feature (1988)..(1988): n is a, c, g, or t
  misc_feature (2900)..(2900): n is a, c, g, or t
  misc_feature (2945)..(2945): n is a, c, g, or t
  misc_feature (2948)..(2948): n is a, c, g, or t
  misc_feature (2984)..(2984): n is a, c, g, or t
  misc_feature (3056)..(3056): n is a, c, g, or t
  misc_feature (3243)..(3243): n is a, c, g, or t
  misc_feature (3272)..(3272): n is a, c, g, or t
tganctgaaatttaaaaatatagactctattgacctgaccacccgttcggatatnaagcttatgtatgacggcaggcttgaaataaagcttggaagctcngtggatatggaatacaagcttacatatcttaaggcggtaattgacaagagcattactgacgattacgagggtacgcttatttacaatggtgctgacagcggcatttcggctattccgaaatcgcaggacgagtcgtcaaaacctgacgacacaagctctgcaaagccagatgacagcagcagtgcggtatcggctgatactaatattgatgacggcaacacatgggacngtgataactcatggtcaggggacgatagccaaggctacagcgacgataccaacgcatgggacggcaatgatgatgctgacaatgcaggcacagatcagtggacaaacgagaacggaaacaccgactgggnatatgataacggcggcgatcagggctataccgacaatggatatgctgacaacggctatgtggacgatcagacgaacacagattggtaggggtcaggataactaattgtatagtatacacaaatgaaactgaaaaatcagtcgttttattgataattaataaaaantttataatggtttcatttaagttctttactttttgacaaaagtatgataatatattattgtatctatttatgtgcatattcggcacataggcttttttgcattttatttttgatttgataaattgatatgtaaaaatacggagaagtatgaaaattcgcttttaggaggagttctattatgggttacgagtatgttgaagagccagtcgtaggcgcaaagatcaaggtaatcggtgtcggtggcggcggtggaaacgcacttaactgtatcgcacaggccggtatcgagggaaatgttgaatatatcgctgttaatactgatatccaggcactgcataagtcagctgcacacacacagatccagataggtgagaagcttactcacggtctgggcgcaggtgcaaagcctgagatcggcgaggcttccgctcaggaaagcaaggacgagatcgagaacgctatcaaggacgctgatatggtattcatcacagcaggtatgggcggtggaacaggtactggtgctgcacctgtagttgctgagatcgcacagtcacttgacaagctnactatcgcagttgttacaaagcctttcaaatttgagggcgctaagaanatggagagagcagaaaagggtatcgaggctcttatcaagcacgttgacgctcttatcgttatccctaaccagaaccttatcacaaacgagatgcgcctcactatgaagcagtcttatgctatcgctgatgaagttcttaagacagacgttatcgctatcgctgagatcattacaagacatgatgagatcaacgttgacttcgctgacgttactactattcttaagggtgcaggcagagcgcatattgctatcggncacggcgagggcaaggataaggtacaggatatcatcaatcaggtcatttcttccgaccttcttgaaacttctatcaagggtgcgagaagacttatcgtaaacgttacaatgagcgaggatctccttatcagtgatatggacgagcttactgctgctatagcagacgctgctgacgataacgttgagatcatttttggtaacggtacaaatcctgataccaaggacgctatggacgttactgttatcgctgctgactttgttgacagagatgacgttcctgaggctgctgcaccaaaggctgcgacaacatatactgcaaattttactcagaaggctgacgacgcaaaggctgacgctgaagcgatgcacaaggctggcgttaaggctgctgataatccaaattattacgacgatatcttcaatatcttcaagaacaagtaataatgctttcaaaggcggatcggcgtttacgctgtccgccttgtttgaaccaaantcggaaaacgtttacataattaaagagattttcgtattctcagaaaattatcatgatattgaaaatttttcgcaaaagcacttgaaatcttacggaaaatttgatataattattctgtgataaatatgattttaagacattttgtataaatttcagttgctattttgtatggaataatgaaatttttgaaaacggcttaaatcagttgaaaaataacgtggtttattgtataatagagataatcactaatgtggagggattgaaatggctagtaatggttatttaagaacggttagagtcggcggatttgataagcaggacgttcttgcttatgtagacgaccttacttctaaaatttatactcttgaggctcaggtcaatgaccagaacgaaactatcgaacgtcttgagaagcagggcggcgctcagaagcaggacttcgagggcaagaaggaacttgagaaaaaggtagaagaggctaaaaacaagatagccgagcttatggctaatactgatacaatgaaggttcgtatcgctgactatgagcagcaggtaactgaaaaggacgctgagcttgaaaagcagaagcaggagatcgaggatcttaaagagaagctcgaaactgctgaggctaatgccggcacagccactcctgcattcgatcttggaagcgtgttcatggaagctcagaacacagctaataaggtcgttcaggaagctaagaaggcagctaagcagatggaagatgaagctaagcagcttcaggatcaggttcttgctgacgcaaacgcacaggcacagaagcttgttacaaatgctcagacagaggctgatactacacttcagacagctaagtcaagcgctgctgcaatgacggctgccgctaagcaggaggctgaagctgttacaagngctgcaaacaagcaggctgccgaggtaacttctaaggctaacgcngangcagaggctgttacatctaaggctaacgcagaagcngctgacgtaacatcaaaggcaaatgctgaggctgcaaaggtagtaagcgacgctaagaacgaagctaagaanatcagagcacagtctgctgatctgagagagtctgttaagacacaattcacaagtctgagcgaaactgttcagcagctcgttacatcacttaacgatctgtatggcaatagtatcggtgctgtaaacactgcaagagatcttattgacgatggtctttctcttgtaagcgatgatgacgctgaataanagtttgtcatgtcggaaataagaaaggtncgttccgaggagcttaaagcggtgagcggagagcttaaatgcggtgacaagatattgctttcgggcgttgtgtacactgcaagggacgctgcacataaaagattcaatgctttgcttgacgagggaaaggagcttcctatccctttgaaagacgctgttatctactatgccggacctactcctgcacctgagggaaagcctatcggttcatgcggaccgaccacttcaggaagaatggacaggtttgcaccgaggttgcttgatcttggattgggcggaatgatcggcaagggcgagagatcacaagaggtaagggacgccgtgataagaaatggtgcggtctatctctgtgctataggcggtgcgggcgcacttgcctgcaactgcataaagtcttgtgaggtagtggcttttgaggagctgggctgtgaatctgtgaaaaaactttacgttgaggattttcctcttgttgtggctgacgattgccacggaggggatattttcagcgatggcagagcaaaatactgccgtgtataacatcaaagttgcgtaaattgcggtcagccgtgtatttcgacacggctgactttttgtttgttgaaaatcacaagaatacattcttaaaactgtggtatgttacaaatattttcacagggacggcggatttcgtcaattctcttgacttttatggtctaaaatggtattataacattacgcagtggcgtcag

SEQ ID NO: 1141 - DNA, 4000 bp, Escherichia coli
  misc_feature (1)..(742): n is a, c, g, or t
  misc_feature (879)..(879): n is a, c, g, or t
  misc_feature (882)..(882): n is a, c, g, or t
  misc_feature (896)..(896): n is a, c, g, or t
  misc_feature (929)..(929): n is a, c, g, or t
  misc_feature (1022)..(1022): n is a, c, g, or t
  misc_feature (1069)..(1069): n is a, c, g, or t
  misc_feature (1141)..(1141): n is a, c, g, or t
  misc_feature (1162)..(1162): n is a, c, g, or t
  misc_feature (1169)..(1169): n is a, c, g, or t
  misc_feature (1174)..(1174): n is a, c, g, or t
  misc_feature (1332)..(1332): n is a, c, g, or t
  misc_feature (1350)..(1350): n is a, c, g, or t
  misc_feature (1509)..(1509): n is a, c, g, or t
  misc_feature (1635)..(1635): n is a, c, g, or t
  misc_feature (1739)..(1739): n is a, c, g, or t
  misc_feature (1987)..(1988): n is a, c, g, or t
  misc_feature (2064)..(2064): n is a, c, g, or t
  misc_feature (2393)..(2393): n is a, c, g, or t
  misc_feature (2398)..(2398): n is a, c, g, or t
  misc_feature (2496)..(2496): n is a, c, g, or t
  misc_feature (3001)..(3001): n is a, c, g, or t
  misc_feature (3011)..(3011): n is a, c, g, or t
  misc_feature (3073)..(3073): n is a, c, g, or t
  misc_feature (3076)..(3076): n is a, c, g, or t
  misc_feature (3797)..(3797): n is a, c, g, or t
  misc_feature (3821)..(3821): n is a, c, g, or t
  misc_feature (3824)..(3824): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaattgccatctcataggctgtcaggctttcgcccaagtggcgccgcatcgcgggccaatcgccccgcaatgcccggttgggcgcggcaaaaatagcctcagccaggggggccaacacgccctgcgcctttgggnggngaaagtgaaacgcnccctcgggcaggtgcacatcggccagcagcccncgccccggttctgccaccgccctttgccagcgcgtcaccaaccaacaatgaaacccatccctggccggcgcgctgggcgccgcttgcggtggngtatcggcctgcgcctgcagccacatgccccaggccagcggcaccgnctggcccgcaaaccgcaacgccaaggcaacttcggccagcaaatcggcgtcttgcgccaaaaacgccaccgngcccgcaaaatgcaggctttncagcgcngcctnctgcagattgacctgcttgcgcccataatctgattggtaaaacaccaaatgcgtcagcgcgtaggcggcgttttggttgggcatcgcaaactggctgctttgccccataaaccccgccaaccgctgccccagcgccgggtcggggcggcccaacccanggcgcgcaaacagcgccnctgcctcggcgcgctgttggtcggacagctcgaccaaatcgaggcgctgatcggcacaccattgcgccagcaccaaacccacgcggccgggcatgcccagatcctctagatcaagggccatagacaggaaaaagcggtaatattgggggaaatcccccncctgctgcgccaagctggcatagattgggtgatacagcgccaaaacatcagggggcaggctggcgccagtggcgcggagcacgcacaggaattcggcattttctttcagccacatcacatcgcccntcggcctgcgctgctgcaacagcgcgcaggccagccgggccatggccccggcttttggcgcggggctggggcggcgaaaggccagaacctgtgccacgatccgnggcttagctgtcgaggcctgcgatataggcacccaccccctgccccagcagcatgtcgctgcccgtctgcgggcccagccctgcgatatagctgccggtggcgtggcctgcgaccatctgcgccggggcgtgctggggcgaaactgtgggggtggcctgtggcgtggccagttcggcggtgtgcttcaaaactgcagtcatgtcgggttctcctttgtggtgagtaaacaaaagtgaaaacacctttnngctgtatgtcaacacacttattcccgccctagatgtttttggccctacagggggccatcggcttgcctgcgccggnccatgggggatagatggacgaaagaggagaggcagatgaaaatcgcgacgtttaacatcaacggtgtcaaagcccgcattcaaacgctgtgcgattggctggatgaaaccaagcccgatatcgccattttgcaagagatcaaatctgtcgacgaggcctttccccgcgagctgatcgaagaccgcggctatatcgtggaaacccacgggcagaaaagctttaatggcgtggcgcttttgtcgcgttacccgctggaagatgtcagccgcggcctgcccggcgacgacagcgacgaacaggcccgctatatcgaggccacggtggtgggnaaaancgcgctgcgcatttgcgggctgtatctgcccaatggcaacccggtcgaactggaccacgcaggccagcccgtggcgggcggcaaatatgcctataaantggcatggatggcgcggctgcaggcccgcgcacaggcgcttttggcgcaggaaattccgtttttaatggcgggcgattacaacatcatcccgcaagccgaagacgccaagcgccccgaggcatggaccgaagatgcgctgtatcggcaaaccagccgcgaggcgtttcgcaaaatcttggcccttggcctaaccgaggcgtttcgcgcccgggtgcaggggccggggcattattcgttttgggattatcaggccggggcgtggaaccgcgacgatggcatccgcatcgatcactttctgcttagcccacaatgtgccgacatgatgatagattgtcatatccagcgtgacatgcgcgggcgcgaaaaaccatccgatcacgtgcccgtctggctggaactggataattaagcgcaaggcccgcgcgcttggcgcgggctgctgaaacttaggcgcttaggcggtctttcaccgccgggccaacggcaccgaaatccatttgaccngtgtatttgnctttaagcgcggccatcactttgcccatatcgcggatgctttgtgcaccgatttcggcaacngcngcatcgatggccttgtccacctcggcctgcgacagctggcgcggcaggaattcttcgataatcacaatctcggcgcgctcgcgttcggccagatcaaggcgcccaccctcttcgtaggcgcgcgcgctttcttggcgctgcttggccatcttgcccaaaatcgccaagatctcgctatcgggcacaccctcgtcattgccatcgctgcgcgcatcaatatcgcggtctttgatcgcggcatttatcagccgaagggtcgacaagcgttcgggctgcttgtctttcatggcttgtttgagggcgctgttcacccgatctcgcatgtccattgctggctccgttttcccgttcggtcctgaatgcgtgtagataggcattaaaggcggcgctgacaacaggcgttgcacccttgacctgtggggcgtggggccataggtacacgccaatttggccgcccagaggaatccccatgtcgcaaacatctgccccccgcccaaccgcgtgccttgcgcttgctgatggcacagtgttttacggccgcggatttggcgccacaggcacgaccgaggcggaattgtgtttcaacaccgccatgaccggctatcaagaaatcatgacagacccctcttatgccgggcaggttgtcacctttaccttcccgcatgtgggcaatgtgggtgtgaaccccgatgacgatgaaaccgccgatcccgtggccgcnggcatggtggtcaaatgggacccnacngaccccagcaactggcgcgcggccgaacatctgtcgccttggttgcatcggcgcgggcgcattgcgattggtggcatcgacacccgccgccttacccgggccatccgccagcagggtgcgccgcatgtggcgctgtgccataaccccgagggcagcttcgacatcgaggcgctggt

SEQ ID NO: 1142 - DNA, 4000 bp, Escherichia coli
  misc_feature (802)..(802): n is a, c, g, or t
  misc_feature (1991)..(1991): n is a, c, g, or t
  misc_feature (3723)..(3723): n is a, c, g, or t
aaggtgcccgtgtattccggcgtgctcatctatatgtgcctggcttcgctgggtttgccagggctggccggcttcgtcggtgagttcttctgcctactcggcagtttcgccatcttcaagctgctgacgtgcatttccgtgctcggcgtcgtcctgtgcgcggcgtacttcctgtggatgatccagcgaatgctgttcggcccgttcaacgagcggtatgtcgacctgaccgacatgaacggagccgagatcttctgcctggtgcccctgatggcgctgacgctcttcatcggcgtctacccggcctttgtgttgggcccgatcaacatcgcgatgcagaacgtgctgaagctgatgggcggataggccccggaggtcctatcggtccaacccggccgacccatctcactcaccggagccatttcccttgggcggaaccgtcttctacttgatgcccgaaatcgtcctcgccctcttgggcgtggggctgatcgtgctcgacaccttcaccagccgcgagcgcaagaactggctcggctggctcgcctttctgggcctattcctggcgtttgagttggcggcctgcgccactgccgtctggtcgttgggcccgcaaggcgggtcggtccacgcgagcgtgctgcctcgttgggcggcccagacggtcaccttcgatcccttcgccggctacttcaagctcctcgtcatcgccgctgccgggctgaccgtcctgctctcgctccactttgtgcacaagcacgttcgcaccggggttggcgagttctacgcattcatcgtattnggcacgctgggcatgacgctgatggtgtccagcaccgacctgattctgctctaccttgccatcgagttcacctcgatctccagctacgtactggcaggctacctccgccgcacgccgcagagcgccgaagcgggcatcaagtacttcctgctgggtgcggtcagctctgccaccatgctatacggcatgtcgctgatatacgggttctccggcagcacgcacattggcgagatcgcccagaaggtgcaagcgggaaacgggactgccccgatcgtcgtgctgggcgtcggtctgatgctggccggctttgggttcaagatcgccgcggcaccgttccacatgtggtgccccgacgtgttcgaaggcgcgcccacaccggtggcagcgctgttgtcggtcggcccgaaggccgccggcatggccgtgctgatccgggtgttccacgtgttctttggaccgcaggaagtggagtggagcctggtcattgccgtcatcgcgacggcgaccatgaccatcggcaacgtagtcgcgctggtgcagaccaacatcaagcggatgctgggctactcgaccatcgcccaggttggctacatgctcgtcggcgtcgccgccacggggccggaggagtggcggattcccggggtgctgctctacctcctgacctacctgttcatgaacctgggcgccttcgcggtcgttatcaccgtctcgaacgcgatcgagtcggacgagattgccgactactcgggtctgttccgccgggcgccggttgcgtgcctggcattcctggttttcgccctgtcgctggcagggctaccgccgatgtccggcttcgtggccaagttcatgatcttcggagcagcgattcactcgggactgctgtggctggccctggtcggcatcgccaacagcgtcatctccgtgtactactacttcaacgtggtccggctgatgttcttcgccaaagcagccggcgtcgaagagccgctgccggagccgggcaccctccgcctcgtgacggttctgacggcagccgccacgatcctgatcggcgtctacccgcagcccttcatcgacctggcccgtgggtcgctgcagatgctggcgccgttctgagcacagcaccgccctccctgtagcgtagccccttgtgggcgttactgagttggcactgcagacgcccacaagnggctacgctacgagggaggtgaataggagccctctcccatgcccgaaaccaccttcgtcatgctcaagcccgacgccgtccagcgtcggctcgtcggcgaggttctctcccgactcgaggcgaaaggactgactctcgttggcctgaagctcatgcagcttccgcaagcacttgtggaagagcactaccgcgaccacaagggcaagcacttctacgagcccctgctccgcttcgtcacctccggtcctgtcgtagtcatggctgtgcgcggcttcaacgccattcagcgcgtgcgcgacctgatgggcgccaccagccccgcccaagcgcttcccggcaccatccgcggcgacttcgccctgagcaaccaaaagaacctgatccacggctccgacagccccgagagtgcccagcgagaactcggtctcttcttcgctccaggcgagatcctggagtacacccgctgcgaggcggagtggctgacaggagaaggcgaggcgtagccgccacgtaccgaggtcgccctcggtctccgcccgcagttgcccttcccccgttgtccgcaagtctccctgtccccaagtcccctcgtcccaccttcccccggaggcagcccatgcagaaagtcagcgagaaagacggcaagtaccgtggcggcgactggggcgtcaagtacatgctgcgcggcccgaagctggattggggcgtcctcctgctcaagcccggtcagcagatgggtggacacggtcaccgcgaggtcgaggagacgttctacttcgtcgagggcagcggcaagatcgtcgtcgacggcgtcgcccatgccgccgaagctggagatgcctttcggtgcgagccaccggagatccacgacctgctcaacgacggcgacgcagactgcaagatcgtcttcctcaagacgccctacctgcccgacgacaagatcgacgcgtgaccggagccggtgctcactgcggattcgtcggagcgccggccggctggcgcagccgttccagtgccgctcgcgcctcgtccgcccggacgccttcgggctcgactgcgaggaatcgctcgaaacaaggggcggcagcccctgccggctgcatcgcggccagtgtccacgccagtctatggagcgagtcggcgtgcttggggtcgagcgccagcgcggcgtagaatgagagcttcgcccgctccaggtcgccggtctgtttgtagaccagtccgagccgacagaagtcttccggcgttcgttgcggggcaaccggccggctggcggcggccgcccgccacggcagcacagccggctcctggaacggcccgtcgctcagcgcccggacggcgctctcgtcaaggtactccagcgggaacaggcacacaccgccgaacccgaactcgcgcgccgaggcgacatgctccaccaatcgctggggggagcccctcagcttgtacgccggcaggccggagaacagactgccatactcctgcgggcgcagggccagcagctctgccgcggcgcgggtgcggaacgcttcttcgtccactacgtacatcatcggacacaggaagtccaccagtcctgcccgcagccaggccgcaccgtcccggaacacgtggaactgatcaacttcttgcgttccggccgccgccgacaccttggtgcccggtcgcttggcccggacggcgtcgctgagttccttcgccaactgagtcacctgttgccgccgccaggcantccactcacggtacccggggcggtcgcgacagtcctggagctgtgcgagggtcggccggctctgcggcgcaaacgcaatcgggtccatgcccgactccgccttgaatgcagccctgcacgccgcgcaatagcagaaccgggcatcgtcgggatagcgaatgtagtccaattgcaccccgtccacaccggcgtagaggcagtcggtcaccagttgcacgaagtactggcgaacctcaggatgcgtgggacagagccagtctgaggaggtcttccccgc

SEQ ID NO: 1143 - DNA, 4000 bp, Escherichia coli
  misc_feature (1300)..(1300): n is a, c, g, or t
  misc_feature (1998)..(1999): n is a, c, g, or t
  misc_feature (2006)..(2006): n is a, c, g, or t
  misc_feature (3104)..(3104): n is a, c, g, or t
  misc_feature (3145)..(3145): n is a, c, g, or t
  misc_feature (3147)..(3147): n is a, c, g, or t
  misc_feature (3151)..(3151): n is a, c, g, or t
  misc_feature (3153)..(3153): n is a, c, g, or t
  misc_feature (3155)..(3155): n is a, c, g, or t
  misc_feature (3157)..(3157): n is a, c, g, or t
  misc_feature (3169)..(3169): n is a, c, g, or t
  misc_feature (3171)..(3171): n is a, c, g, or t
  misc_feature (3173)..(3183): n is a, c, g, or t
  misc_feature (3185)..(3186): n is a, c, g, or t
  misc_feature (3188)..(3189): n is a, c, g, or t
  misc_feature (3192)..(3192): n is a, c, g, or t
  misc_feature (3194)..(3196): n is a, c, g, or t
  misc_feature (3198)..(3201): n is a, c, g, or t
  misc_feature (3203)..(3208): n is a, c, g, or t
  misc_feature (3210)..(3211): n is a, c, g, or t
  misc_feature (3213)..(3223): n is a, c, g, or t
  misc_feature (3225)..(3229): n is a, c, g, or t
  misc_feature (3231)..(3232): n is a, c, g, or t
  misc_feature (3234)..(3235): n is a, c, g, or t
  misc_feature (3237)..(3241): n is a, c, g, or t
  misc_feature (3244)..(3246): n is a, c, g, or t
  misc_feature (3249)..(3253): n is a, c, g, or t
  misc_feature (3256)..(3259): n is a, c, g, or t
  misc_feature (3261)..(3262): n is a, c, g, or t
  misc_feature (3264)..(3268): n is a, c, g, or t
  misc_feature (3270)..(3271): n is a, c, g, or t
  misc_feature (3276)..(3281): n is a, c, g, or t
  misc_feature (3286)..(3287): n is a, c, g, or t
  misc_feature (3289)..(3289): n is a, c, g, or t
  misc_feature (3295)..(3296): n is a, c, g, or t
  misc_feature (3300)..(3303): n is a, c, g, or t
  misc_feature (3305)..(3310): n is a, c, g, or t
  misc_feature (3312)..(3318): n is a, c, g, or t
  misc_feature (3320)..(3322): n is a, c, g, or t
  misc_feature (3325)..(3325): n is a, c, g, or t
  misc_feature (3327)..(3328): n is a, c, g, or t
  misc_feature (3330)..(3334): n is a, c, g, or t
  misc_feature (3336)..(3336): n is a, c, g, or t
  misc_feature (3338)..(3342): n is a, c, g, or t
  misc_feature (3345)..(3346): n is a, c, g, or t
  misc_feature (3350)..(3350): n is a, c, g, or t
  misc_feature (3352)..(3365): n is a, c, g, or t
  misc_feature (3368)..(3372): n is a, c, g, or t
  misc_feature (3374)..(3374): n is a, c, g, or t
  misc_feature (3377)..(3379): n is a, c, g, or t
  misc_feature (3383)..(3383): n is a, c, g, or t
  misc_feature (3385)..(3388): n is a, c, g, or t
  misc_feature (3391)..(3392): n is a, c, g, or t
  misc_feature (3394)..(3395): n is a, c, g, or t
  misc_feature (3399)..(3403): n is a, c, g, or t
  misc_feature (3405)..(3406): n is a, c, g, or t
  misc_feature (3409)..(3411): n is a, c, g, or t
  misc_feature (3414)..(3416): n is a, c, g, or t
  misc_feature (3419)..(3420): n is a, c, g, or t
  misc_feature (3423)..(3427): n is a, c, g, or t
  misc_feature (3430)..(3434): n is a, c, g, or t
  misc_feature (3436)..(3437): n is a, c, g, or t
  misc_feature (3439)..(3441): n is a, c, g, or t
  misc_feature (3443)..(3444): n is a, c, g, or t
  misc_feature (3446)..(3446): n is a, c, g, or t
  misc_feature (3449)..(3449): n is a, c, g, or t
  misc_feature (3451)..(3452): n is a, c, g, or t
  misc_feature (3454)..(3455): n is a, c, g, or t
  misc_feature (3457)..(3457): n is a, c, g, or t
  misc_feature (3459)..(3460): n is a, c, g, or t
  misc_feature (3462)..(3462): n is a, c, g, or t
  misc_feature (3467)..(3469): n is a, c, g, or t
  misc_feature (3471)..(3472): n is a, c, g, or t
  misc_feature (3475)..(3477): n is a, c, g, or t
  misc_feature (3479)..(3480): n is a, c, g, or t
  misc_feature (3483)..(3483): n is a, c, g, or t
  misc_feature (3486)..(3487): n is a, c, g, or t
  misc_feature (3490)..(3490): n is a, c, g, or t
  misc_feature (3492)..(3499): n is a, c, g, or t
  misc_feature (3501)..(3504): n is a, c, g, or t
  misc_feature (3507)..(3509): n is a, c, g, or t
  misc_feature (3511)..(3513): n is a, c, g, or t
  misc_feature (3515)..(3518): n is a, c, g, or t
  misc_feature (3522)..(3524): n is a, c, g, or t
  misc_feature (3530)..(3530): n is a, c, g, or t
  misc_feature (3533)..(3533): n is a, c, g, or t
  misc_feature (3535)..(3536): n is a, c, g, or t
  misc_feature (3539)..(3539): n is a, c, g, or t
  misc_feature (3542)..(3542): n is a, c, g, or t
  misc_feature (3544)..(3544): n is a, c, g, or t
  misc_feature (3546)..(3546): n is a, c, g, or t
  misc_feature (3551)..(3552): n is a, c, g, or t
  misc_feature (3555)..(3556): n is a, c, g, or t
  misc_feature (3559)..(3560): n is a, c, g, or t
  misc_feature (3568)..(3571): n is a, c, g, or t
  misc_feature (3574)..(3574): n is a, c, g, or t
  misc_feature (3576)..(3577): n is a, c, g, or t
  misc_feature (3579)..(3579): n is a, c, g, or t
  misc_feature (3581)..(3583): n is a, c, g, or t
  misc_feature (3585)..(3588): n is a, c, g, or t
  misc_feature (3591)..(3596): n is a, c, g, or t
  misc_feature (3599)..(3599): n is a, c, g, or t
  misc_feature (3601)..(3602): n is a, c, g, or t
  misc_feature (3606)..(3608): n is a, c, g, or t
  misc_feature (3611)..(3611): n is a, c, g, or t
  misc_feature (3614)..(3614): n is a, c, g, or t
  misc_feature (3619)..(3620): n is a, c, g, or t
  misc_feature (3622)..(3623): n is a, c, g, or t
  misc_feature (3626)..(3626): n is a, c, g, or t
  misc_feature (3628)..(3628): n is a, c, g, or t
  misc_feature (3630)..(3630): n is a, c, g, or t
  misc_feature (3635)..(3635): n is a, c, g, or t
  misc_feature (3639)..(3640): n is a, c, g, or t
  misc_feature (3643)..(3644): n is a, c, g, or t
  misc_feature (3648)..(3648): n is a, c, g, or t
  misc_feature (3652)..(3655): n is a, c, g, or t
  misc_feature (3657)..(3658): n is a, c, g, or t
  misc_feature (3661)..(3663): n is a, c, g, or t
  misc_feature (3668)..(3672): n is a, c, g, or t
  misc_feature (3675)..(3677): n is a, c, g, or t
  misc_feature (3680)..(3680): n is a, c, g, or t
  misc_feature (3683)..(3685): n is a, c, g, or t
  misc_feature (3690)..(3692): n is a, c, g, or t
  misc_feature (3697)..(3698): n is a, c, g, or t
  misc_feature (3700)..(3701): n is a, c, g, or t
  misc_feature (3703)..(3704): n is a, c, g, or t
  misc_feature (3710)..(3710): n is a, c, g, or t
  misc_feature (3712)..(3712): n is a, c, g, or t
  misc_feature (3714)..(3714): n is a, c, g, or t
  misc_feature (3719)..(3721): n is a, c, g, or t
  misc_feature (3723)..(3724): n is a, c, g, or t
  misc_feature (3726)..(3726): n is a, c, g, or t
  misc_feature (3728)..(3728): n is a, c, g, or t
  misc_feature (3731)..(3733): n is a, c, g, or t
  misc_feature (3738)..(3739): n is a, c, g, or t
  misc_feature (3741)..(3743): n is a, c, g, or t
  misc_feature (3745)..(3748): n is a, c, g, or t
  misc_feature (3753)..(3754): n is a, c, g, or t
  misc_feature (3756)..(3756): n is a, c, g, or t
  misc_feature (3758)..(3759): n is a, c, g, or t
  misc_feature (3763)..(3764): n is a, c, g, or t
  misc_feature (3767)..(3767): n is a, c, g, or t
  misc_feature (3782)..(3782): n is a, c, g, or t
  misc_feature (3784)..(3784): n is a, c, g, or t
  misc_feature (3787)..(3788): n is a, c, g, or t
  misc_feature (3815)..(3815): n is a, c, g, or t
  misc_feature (3826)..(3826): n is a, c, g, or t
  misc_feature (3831)..(3831): n is a, c, g, or t
  misc_feature (3847)..(3847): n is a, c, g, or t
  misc_feature (3863)..(3863): n is a, c, g, or t
  misc_feature (3866)..(3866): n is a, c, g, or t
  misc_feature (3871)..(3872): n is a, c, g, or t
  misc_feature (3880)..(3880): n is a, c, g, or t
  misc_feature (3907)..(3908): n is a, c, g, or t
  misc_feature (3911)..(3912): n is a, c, g, or t
  misc_feature (3915)..(3915): n is a, c, g, or t
  misc_feature (3921)..(3921): n is a, c, g, or t
  misc_feature (3924)..(3924): n is a, c, g, or t
  misc_feature (3929)..(3929): n is a, c, g, or t
  misc_feature (3931)..(3932): n is a, c, g, or t
  misc_feature (3935)..(3935): n is a, c, g, or t
  misc_feature (3943)..(3944): n is a, c, g, or t
  misc_feature (3948)..(3948): n is a, c, g, or t
  misc_feature (3981)..(3981): n is a, c, g, or t
  misc_feature (3983)..(3984): n is a, c, g, or t
  misc_feature (3986)..(3986): n is a, c, g, or t
tcctcaccaggaagaagagtggaagaagcctttcgtaccgatggcattggtgtgtttcattttcaacacgtggagagatcacttcgaggatgaaaaatatgtgttcgatcacgattccaaattcgcgtacgtgttgcaattatactgccattcgatggcgtttgaaaacccgggcgcgcgagacgtgtgtcgcaagcacatcgagttggcgtttaaatttcctctggttaaaaaattcgcgtttcaaacgagaactttcgcggacaactttttgcaatcgttcagcaattggtgcaagtcagtcgacgcgagcgatcttaatagttccagagaggaggagatggagaaacaaatctcattcatgatgcgcgtgctgtcaaacgtaccggaaggatcaaagaacgcggggcccgaaagaccgggattttcaccgattcgcgagactctgatactgtcgatgcgcagatatctggaatacttggcgaaagatttaggggatttgaacgaaggattgatcgagtgcatgagggttttcaaagaccaccctgagctgatcccggggtacggtgtcaaccaattacatccgaaacactggaaaaagttccaaatgctcttcgagcgtatcatcgagcgtttggagtgcgtcgcgagacttctaacgcgatgtcgcggaattctcgattcgagagatttcatgttcgaacctggactgatggaccagctcgccgaaatcatcgcgtacatcggcaagcacttccacttgaaacccggcagagaaggcacggaaaatccatttggagtatttgtcaaacatttggcctctgaacttgattttcaacaagatgttaacggagtattatgcgttgacccgggaaggtttctgaatccagtggttgagattctctgtcgaatgacggaaagtcctttacctgaggaagaagagagacatgattattacgatctctacagtggatgtgacttcttaaacgttcgcaacctttttacaagggtgcacggggaggatgaagtcgacggtccgatccgagatcacggagatgataggcaacatttcaaatgcaaagtccgaggtgaatttttggacgcgctcgtgagacacgtgacgagaaaagatgtccagaacctttcgttttacttcaatggcgaatctctcaatttcggagggcattccaatttatttaagggcgttttcttctatatgtcgccgtcttggtttatggataaagacgtgctctccgaaggtacaataaccgaagcaacggtgcatccagaagacgtcatnaaggacggagcacaacaaaaaggatattacataaaaatgcatctcaactctgtccgatgcgaaaatcgcatcctccacgcggcggctgtgaaagcgttgcacatgaaattgaacgatttagaagctttagatggcaacaaaaacatcctcccggaaatgctcgatccaatcacgcactccatcatgctcgacccagtttttgtgggcaaaacggagaagacatcttgcgacttctcgacgctttccaggcactttcaaaaatccggcaagcgaaccgatccgttcaccggtttgcccgtcgtcggcgagattcgcaggaacgcgaagctgaaagaacgcataaaaaaactcttacagaaggaaaacgcgatgtcgatgataggcgacgtggatgtggacgtttttacccccgacgatgcgatgtcggttgagtgggcacgggtgaatgaagatagaaatacattcaacgcagatgatgatgttcgctcgattggggattggcgcaaaaattggcgcttaggaaattacgagtagtctggtacttcgttgatgatctctgtgatgttgttgtgtttttgttgttgcaaaagaataatggtaagtagtttactgttgcttgcactcctccttcgctttcgggtccaatcctttgatcttctccccgttttcgtcttcgtcgtcgtcgtcttcttcgtcgnngtcgtcntcttcttcgtcggagtcaccgtcgatggattcgccgtactcggcgtcttcctcgccttcttcctcgtcctcgtcttcgtcgtcttccaagtgcaaacctaagaaatgatccaccgcgtttggaaccaacgcggtggcgatcaaactcccgatcgcgtaatcgttctccatttgctcttgcaaatcctcgacctcttcttcggtcatgttttcttgttcgtcctcgtccgggacttccggcgggtaaaaaaacgtaaagaaggattcgcacggttccgttttcgtgattggtttctggttcttcgccccaggtttcggtttcttcctcaacacttttacggtcaagttcttccctggtttccaatcgatgtcgtcgcacacgatgtaattcaacaccgcgtcttcgctgtcgtcttccatgtggtatcgcttctcgatcgtttggttggtaaaaaacgcattctctttgaagtaaaatcgcaaataaaacccaaccatttcgtcgccatcttcgtcttcgccttccaatttccccgtttgcacgtccaccaaagcgctcaaacacgcctcgtctctctccgaaatctcctcggccaaatcttcgatgttcttcatcgcgactaaccaaaaatccggcacgccgctcggactcgcgtcgtccttcggcaacgcctcgatttccttcttcaaatcctcgtcgcaatccgagtactctttctcacccgtgacgatttctttcctcgagttatataacggcgcgtataacttctcgtatttctcttccaattgccttcgctcctcggaatacttctcgaacaactcgtctcgttcggtttgtaagacttgcaaagagaataatctcgcacgaattttcgggtgcaattcctccacgtacccgctcgataaaccaaccaaaccgtccagtttcgcttgcaacgcgccgatcagacccccgtcgccgtggagttgcgataaagctttcacgatctcttgtttgtccaccgattcgcctccttctttcttgttcgctaagcgcatcttttccaacgctttttcgatttctttttgctgctgattttgctgctgctcttttgaaganccagaagacatttttcaaaaagcgttctctctctctctctntntctntntntntgtgtgtgtgtntntnnnnnnnnnnnannannaanannngnnnnannnnnngnnannnnnnnnnnntnnnnntnntnntnnnnntgnnntannnnngannnntnngnnnnntnntcttnnnnnnttttnnanaatttnnaaannnnannnnnntnnnnnnntnnnatntnngnnnnntnannnnnagnntgtntnnnnnnnnnnnnnntgnnnnntntannnttgngnnnncanntnntatnnnnnannatnnnatnnngtnnaannnnnctnnnnnanntnnnanncntangnntnntntnncntgtgnnnanncannngnnctntcnnatnannnnnnnnannnnaannntnnncnnnnacannncattcntangnnttntcntncntgtgnntanncanntgtttttnnnnatnannanannnannnnacnnnnnntcncnnacannncantcntacgnntnntcntncntgtgnatanncanntgtntttnnnnannatnnnagtgnnnnnaannnttntcnnncacannncattnntnngnnttttcntncntgtgnnnanncntntgnnntttcnnannntnnnntcgannananntctnntcncacacatcgcattcntncgnnctctctttcgtgtgaatacgcatgtgnctttggaaacnaccanattcacgaaaacgctnctcacacacatcgcanttntacgnnctctcgtncgtgtgaatacgcatatgtctcgccannttnnatngtgttncanacacntnntcncaaacatnncacncgtgttgccctctctttctcttccctcctttcntnntngtcgtcttgtcttt

SEQ ID NO: 1144 - DNA, 4000 bp, Escherichia coli
  misc_feature (1954)..(1954): n is a, c, g, or t
  misc_feature (1987)..(1987): n is a, c, g, or t
  misc_feature (3332)..(3332): n is a, c, g, or t
  misc_feature (3334)..(3334): n is a, c, g, or t
  misc_feature (3352)..(3352): n is a, c, g, or t
agtggtagtgatggtgcaaattcaataagtttgtcatttggaacgacgattacggtgtctgcgtgttctcttaatttcttaagtccaccatctgcatttgtacggcgagcttcaccttctgcactaaatggtgttgttacaatagcaacagttaatgcatttttgctagcaatttcagctacaactggggccgaacctgttcctgttccaccacccattcctgccgtaatgaaaaccatatcttggtctttaactatattttcaatttcttcttcatcttcacgagcagatttttctccttgttgaggaacacttccggcaccacggccaccacatgtatctttaccaattagaagttttgttgtggctttactactttgaaggtcctgagcatctgtattaagtgcaactaactctgcaccttcaataccttcatctgctatacggtttatcgtattacatccaccgccaccgcaaccaatgacactaacacgagtacgaagcgattttgcaattctatcaatttcttcatcagacattcctttgtcacctgatgattcttcacgtatttcattctctaattcttcatctacctccatattttgttcatctgattcttcatcttgttcgattgcatcttctacaattgattccatgtttgtcttattttgtttacatagtaattatacttacgcctttttcggtagtttggattgaaaatatatacatgattatgtatattttgaatatttttggaaaaatctcttatatttttaagaaaaaatccaaaggtttaagtacataactctattactaagatattgaacacaaaacatgtttgacatagcacaaaatttacttgttcgagatgtcgatatgagggtctttggagtacttatggtggcgattctagtcaatgaaattggcagcgcgtacgagattattggaatcatggctgtaggtattacatgggctttcttgaccacaccagattcaaaagaaattattaattctgctgctctaaaattcgaagagaaaatgacacccctcaaagaatctgagaaatggaatctttacggacggcctctcacatatctttcatttgtgcttttcatcatgtttcttgctcttgcgtaaattcttgcgatttttcttgtaatttataacgtcgtcatctaaattttcgtataaaatttagtactatcttatagttataatcataaaactattttaataaatatatctctgtgtaaattttagaataaaaaatcaaatgaaccaaaattaaaaattttctatattagattaaatacgaaaatttgatgatatcacaatttcgtcatagatacgttacttgtttctgttacaggattttttgaaatttcatatgatacatctgcattttcaatcatatcatttttgtgactcacaacaattacttgaggtacatcccaactttttattgtatcaataacaccctgtagattcgaaacgtgatttgtatctaagaatgttgttggttcatcaagtataaatggtggtaatttatcagcattaccatttctttcaacaagtaatctatatacaccagcacgaattgctagactaacaattgtttcttcaccaccagataactcttgaggtttgattttaaccccatcccccgtaattagatttatcgaataattttcatcaatatctaatcgctggtatacctgactatggtacacagatttgaatacttcatttgcatacttgtttaataacccaatattttcttgacgaagttgtgtctttacgtttttgtacgtggcgattacactctcagattcaacctctttatttgccgcatcaacttttttctcttcaagttcacgacatctatcttctatggatttaatctgttttaatatctgttttatctcagctaattcatctcgtatatcatctaatntattctccttttttgtcttaagattatctaatntatctagtttatccttatgttcattaatctctttctcaagtttttgtttatccttatgttcattaatctctttctcaagttcgttctttttttgttcagcatctaaccgttggtttcgtgtctctttctttaatgctttgttctgttcaatttttgaacgtaggttattaatttcttgattaagttcatctacagacgagaacatatcttttatatcttttaactcatcaacatctgatttgtattcatctaatttatcttgtttattcttaattttattgttaacgcggtcttttttagtattatttttaactattccatctttttcttcttggatagatagttttgtttcttcgatatctgttttaatctgagagagttgattctgtttatcttccaaacgctgttcaatttgacttaccgtatcttcaatccgttttcgttcggaattcaaatcaataattgaatcaatatattgattagctgaatcgaataagtcttgttgcttactcatagcatctgatttttctttcatatcatttcgttcagatgtaatttcatctaagtgttcttttatatcttcacttactatattatgttctgtatcacaaattgtacatacatttgaatcaactaattcttgatacattttccattctgattgtgtttcaccaacagatatgtatacatcttttgaacgttctaatagattttcacgaccttcagggatatgggtatcacggagttcttttgcgcttgcatttttaggtaggtcaatattatcacaaatatcatctaatttttcttcgtaattttcaatatctgtatttatttcttctagtttttcttcagattcttgcttttcattctgtatatctttaattaagttttctaatgactgtttttcggatattttatttgatttctgtttttcaagtgtttcaattgattccttgtgttgattaatcgtattttcaatagtttttaattctcctgtttggagtgaagatatttctgtattcagagaattatatttttctctaacagattctagtttattttgtataatatcttcatcagcatcaatatctaattcatcacacttttcttcaatagaattaagtaaagcatcacgttctatagatattgcgtctttttcttgttcagcattcttttgtttctgctgccaatcttcttgtttttgttttaactcattatattctgaccgggcttcagataatttattagatagcttttcatatgattctaattcatcttctatgttgcttttttctttttcttttttactgatactatcttcaactttttctttatcttgaatttntnttttcttttttgatttcnattctgataaattagattctaacgtagacttatcatcatacgaattcaattgtcgctctttttcttcaagaaggtcaccaaactttcttacttgagaacctatctctcttcttgcttcatgcattctttcaatataatcatctaacttacttaatccaagtaatccatcgatgatttcttttcgtttttcatcatttgcatcaaccatgcgcgtgatatcgccttgttgaacgtaaacactatttacaaatgattctggacccaaaccaattatctcttgtacggctgaatctacagctttaacaccttcaacaggttcatttattgaatcgcctgttaatgtgcatgaggtagttgaaccacgacgttcaccatcttctttctcactaacagaaatgacccaatcaacagtgtaattatcatcacccacactaaatgtaagtgaaatttttccagaattctctgtcctacgaacaagtgaatctagtgtaaggtctgtatcaatatagtcaagaacattactaagatataatccgccaaatatactaccgagtaatgaacttttaccagaaccgttatccccatgtatgagcatgagtccatcatcaaagtctactgtctctttaccatagcttctaatattttcga

SEQ ID NO: 1145 - DNA, 4000 bp, Escherichia coli
  misc_feature (771)..(771): n is a, c, g, or t
  misc_feature (1940)..(1940): n is a, c, g, or t
  misc_feature (1991)..(1991): n is a, c, g, or t
gggcggtggcggccatcgcttcgccgccggcttcagttccgacgacaccgtcgacacggtcgtggggcggatcgagcacaagcttccgattgcgcgctgaccggccgttcatggccacgcacggcgtgatcgtcgtcgacaagcccgccggctggacgtcgcacgacgtcgtggcgaagatccgcaagatctatcgccagaggcgggtcgggcacgccgggacgctcgatcccgacgcgaccggggtgctcctcgtcgggctgggacgcgcgacgcggctgttgcgtttcctccaggacaccggcaagggataccgcgccacaatcgtgttcggcgtgtcgaccacgaccctcgacgcgtcgggggaggtcgtcgaccggcgaccgatgccgatcgaccaggcggacatcgaggcggtcgtgccggcgttcctcggtgagatcgagcaactcccgccgatggtgtcggcggtgaaggtcggcggacggcgactccacgagctggcgcggcgaggcgaggaggtcgagcgcgcaccccgccgcgtccacgtcgaccgcatcgatgtcgaagccttcgagcccggtccgtacccggctgccactgtcctggtcgagtgcagcagcggcacgtacgtgcggtcgttggccgcggacatcggcgggcgcctcggaggtgtcgcgcacctcggtgagctccgccgcttgcatatcggctcgttcacgctcgacgaggcccgtactctcgccgacatcgaagcggaccccgacaagnccgtgctgccacccgtcgcggccatgcgcgacctcgagcaggtcagtatcgacgccgagcaggcccgcgcagtcgcgcacggtgtcacgttcccggccgcggtgttcgccggcgcgaacgccgggcccggtccgttcgcggtcgtcgggcccgacggcgagctgctcgccgtgtacgagcgccgccgcgccgcggtgaaaccggcggtggtcctcgcgccggtcgaggcgacctgaccggtgcgcatcgtcaccggcagcgacgaggcggccctcgccacggtgcagaccgacggcgcagtcgtcacgatcggcgcgtacgacggcgtgcacctcggccaccaggccgtgttgcgcctcgtgcgcgagctcgcggacgcccgggggttcgaggcggggctggtcaccttcgaccgccaccccgcggaggtggtccgccctgagtccgcgccacgcctgctgacgacgctcgagcagcggctcgagctcctcgacgcgacgggcgacctcgatctgtgctgggtgctcaccttcgatgaggcgcgcagcaaggaaccggcggaggacttcgtgcgcgaggtgctcgtcgacgggatcggggctcgattggtcgtcgtgggagccgatttccacttcggccaccgccgcgggggcaacgtgccgttgctcgagcgcatgggcgcagagctcggtttcgaggtgctcggcctcggcctggtcgccgtcgagggagacgcgacagcggtgccgtactcgtcgaccaggatccgcgagctcctgggcaaaggcgacgtcgccgaagcggcgcgcctcctgggccggccgcacgaagtcaggggagtcgtggagcgaggcgaccagcgcggcgccgagcatctcggcatgccgaccgccaacctcaccgtccccgaacgcatctgcctgcccgccgacggcgtgtacgcggggaccttcgtcaccgaggacgaggtcgagcgtcccgcggcgatctcggtcgggacccgtccgaccttctacgaggacggcgacgtcctggtcgaggcgtacgtgctcgacttcgacggcgacctctacgggcagcgggtgaaggtgcgtttccgggagtgggtccgtggccaagagcggttcgactccaccgaggcgctcgtcgagcagatgaacgccgacgtngaagcgacccgccgcatcctggccgtctgaagcgccgtggtaacctgagantgcgtcggcaatgtgctggcgcgctcccacatcagcacgaagaccgaagctgctgcatgcccgacaccacggccacgatcgccgagcaccgcctccacgagaccgacaccggctcgccggaggtgcaggtggcgctgctcaccgagcggatcaaccacctcacggagcacttgaaggtccacgcaaaggaccatcactcgcgccggggactgctcgtgctcgtcggccgccggcgccggttgctcgactacctccggcgtaacgacgtcgagcggtaccgagcgctcatcgcgaagctcggcctccgccgctagcgcgggacacgaaggacgaagaagacgagcaagggcagtcggttgtcagtcgccaccgcccgggcccgacccggaccgtgaccactgagaaccggatgccctctccaatagcgcatcaggagagaggttccatgcctgccacacaggcggatggcgcgattcgcgtcgagggcgtcgtcaacgacgccggcaaggccatgtcgttcgagacggggcgtctggccgccatggccgacggcgccgccgtcgtcaagatcggcgacaccaccgtgctcaccacggtcgtcaccgacaagccgcgggaaggaatcgacttcttcccgctgacggtggacgtcgaagagcgcatgtacgccgcgggcaagatcccggggtcgttcttccgccgggagggacgtcccggagagcaggcgatcctcacctgccggctcacggaccggcccctacggccgtcgttccccgaggggttccgcaacgaggtgcaggtcatctcgacgatcctcggcgccgacctcgagaacccgcacgacatcgcgtcgatcaacggcgcgtcggcggcgttgacggtctcgggcatcccgttcaacggcccgatcggcgccgtgcggttggctcaccaccacggcgagtggatcgcgcacccgacgtaccaggagggtgacgagtcgacgttcgagctcgtcgtcgccggcaggcggaccgatgccggcgagatcgcgatcatgatggtcgaggccggcggcaccgaagcgaccagcgagctgtacgagcacggcgcgccgaagatcaccgaagagctcatcgccgacggcctcgaggcgtcgaagcgctggatcggcgcgtcgatcgacctgcagctcgagctgcgcaaggccttcgaggaagcgcgcggcccgatcgagacgatctcgtacgaggtccacagggactacgacgacgacgtctacgcggcggtcgaggaggccgcccgcggcgacgtcgaagaggcgatgaagatcgccgacaagacggctcgcgaggagcgcacgcacgaactcgaggcccaggtggtcgagaagctcgcgggcacgcccgagtcgcccgggaagttcgtcgatcgcgccggtcagatcaaaaaggcgttccggtcgctgcagaaggacgtcgtgcgcaagcgcatcgtcaacgagggcgcgcgcatcgacgggcgcggcccttccgacattcgtccgctctcggccgaggtcggcgtgatctccaccgcgcacggctccgggttgttccaacggggcgagacgcaggtgctgagcgtcgcgacgctcgccatgccccgcatggagcagatgctcgacaccatcggcgtcgacgagcgtaagcgctacatgcaccactacaacttcccgccgttctcgacgggagaggtcggacgggtcggatcgccgaagcggcgtgagatcggtcacggtgcgctcgccgagcgggcgctcatccccgttctgccgagccaggagcagtggccatacacgatgcgggtcgtctccgacgtcctgtcgtcgaacggctcgacgtcgatggcatccgtctgcgggtcgacgctgtcgctgatggacgccggcgtgccgatcaagggctccgtcgccggcatcgccatgggcctcgtgtacgcggacggcaagtacacgactctgaccgacatcctcggcgccgaggacgcgt

SEQ ID NO: 1146 - DNA, 4000 bp, Escherichia coli
  misc_feature (871)..(871): n is a, c, g, or t
  misc_feature (895)..(895): n is a, c, g, or t
  misc_feature (925)..(925): n is a, c, g, or t
  misc_feature (1635)..(1635): n is a, c, g, or t
  misc_feature (2259)..(2259): n is a, c, g, or t
  misc_feature (2905)..(2905): n is a, c, g, or t
  misc_feature (3265)..(3265): n is a, c, g, or t
tgattttgatatcaattttagtttctaaagattgtttttcaaaattattattcaaagattggtaaacaggattattctttacaccgcaggacgttgttaaaaataatattgataatactaataaaattctaatcatttaaactctttttgatatttttttatcattttattaacattaaacggtgatgttccgccataagatttttttgaattcaccgaattctttagatcaaacatttttagaacatctctttctacgcttttttcaactttttttatcgttaaaaaatctaactcatcaagtgtttgattatttttttcagcaatatttacaagagttgcagattttttatgagcatctctaaaagacattccttttttaactaaataatcagcaaagtctgttgcggtagtaaaacctaattttgcagcggcaagcattttagctttatttggcttcatcccttctaccaattcggcagcaagctgaatatttaataaaagagtatcgtatgagtcaaatacactttctttatcttcttgcatgtctttaaagtaggcaaggggtaagcctttcatagtagtcaacatcgaagacagttgtccaaatattcttccagttttgcctctaattaattctgcagaatctggattctttttttgaggcatgattgaagatcccgttaacaaactgtcttcaagagtgattaaatttacaagatctgaattccaaataataatttcttcagctagtcttgaaagatgcattgagcacaaagaggctataaataagaattcaatagcaaaatctctatcagaaactgaatcaatagagttgtcagtaggttttttaaatccaagtttttttgangtaaaatttctatcaatattatangaagtcccagcaagagctgcagatcctaangggttttcattaatattttctaagaaatttttaattctttttttatctcttttgaacatttctacatacgccaataaataatgagaaaacagcaccggctgtgcatttttaaggtgcgtaaatccaggcatgattacatcaatattttttttagctttatttaaaaaacttttgatgagtagagttaaatttttatcaataatgtttgtagatttttttacccaaagtttaaaatctgttaccacctgatcatttcttgatcttgctgtatgaagaaatccagcgtgatctcctataatttcaaataatcttttttcgatatttaggtgaatatcttcatgctcttttttaaattcaaatttattattttgtatttctattttaatcttttttaatccaaaaatgatttttttagcagtttcacttttaataattttctgttttgatagcatttcacaatgagcaatagatgcatcaatatcttcattgaatagtcttttatctatatcaatcgaagaattaattgattgtaaaagtttagatgtaggttttttaactcttgtaccccacactttatttttattttctttagtcatatttttaataatatataaaactaaactatgttttttttacgtaattcttttaaatatttagtttatttaactagtttattattatttattactaatcactctttatcacaaccnattaaagatcttcccttcaagaacatagttgtgcatgaggttccaaaagaaattattggtgaagaatttctagatttctctggtaaaaaattaaaatttaataaatttgatcatcaaataaatctaattaatttttggtctacctggtgtgtgccttgcaaagaagaaatgccttcaattgataaattagttgatgttatgggcaaagataaagtaaaaatatttgcaattgatcttgaaaaaataaataagaaaaaaactgataaattttttactgatttaaaaattaagaatttttctacttattatgatccagactacgttttggctaacaaaattggattaagaggcctgccaacaactttaattgtgaaccgcaatgggaaagaaatagcaagagttataggatctatcgattttgctgatgaaaaatttattagttggttaaggaatctttaaatctattttttatgaaaataaaatagagtcattaaaataactatagcgacaaattgagcaacaactcttaactgcattagcttgtttccttttcttttgtcatcaatattgctgccaaggaaaaatgattttaatccacgtataagaattacggtaacaacaatnaatgcaactattgcaataatacgacttaaatctgacattaagaaataattatcataaaataatataaattatataaaataaaatattaatgaaattaattgaagaaaatatatttttaaaggcaacttctttgccacaaactgctaccaaggcaaattatttaacagtgttttgtcatggatatggtgcggatggaaaagatttaattaatattggaaattattggcaaagatttttgccagatttttattttacctcacctaatgcaccaaatatttgctcagtaaacccaggaggatttgaatggtttgatctaatgagtcatgacgttaaaaaaattaatttagaactgcaaaactcaatattaaaattaacagattttattaatgcgaaactcaaagaattaaatttagactattcaaagttgtttttagtaggctttagtcaaggaacgatgatgtcattacattatgcgctaacaaattctaataaagttgcaggagtagttggttattcaggaaagatttatgatcccgttcttttagagcagaatattaaatctaaaccaccgatttttttaatgcacggagatgatgacagtgttgttccgttagaagaaatgatggaggcaaaaaattttttactncaaaataaatttaatttaaaaactaaaatttttaaaggttgtggccattctattccagtcgaaggattaagtttaggtctagaatttattaacatcaataaaaaataaatgtttttgattacaaataaaattgatatattaattatatattaaatgattattacagaatctaattcagtccctttggataagtgtccagctcttgtattgaacgccgactatagacctttgagttattaccctttatccttatggtgttggcaagatgttgtccgtgatgtttttttagatagagtgacaatagtttcagaatatgatcgggaaattagaagtccttctttttctatgagattaccaagngtaatatcattaaagaaatacataaaaccttcggagtttcctaattttacaagatttaatgtttttttaagagatagattttcttgtcagtattgtggggataataaaaatttaacttttgatcatgtaattccaagatctagaggggggattacttgttgggagaatgtggtgtctgcttgttgtacatgtaacgtaagaaaaggcggcaaacttccccaagtcagtgggatgattccaaaaacaaaaccatctcgaccaacagtggaagagttacatgataatggaaaattttttccaccaaattttttacatcagagctggttagattatttatattgggacgttaagcttgaaagctaatatttttttgaaatagctatagctaatttagaagtattttttattacgatgtctaaaatagaatataaaccatcattgttagcgcctaaactttcagcagtatttttatgctcaagctcctcttctctaaatttaataaatttttcttttagttctttttcttctttataatctttagataaaatatctatctgctccccataatgaccaccaataacctcttcaacagctgacgtacataaagctgtagcttttttcccaagtaatgccgtaccaaaaccaagagctgtaccaagtacatcccacaaaggaagtaaagctgtaggtctaactttcctttcaataatttgattttcaaaaaactttaaatgt

SEQ ID NO: 1147 - DNA, 4000 bp, Escherichia coli
  misc_feature (1483)..(1483): n is a, c, g, or t
  misc_feature (1503)..(1503): n is a, c, g, or t
  misc_feature (1509)..(1509): n is a, c, g, or t
  misc_feature (1986)..(1986): n is a, c, g, or t
tttatttgattttgatgaaaataataaaaaagaatatttttataaattaaatgaacgctttttattctaagttatattaaagtttatccaattatattttttttgatggatttttattcaatcaaaaaactcttaatactttttttttaaaaaaaagaaaaattattaaaattattatttatttattattgatattaaatatgtaattatttatttaatattaaatatatatttacttagttagttagttatttatttagttatttatttatttatttattatatattatatataatatattataaaaattttttatttaaaaattagaaatttaaaattttcaatttttttaaaattttaaccctttaaaattttataaaaatattaaaaatatttatattttatttgaaatttgaaatttgaaattaaaataaaattaagaaaagaaatgagtgacagtacaaaaaatttatcaaaagctaaattaaagaaaaaggcttccagacttcaaaaaaaagaaaaaagtaaattacaactaaaaaaagaagaaaataaacatcttcttgaacatatatatcatcttggaaaacaaacatgtgtatcccaagccatattaaatattattaaaacggcatgtttagagcatatttcaaacgattcgttcgaaactatattacaaaaaattaaaactcacttttataatagagaatatgatgctatatttagtgaaccaaaataccttccaatatataccactgcctatgccccatctagagcattagcttattatgaattatttacttcacatactgaacttaagaatatattagctactcccaacgcttatatttattgcatgggttctggggctggaagtgaagttgtcggtttaacttgtgctaatttagcttcttctaccgatgaaagtcagggtttagaaattcattgtcaagattatgctgactataatgaagttcaagcaagtttagtaaaaactatgcaaaaacaatggaatattcaggagagtagaattaaatattcaacttcagttgctgatgtattaaaaaatgataaaatagatggtatgaccgttgacgaacatatttcaaaagcaactcttgtcacagcaatgtttcttatgaacgaattatttacaatgtcaaaaaaggaaacagttcagctcattactagattagtaaaaaatttaccaaaaggttcctactttttattagtggattccgctggttctttctcaaatttagatgttaataatagtgaaggaaatactaaaaaaacaattatgatttatcaacttatcgatatgattaaaagttttgatatattaattaaagatgatgcagtatggtacagattaccaaatgaaaaagttcaaccccttcattatccaacaaaattaaataatatgagatatttcttaagattataccaaaaattataattttctataaaaaaaaaaatcanaaaaaaaaatcataaaaaanaataanaataaataaattactccatgagaaaaaaaataaaaaaaaaaaaacaattaagaaatatttaataatattacaattacatatttataaattttttttataaaatattgaattgatataccaagtaaaaagatatgaatgttttttttttatttaatttttaaaattataccaatgcaattaataaataataaaaatattatttttaaaacaaaacaaaaaaaatttttttttttaatatttataaataaaattatttctaaattatttttaaaagtcactttcttaagaaattattaaaaaataaaaataaaaataaatgataaataaataatgacaaataaataatgataaataaataaatgactaattaattaattaattaattaatagttatgtatttttaataaaatacaaaaatatataaatataaatatttatatttatatatatatatttatatttatatattgttaaaanaaatataaaaaaaaaaaaaaaaataagataataatttaattatttatagaatttgttaaaaatatatccatatttttatattttatttttagtttttaatcgagaagcctcggtaggtttggtataggatggtgctgatttaattataccttttgatctaacttttttcttgggttttaatgttgtttttttcattgtatttcgaactaattttaaattaataataaaattaaaataataataataataataataatatataaatatgaattattttaataataatatatgaatataaattattataataataaaattttaatattttttttaaaatatatattatatatattatgtatcgttttttattaatatatatatattacctttatgttttaatggatcaagagttttcgatctttgagaaattctttttttcaaattctctatcatattttgtatatttttcatttcttcatcttcttgtaatgtatttataacatattcttcatcattttcgtttaaaatttcattttcactttcttgttcttcctcattacattcttgattatggtcattgaaattttcttcctcatatcggatttcaatatattcttcattttcatgcttttttgaattaatataataaagatcttcttcttcttcttcttcttcttcaccttctggaatgtaagatatcggaataaaatctttcatatctacgatttctttattttttttattttctatatcaggttttgatttcttttcatttatatttaatttcttttcagtatgatttatattattattactactgctttttctatctttttcaatttcatgattacttctactttttgaaagaatacctgaactatttcttttaatcttaagattatgattaacattacttcttcctatactattggaaattgaagcattactcacttttttagcgttagatttggaattagattctaatgacattttgttattattaaaatgagtatcttttggatttaaatttttccatttatattcggtggttacatgatgcttcaccccatctttgatattagttttttcattctctttgttttcttcattattattatttttattattattatggtttttatgaatacttttactactaatcttattgttattactatcatttttattattgtttatattattattattaatattattaatattattatttaaaattttgttattatttatattattaataataatattattattatcatctatatcattattagaattatttgttttattattattagtagtagtaatatcaatattattaatattatcaaaattattattattattattattattattattattattattattattgatattattaatattattaatattattattattattatatgccaaatagttattagcatatagatctcttaaactactagttttatttttgctatttttatatgttataatagacgaatttatattatcataataataattatttgaaatattaatgttgtttttattttcattaatattattattgttaatatcattattattatcatcattattattattattattattattttcattattataattaatattgctatttatattttctgaattcatattgtcattgttattattacaatatatattcaattcagggttaagtttattaatttcttttgaaagggttagattattattatctaattttttatgattgggtataaataatgtatctttttgacgagtaaacttatcattttgtttactgtttgatgtattttttgaatctttttccattaaattatttgattctatattatgaagtatttcatttaatatattttctttatattcttttaatttcggatttaatatttcgttaaatttactttctgttatataattagaattgctaaaagtattgttgatagaaacagcaatttttcgtatcatt

SEQ ID NO: 1148 - DNA, 4000 bp, Escherichia coli
  misc_feature (116)..(116): n is a, c, g, or t
  misc_feature (499)..(499): n is a, c, g, or t
  misc_feature (789)..(789): n is a, c, g, or t
  misc_feature (1163)..(1163): n is a, c, g, or t
  misc_feature (1568)..(1568): n is a, c, g, or t
  misc_feature (2529)..(2529): n is a, c, g, or t
  misc_feature (2838)..(2838): n is a, c, g, or t
  misc_feature (2862)..(2862): n is a, c, g, or t
  misc_feature (3516)..(3516): n is a, c, g, or t
  misc_feature (3564)..(3564): n is a, c, g, or t
  misc_feature (3933)..(3933): n is a, c, g, or t
cagcgcacggtgtgaccctgacggctgcgaatacggtggtatggtgggggccaaccagttcactagaaacgtacgcacaggctaacgctcgggtacacagatcaggtcaagaccanaagtgtaccgtggttcagttgcaaggatcgtccatagaaaaacgtgtttatgcaatgctggacaataaaatcaatatccatacaaaaatgattgatttatacaatgatatacttgcgtaggacagccaagtatattatattcaacagttcggcaagttaaggagatgtaaatgggcagcgaaacggctatacctttagacaagttggtcaagacctatataaaaatacgggatcgacggtctgaattgaaggcggaattcgacaaagaggacagcattcttgtagaacaattggacgcggtgaagggcgctctgttggaacactgcaaagaacatgacgttagcagcgtcaagacttcagaaggtctattctatcggacggtnaaacaaacgtattggactagcgactgggatcaaatgcacaagtttattcttgagcacggagaacctgcactgttggacaagcgcctaaaccagaagaacatgagagaatttcttgagtcgaatcctgacttgttgccgaaaggtcttaactcaaactccacatacactatatccgttagaaggaagtaaccatgacacccgcattagtttcaattagagaagtcgctcaacactttatggtatctgaacgcttgatccgtaactggatgaagcaagggcgtataccgaanaatacttacatccatatagggcagacctacaggtacgacttgaatgccgtatcgcaagcactacttagtgacttgaacgaagatgcacctgacacaacatgggatgaagtaagtccagaagatgatcgggtcgaagtccctgacttggatacagacgaagattattaatggaaactaacgttaaaagaattggtattaaggacaagaagtttggtggtatacccaccgagggtctagattctatcgagtgcatcatcattggcgttgcttatacgtctaggatgtattataaaaatgagtacgaccccgataaaatagttgcaccgacttgttggtctaacgataccgaataccctgctttagacgtaccaganacccaacggcagtctggacgttgcttagattgtgttcaaaatattagaggttctgggaaaggctctgggcgcgcatgtcgttttgtgcagcgtttggcagtcgttttaaaggatgatctggaaacagtttatcagttacaactacccccgacttctatatttggggacgcggtaaaaggggaaatgcccctacgtgcttatgcacggtaccttgaggcgcgtgagacgcctttcatcgctgtcatatcgaagatttatttcgacgaaggtagcgatacaccaaaactcttcttcagaccgatacgtccgttagaagagcaggagctagagactgtcaaagagatgcaggatcacgaagatactattaacgcaatgactaaaattgttgcgccggtagaagatcgnagtgtttccccattcgatgaggttgacggttttaaattaaatgactaaatgtttggagaaacatatatgaactaccttataaaaggtgttgaagtactatacccacgtatcaataagacctaccgttttgataatacggagaacagaagtgtgccgtgtgacccattcgacgacggtgcttcttactcgatgcagtttaagatggacgataaacaggctaaagaattgatgggcgctatggcggctgcatacgctgagaagcgtgaggctaaatggcctgagaagatccccatgcctttcaagaagactgatgacggtatgtttattggtaaagccacgttgaaaggggcgtacggtaaagatgctaccagcaagcctaagcaatatgacgcagggaacaaggagttagatgaagattttgccttgactaccggcagtgttggtaacattgcggtcgttcttttcccatacaacatgcgagaagcaggggtatcactacggttacgagcagtgcaagtcaccaagtacgtaccgctacaagcgtcatccccgtttgatgcagtggaaggcttcaccgttggcggagaggtaagtccttttgcagacgttacccagtctgccccggtgacagccgacgaagttgatgtagtagaagttgatgtagaagatgtcgaagaacctgtaaaagagccgaagaaagtggcgaaggtgaagtcggcagcaccgaaagaagcggcagatttgagtgcacttgttgatggatgggacgactagtcctaattactttgggtatcttcgagaagaagcccattcctaaaacaatacccacggctagactagtcgaagagggcgtaataatgcccctgccgtggtgtcgctcggatctacgcttatggatacaacaacatttttaaaggaggttctatcgagcagtgggctatattgtatttttgcgtccaanagttccaaagataaaagaagccaacagttttatggttccatagaccaattagtcagtgccgccaaagacctagatgataacgactacgatgtttattttgctttagctacgttcaacgaaggtaagtcgcgtaaagtcgataacgtaaaacatcttaagtccttcttcctagatcttgattgcggcccatccaaagaattcgcttctcagcaagaagccatgcaagcactaaagcagttttgtaagacttattcgttaccacgtcccaccatcattaactctggtaggggtgtgcatgtgtactggccnctcaaagaggcagtgtgcctagangactggctacctgtagcagaacgcctcaaggctctttgcgcccgaagtaatttccctgccgaccctgcggttacatcggatgctgcacgggtcttgcgtgtaccccaaacacacaactacaagcctgacactcctgtagcagtgggctttatagggccaacggtttcggcgttagttgacttcgacaagttctcagacctcgttggtggagacttgataccagttcctaacaaaagaatagaagcccctagtgcgacgatgctcgctgcgctgggaaaccaagagtataagttcaagcacatcttacagaaatcaaacgaaggcgcagggtgcgtccagatctataacgccctaaagaaccagaacggcgtctcagaacctatatggcgtgggatgctatcgattcttaaagcgtgcagtgatggtagtcgggagaaggcacacaagatatccagtgggtacgaaggttataaccccgaagaaacggatgctaagtgggataacttgacggctgataaacggtacacctgtaacaagtttgaggaagagaaccctgaagcatgtttggcttgccctaatcggggtaagttacgtagcccattgcacgttgggaagacgctacgagaagctaccgaagaagataacgtagtacangtccctgccttagacctacccaatgcacctgttaacacgtacgtaatnccgaaatacccgttcccatacgtgcgtggtgcaagtggtggtgtgtacgtacgcaacaagaacgcagacggggacatagaagagaagcagatttaccacaacgatgtctatgtggtgcagcgcatagtagatgtggaaataggggaagcggtggtaatgcgcttgcacctaccgaaagacggtgttagggagtttacagtacccctgacagcggtaacgtcaaaagaggagtttcgcaaacagatgtcaatgcggggtgttgcaatacccaacatagatgacttgatgcggtacgtaacagtatggattaacgaactacaggcaaccgaaatggcagataaagcacatagacagtttggatggacagangatacagcatccacttttattctgggcaaccagaaaatacgtaaagacacgattgaattcaacccac

SEQ ID NO: 1149 - DNA, 4000 bp, Escherichia coli
  misc_feature (1077)..(1077): n is a, c, g, or t
  misc_feature (1976)..(1976): n is a, c, g, or t
  misc_feature (1980)..(1980): n is a, c, g, or t
  misc_feature (1989)..(1989): n is a, c, g, or t
  misc_feature (2877)..(2877): n is a, c, g, or t
  misc_feature (2895)..(2895): n is a, c, g, or t
  misc_feature (2898)..(2898): n is a, c, g, or t
  misc_feature (2900)..(2901): n is a, c, g, or t
  misc_feature (2904)..(2906): n is a, c, g, or t
  misc_feature (2951)..(2951): n is a, c, g, or t
  misc_feature (3143)..(3144): n is a, c, g, or t
  misc_feature (3146)..(3147): n is a, c, g, or t
  misc_feature (3149)..(3152): n is a, c, g, or t
  misc_feature (3154)..(3154): n is a, c, g, or t
  misc_feature (3157)..(3158): n is a, c, g, or t
  misc_feature (3161)..(3162): n is a, c, g, or t
  misc_feature (3166)..(3167): n is a, c, g, or t
  misc_feature (3169)..(3171): n is a, c, g, or t
  misc_feature (3173)..(3177): n is a, c, g, or t
  misc_feature (3181)..(3181): n is a, c, g, or t
  misc_feature (3183)..(3183): n is a, c, g, or t
  misc_feature (3185)..(3188): n is a, c, g, or t
  misc_feature (3190)..(3191): n is a, c, g, or t
  misc_feature (3193)..(3200): n is a, c, g, or t
  misc_feature (3202)..(3202): n is a, c, g, or t
  misc_feature (3205)..(3205): n is a, c, g, or t
  misc_feature (3207)..(3217): n is a, c, g, or t
  misc_feature (3219)..(3219): n is a, c, g, or t
  misc_feature (3221)..(3225): n is a, c, g, or t
  misc_feature (3227)..(3229): n is a, c, g, or t
  misc_feature (3231)..(3233): n is a, c, g, or t
  misc_feature (3235)..(3238): n is a, c, g, or t
  misc_feature (3240)..(3245): n is a, c, g, or t
  misc_feature (3247)..(3256): n is a, c, g, or t
  misc_feature (3258)..(3258): n is a, c, g, or t
  misc_feature (3260)..(3265): n is a, c, g, or t
  misc_feature (3267)..(3275): n is a, c, g, or t
  misc_feature (3278)..(3283): n is a, c, g, or t
  misc_feature (3285)..(3289): n is a, c, g, or t
  misc_feature (3291)..(3297): n is a, c, g, or t
  misc_feature (3299)..(3300): n is a, c, g, or t
  misc_feature (3304)..(3304): n is a, c, g, or t
  misc_feature (3308)..(3308): n is a, c, g, or t
  misc_feature (3310)..(3311): n is a, c, g, or t
  misc_feature (3315)..(3316): n is a, c, g, or t
  misc_feature (3318)..(3324): n is a, c, g, or t
  misc_feature (3326)..(3326): n is a, c, g, or t
  misc_feature (3328)..(3336): n is a, c, g, or t
  misc_feature (3338)..(3341): n is a, c, g, or t
  misc_feature (3343)..(3344): n is a, c, g, or t
  misc_feature (3346)..(3346): n is a, c, g, or t
  misc_feature (3348)..(3348): n is a, c, g, or t
  misc_feature (3350)..(3352): n is a, c, g, or t
  misc_feature (3354)..(3354): n is a, c, g, or t
  misc_feature (3356)..(3356): n is a, c, g, or t
  misc_feature (3358)..(3359): n is a, c, g, or t
  misc_feature (3363)..(3368): n is a, c, g, or t
  misc_feature (3371)..(3378): n is a, c, g, or t
  misc_feature (3380)..(3380): n is a, c, g, or t
  misc_feature (3382)..(3383): n is a, c, g, or t
  misc_feature (3386)..(3386): n is a, c, g, or t
  misc_feature (3389)..(3389): n is a, c, g, or t
  misc_feature (3392)..(3393): n is a, c, g, or t
  misc_feature (3395)..(3395): n is a, c, g, or t
  misc_feature (3397)..(3407): n is a, c, g, or t
  misc_feature (3409)..(3411): n is a, c, g, or t
  misc_feature (3413)..(3413): n is a, c, g, or t
  misc_feature (3418)..(3424): n is a, c, g, or t
  misc_feature (3429)..(3432): n is a, c, g, or t
  misc_feature (3435)..(3435): n is a, c, g, or t
  misc_feature (3438)..(3438): n is a, c, g, or t
  misc_feature (3442)..(3451): n is a, c, g, or t
  misc_feature (3453)..(3454): n is a, c, g, or t
  misc_feature (3456)..(3462): n is a, c, g, or t
  misc_feature (3464)..(3464): n is a, c, g, or t
  misc_feature (3466)..(3470): n is a, c, g, or t
  misc_feature (3472)..(3477): n is a, c, g, or t
  misc_feature (3479)..(3484): n is a, c, g, or t
  misc_feature (3488)..(3489): n is a, c, g, or t
  misc_feature (3491)..(3497): n is a, c, g, or t
  misc_feature (3499)..(3505): n is a, c, g, or t
  misc_feature (3508)..(3510): n is a, c, g, or t
  misc_feature (3512)..(3512): n is a, c, g, or t
  misc_feature (3514)..(3514): n is a, c, g, or t
  misc_feature (3519)..(3523): n is a, c, g, or t
  misc_feature (3526)..(3528): n is a, c, g, or t
  misc_feature (3530)..(3535): n is a, c, g, or t
  misc_feature (3539)..(3546): n is a, c, g, or t
  misc_feature (3548)..(3549): n is a, c, g, or t
  misc_feature (3551)..(3552): n is a, c, g, or t
  misc_feature (3554)..(3554): n is a, c, g, or t
  misc_feature (3557)..(3557): n is a, c, g, or t
  misc_feature (3559)..(3559): n is a, c, g, or t
  misc_feature (3562)..(3564): n is a, c, g, or t
  misc_feature (3567)..(3570): n is a, c, g, or t
  misc_feature (3572)..(3573): n is a, c, g, or t
  misc_feature (3578)..(3582): n is a, c, g, or t
  misc_feature (3584)..(3584): n is a, c, g, or t
  misc_feature (3586)..(3593): n is a, c, g, or t
  misc_feature (3595)..(3596): n is a, c, g, or t
  misc_feature (3598)..(3599): n is a, c, g, or t
  misc_feature (3601)..(3607): n is a, c, g, or t
  misc_feature (3609)..(3609): n is a, c, g, or t
  misc_feature (3611)..(3613): n is a, c, g, or t
  misc_feature (3615)..(3623): n is a, c, g, or t
  misc_feature (3625)..(3635): n is a, c, g, or t
  misc_feature (3638)..(3638): n is a, c, g, or t
  misc_feature (3642)..(3642): n is a, c, g, or t
  misc_feature (3644)..(3644): n is a, c, g, or t
  misc_feature (3646)..(3647): n is a, c, g, or t
  misc_feature (3649)..(3655): n is a, c, g, or t
  misc_feature (3657)..(3672): n is a, c, g, or t
  misc_feature (3675)..(3681): n is a, c, g, or t
  misc_feature (3683)..(3684): n is a, c, g, or t
  misc_feature (3687)..(3688): n is a, c, g, or t
  misc_feature (3691)..(3692): n is a, c, g, or t
  misc_feature (3694)..(3695): n is a, c, g, or t
  misc_feature (3698)..(3698): n is a, c, g, or t
  misc_feature (3703)..(3703): n is a, c, g, or t
  misc_feature (3706)..(3706): n is a, c, g, or t
  misc_feature (3710)..(3710): n is a, c, g, or t
  misc_feature (3714)..(3714): n is a, c, g, or t
  misc_feature (3717)..(3718): n is a, c, g, or t
  misc_feature (3722)..(3724): n is a, c, g, or t
  misc_feature (3726)..(3727): n is a, c, g, or t
  misc_feature (3729)..(3730): n is a, c, g, or t
  misc_feature (3732)..(3732): n is a, c, g, or t
  misc_feature (3734)..(3735): n is a, c, g, or t
  misc_feature (3737)..(3742): n is a, c, g, or t
  misc_feature (3744)..(3745): n is a, c, g, or t
  misc_feature (3748)..(3752): n is a, c, g, or t
  misc_feature (3754)..(3756): n is a, c, g, or t
  misc_feature (3758)..(3760): n is a, c, g, or t
  misc_feature (3765)..(3767): n is a, c, g, or t
  misc_feature (3769)..(3775): n is a, c, g, or t
  misc_feature (3777)..(3781): n is a, c, g, or t
  misc_feature (3783)..(3783): n is a, c, g, or t
  misc_feature (3786)..(3789): n is a, c, g, or t
  misc_feature (3791)..(3794): n is a, c, g, or t
  misc_feature (3797)..(3797): n is a, c, g, or t
  misc_feature (3799)..(3801): n is a, c, g, or t
  misc_feature (3803)..(3804): n is a, c, g, or t
  misc_feature (3806)..(3814): n is a, c, g, or t
  misc_feature (3816)..(3816): n is a, c, g, or t
  misc_feature (3818)..(3819): n is a, c, g, or t
  misc_feature (3821)..(3821): n is a, c, g, or t
  misc_feature (3823)..(3826): n is a, c, g, or t
  misc_feature (3829)..(3832): n is a, c, g, or t
  misc_feature (3835)..(3839): n is a, c, g, or t
  misc_feature (3842)..(3842): n is a, c, g, or t
  misc_feature (3844)..(3846): n is a, c, g, or t
  misc_feature (3848)..(3851): n is a, c, g, or t
  misc_feature (3853)..(3854): n is a, c, g, or t
  misc_feature (3856)..(3860): n is a, c, g, or t
  misc_feature (3862)..(3863): n is a, c, g, or t
  misc_feature (3865)..(3865): n is a, c, g, or t
  misc_feature (3867)..(3869): n is a, c, g, or t
  misc_feature (3871)..(3873): n is a, c, g, or t
  misc_feature (3875)..(3878): n is a, c, g, or t
  misc_feature (3880)..(3887): n is a, c, g, or t
  misc_feature (3889)..(3896): n is a, c, g, or t
  misc_feature (3898)..(3900): n is a, c, g, or t
  misc_feature (3902)..(3908): n is a, c, g, or t
  misc_feature (3910)..(3914): n is a, c, g, or t
  misc_feature (3917)..(3918): n is a, c, g, or t
  misc_feature (3920)..(3923): n is a, c, g, or t
  misc_feature (3925)..(3926): n is a, c, g, or t
  misc_feature (3928)..(3928): n is a, c, g, or t
  misc_feature (3931)..(3935): n is a, c, g, or t
  misc_feature (3937)..(3939): n is a, c, g, or t
  misc_feature (3941)..(3943): n is a, c, g, or t
  misc_feature (3945)..(3947): n is a, c, g, or t
  misc_feature (3949)..(3953): n is a, c, g, or t
  misc_feature (3955)..(3956): n is a, c, g, or t
  misc_feature (3958)..(3960): n is a, c, g, or t
  misc_feature (3963)..(3965): n is a, c, g, or t
  misc_feature (3968)..(3972): n is a, c, g, or t
  misc_feature (3974)..(3977): n is a, c, g, or t
  misc_feature (3980)..(3983): n is a, c, g, or t
  misc_feature (3985)..(3989): n is a, c, g, or t
  misc_feature (3991)..(3995): n is a, c, g, or t
  misc_feature (3997)..(3997): n is a, c, g, or t
  misc_feature (3999)..(3999): n is a, c, g, or t
tcctccgcgggcacggccgcggctgccccgccgcccgtgtcggtcaccccgggcaccaaagtcctggtcgcggcgacgtactcgatgtcctccccgggggtggtatccttgagcaccacgaaaccgcgtttgagatccgccgccgccgggacgaacctgctgccctcgtcgaaccgcacgtacctctcctgcgcgggcgtgaccctggcggggttggacagttcctccttggtgggctccggcttcttcttctccttctcgtcctcctcctcatccttagcatcgccgtcgacgtccatcccatccgcctcgccctccttcttctcgccgtccacgtccatgccgtccgtatccttgccctcctccctagccttcttggccgccttggccttggccttggcggtggtggagaggacagccttgacgagcttacccttgtccttcttgtcgtcgaggttgatcgccgccgggtaggcgaatagggacggcttgcagtgcgacgtcaccgagcacatgggcatcttgagctgggagtcgaggccgatgaacgcggtgggaacaaaggtgagggagatgaagtaggagagcgggtaccagtaccagtactgcgtgaacaccagcatggagagcacggcggtcatgcgggggtagcccgacttggccctcagcccgatggtcacgttcctgccgccggcgtcgatgatgccctgcgccatgatggcgcccatcttggtcatcgtcacctcgcgctcatcctggatgtggaccatcagcctcttgcggaagggcgcgagggactgctcggactgctcgaccatcaccatggccatggcgatgagcgcaccctgctgcacaaagtcaaccgcgtcggtgagcatgggctcgaggagcgccacagcctccttcatgccggtgcccgagcacgagatgcccaccgccatcgccgcaccgtagcgcacgtgggggttgtaagactccgcgaggagcttcacgaccctcgggcactggctcggggtggagcacagcacgaaacccagggacatcaccgcggctcttcgaacgtcgtccgacacgtcngacacggcgacgtgcagtagtcggcggatgcccgcgttgttacccgtggccacgtaggcggatgcggtggcgaggcaggcgccgtagcggatgatggggtcgctgtcacggaccatctgctcgatgagtggctcagcctcctcctcgcggccgtaggtggtgagcgccaggccgacggagcacccgcggatgatcttttcgtgctgcgtcttgtggcagtagttgagaatctgctgctgcttgtccacggcgccagagcccgcgaggacaaggcccatgccgacgccggcaccctcgcccgcgacggcaccgtccgtgcggaggatgcggaacatgtcggtgaacacctcctcgttgcccgtgccgagcgcggccaggccgaggccgaggcaggcgccgtgctggatcacctcgttgttgctggacctcgacgactccagcaaaaagggcaggataccctcgccgtggttggcgtggatcagaccgagcgcgtacaacgccccgccctcggtgtaggggctcgggcgcgcacccccggcgccgccctcgcgtggaaggaacggtcccatcagcgtgcggccctcgttgagctggccgcggtgaatgacgcccatgcccgccgtcgccgagaacctcgcccagttcgtcgccctgctgagccagtcgaggttctccctgaggaaggtgtccacggtggtacccgcgtgcatcagcgcgttggacagcacggtcgcggagtggcacacggagttcctggactcaaccgcggctcgcatctgcttgagcaagaggagatccgccgcgttgtgcgagtacagaaactcgaggtgaaggttcacggggagctcgccggagagcaccgagcggagcagcgcgatgggcttcttcttctcctcggngctntccttcttntcctcggtgtcgtccttcttctcctcggtgccgtcctgcatgtcggcgtcgccgtcctccaccttgggggtatctcccggggtatcctccggcgcgagcttggacgcgacttcggagagaaacttctgaatctcattttcgcagagggagaaggcgatctggtacgccaggagctgatcgtcctcctcgccctcgacgagccgggtgaggatcgccgcgacgccgtccgcgtcgtccaggaacatgaggcactggcacacgttcaggtagttgttctccacgtggtcgctctcgtacatgcgcaccagcaccgtgagcacctcgcggcggaactcgcgggaggtgacgagggtctggcacaccttggtggcgtagttgagcgcctccgccacgtcggtgctcgtgtggatggcctcctcgagcttgtccagccgcttggtctcgagcgcgacgccgatggcctgatggatctggccgtcgtcgaagcaccgctggaacatccgctcgacgatggacacgagccgcgcgtcgatcgcctgctcgctcgtgggcttctgcctttgctcgatgtactcgtcgatcgccttggctgttgggagaaatgggatcgggggaggggcgcgagggtcagatcggttgttcacttttttcttcccaaaactcgcacgggaaaaggcggtcaagggatgaacaacgggtaggttggatctgggggcgggggacgcgcgcgtaccgagcagggtcttgacgaaatcgttggactcggtgacgtcgaacatgccaccggcgcagagcgcgtagttgagcgcatcgttgagctcgccgaggtggtagaagacctgtcgaggggtgggaggggcgggtcaggtttcgttttagatctggctnggtgtgggcacacggtanccntnnaannntcgcggtggacggggcgcgacgtgtcgacggcgtgggaggtgganggcgcaccttggaggccaaaagtgccgcgagctcgcgctgggcgaagaactcgtcctcgtacatcgcctcgatgaccgagatggatcccgccacctcggcccagtgcgtgtcgatgaccttgttcagcgatcgcagcgcggtggtctggagctgcacctcggtctcctcgagcatcgagatgaggccagccnngnngnnnngnccnnggnngggnncnnngnnnnngggncngnnnncnncnnnnnnnnanccntnnnnnnnnnnncnannnnntnnntnnncnnnncnnnnnncnnnnnnnnnntncnnnnnngnnnnnnnnnccnnnnnngnnnnncnnnnnnntnncccntttncnntttnnannnnnnngncnnnnnnnnncnnnncnntngncnnnantngnngggnnnnnnggnnnnnnnnancnnccnttnaannangnnnnnnnnnnncnnnanggggnnnnnnnggggnnnnggnttncccnnnnnnnnnngnngnnnnnnnangnnnnnannnnnncnnnnnncccnncnnnnnnncnnnnnnnccnnncngncccgnnnnnccnnncnnnnnnaaannnnnnnnanntnntnccnanccnnnccnnnncnnccccnnnnntncnnnnnnnngnncnngnnnnnnncntnnngnnnnnnnnncnnnnnnnnnnnaancccnangnngnnnnnnngnnnnnnnnnnnnnnnnaannnnnnncnnccnnccnncnnccnacccnccncccncccnccnncccnnncnntnngnanngnnnnnncnnccnnnnnannnannnccccnnnannnnnnncnnnnntnccnnnncnnnnccnannntnncnnnnnnnnncnannancnnnnggnnnnggnnnnnccngnnntnnnngnngnnnnngnngncnnngnnntnnnngnnnnnnnncnnnnnnnncnnntnnnnnnncnnnnnttnngnnnngnngnttnnnnngnnntnnngnnngnnnnngnngnnnttnnnggnnnnngnnnnggnnnngnnnnngnnnnntngnt

SEQ ID NO: 1150 - DNA, 4000 bp, Escherichia coli
  misc_feature (3)..(3): n is a, c, g, or t
  misc_feature (5)..(8): n is a, c, g, or t
  misc_feature (10)..(13): n is a, c, g, or t
  misc_feature (15)..(16): n is a, c, g, or t
  misc_feature (19)..(20): n is a, c, g, or t
  misc_feature (22)..(27): n is a, c, g, or t
  misc_feature (29)..(41): n is a, c, g, or t
  misc_feature (43)..(50): n is a, c, g, or t
  misc_feature (52)..(52): n is a, c, g, or t
  misc_feature (54)..(58): n is a, c, g, or t
  misc_feature (60)..(75): n is a, c, g, or t
  misc_feature (78)..(87): n is a, c, g, or t
  misc_feature (91)..(92): n is a, c, g, or t
  misc_feature (94)..(97): n is a, c, g, or t
  misc_feature (100)..(100): n is a, c, g, or t
  misc_feature (102)..(105): n is a, c, g, or t
  misc_feature (107)..(107): n is a, c, g, or t
  misc_feature (109)..(111): n is a, c, g, or t
  misc_feature (113)..(113): n is a, c, g, or t
  misc_feature (115)..(119): n is a, c, g, or t
  misc_feature (121)..(124): n is a, c, g, or t
  misc_feature (126)..(127): n is a, c, g, or t
  misc_feature (130)..(132): n is a, c, g, or t
  misc_feature (134)..(134): n is a, c, g, or t
  misc_feature (137)..(139): n is a, c, g, or t
  misc_feature (141)..(147): n is a, c, g, or t
  misc_feature (149)..(152): n is a, c, g, or t
  misc_feature (156)..(156): n is a, c, g, or t
  misc_feature (158)..(161): n is a, c, g, or t
  misc_feature (163)..(171): n is a, c, g, or t
  misc_feature (174)..(175): n is a, c, g, or t
  misc_feature (177)..(180): n is a, c, g, or t
  misc_feature (182)..(184): n is a, c, g, or t
  misc_feature (188)..(189): n is a, c, g, or t
  misc_feature (192)..(198): n is a, c, g, or t
  misc_feature (200)..(201): n is a, c, g, or t
  misc_feature (203)..(207): n is a, c, g, or t
  misc_feature (209)..(210): n is a, c, g, or t
  misc_feature (212)..(214): n is a, c, g, or t
  misc_feature (216)..(219): n is a, c, g, or t
  misc_feature (224)..(225): n is a, c, g, or t
  misc_feature (227)..(235): n is a, c, g, or t
  misc_feature (237)..(244): n is a, c, g, or t
  misc_feature (248)..(264): n is a, c, g, or t
  misc_feature (266)..(266): n is a, c, g, or t
  misc_feature (268)..(273): n is a, c, g, or t
  misc_feature (276)..(278): n is a, c, g, or t
  misc_feature (281)..(281): n is a, c, g, or t
  misc_feature (283)..(286): n is a, c, g, or t
  misc_feature (289)..(289): n is a, c, g, or t
  misc_feature (291)..(299): n is a, c, g, or t
  misc_feature (301)..(301): n is a, c, g, or t
  misc_feature (303)..(309): n is a, c, g, or t
  misc_feature (311)..(311): n is a, c, g, or t
  misc_feature (313)..(319): n is a, c, g, or t
  misc_feature (321)..(322): n is a, c, g, or t
  misc_feature (325)..(327): n is a, c, g, or t
  misc_feature (329)..(329): n is a, c, g, or t
  misc_feature (331)..(331): n is a, c, g, or t
  misc_feature (338)..(338): n is a, c, g, or t
  misc_feature (341)..(342): n is a, c, g, or t
  misc_feature (344)..(344): n is a, c, g, or t
  misc_feature (347)..(347): n is a, c, g, or t
  misc_feature (349)..(350): n is a, c, g, or t
  misc_feature (353)..(353): n is a, c, g, or t
  misc_feature (355)..(355): n is a, c, g, or t
  misc_feature (359)..(359): n is a, c, g, or t
  misc_feature (362)..(362): n is a, c, g, or t
  misc_feature (365)..(365): n is a, c, g, or t
  misc_feature (1989)..(1989): n is a, c, g, or t
ganannnncnnnngnnganncnnnnnngnnnnnnnnnnnnntnnnnnnnnanannnnnannnnnnnnnnnnnnnnggnnnnnnnnnngggnnannnnagngnnnnanannncncnnnnnannnngnngtnnncnccnnnannnnnnncnnnngcgngnnnngnnnnnnnnntgnnannnngnnntttnngannnnnnntnngnnnnnanngnnnannnngcgcnnannnnnnnnnannnnnnnncccnnnnnnnnnnnnnnnnncncnnnnnnaannntanannnnttntnnnnnnnnntntnnnnnnnanannnnnnnannttnnngntntttgtcnaanngntgngnnagngntttnggngcngcgaggcgccaggcggcttcgagggcgcggcgcagcgtaggccttctggctcctttcagtcgcacgttcgtgcagcctcgacgtccccaagctcccccgcaagggttgaacaccttgggctgggctttgacgaacgtttcctgctccaccggcgtgagcttgaccatgccccagccattctcggggtagccaagagtggcaaaaatctttccggtcacgcgaaaatccggatggttcatgtgggcgcgctcctcggtttcggggaagctcaaggccagcctgcgaaagtctttaggggtcatggggcagcctccgtttcgagaagtatcggaccacaaaagcagcgggagaaaaaagatcttgacaggggcctgaaaagactgtatattcggtaacaacagaaacaacggacgcaacgaaagcgatggcaacgacgccagccacggatagaaaaaatgagtgaacccgcaaaaaacacgctagccccggtggcccagaagttcattttgcattggggagagatgggcacgaggtggggcatcaaccgcaccgtcgcgcaagtgcatgcgctgctgtttttgtcgccgcatccgctgcccgccgacgagatttccgagacgttggcagtggcgcggtcgaatgtgagcaccagcctgcgcgagttgcaggggtggagaattgtgcgcgtggtgcacgtgctgggagaccggcgcgaccatttcgagtcgatcaaggacgtttgggaaattttccggattgtttcggaagaacgcaagcggcgcgagatcgatccaacgctgaatgtgctggcggaatgtgtgcgcgagatcaagtccagtccgcagagtgatgcgtatacgcgcgagcggctggaaagcatgctggaatttttaacagcgatgacggggctgttcgaggagatcattcgtatgccgacgggcgcgttgaagggcgttgtgaaactacgcggcaaggtgattacgctgctcgggagtgaaaagaagaaggcggcgggttgaaagttaaaagctccgagagaaaaaggaaacggataacgcggagacgcagaggacgcggagattcgcagagaagagccgagcgcgataaggaaccgcaggtggatcatgatttcgctggtgagtgaatacacggacgggaagggacggcacgcacgaggttggctgttttttgatgcggagtgcaagttctgcacgcgcatcgcgcgatggctggccccgattctggagaagcgcgggatggcgctggcgccgctgcaggatccgcgcgtgggagcgctgctgggattggcacgcgaggacttaatgcgcgaaatgcaatttcttctgagtgacggaagccgcttcggcggagcggatgcggcggtggcgctggcgcgcgagatttggtggggccggccattggtatggatctcgaaaattcccgggatgatggaaattctgcgcaaaggataccactgggttgcggcgagccggagttgcgcggctgtctcttgtccggcgaatgagccctcgccccgagtctagacctggcaaggagggattctgccaatgactcctacaacagtttttctgtgcgatgtgggaattgcggcgttcttgctgcnggaatcgttatttacatcaagaagtatctgagaaccttgctcatcgaactctgcggcacaaccgaacgcgcgaacttttggttggcattctccaatgtcacgcttgttctcgtcccgttgatcttcgctctcgactacaagcccgagttcgggccagacaagaccgcgatcttcgagatcgccactcaactgaagtacgcactaattgggttcgtcgtcacgctgggctcccttgcgcttatccttttccgatttattccacgtgataagggcaatctcgcaagcggcctgcagcggtgaaggtgaacagcgcatcgatcggaacgtaaggaggtcttgtgacgtttcgttttgccgatttgtggcgatgggacggaaaagtcggccgcgcggaatacgcggcggttggtctcattggtgtggcgatcaaacacaacctcgaccggctgatcgcgttggcgtttttcgcgaacaacctaaattttctaaattactgggcgcctctgggaaaggcggcgcggctcgatcacctctcgaatcgcgaagcgaaatttctcgccacgctgctgctgttctccgttcctttcttatgggtgggcgtggcgatgaccgtgaagcggttgcgcgatgcgggacagccggtgtggctggtggtgctctttttctttccagtcatcaatgtgttgttcttcctggcgctttgcgcgttgccgccgcgcgagcgcgccgaggagtccgaaggcgcaccatggcccggaccgaccggactgagcggaatgattccgagcagtccgctcggtagcgcggtgctttcgatttttctcacgtccgtcctggggctggtgtttctgacgctggggacgttggtgatcggggcgtacggctgggggctgttcgtcgctttgccattttgtttgggaatgttttccgtgctgctttacagctaccattcgccgcgagactggtggacatgcctgaacgtcgcgctgctgccggtcggaatcttgggtgtcacactgattctggtggctatggagggcgtgatctgcgtgttgatggccgcgccgtttgcgctgggactagcggcgctgggcgggatgctgggctacacgattcaggcgcaccactggcgcccgaagcagacgccggcgatgttgtcgatcgtgattttgctgattccagcgtcgtttggaatcgagcacgccgcggcgctgcagccgccgacgtctgaggtgcggacggcgatcgaggtgaacgcgccgccggagaaagtttggaatcaggtcgtggcgttcgcagagataccgccgccgaaagaattgctgtttcgcgcggggattgcgtatccaattcgcgcggagatttccgggcatggagtcggcgcggtgcggcattgcgttttttcgaccgggccatttgtcgagccgatcgaagtgtgggacgagccgcggctgctgaagtttggcgtgacggcgaatccggctccactggatgagttgacgccgtacggtcatatcgatccgctgcacttgcatggctacttcgtttccgagaaggggcagtttttgctgacggcgttgcccgggggccgaacgcgggtcgaaggcacgacgtggtatcagcacacgatgtggccggcggcgtactggcatttgtggtcggattacatcattcatcggattcatctgcgcgtgctggagcacattcgcgaaggggtcgaagaaaagcctcgcgcctcccaaccgggccgggatcaattccggcctgagctatagcctcgggaattcctatcgcgtggagagcgcgtcacgcagggcgaagaaagcgggtttgggattgagatcggcgtcgaagggtaacgggcgctgggggaggccctctttgcggggacggaagccttggagccaagtatcccggtcggaaaggcaccaggttaggacggctttcacagattcatggcgaagaatgttttcgagatagcttcggtagacttctgcgaccaggcggtcgc

SEQ ID NO: 1151 - DNA, 4000 bp, Escherichia coli
  misc_feature (18)..(18): n is a, c, g, or t
  misc_feature (25)..(25): n is a, c, g, or t
  misc_feature (185)..(185): n is a, c, g, or t
  misc_feature (196)..(196): n is a, c, g, or t
  misc_feature (262)..(262): n is a, c, g, or t
  misc_feature (565)..(565): n is a, c, g, or t
  misc_feature (567)..(567): n is a, c, g, or t
  misc_feature (1200)..(1200): n is a, c, g, or t
  misc_feature (1240)..(1241): n is a, c, g, or t
  misc_feature (1250)..(1250): n is a, c, g, or t
  misc_feature (1295)..(1295): n is a, c, g, or t
  misc_feature (1319)..(1319): n is a, c, g, or t
  misc_feature (1346)..(1346): n is a, c, g, or t
  misc_feature (1972)..(1972): n is a, c, g, or t
  misc_feature (1987)..(1987): n is a, c, g, or t
  misc_feature (1992)..(1992): n is a, c, g, or t
  misc_feature (2051)..(2051): n is a, c, g, or t
  misc_feature (2073)..(2073): n is a, c, g, or t
  misc_feature (2123)..(2123): n is a, c, g, or t
  misc_feature (2170)..(2170): n is a, c, g, or t
  misc_feature (2270)..(2270): n is a, c, g, or t
  misc_feature (2573)..(2573): n is a, c, g, or t
  misc_feature (2771)..(2771): n is a, c, g, or t
  misc_feature (2798)..(2799): n is a, c, g, or t
  misc_feature (2803)..(2803): n is a, c, g, or t
  misc_feature (2806)..(2806): n is a, c, g, or t
  misc_feature (2817)..(2817): n is a, c, g, or t
  misc_feature (2858)..(2858): n is a, c, g, or t
  misc_feature (2864)..(2864): n is a, c, g, or t
  misc_feature (2984)..(2984): n is a, c, g, or t
  misc_feature (3124)..(3124): n is a, c, g, or t
  misc_feature (3151)..(3151): n is a, c, g, or t
  misc_feature (3218)..(3218): n is a, c, g, or t
  misc_feature (3388)..(3388): n is a, c, g, or t
  misc_feature (3390)..(3390): n is a, c, g, or t
  misc_feature (3393)..(3396): n is a, c, g, or t
  misc_feature (3398)..(3399): n is a, c, g, or t
  misc_feature (3401)..(3402): n is a, c, g, or t
  misc_feature (3405)..(3408): n is a, c, g, or t
  misc_feature (3411)..(3411): n is a, c, g, or t
  misc_feature (3413)..(3413): n is a, c, g, or t
  misc_feature (3417)..(3418): n is a, c, g, or t
  misc_feature (3420)..(3423): n is a, c, g, or t
  misc_feature (3426)..(3434): n is a, c, g, or t
  misc_feature (3436)..(3438): n is a, c, g, or t
  misc_feature (3440)..(3440): n is a, c, g, or t
  misc_feature (3442)..(3445): n is a, c, g, or t
  misc_feature (3447)..(3452): n is a, c, g, or t
  misc_feature (3457)..(3459): n is a, c, g, or t
  misc_feature (3461)..(3464): n is a, c, g, or t
  misc_feature (3467)..(3468): n is a, c, g, or t
  misc_feature (3473)..(3473): n is a, c, g, or t
  misc_feature (3475)..(3475): n is a, c, g, or t
  misc_feature (3480)..(3484): n is a, c, g, or t
  misc_feature (3487)..(3487): n is a, c, g, or t
  misc_feature (3489)..(3490): n is a, c, g, or t
  misc_feature (3492)..(3492): n is a, c, g, or t
  misc_feature (3495)..(3500): n is a, c, g, or t
  misc_feature (3503)..(3503): n is a, c, g, or t
  misc_feature (3505)..(3512): n is a, c, g, or t
  misc_feature (3514)..(3520): n is a, c, g, or t
  misc_feature (3522)..(3522): n is a, c, g, or t
  misc_feature (3524)..(3529): n is a, c, g, or t
  misc_feature (3532)..(3532): n is a, c, g, or t
  misc_feature (3534)..(3541): n is a, c, g, or t
  misc_feature (3547)..(3547): n is a, c, g, or t
  misc_feature (3549)..(3552): n is a, c, g, or t
  misc_feature (3554)..(3554): n is a, c, g, or t
  misc_feature (3556)..(3562): n is a, c, g, or t
  misc_feature (3564)..(3567): n is a, c, g, or t
  misc_feature (3569)..(3575): n is a, c, g, or t
  misc_feature (3578)..(3580): n is a, c, g, or t
  misc_feature (3582)..(3583): n is a, c, g, or t
  misc_feature (3585)..(3585): n is a, c, g, or t
  misc_feature (3587)..(3589): n is a, c, g, or t
  misc_feature (3591)..(3596): n is a, c, g, or t
  misc_feature (3599)..(3599): n is a, c, g, or t
  misc_feature (3601)..(3602): n is a, c, g, or t
  misc_feature (3604)..(3604): n is a, c, g, or t
  misc_feature (3606)..(3610): n is a, c, g, or t
  misc_feature (3612)..(3615): n is a, c, g, or t
  misc_feature (3617)..(3622): n is a, c, g, or t
  misc_feature (3624)..(3626): n is a, c, g, or t
  misc_feature (3630)..(3631): n is a, c, g, or t
  misc_feature (3633)..(3638): n is a, c, g, or t
  misc_feature (3640)..(3640): n is a, c, g, or t
  misc_feature (3642)..(3643): n is a, c, g, or t
  misc_feature (3645)..(3645): n is a, c, g, or t
  misc_feature (3648)..(3649): n is a, c, g, or t
  misc_feature (3651)..(3651): n is a, c, g, or t
  misc_feature (3653)..(3653): n is a, c, g, or t
  misc_feature (3659)..(3661): n is a, c, g, or t
  misc_feature (3663)..(3663): n is a, c, g, or t
  misc_feature (3665)..(3672): n is a, c, g, or t
  misc_feature (3675)..(3676): n is a, c, g, or t
  misc_feature (3678)..(3680): n is a, c, g, or t
  misc_feature (3682)..(3682): n is a, c, g, or t
  misc_feature (3686)..(3687): n is a, c, g, or t
  misc_feature (3691)..(3693): n is a, c, g, or t
  misc_feature (3695)..(3695): n is a, c, g, or t
  misc_feature (3697)..(3697): n is a, c, g, or t
  misc_feature (3699)..(3700): n is a, c, g, or t
  misc_feature (3702)..(3707): n is a, c, g, or t
  misc_feature (3709)..(3709): n is a, c, g, or t
  misc_feature (3711)..(3715): n is a, c, g, or t
  misc_feature (3717)..(3717): n is a, c, g, or t
  misc_feature (3719)..(3720): n is a, c, g, or t
  misc_feature (3722)..(3724): n is a, c, g, or t
  misc_feature (3726)..(3726): n is a, c, g, or t
  misc_feature (3728)..(3736): n is a, c, g, or t
  misc_feature (3738)..(3738): n is a, c, g, or t
  misc_feature (3741)..(3741): n is a, c, g, or t
  misc_feature (3743)..(3745): n is a, c, g, or t
  misc_feature (3747)..(3748): n is a, c, g, or t
  misc_feature (3750)..(3754): n is a, c, g, or t
  misc_feature (3757)..(3764): n is a, c, g, or t
  misc_feature (3768)..(3772): n is a, c, g, or t
  misc_feature (3774)..(3776): n is a, c, g, or t
  misc_feature (3778)..(3780): n is a, c, g, or t
  misc_feature (3782)..(3790): n is a, c, g, or t
  misc_feature (3793)..(3802): n is a, c, g, or t
  misc_feature (3804)..(3808): n is a, c, g, or t
  misc_feature (3810)..(3810): n is a, c, g, or t
  misc_feature (3814)..(3817): n is a, c, g, or t
  misc_feature (3819)..(3822): n is a, c, g, or t
  misc_feature (3824)..(3826): n is a, c, g, or t
  misc_feature (3828)..(3836): n is a, c, g, or t
  misc_feature (3838)..(3848): n is a, c, g, or t
  misc_feature (3850)..(3852): n is a, c, g, or t
  misc_feature (3854)..(3857): n is a, c, g, or t
  misc_feature (3859)..(3861): n is a, c, g, or t
  misc_feature (3863)..(3865): n is a, c, g, or t
  misc_feature (3867)..(3869): n is a, c, g, or t
  misc_feature (3873)..(3874): n is a, c, g, or t
  misc_feature (3876)..(3876): n is a, c, g, or t
  misc_feature (3878)..(3881): n is a, c, g, or t
  misc_feature (3883)..(3883): n is a, c, g, or t
  misc_feature (3885)..(3885): n is a, c, g, or t
  misc_feature (3887)..(3891): n is a, c, g, or t
  misc_feature (3893)..(3895): n is a, c, g, or t
  misc_feature (3899)..(3900): n is a, c, g, or t
  misc_feature (3902)..(3903): n is a, c, g, or t
  misc_feature (3905)..(3905): n is a, c, g, or t
  misc_feature (3907)..(3908): n is a, c, g, or t
  misc_feature (3911)..(3916): n is a, c, g, or t
  misc_feature (3918)..(3918): n is a, c, g, or t
  misc_feature (3920)..(3922): n is a, c, g, or t
  misc_feature (3924)..(3924): n is a, c, g, or t
  misc_feature (3926)..(3926): n is a, c, g, or t
  misc_feature (3928)..(3928): n is a, c, g, or t
  misc_feature (3930)..(3940): n is a, c, g, or t
  misc_feature (3942)..(3942): n is a, c, g, or t
  misc_feature (3944)..(3945): n is a, c, g, or t
  misc_feature (3947)..(3950): n is a, c, g, or t
  misc_feature (3952)..(3962): n is a, c, g, or t
  misc_feature (3967)..(3967): n is a, c, g, or t
  misc_feature (3969)..(3972): n is a, c, g, or t
  misc_feature (3974)..(3976): n is a, c, g, or t
  misc_feature (3978)..(3982): n is a, c, g, or t
  misc_feature (3984)..(3988): n is a, c, g, or t
  misc_feature (3990)..(3991): n is a, c, g, or t
  misc_feature (3993)..(3993): n is a, c, g, or t
  misc_feature (3995)..(3999): n is a, c, g, or t
cctcctgccgcctttcgntctcgcnggcgtggggatgatggtgctgatcatgccgcagacctcaatcaccctggcggagattcccacgaccgaagccggagcagcgtccggcaccctcacgaccttcggccaagtcggcatggtgttcggcatcgcactgtccggcaccgcatacttcggagcanccggtgacagnggccagaacgtgaccgcgggcctgtgggtcatcgtcatcgcctacaccgtctccggcttggccgcnctcacgatgcccacccgcagcagccaggagcagccctcgcccgaccccaatgagcctggttgagccagcatgagcggccccttccccgaagccggttgagccggggcgcgacgaaggagcgacccgagtcgaaaccatcactggcgctcggtagatagaactcgaccacagctccccggacacgcacaccgcggtttcgacacgaccagctcgcagagcgagcaggccggctcaaccagcttgggagaagttcaccgcaggtcggctcaaccggcttggaagcagggagagcagaccctcagnanccaccaaacccctgcacggaggtgtgtgcaggggttcggcgggaattgaggaagggcttgaaagccaagtttttatttgtcagaggacctcgtagttgacggtgatcaccccggaggaggtgccgccgatggtttccatggcggccttggagaggtccaggcagcgtccggcgacgtaggggccgcggtcgttgatgcgaaccacgacggtcttgccgttgctcgggttggtcaccttgaccttgctgccgaggggaagggtcttgtgggcggcggtgaggtcgctggggttgaactgttcaccggaggccgtgatctgtccctgccagtagtaggaggcctggcaggagctgccgttggcggggctgaggtcgccgccgctacccgagccggagccaccctcggaaggcttgctggccttcttggtgcccaccttggtcacctgggcgacgggctccttggtgacctgctcgttctgcagctcggaggagaccagcgtgccgttgtggtagacctcgacgaagttctgggtcttgacgccgttgacgccctcggtggtgaccttggtcttgccctcctccagttcgtcggacttctcctccttcttctcgaaggggaccgcctcctccttgntggtggcgcgcttctcgacgttggtgtaggagatggccannccatcggtnagggaggtgtccgcggcgggggtgaccacgtcgtcctcgtcgggngtcaccttggcggcggtcagggcntcgccgacggtcccggcgacccgcagntcgaccggggtgcccgcggcgtcgacggtcacgttcttgggggtgctgatgttgaaggagagcccctcgcggccgatggcggccgagcgggaggtggacagcttggagtcggggtcgttgaggttgagctgcgtcagagcgtcgtcgacggtgcgggaagtggtccacacggtgcgggcctcaccgtcgatggtcagctggagctggcggccgtagagaacgctgatctccatgccgttggtgatcttggtgtccagcgacggggccaccacgtcgtgctcgccgacggtgatcccgtccttctcgagcacctgcttcaccgtgtcctcgcgaaccgagacactgtgggtttccccgtccacggaaaggaccacatcgttcttgtgcagtgccaccgcgacggcgacgccaccggcgatcgtcagcgccacaccgcctgccactgcggcaataaccacgtgtttcttggccatagatctcttcctggtctaagacttcccggaccttaccggctgggccagcctagccgagcaccgatttaattccaaacgaatcctgagaatctctcagggccgcgcaatccgattgtagccctcgaccctcccaactgggaacaggtcctcgtngacgcccgcctcccnggggncgaatcctgacgtgaccacgggtttcacagcgatcccccggcttccgggagggatgggnggaagccgggggaaccctgagnaacggtcttaacggaagttacgcaacctgagagagttcagcaccacgaanacgctggagcaggccatggccgcgcccgcgatcatcggggtcagcancccgagggccgccaccgggatggccgccacgttgtagaagaaggcccacagcaggttgccccggatggtgcgttccgtggcgcgggagagccggatggcntccaccacgcccatcaggtcgtcgcgcatcagggtgaggtcgctggcggccatggccgcgtcggtgcccgcgcccatcgcgatgccgaggtcggaggtggcaagcgccgcggcgtcgttcaccccgtcgccgaccatcgccacccgcatcccatcggcctgcagcccggtgatcacctcggccttgccctgcggcagcacctcggcgtgcacgtcttcgatgcccacctgcgaggccacctcccgggccacggcccacgagtcgccggtcagcaacaccggtcgcaatcccagatccctcaanccggccacggcctccgcggccccgggtttgagctggtcgccgaccacgatccgccccagcagcgcgccgtcgcggacgacgaacacctcgctgccctcccggctggcctcgcccgggacctcgatgccctgctcggccagcagacgccgggaacccaccgccaccggaaccccgtcgagcagggcccgcgccccgatnccgggcagggcctcgaaccgctccgcnncggncgngtccccggcgngctccacgacggcgcgggcgatgggatgctcggaaccggcntccacngccgcggcgacggccagcagctcggcctcgtccacgccctcggcgggcgcgacctccagcaccgacatcctccccgtggtgagggtgccggtcttgtccagcaccaccgcctgcacggancgggccttctccagggcctgggcgcctcggatgatcacgcccagctcggcgccgcgaccggtgcccaccagcagcgccgacggggtggcgagcccgagcgcgcacgggcaggcgatgatgagcaccgccatgcccgcggngagcgcgaaggtggggcccgcaccgangagcagctgcaccatgaaggtgagcatcgacaacaccagcacggcgggcacgaagaactccgtgatncggtccgccaggcgctgggcccgggccttgccggtctgggcctcctcgacgagccgcgcgatctgcgccacctgggtggccgacccgaccgccgtcgccttgaccaccaggcgtcccgtggtgttgaccgacccgcccaccaccgccgagcccgggccgacctccaccgncngcnnnncnncnntgnnnncgncngcgnngnnnncgnnnnnnnnntnnncnannnncnnnnnngcggnnncnnnntcnnccggncncaccnnnnngangnngntgnnnnnnagntnnnnnnnngnnnnnnngncnnnnnngcngnnnnnnnngatcgncnnnncntnnnnnnngnnnncnnnnnnngcnnncnncncnnntnnnnnntcncnntngnnnnngnnnncnnnnnngnnncccnncnnnnnnangnngnccnngncngcggcnnncncnnnnnnnncgnngnnnancggnncggnnngncngnngnnnnnngngnnnnngngnntnnngncnnnnnnnnngncgngnnngnngnnnnnggnnnnnnnngacnnnnncnnngnnncnnnnnnnnngannnnnnnnnngnnnnncntggnnnngnnnncnnncnnnnnnnnngnnnnnnnnnnntnnngnnnncnnngnnngnnncagnncncnnnnangntnnnnngnnncagnncnngncnntgnnnnnngngnnncngnangnnnnnnnnnnncnanncnnnnannnnnnnnnnngccancnnnnannncnnnnncnnnnncnncngnnnnnc

SEQ ID NO: 1152 - DNA, 4000 bp, Escherichia coli
  misc_feature (2637)..(2637): n is a, c, g, or t
  misc_feature (2886)..(2886): n is a, c, g, or t
  misc_feature (2949)..(2949): n is a, c, g, or t
gaggtggggcatgccaggtacgaggccgatgagcacgagaatccctgcggtaatcttgagcgcggctgggttggtgagctgactgcctgctgagttggccgtagtttcagaggtggtgacgcgagttacgattattgctgtagacagcgatagcagcagcgatggcacttgggcaacaagaccgtcgccaatagtgaggagcacataaatttccgctgcctcgctaaattcgagtccgttctgcgttaccccgacgagcagaccgcccacaatgttgatcaacagaataagcacgccagcgatcgcatcaccgcggacaaacttagaggcaccgtccatggagccgaaaaaatcggactcctgcgagacttcttctcgtcgcttaagggcagtttcctgatcgatcacgccggcattcagatcggcatcgattgccatttgcttaccaggcaacgcgtcgagagtgaaacgcgcgataacctcggaggttcggcctgcacccttggtcacaacgataaaattgatgatcatcagaatgataaaaatgatgaagccgacgatgtaatttccggcgatgacgaactcgccaaacgaggcgatgacatttcctgccgcgtcggggccttcgtgaccacgcaggagcactacgcgagtcgaggctacattaaggctcaggcgaagcattgtggctaagagcagtattagcgggaacgaagaaaattcgaggggcttatgcacgttgatgcagatcatcacaatgatgaggccggtcataatattaaaagtaaacaggatatcgagcgctatcgaaggtaatggcacaacaagcatgcccataatcgctaggataaccaggggaatacctaggtttttcgcttcaccggtaaagagtgattgtcgtaaacctgacactaaagtcgcgctcataattacttcttcttaatcaatgggttactagattattccggcgatctatcgttctgtttatagccttttcagcctcggcatttaccggctgtcctaggcagttgcaaagcctgtgccaataaattgtgacagtgaaattcgagactagtcggcctgtgatgactcgcttgaagaaattaagcgacaccaacgagtaaagcgcggtgaacaagtgtcgattggctcttcgtagaggcgccactaaagaacctaaagaggagcaggaaatgaagtcatcgcagagctatttaataggccgaattgggttattcgccttaatagtcaccgtgtttgctagctgttcgagcaatggacgggtcggtgttgcaggcatcaatgcaggcttctccctagagggccccgtcgtcaactcgtcgggtggcttggggtatcttgctagtgatcgcatcgaggcaacggggtatgcggtgatccagagtcaggctggagaaccggcgcagcagcgtcttatggctattaaagcagcccgttttgatgcctatcgtcagctcaccgaaattgtttttggtgtctacattgactcatcgaccacgatcgcggatctcacgattgccagcgacgattttcgctcgcgtatcgaaggtgtgatctacggtgccgagctcgtgaagatcgaaccagtctcgggcgatacctatgccgtcacgctggcattgccaaactcgacgatcgacgatctccgtgcgctgtacctcgaccaacttgcgttaggtgctggataagttgatgcgagctgatttcatccattcctttgcgatcgctttacgcgccatagtgtcgggccgaatgctcctagtggggatggccgttgcggtgagtttgccgagtgttgctcaagatacagcaagtcaactcgaaacaattaaggccgaggtactcaatgcggcggtggccgacggcgtctctgtggtctcttctgcttatataaatggcgatggccaactcgttgagtcttctttttatcgcgccggcggcggtatccgcggcattcggatgcatgcgttgctcgaagaccaaaacgcgcatgttcacgcgggatacatagaaacgagtccgctaaatccaaagttgagctgcgatcagctaccgcctccacgctatgcccgttctttagcgctgtcgtttgtgctgctcgatcaggtaaaagagcaagcgaaacgtcacgtccgcgagctcggcgaggtgtccactctcttacaggacgcggtgagcaccgaaataaacacgagcagccagtggtcactgctgtcggttcgcaattctgacaggcaggcagaggagccagtctctctctacacgcgctttaccgacggcagttttatcgaccatcgaaacaacaacacagcgctgcgagtaaccgttatcgacttttcgccccaggagctcaatcccgcgcagacactgcgtgcggggacacgaggcctcaggcgactggggtctcaattgggcgccgagattggcctcggcgttgaccgtagtgtgctcgcaggctcgagagtgcgcgagggaatgatcgaggtaagccttatgctgagcctagttgagctcgatagcggggaaaccgaaatagctcggcaacgattaaacttgaaagttgcgctacgtgacggccagatcgcgaatgcagaccggatgcaagggcagatcgcntctgcaaccgcgtcgctcttagcacgcggtcaggcgacactccgatgccagcccgaatcgcttgtagtctatagccaactcgaattctcggacgcaacccctacacttaatcagggtgcgagcgtcggtgttcgccgcggcgatagatttctgcttagcacgcgcaaatttaccgacgccgagcaactgctggattctgagatgcttgaatcattatcgatcgccgaggttgtgcgggtaaatccacanaatgccgaactgcgaattctcgaagggcctaccactgtgggacttcataaaagcgcgctgccnttctagtggaaagacgacaggtcatccatacagtaaggtaattgagcgtgcccaaaaaacgaatacaacgctaacgacaagattgaagggctagaaggggaataagatgacagtaaaaattcggttggtcgtagttgcgctattagcatggttcaccggtcaagcgatagccgccgaaaccgcgtctcgcactgagatcgaccgcgcgctccgggtcttgcttgcagactatgacgtacaagatcatctcgacattcgctacgccgaagaagtcgcgaccggcttttatgaggttcgcgctggcgacacgctcgacggcatcattaatcgcgcgattcagggcagctcgatccgtaaagaaatgctgcgcagcgcgtttattaaagcgaacccgcgcgcatttccttcgggtaatcccaatcgaatgcttgccggtgtgacacttcgcattcccaccgccgacgatgtactccgcctcgtgtttacggtcgatccggcggagctcgaaattgaacgtagggcacgagaaagctgggttcactttccctagacacgcttttctctgcataactttcgtctatctgattagggcgcagacgagcgacgttaataaggactgcccgtgaatggccccgagaatatcagccaattccttagagttccgatagccgatcaaccggccctcggaattttgcgcttaaacagcgccgaggtgcgtgagtacggactcactcctgggcagactgtgcgtggcattgttgcggacgatgggcgttcggttaccttgtttttccctaatcagccgcgacgatttcgcggtgactatcaagacctcaaaaatcaatcgctcgacttcagtgtgtcacgcagcgcctatggcgtgacaataaaaccggtcgaggagcgtatgacgctaaccacggcggcgatggcacgcgcagcagcgctgcaagcacagacccccaaacaaccagttaaccttcaagcgctcgcggcactggcgtcgaatcccgagctcaccgacgtgccggtgctcgcgggcgctgcaggc

SEQ ID NO: 1153 - DNA, 4000 bp, Escherichia coli
  misc_feature (1273)..(1273): n is a, c, g, or t
  misc_feature (1987)..(1987): n is a, c, g, or t
  misc_feature (1991)..(1991): n is a, c, g, or t
aaggatggtgatatcaaaggtgccgccgccaagatcgaaaaccgcgatggtggcgtcagtattggtcttgtccagcccgtacgccagcgacgaggcagtgggctcgttgatgatgcgcaaaacttccagtccggcgatggtaccggcgtctttggttgcctggcgttgtgcgtcgttgaaataggctgggaccgtgatcactgcctgggttatcttctcgcccaacttggcttcggcgtcctgcttgatcttctgcagcacgaaggcggagatctggggaggggcgtgggactcgtcgcccaactgcaccatcgcgtcgccactggggccggccacgatcttgtagggcagtttggacatggcgttctgaatctcagcgtcgttgaacttacggcccatgagccgtttcactgaaaagagcgtgttctcggggttggttacggcctgccgtttcgcgacttggccaacgtaacgctcgcccgttttggtgttcagagcaacgaccgacggggtgatgcgggcgccttctgcattttccacgaccacgggttcaccggcttcgatgatcgccgcgactgagttggttgttccgaggtcgattcccaggactttagccatttggtttctcctaaattctcacacgctggtgacaatattgatgcgatgggatgatttggggtttgctatctgatcttaagttggttctgattggtctttgggggccgtggccaccatcacttgggctgggcggatgacccggtcatgcaaccggaaccccatccttaatatctgagtgatgtagcccggctccacctcgcttgactcttcggtgccaacagcttcgtgctccatggggttgaacatcagacccacggcctcgatggccgctacgccctcggattctagcacgccggttaatttccgctggatcagcttgatcccttcgaggaaagagtcgttgatctcggtgctggattcggtatgggtgatagccaggtccaactcctccaagaccgggaggatattggcgatcaaccggctgttggcgtatttggcgttggcgatgcggtcttcgtcggtccggcgccggaagttaaccatctccgcttgggcccgctgggcggtgtccaggttctcggcggcatcttgctgcgctcgttcgagactggtcttcagcgaactcacctggtcctccaaggggaggctgtccagatcgactccagcctgggccaagagttcttcaagttccttctccagtccctgagattcgggntgttctgcccgctcttcttgctcttcgggctggtcatctgattcgtttggtcctttccccattgaggtattcccctagatgtgatcggtcttggtccgaaaagccggctttagcggtctaccggcagattcaagctcttgaataataggtccatctcttcttgtaccacctgttgggccgcagggataccctcgaggcggtcactgattcgctgcttgatcgtggacatattgtcaaacgcggccaaggcgaattcaaccccagccagattcaggcccaattcgtcggacagataccggatcaaccggacctttctgatgtcctcggttgaatagagccggagcatcccgatggtccgcccaggattgatcaaccccagccgctcgtacttacgcagcgtctgagggtgaatgtccaagatccgcgcggcgacgctgatgatatagacgccctgggcctcgatcaccggttcgtcattggcaggcggctgagcaggcgaaatgtccgtattttcggggcgcgtggggggcgtccggcccggcgttaccggctgattctccacgcgaggtctctgttgttggctcatatggactccccagggccaccacgagttctggcatgaaactctagaatcggtcaatcagcggcgcatttcggtcacattgttgaccggcgattaatcatatgatagagtctgatacgtttcgtgtcaangttngtgcaacagcctgcattacatgacttaagatcatccggttaatggctgaggccaaataagagttagaccgggaaaaagaaggttaatcatgatgtacttcaaggaatgcccaaagtgccacggtgacctattagacggagaggatgttcacggccggtatgttagctgtatccagtgcggatacatgcgtgatctgcctgaggagaccccccatccgttggcagggaagacctttgtgatcgatgctcccaagcccgccaagaagcgccgaaaaaaggtcgctcgagccgcctgaaattagattaggccgatgcaaaagaggggcggctaagttgccgcccctcttctttttctattattgggccgaggttcggatctaatcattacttggcaatcaccgtcattccagcggaggctggaaaccagatttgctgagttagccaaccatcatactgtgaaggcatcctgggttcctgccttcgcaggaacgacggggcggcttttcgctcacagtgccttgacatgcgaggttcagtttatttagtcagttcgggccagaatcgttcttctttccacggatcgccatcgttgtggtagccgcgctgctcccagaatccgggggaatcttcggcgatgagctcgataccgttgacccacttggcgcttttccaggcgtagatgctggggacgatcagccttagtggccagccgtggctcgtgcccaagggctcgccttcctgcttgtgggccagtatcccctcttccatggccaaggccagcgggaggttggtggagtagccgccgtagcagtgggccatgacgaacttggcctccggtttggggccggcggcggcgaccagttcgttgaagttcacgccctcccaggtgttgtccaatctgctccactgggtgacgcagtggaaatcggccagcgtggtggtccatttgagcttggagaattcctcccaattaagggttatctcccgttccaccagtccgaagactcggatctgccaggtgtcgatatcgatcttgggttcagtgccgtaggtcaggacagggaacttgtcggttaggaattgtcccggtgggacgcggtcgcccaggctttggccgggcgccgtctttacttggtcaggtcgcttcatttgataagactcttcggctgatattccgcaatagggccaaaccggctgcgaatacacagtttatcaccggcttgcggcgtattgaaagaaaggcgccgttgtctggctctaggcggatacgctgatccgtccggggttctcggcggtgatctcgcccaccacggccttggtctgcactccggaggcgtccagtttagctagcaattggtccaacttggacttggggaccgagatcagtaggccgccggaggtctgggcgtcgcacatcaaaagcttctgttggtctgacagaacgtcgtcccagtccaccacgtcctcgacgctggacatgttgcggaaggtgcctccgggaaccgtccctttctccagcaggtcccagacgccgggcaacaccggtacgtccgccacccgaatcctggcccctgcctggctgcccttgaccatgccgctcaggtgtcccatcaggccgaagcccgtgatgtcggtgcaagagttcactcccaccctcatcatggcctcggacgcgcccttgttcagttcggccatcatgtccacggcctgcttcaatatggcgtctggcgtgaccccctgtttgacgccggtggtgactatccctgtgccgatgggtttcgttagcaccaggacgtcgccgggcttcgcgttggcgttggaaacctcttttccgggctcgatcaggccgaccaccgagaggccgtactttggctctgcgtcatctaccgtgtgcccgcccacgatcaggcagcccgcctccgtagccttatcgtagccgcccttcagcacatcgcccagcatctccacggccagatcggcagggaatcccaccacgttcaaggccaccag

SEQ ID NO: 1154 - DNA, 4000 bp, Escherichia coli
  misc_feature (1)..(4): n is a, c, g, or t
  misc_feature (6)..(6): n is a, c, g, or t
  misc_feature (8)..(8): n is a, c, g, or t
  misc_feature (12)..(13): n is a, c, g, or t
  misc_feature (15)..(19): n is a, c, g, or t
  misc_feature (21)..(22): n is a, c, g, or t
  misc_feature (26)..(26): n is a, c, g, or t
  misc_feature (28)..(30): n is a, c, g, or t
  misc_feature (32)..(35): n is a, c, g, or t
  misc_feature (37)..(37): n is a, c, g, or t
  misc_feature (40)..(40): n is a, c, g, or t
  misc_feature (42)..(42): n is a, c, g, or t
  misc_feature (46)..(46): n is a, c, g, or t
  misc_feature (48)..(50): n is a, c, g, or t
  misc_feature (52)..(55): n is a, c, g, or t
  misc_feature (57)..(57): n is a, c, g, or t
  misc_feature (59)..(61): n is a, c, g, or t
  misc_feature (63)..(63): n is a, c, g, or t
  misc_feature (65)..(65): n is a, c, g, or t
  misc_feature (67)..(69): n is a, c, g, or t
  misc_feature (72)..(76): n is a, c, g, or t
  misc_feature (78)..(78): n is a, c, g, or t
  misc_feature (82)..(85): n is a, c, g, or t
  misc_feature (89)..(92): n is a, c, g, or t
  misc_feature (94)..(94): n is a, c, g, or t
  misc_feature (98)..(100): n is a, c, g, or t
  misc_feature (102)..(102): n is a, c, g, or t
  misc_feature (104)..(107): n is a, c, g, or t
  misc_feature (109)..(114): n is a, c, g, or t
  misc_feature (119)..(119): n is a, c, g, or t
  misc_feature (122)..(122): n is a, c, g, or t
  misc_feature (125)..(125): n is a, c, g, or t
  misc_feature (127)..(127): n is a, c, g, or t
  misc_feature (130)..(130): n is a, c, g, or t
  misc_feature (132)..(132): n is a, c, g, or t
  misc_feature (134)..(137): n is a, c, g, or t
  misc_feature (139)..(139): n is a, c, g, or t
  misc_feature (141)..(141): n is a, c, g, or t
  misc_feature (143)..(144): n is a, c, g, or t
  misc_feature (147)..(149): n is a, c, g, or t
  misc_feature (151)..(155): n is a, c, g, or t
  misc_feature (157)..(157): n is a, c, g, or t
  misc_feature (159)..(162): n is a, c, g, or t
  misc_feature (164)..(172): n is a, c, g, or t
  misc_feature (174)..(174): n is a, c, g, or t
  misc_feature (176)..(190): n is a, c, g, or t
  misc_feature (194)..(194): n is a, c, g, or t
  misc_feature (196)..(196): n is a, c, g, or t
  misc_feature (198)..(199): n is a, c, g, or t
  misc_feature (201)..(201): n is a, c, g, or t
  misc_feature (203)..(203): n is a, c, g, or t
  misc_feature (205)..(205): n is a, c, g, or t
  misc_feature (207)..(211): n is a, c, g, or t
  misc_feature (213)..(214): n is a, c, g, or t
  misc_feature (216)..(216): n is a, c, g, or t
  misc_feature (218)..(218): n is a, c, g, or t
  misc_feature (221)..(223): n is a, c, g, or t
  misc_feature (226)..(227): n is a, c, g, or t
  misc_feature (229)..(230): n is a, c, g, or t
  misc_feature (233)..(233): n is a, c, g, or t
  misc_feature (237)..(239): n is a, c, g, or t
  misc_feature (241)..(241): n is a, c, g, or t
  misc_feature (243)..(243): n is a, c, g, or t
  misc_feature (248)..(250): n is a, c, g, or t
  misc_feature (252)..(256): n is a, c, g, or t
  misc_feature (258)..(260): n is a, c, g, or t
  misc_feature (262)..(267): n is a, c, g, or t
  misc_feature (270)..(273): n is a, c, g, or t
  misc_feature (277)..(279): n is a, c, g, or t
  misc_feature (286)..(286): n is a, c, g, or t
  misc_feature (291)..(293): n is a, c, g, or t
  misc_feature (295)..(295): n is a, c, g, or t
  misc_feature (297)..(297): n is a, c, g, or t
  misc_feature (299)..(301): n is a, c, g, or t
  misc_feature (303)..(304): n is a, c, g, or t
  misc_feature (306)..(306): n is a, c, g, or t
  misc_feature (308)..(312): n is a, c, g, or t
  misc_feature (315)..(318): n is a, c, g, or t
  misc_feature (321)..(321): n is a, c, g, or t
  misc_feature (323)..(324): n is a, c, g, or t
  misc_feature (327)..(331): n is a, c, g, or t
  misc_feature (335)..(335): n is a, c, g, or t
  misc_feature (337)..(338): n is a, c, g, or t
  misc_feature (342)..(342): n is a, c, g, or t
  misc_feature (345)..(345): n is a, c, g, or t
  misc_feature (350)..(351): n is a, c, g, or t
  misc_feature (354)..(358): n is a, c, g, or t
  misc_feature (360)..(360): n is a, c, g, or t
  misc_feature (363)..(364): n is a, c, g, or t
  misc_feature (366)..(366): n is a, c, g, or t
  misc_feature (370)..(370): n is a, c, g, or t
  misc_feature (372)..(372): n is a, c, g, or t
  misc_feature (374)..(374): n is a, c, g, or t
  misc_feature (405)..(405): n is a, c, g, or t
  misc_feature (795)..(795): n is a, c, g, or t
  misc_feature (879)..(879): n is a, c, g, or t
  misc_feature (1080)..(1080): n is a, c, g, or t
  misc_feature (1096)..(1096): n is a, c, g, or t
  misc_feature (1657)..(1657): n is a, c, g, or t
  misc_feature (1662)..(1662): n is a, c, g, or t
  misc_feature (1683)..(1683): n is a, c, g, or t
  misc_feature (1696)..(1696): n is a, c, g, or t
  misc_feature (1710)..(1710): n is a, c, g, or t
  misc_feature (1728)..(1728): n is a, c, g, or t
  misc_feature (1737)..(1737): n is a, c, g, or t
  misc_feature (1752)..(1752): n is a, c, g, or t
  misc_feature (3578)..(3578): n is a, c, g, or t
  misc_feature (3584)..(3584): n is a, c, g, or t
  misc_feature (3656)..(3656): n is a, c, g, or t
nnnncngngggnngnnnnngnnaaanannntnnnnanaancnaaanannncnnnngngnnncncngnnnaannnnngntttnnnnaaannnngngggnnngntnnnngnnnnnnggggnccnccngnggntntnnnntngngnnggnnncnnnnnanannnncnnnnnnnnngngnnnnnnnnnnnnnnngggncncnngntngnannnnncnnangnccnnnacnnannggngaannntntntcccnnnannnnncnnntnnnnnnaannnngggnnnagggggnaaagnnntngngnnnanncncnnnnngannnnccntnnggnnnnntgtnanncccnggncccanngcnnnnntnttnnantttngngnaaaaattttttaaccgtatttccgaccaaanaaatcggataactttgtttgaatgaaataaacgctgccgagcaaaggagagagagcgatggagaaagctctgacttggaaagaaaaactcgccggcaaaatggtaccggagctggcacgcgagatcgacatcttcgagcagcaaatgaaactccgcaagcaaggcaagatcgacgagaaggtctttgccgagacacggttgcggcgcggtatctacgggcaacgctacgacaacgggcagcgccacgacggcaagcgcgtgcagaaactcaaactgcctgccgaggttatcaaaggacctgacacgctctgggacgcgcccggtatgatgcgaatcaaaatacctttcggcggcgtaacgcctgaacagctggagaccttggccgatctntccgaggaatacgccgacggggttgcgcacatcaccacgcgccaagatgtccaattccatttcgttcatatcgacgacacgccntcgctcatgcggcgcctggccgcggtcggaatcacgagccgcgaggcctgcggcaacgtcgtgcgcaatgtgacggcctgcccgttggccggcatttgccgcgacgaagcattcgatacgacgccctacgccaaagcctgctcgaagttcatgatgggccatcccgatacgcaggactttggccgcaagttcaagatcgcnttttcaggctgccaanagcatccttgcgggctggtaaccatgcatgacatgggcgccatcgctaagacgaagatcgtggatggcaaggagaagcgagggttcgaattctacgtgggtggcggcctcggctcggttccgtataaagcgaagctattcgatgaatttctgcctgaggaagaattcctgccgatggcgcaggcgatttcccgggtcttcgcccgcctcggcgaaaagcgcaatcgcgcgcgggcgcggatcaagtttttgatcgccaatctcggcattgacgaattccgccggctagtactcgaagagcggcagaagctttctcctgatcctcgctggacggcccatctcgccacggtcaatgagcagatggaagaagcgctcaaggctggagtgagcttgaacggcagcgagcggcccgagggattcgaggcctggtacgctaccaacgtttacaagcagaggcagccgggatatgtggccgccaccgtgaccttgcctctcggcgacgccagcgccgagcagttgcgcgcgctcgccgacatcgcgcggcgatttgttaaggacacgntccgnaccacggtagagcaaaatatnctctttcgctggntgagcgaggcggancttccggagttttaccgngccattcgngcgatcggtctgggngcggcggacgcggccaccatcgtcgacgttaccgcctgccccggcaccgacacctgcaaattgggcatcgcttcctcgcgcggtctcgcgcgcgagctgcgttatcgcctcggtgaaaagagtctggagctggatcaagcggtgaagaacctgcgcatcaaagtcagcggctgctttaactcatgcggccaacaccacgtcgccgacatcggcttctatggcatcaaccgcaacgttaagggtttccaggtgccgcacttccaggtgatcctcggcggcaaattccgcgacaacgcgggggaatacggcgtggccgtcggggcggtgccgtccaaacgagtaccggaggcggtgctgtcgatcacggaatactacgtgcgcaggcggttgagggatgagagctttcaggattttgttcgacggattggcaagaaggagattaaagacctgctggaggatttaaccaaaatacccgcgcacgaggtgggcccgtcgtactacaccgattggggagatccgcgcgagtttactttgaccgatatgggaaccggagaatgtgcgggtgaggtcgtcagccaagcggagtttgcgctggcagcgagcgaacgcgaattgttcgaggcccaattgctcttggacggcggacgtccccaggacgctgtcaagacggcgtatgcctctatgctccgcgcggcgcaaggtctggtgaagacccagaatcccggtatctccgaggatgaacagcagattctcgcggaattcaccagccgtttttacgatacgcagctcttctgggacaaatacgctggtggaaaattcgccgagtatttgttcaaggccaaggaatttatcggcgcggcaaaatctgccgacgcggatcgcgcggttcaactgttgcaggaagcgcagctgtttatcgacgcggctcacgactgccacaacaaggtgcgcggcgccgtggaaagtccggttaagataacgaccgccgctcaaccgagcgcatagcgtcttggagcaaagatggaactgcaaaagatcaatgtaaaattcttcgcgacggatcctaacaacccgccactgacggattttatcgatctttttcatggctggattcaagctaccgacggcgtctaccacgacgtggccgactatagtcacatgcaagcggggccggggatcgtgctggttgccaacgatgccaacgtgagcatcgatgagacggacaatcgtcgggggcttctctacagtcagaagtcgccgcttagcggctccaacccggaaaaaatccgcacggtgttgcgctccgctctgaaaaactgccgccggttggaggaagagccctcgctgcacaataaattgaagttttccggtagcgaggcgttgatatccatcaatgatcggttggctgcgccgaataccgacgaggccttcgaagaaataaaaccggagatcgagtcggtggcacaaacccttttcggcgacgcggatattactttggagcgcgatccagatccgcgccagcgcctgaacgttcgcatcaagacgtctcgttcgttgggcttgggcgaattggtgcgcaatctgcagaacgactgactggaaagggcgaaaaaatggcattgttaaaccttcagcaagcaacctcgacggcaacgattgatgctttggaacaacttcccaccgagggaatcctgcgctgggccttcgacaagtttgctccgaagttagcgctggcctgttcctttcaagccgaggagtcggtcctgatcgatatgatgcaccgcatgcgtggagcggattttcgcatctttaccttggataccggncggctnaatcaggaaacctatgactgcatggatgcgatccggcagcggtatggggtgagcgtggaagtctatttcccngacgccgagaaggttcaaaacatggtacggagccacggccttaacctgttctacaactcggtggagctccgcaagctgtgctgtggcattcgcaaggtggagccgctcaaccgggcgttgagagaattaaacgcatggatgaccgggttgcgccgcgagcaggcggtgacccgctccgaggtgcgcaagatcgagctggatagagatcacggctccattgtcaaaattaacccgttggtcgattggagctacgaccaggtgtggaactatattcgcgagcacaaggttccgtacaatcggctccataaccaaggttatccgagcatcggctgcgccccgtgcac

SEQ ID NO: 1155 - DNA, 4000 bp, Escherichia coli
  misc_feature (1987)..(1987): n is a, c, g, or t
  misc_feature (1989)..(1989): n is a, c, g, or t
  misc_feature (2884)..(2884): n is a, c, g, or t
  misc_feature (2898)..(2899): n is a, c, g, or t
  misc_feature (2902)..(2902): n is a, c, g, or t
  misc_feature (2916)..(2916): n is a, c, g, or t
  misc_feature (2919)..(2922): n is a, c, g, or t
  misc_feature (2924)..(2925): n is a, c, g, or t
  misc_feature (2930)..(2930): n is a, c, g, or t
  misc_feature (2932)..(2933): n is a, c, g, or t
  misc_feature (2936)..(2942): n is a, c, g, or t
  misc_feature (2944)..(2946): n is a, c, g, or t
  misc_feature (2948)..(2951): n is a, c, g, or t
  misc_feature (3018)..(4000): n is a, c, g, or t
tcaggtatgtgtaatataccgaattacaccgagcacataaattgttccgaatcttcaaatataaataataaaaataataatgttgcgatgtatccgggtaataatattatttatcataataatcaacaaaacaacttaaatttaaacgctgttaaaaataatcaatatatgcaatccattcaaaataatcattcaatgatgaatcagaattgtatttctaatccacaaataaattgtaataatgaatacatgcaatctttaattcaatttggatgtttcaatgtaaattgcaattttatgggtgcttcaaggaatggtattaataacatggattattacaataaaataaatggaatgttagattgtgataatgaaaaattaataaaacaatttgatgaagatatgaaaagaataaatggtaagtagtagaaaatttgtaatattttcatttattaataaatttttattatatatattaatatagtaatttttaatattatattttatataaaaggagagaatacatcaaataatcaaaaaatagatgttaataatcaaactaatattaaatgtacacaaacaacatattatgaacaaggatatacaaataattcctatagagaatataattcttctagtaatcaaagtaatggtagtaatggtgatagtaatagtaatgactctaatggtaattgtagtaatagtggttatggtaataacagtggaaatcaaaataatgataacaataataataacaataataacaacaataataattttaatgatctttcaaaagataaagatgtagttgaaagaccaaaaacattaaaaaattctgaggaaattatggaaaaatatttcaaaaatcatactttacataaagattttgttaatcaatatacattaacagaggaattaggggaaggtggatatggttttgttatatcatgtacaagaaaaagtgatggtcaaaaagttgctgtgaaatttattatcagagaaaaagttcctgttgcttgttgggtaagaaatgaagaccttggaatgatcccacaagaaattcatattttaagaatgattaatcataaaaatattataaaatatattgattattttgaagatgacaaatatttctatttagttcaagaacttcatggtactttttgggcaaataatttaaatattccagcaattgaaaacagttttagttcaagttcagaattttatgataatgttgctaatgaaagtagtgcatccaatattcattatcttcaaaagaatggtaatgataattctggaaattactatgataatgccaatccacttcctacacctccattttatgatcaacatgttcctagtaaaccatattatgtaaacccatctatgatggatattggttctagaaaagatttagatccaaacaatgttttaaaatcattaacaattcaagaaattgaagaaattgaattgaaagaaaaatcatcaatgtcgtcaggatcagcatcaataccagtaaaaggagtaagaaaggtaacaaatacttctatttcttcttctttttcatcatctacatcatcatcaccaatcaattattattctttgaattctaattctaactatcacaattataatatggaaatgcaacctccaccacttcctccatcacctgtcaataataaaaaggaaggaaataataagggttcaaatagtcaacaatttattgaattaccaagatctgttagtccatatataccatcagtaaaccaacgaccaatgaaaaatttaaataaaggtcgtaatttacaaaagaaaccatcaatggatctttttgaatgtatagaaagacatccccaattagacgaatcaatagtgaaatatatcatgagacaagtagtagaatgtgtttattatttgattaatacttgttctgtggtacatcgtgatttgaaggatgaaaatattgtaagttttttttttttttttntnttgttttttaaaatgtaaaatacaattataaattataaattataaattattattattattattattattattattttaaaaaaaaattaacaaaaatatttttattataaaaatattaatacattatataaaggttattgatgaaaactataatatcaaaattattgactttggtagtgcaactatattacctaaaaacagaaaaaatagactttttgcccaatttaatggtactattcaatatgcttcacctgaaattataagaggtgaaatgtattctgctcttgctcaagaaatttggtcattgggtatattaatgtatatgctcttatgtgaaggagaacatccatttggtgatgctaataatgttgttaataagccattagtgataactagacgatgctcaccagaatgtctcgatttattatatagaatgttggataaaaaccctacaaaccgtattaatattgatgatgtttataatcatccatggtttaaaaattaaatatgccattaacaataataataataattaaataacggaatcaactttttatttttatattatagacatttatatttaagtaaaatttcatttatattgtgtttttattttattttattttttaattaaattcttttaatattttaaaaattttaaggtaatatctataaaaaggaaacgaattacaacaatgaaaaaatatatttgtgataaaaaaaattttttttttttccattttatcttttaatcattatacaagaactttacataaaaaaaattaacaatattcacaattcatattcatattttatattaacaaaaacatttttaaacaaccaaaaaaaaaaaaaaaaaaaaaaaaaaaaaaaaaaaaaaaatattttttttttnttttttaaaaaaannttnaaaaattttaaaanttnnnntnnaaaantnnttnnnnnnntnnntnnnntttttttttttttttttttttggttgttttaaattgtttttgtttatataaaatatgaatatgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1156 - DNA, 4000 bp, Escherichia coli
  misc_feature (1)..(6): n is a, c, g, or t
  misc_feature (8)..(10): n is a, c, g, or t
  misc_feature (15)..(17): n is a, c, g, or t
  misc_feature (19)..(20): n is a, c, g, or t
  misc_feature (22)..(24): n is a, c, g, or t
  misc_feature (27)..(29): n is a, c, g, or t
  misc_feature (31)..(32): n is a, c, g, or t
  misc_feature (34)..(38): n is a, c, g, or t
  misc_feature (40)..(46): n is a, c, g, or t
  misc_feature (48)..(52): n is a, c, g, or t
  misc_feature (55)..(55): n is a, c, g, or t
  misc_feature (57)..(57): n is a, c, g, or t
  misc_feature (59)..(60): n is a, c, g, or t
  misc_feature (62)..(63): n is a, c, g, or t
  misc_feature (66)..(71): n is a, c, g, or t
  misc_feature (73)..(74): n is a, c, g, or t
  misc_feature (76)..(77): n is a, c, g, or t
  misc_feature (79)..(83): n is a, c, g, or t
  misc_feature (85)..(93): n is a, c, g, or t
  misc_feature (95)..(101): n is a, c, g, or t
  misc_feature (103)..(105): n is a, c, g, or t
  misc_feature (107)..(108): n is a, c, g, or t
  misc_feature (110)..(119): n is a, c, g, or t
  misc_feature (121)..(125): n is a, c, g, or t
  misc_feature (127)..(127): n is a, c, g, or t
  misc_feature (129)..(133): n is a, c, g, or t
  misc_feature (135)..(140): n is a, c, g, or t
  misc_feature (142)..(142): n is a, c, g, or t
  misc_feature (144)..(152): n is a, c, g, or t
  misc_feature (155)..(157): n is a, c, g, or t
  misc_feature (160)..(163): n is a, c, g, or t
  misc_feature (165)..(173): n is a, c, g, or t
  misc_feature (175)..(176): n is a, c, g, or t
  misc_feature (181)..(185): n is a, c, g, or t
  misc_feature (187)..(187): n is a, c, g, or t
  misc_feature (189)..(190): n is a, c, g, or t
  misc_feature (192)..(193): n is a, c, g, or t
  misc_feature (195)..(200): n is a, c, g, or t
  misc_feature (202)..(204): n is a, c, g, or t
  misc_feature (207)..(218): n is a, c, g, or t
  misc_feature (220)..(220): n is a, c, g, or t
  misc_feature (223)..(229): n is a, c, g, or t
  misc_feature (233)..(233): n is a, c, g, or t
  misc_feature (235)..(235): n is a, c, g, or t
  misc_feature (237)..(245): n is a, c, g, or t
  misc_feature (247)..(253): n is a, c, g, or t
  misc_feature (255)..(256): n is a, c, g, or t
  misc_feature (258)..(259): n is a, c, g, or t
  misc_feature (261)..(261): n is a, c, g, or t
  misc_feature (263)..(263): n is a, c, g, or t
  misc_feature (265)..(265): n is a, c, g, or t
  misc_feature (268)..(268): n is a, c, g, or t
  misc_feature (272)..(272): n is a, c, g, or t
  misc_feature (275)..(277): n is a, c, g, or t
  misc_feature (279)..(283): n is a, c, g, or t
  misc_feature (286)..(301): n is a, c, g, or t
  misc_feature (303)..(304): n is a, c, g, or t
  misc_feature (306)..(314): n is a, c, g, or t
  misc_feature (316)..(317): n is a, c, g, or t
  misc_feature (319)..(319): n is a, c, g, or t
  misc_feature (322)..(322): n is a, c, g, or t
  misc_feature (324)..(329): n is a, c, g, or t
  misc_feature (331)..(337): n is a, c, g, or t
  misc_feature (339)..(342): n is a, c, g, or t
  misc_feature (345)..(347): n is a, c, g, or t
  misc_feature (349)..(361): n is a, c, g, or t
  misc_feature (363)..(373): n is a, c, g, or t
  misc_feature (375)..(379): n is a, c, g, or t
  misc_feature (382)..(386): n is a, c, g, or t
  misc_feature (388)..(393): n is a, c, g, or t
  misc_feature (395)..(395): n is a, c, g, or t
  misc_feature (398)..(398): n is a, c, g, or t
  misc_feature (400)..(404): n is a, c, g, or t
  misc_feature (407)..(415): n is a, c, g, or t
  misc_feature (419)..(429): n is a, c, g, or t
  misc_feature (431)..(431): n is a, c, g, or t
  misc_feature (433)..(435): n is a, c, g, or t
  misc_feature (437)..(449): n is a, c, g, or t
  misc_feature (451)..(453): n is a, c, g, or t
  misc_feature (455)..(455): n is a, c, g, or t
  misc_feature (457)..(458): n is a, c, g, or t
  misc_feature (460)..(460): n is a, c, g, or t
  misc_feature (462)..(464): n is a, c, g, or t
  misc_feature (466)..(469): n is a, c, g, or t
  misc_feature (471)..(475): n is a, c, g, or t
  misc_feature (477)..(477): n is a, c, g, or t
  misc_feature (479)..(488): n is a, c, g, or t
  misc_feature (490)..(490): n is a, c, g, or t
  misc_feature (492)..(492): n is a, c, g, or t
  misc_feature (494)..(494): n is a, c, g, or t
  misc_feature (496)..(511): n is a, c, g, or t
  misc_feature (514)..(515): n is a, c, g, or t
  misc_feature (518)..(518): n is a, c, g, or t
  misc_feature (520)..(520): n is a, c, g, or t
  misc_feature (522)..(526): n is a, c, g, or t
  misc_feature (528)..(533): n is a, c, g, or t
  misc_feature (535)..(535): n is a, c, g, or t
  misc_feature (538)..(541): n is a, c, g, or t
  misc_feature (543)..(545): n is a, c, g, or t
  misc_feature (549)..(550): n is a, c, g, or t
  misc_feature (554)..(555): n is a, c, g, or t
  misc_feature (557)..(559): n is a, c, g, or t
  misc_feature (562)..(562): n is a, c, g, or t
  misc_feature (564)..(572): n is a, c, g, or t
  misc_feature (574)..(575): n is a, c, g, or t
  misc_feature (577)..(579): n is a, c, g, or t
  misc_feature (582)..(586): n is a, c, g, or t
  misc_feature (588)..(595): n is a, c, g, or t
  misc_feature (598)..(600): n is a, c, g, or t
  misc_feature (602)..(603): n is a, c, g, or t
  misc_feature (605)..(608): n is a, c, g, or t
  misc_feature (610)..(611): n is a, c, g, or t
  misc_feature (614)..(617): n is a, c, g, or t
  misc_feature (619)..(619): n is a, c, g, or t
  misc_feature (621)..(621): n is a, c, g, or t
  misc_feature (625)..(630): n is a, c, g, or t
  misc_feature (632)..(634): n is a, c, g, or t
  misc_feature (636)..(638): n is a, c, g, or t
  misc_feature (640)..(650): n is a, c, g, or t
  misc_feature (653)..(666): n is a, c, g, or t
  misc_feature (668)..(671): n is a, c, g, or t
  misc_feature (673)..(678): n is a, c, g, or t
  misc_feature (680)..(682): n is a, c, g, or t
  misc_feature (684)..(684): n is a, c, g, or t
  misc_feature (687)..(687): n is a, c, g, or t
  misc_feature (689)..(690): n is a, c, g, or t
  misc_feature (692)..(692): n is a, c, g, or t
  misc_feature (694)..(694): n is a, c, g, or t
  misc_feature (697)..(700): n is a, c, g, or t
  misc_feature (702)..(703): n is a, c, g, or t
  misc_feature (706)..(716): n is a, c, g, or t
  misc_feature (718)..(721): n is a, c, g, or t
  misc_feature (724)..(729): n is a, c, g, or t
  misc_feature (731)..(732): n is a, c, g, or t
  misc_feature (734)..(734): n is a, c, g, or t
  misc_feature (737)..(737): n is a, c, g, or t
  misc_feature (741)..(743): n is a, c, g, or t
  misc_feature (745)..(746): n is a, c, g, or t
  misc_feature (749)..(752): n is a, c, g, or t
  misc_feature (754)..(756): n is a, c, g, or t
  misc_feature (758)..(762): n is a, c, g, or t
  misc_feature (764)..(771): n is a, c, g, or t
  misc_feature (773)..(775): n is a, c, g, or t
  misc_feature (777)..(779): n is a, c, g, or t
  misc_feature (781)..(785): n is a, c, g, or t
  misc_feature (788)..(789): n is a, c, g, or t
  misc_feature (791)..(792): n is a, c, g, or t
  misc_feature (794)..(797): n is a, c, g, or t
  misc_feature (799)..(805): n is a, c, g, or t
  misc_feature (809)..(811): n is a, c, g, or t
  misc_feature (815)..(822): n is a, c, g, or t
  misc_feature (824)..(831): n is a, c, g, or t
  misc_feature (833)..(844): n is a, c, g, or t
  misc_feature (846)..(847): n is a, c, g, or t
  misc_feature (849)..(852): n is a, c, g, or t
  misc_feature (854)..(854): n is a, c, g, or t
  misc_feature (856)..(856): n is a, c, g, or t
  misc_feature (858)..(860): n is a, c, g, or t
  misc_feature (862)..(864): n is a, c, g, or t
  misc_feature (866)..(869): n is a, c, g, or t
  misc_feature (871)..(874): n is a, c, g, or t
  misc_feature (877)..(878): n is a, c, g, or t
  misc_feature (880)..(883): n is a, c, g, or t
  misc_feature (885)..(885): n is a, c, g, or t
  misc_feature (887)..(890): n is a, c, g, or t
  misc_feature (892)..(897): n is a, c, g, or t
  misc_feature (899)..(902): n is a, c, g, or t
  misc_feature (904)..(907): n is a, c, g, or t
  misc_feature (909)..(909): n is a, c, g, or t
  misc_feature (911)..(912): n is a, c, g, or t
  misc_feature (915)..(917): n is a, c, g, or t
  misc_feature (919)..(921): n is a, c, g, or t
  misc_feature (923)..(926): n is a, c, g, or t
  misc_feature (928)..(931): n is a, c, g, or t
  misc_feature (933)..(940): n is a, c, g, or t
  misc_feature (944)..(951): n is a, c, g, or t
  misc_feature (953)..(962): n is a, c, g, or t
  misc_feature (964)..(965): n is a, c, g, or t
  misc_feature (967)..(968): n is a, c, g, or t
  misc_feature (970)..(971): n is a, c, g, or t
  misc_feature (974)..(979): n is a, c, g, or t
  misc_feature (981)..(982): n is a, c, g, or t
  misc_feature (984)..(998): n is a, c, g, or t
  misc_feature (1000)..(1002): n is a, c, g, or t
  misc_feature (1005)..(1005): n is a, c, g, or t
  misc_feature (1007)..(1012): n is a, c, g, or t
  misc_feature (1014)..(1017): n is a, c, g, or t
  misc_feature (1019)..(1019): n is a, c, g, or t
  misc_feature (1021)..(1023): n is a, c, g, or t
  misc_feature (1026)..(1028): n is a, c, g, or t
  misc_feature (1030)..(1031): n is a, c, g, or t
  misc_feature (1033)..(1039): n is a, c, g, or t
  misc_feature (1041)..(1041): n is a, c, g, or t
  misc_feature (1043)..(1046): n is a, c, g, or t
  misc_feature (1048)..(1049): n is a, c, g, or t
  misc_feature (1051)..(1051): n is a, c, g, or t
  misc_feature (1053)..(1053): n is a, c, g, or t
  misc_feature (1055)..(1055): n is a, c, g, or t
  misc_feature (1057)..(1059): n is a, c, g, or t
  misc_feature (1063)..(1063): n is a, c, g, or t
  misc_feature (1066)..(1067): n is a, c, g, or t
  misc_feature (1071)..(1072): n is a, c, g, or t
  misc_feature (1074)..(1077): n is a, c, g, or t
  misc_feature (1079)..(1080): n is a, c, g, or t
  misc_feature (1083)..(1098): n is a, c, g, or t
  misc_feature (1100)..(1107): n is a, c, g, or t
  misc_feature (1110)..(1111): n is a, c, g, or t
  misc_feature (1113)..(1116): n is a, c, g, or t
  misc_feature (1119)..(1119): n is a, c, g, or t
  misc_feature (1121)..(1124): n is a, c, g, or t
  misc_feature (1128)..(1131): n is a, c, g, or t
  misc_feature (1133)..(1134): n is a, c, g, or t
  misc_feature (1136)..(1144): n is a, c, g, or t
  misc_feature (1146)..(1150): n is a, c, g, or t
  misc_feature (1152)..(1156): n is a, c, g, or t
  misc_feature (1158)..(1159): n is a, c, g, or t
  misc_feature (1161)..(1164): n is a, c, g, or t
  misc_feature (1166)..(1166): n is a, c, g, or t
  misc_feature (1168)..(1174): n is a, c, g, or t
  misc_feature (1176)..(1176): n is a, c, g, or t
  misc_feature (1178)..(1181): n is a, c, g, or t
  misc_feature (1185)..(1188): n is a, c, g, or t
  misc_feature (1191)..(1196): n is a, c, g, or t
  misc_feature (1198)..(1202): n is a, c, g, or t
  misc_feature (1204)..(1205): n is a, c, g, or t
  misc_feature (1207)..(1208): n is a, c, g, or t
  misc_feature (1210)..(1210): n is a, c, g, or t
  misc_feature (1212)..(1212): n is a, c, g, or t
  misc_feature (1214)..(1218): n is a, c, g, or t
  misc_feature (1220)..(1221): n is a, c, g, or t
  misc_feature (1223)..(1226): n is a, c, g, or t
  misc_feature (1228)..(1231): n is a, c, g, or t
  misc_feature (1233)..(1234): n is a, c, g, or t
  misc_feature (1236)..(1240): n is a, c, g, or t
  misc_feature (1242)..(1246): n is a, c, g, or t
  misc_feature (1248)..(1249): n is a, c, g, or t
  misc_feature (1253)..(1253): n is a, c, g, or t
  misc_feature (1257)..(1258): n is a, c, g, or t
  misc_feature (1260)..(1261): n is a, c, g, or t
  misc_feature (1263)..(1265): n is a, c, g, or t
  misc_feature (1267)..(1274): n is a, c, g, or t
  misc_feature (1276)..(1277): n is a, c, g, or t
  misc_feature (1279)..(1280): n is a, c, g, or t
  misc_feature (1282)..(1283): n is a, c, g, or t
  misc_feature (1285)..(1285): n is a, c, g, or t
  misc_feature (1287)..(1287): n is a, c, g, or t
  misc_feature (1289)..(1289): n is a, c, g, or t
  misc_feature (1291)..(1293): n is a, c, g, or t
  misc_feature (1295)..(1295): n is a, c, g, or t
  misc_feature (1298)..(1299): n is a, c, g, or t
  misc_feature (1301)..(1302): n is a, c, g, or t
  misc_feature (1304)..(1305): n is a, c, g, or t
  misc_feature (1307)..(1308): n is a, c, g, or t
  misc_feature (1310)..(1310): n is a, c, g, or t
  misc_feature (1312)..(1314): n is a, c, g, or t
  misc_feature (1316)..(1322): n is a, c, g, or t
  misc_feature (1324)..(1324): n is a, c, g, or t
  misc_feature (1327)..(1327): n is a, c, g, or t
  misc_feature (1329)..(1332): n is a, c, g, or t
  misc_feature (1334)..(1337): n is a, c, g, or t
  misc_feature (1340)..(1345): n is a, c, g, or t
  misc_feature (1347)..(1353): n is a, c, g, or t
  misc_feature (1355)..(1357): n is a, c, g, or t
  misc_feature (1359)..(1363): n is a, c, g, or t
  misc_feature (1366)..(1366): n is a, c, g, or t
  misc_feature (1368)..(1369): n is a, c, g, or t
  misc_feature (1371)..(1375): n is a, c, g, or t
  misc_feature (1378)..(1378): n is a, c, g, or t
  misc_feature (1380)..(1381): n is a, c, g, or t
  misc_feature (1383)..(1383): n is a, c, g, or t
  misc_feature (1385)..(1385): n is a, c, g, or t
  misc_feature (1387)..(1390): n is a, c, g, or t
  misc_feature (1392)..(1397): n is a, c, g, or t
  misc_feature (1399)..(1402): n is a, c, g, or t
  misc_feature (1404)..(1404): n is a, c, g, or t
  misc_feature (1408)..(1409): n is a, c, g, or t
  misc_feature (1411)..(1414): n is a, c, g, or t
  misc_feature (1416)..(1419): n is a, c, g, or t
  misc_feature (1421)..(1421): n is a, c, g, or t
  misc_feature (1423)..(1423): n is a, c, g, or t
  misc_feature (1425)..(1426): n is a, c, g, or t
  misc_feature (1428)..(1428): n is a, c, g, or t
  misc_feature (1430)..(1432): n is a, c, g, or t
  misc_feature (1434)..(1438): n is a, c, g, or t
  misc_feature (1440)..(1440): n is a, c, g, or t
  misc_feature (1442)..(1445): n is a, c, g, or t
  misc_feature (1447)..(1454): n is a, c, g, or t
  misc_feature (1456)..(1458): n is a, c, g, or t
  misc_feature (1460)..(1463): n is a, c, g, or t
  misc_feature (1466)..(1466): n is a, c, g, or t
  misc_feature (1468)..(1468): n is a, c, g, or t
  misc_feature (1471)..(1473): n is a, c, g, or t
  misc_feature (1478)..(1481): n is a, c, g, or t
  misc_feature (1483)..(1483): n is a, c, g, or t
  misc_feature (1485)..(1490): n is a, c, g, or t
  misc_feature (1493)..(1496): n is a, c, g, or t
  misc_feature (1498)..(1499): n is a, c, g, or t
  misc_feature (1502)..(1513): n is a, c, g, or t
  misc_feature (1516)..(1517): n is a, c, g, or t
  misc_feature (1520)..(1526): n is a, c, g, or t
  misc_feature (1528)..(1528): n is a, c, g, or t
  misc_feature (1530)..(1532): n is a, c, g, or t
  misc_feature (1535)..(1535): n is a, c, g, or t
  misc_feature (1537)..(1537): n is a, c, g, or t
  misc_feature (1539)..(1546): n is a, c, g, or t
  misc_feature (1548)..(1554): n is a, c, g, or t
  misc_feature (1556)..(1557): n is a, c, g, or t
  misc_feature (1559)..(1560): n is a, c, g, or t
  misc_feature (1562)..(1562): n is a, c, g, or t
  misc_feature (1566)..(1578): n is a, c, g, or t
  misc_feature (1580)..(1581): n is a, c, g, or t
  misc_feature (1583)..(1585): n is a, c, g, or t
  misc_feature (1587)..(1587): n is a, c, g, or t
  misc_feature (1589)..(1591): n is a, c, g, or t
  misc_feature (1593)..(1594): n is a, c, g, or t
  misc_feature (1596)..(1596): n is a, c, g, or t
  misc_feature (1598)..(1598): n is a, c, g, or t
  misc_feature (1600)..(1600): n is a, c, g, or t
  misc_feature (1602)..(1610): n is a, c, g, or t
  misc_feature (1614)..(1627): n is a, c, g, or t
  misc_feature (1629)..(1630): n is a, c, g, or t
  misc_feature (1632)..(1635): n is a, c, g, or t
  misc_feature (1637)..(1640): n is a, c, g, or t
  misc_feature (1642)..(1643): n is a, c, g, or t
  misc_feature (1645)..(1655): n is a, c, g, or t
  misc_feature (1657)..(1658): n is a, c, g, or t
  misc_feature (1660)..(1661): n is a, c, g, or t
  misc_feature (1663)..(1663): n is a, c, g, or t
  misc_feature (1665)..(1666): n is a, c, g, or t
  misc_feature (1668)..(1671): n is a, c, g, or t
  misc_feature (1673)..(1673): n is a, c, g, or t
  misc_feature (1675)..(1675): n is a, c, g, or t
  misc_feature (1677)..(1678): n is a, c, g, or t
  misc_feature (1680)..(1685): n is a, c, g, or t
  misc_feature (1986)..(1986): n is a, c, g, or t
  misc_feature (3192)..(3192): n is a, c, g, or t
nnnnnncnnnttttnnncnngnnnttnnnannannnnntnnnnnnnannnnnttnancnnannttnnnnnngnnanngnnnnncnnnnnnnnnannnnnnnannngnngnnnnnnnnnntnnnnncnannnnngnnnnnntngnnnnnnnnnaannnttnnnngnnnnnnnnngnnttttnnnnnangnntnntnnnnnnannnaannnnnnnnnnnnanttnnnnnnntttncntnnnnnnnnntnnnnnnnanntnntncngnttncccnttnnntnnnnnttnnnnnnnnnnnnnnnngnntnnnnnnnnntnncnggnannnnnncnnnnnnnannnnaannngnnnnnnnnnnnnnannnnnnnnnnnannnnnttnnnnnannnnnngnaantnnnnnttnnnnnnnnnaaannnnnnnnnnnantnnncnnnnnnnnnnnnncnnncntnncntnnnannnnannnnngnannnnnnnnnncntncntnnnnnnnnnnnnnnnnttnnttncngnnnnngnnnnnncnttnnnncnnnaaanncccnncnnnttngnnnnnnnnncnncnnnttnnnnnannnnnnnnttnnnanncnnnnannccnnnntngntttnnnnnngnnntnnntnnnnnnnnnnnggnnnnnnnnnnnnnntnnnntnnnnnngnnntnaantnntnanttnnnnannttnnnnnnnnnnnannnnaannnnnngnngnaancccnnncnnttnnnncnnntnnnnnannnnnnnntnnntnnntnnnnnaannanngnnnncnnnnnnntttnnnaaannnnnnnnannnnnnnnannnnnnnnnnnntnncnnnnantngnnnannnannnncnnnnggnncnnnntngnnnncnnnnnngnnnncnnnngnannccnnngnnncnnnncnnnntnnnnnnnntttnnnnnnnnannnnnnnnnntnncnncnnggnnnnnngnnannnnnnnnnnnnnnntnnnccntnnnnnntnnnncngnnnttnnncnncnnnnnnntnannnncnncnantncnnntttnccnntttnntnnnntnnggnnnnnnnnnnnnnnnntnnnnnnnnttnnannnnccnannnntttnnnnanngnnnnnnnnntnnnnnannnnncnncnnnncnannnnnnntnannnnaaannnnccnnnnnncnnnnncnncnncntnannnnntnntnnnncnnnntnntnnnnncnnnnnannaaantttnncnncnnngnnnnnnnncnncnngnngnantncnnngnccnncnnanntnnangnnngnnnnnnncnaantnnnnannnnaannnnnntnnnnnnntnnnannnnnaangnntnnnnnttngnntncnannnntnnnnnngnnnncnaaanngnnnncnnnntncnannantnnngnnnnnantnnnntnnnnnnnncnnnannnnaantnccnnnggggnnnntncnnnnnnggnnnncnnaannnnnnnnnnnnccnnccnnnnnnnancnnnaantncnnnnnnnngnnnnnnncnntnnangggnnnnnnnnnnnnntnncnnncngnnncnngncnancnnnnnnnnncccnnnnnnnnnnnnnncnngnnnncnnnncnncnnnnnnnnnnngnngnntncnngnnnncngnannannnnnntatccgcaagttaccgccaaaaattcgcaaccaaacgggagcagcggcccatgacgagccgctatcttggttctcaaagatgagaccaaatttaatcaaaatcaccgtgaccgccgcagcgagtttttttggcttaacgactcatttgcgcgcgcaggaggtagcaactgttccggaagtggaaatcaccggaaccgctccgggcgttcttcgccaagagttacaggtaggccagtacgggcagccggagtggacgacagagcgcgccttcagcaacagccgcgtttatgtgcggccggcngggacgcttgagttcaaccagttctggactccagaatttgccgaaggccacgtcacacacagctttcgcgaggaagtcgaaatcggcttgccgtatcggtttcaactcgatctctatcagaactggggcatagaacgaggagacgccttctacaaaggctcaagcgtggagcttcgttatgcgcttgctaactggggaaaaattccgctaaacccgaccctttacggcgagtggagctttaatgacaatgcgcccgacgtatgggagctcaagctgctgcttggtcaaacattcgcccatcgttggaactgggccgctaacctcacatatgaacacgaaaatggagggccgcgcgaacgtctgttcgagatgagcagcgcgctgacctatgcgctaattgatcagaccctcaacgtcggcatcgaagctctctttgaacacgccacggaggccggctcgcggagtgatcctacgtacgaattcctcatcggcccgagtgtcaaccttcgacccacacgcaatacttttgtcacggtatcgccacagttcggcgtaacccacgactcgccggacgcgaaggtgtttgtcatcgcgggatttaacttctctttcggtgggccgcgcgccccgagagaagaaggcattcgagcgcctgcctcaatgttcgggcgctaaacatcgagaaatggtgtggccttatcacgcaatttttcggtgtgcgcacgggattcgtgagctgccgcctagttcggctgacctgttcggttttttgctttgacgcaaatttcctacttgtacctcgaagctgcatacgaacacgctccggaagcgacctcgtcgggccgtgcgtttgcgagtctcttcgaaacagcggtagtgaactcaggttcaacaacccctcttgcctggcaagcgattccgggatgtggcaaccacatacatcgcgtggcgaaatgtgctgccgcggtcttgctcgcttgacgctggattgcagcgtcatcgggagcgcgcctagagcaacgcggtgctatcgcgagcctttctccgcgtatctcgccagcacccagcagagatcagaaagccggttgaggtaacgcaagatctccggattaagatctttctctccggcgcctaatgtggcgatgcgccgctctgctcgccgacatgttgtgcgggcaaaatcgatcgcagcggacaagggtgttncacctggtataacccaatccttcgaataaagcgacttgtctttctcaagctcggaaatgactccggtgatccgatccaccatctccgttgtggtaagatgaaacccatctttgacgtagcgttcccggtcgcctgtcgccgtcgccagctcacccatgacgacgatcaaatctttttgtgcagctaaaatctcgcctgaaatgaatttgtccgttgaaaatgatcgggcgagaccaagcgcggcggtgagctcatcgatacaaccgtaagcatcaacgcgcggatcagctttcgacaggcgccggccatacataagggaggtttcacccttatcgccctttttggttacgatcgacatccgccaaactgtaggccgtttatgcaaactcggagccgacacacaggccctaccatctttgctggcgagccgtgttttatccgatcgcaggttgcggctcagcttcttccatcactggcgcgccaatcggctcgcctttttcgatcagcttgatctggcgatgctcggggaacccggtgccggccgggatcaagtgacccatgatcacgttttccttgaagccacgcagcttatcgactttaccgagcgtggccgcttccgtgagaacacgtgtcgtgtcctggaacgaggcagcagaaataaagctgtccgtttcaagcgaagctttcgtgataccgagcagtacaggaagggcttccgctggtttgccgcccttctcgaccacctttttgttctcttcctcgaagtcgagcttgtccacctgatcgccccagagcaacgatgtgtcac

SEQ ID NO: 1157 - DNA, 4000 bp, Escherichia coli
  misc_feature (833)..(833): n is a, c, g, or t
  misc_feature (839)..(839): n is a, c, g, or t
  misc_feature (848)..(848): n is a, c, g, or t
  misc_feature (860)..(861): n is a, c, g, or t
  misc_feature (872)..(872): n is a, c, g, or t
  misc_feature (881)..(881): n is a, c, g, or t
  misc_feature (884)..(884): n is a, c, g, or t
  misc_feature (892)..(892): n is a, c, g, or t
  misc_feature (896)..(896): n is a, c, g, or t
  misc_feature (899)..(899): n is a, c, g, or t
  misc_feature (901)..(901): n is a, c, g, or t
  misc_feature (907)..(907): n is a, c, g, or t
  misc_feature (911)..(911): n is a, c, g, or t
  misc_feature (962)..(962): n is a, c, g, or t
  misc_feature (983)..(983): n is a, c, g, or t
  misc_feature (989)..(989): n is a, c, g, or t
  misc_feature (1001)..(1001): n is a, c, g, or t
  misc_feature (1004)..(1004): n is a, c, g, or t
  misc_feature (1064)..(1064): n is a, c, g, or t
  misc_feature (1096)..(1097): n is a, c, g, or t
  misc_feature (1139)..(1139): n is a, c, g, or t
  misc_feature (2190)..(2190): n is a, c, g, or t
  misc_feature (2358)..(2358): n is a, c, g, or t
  misc_feature (3334)..(3334): n is a, c, g, or t
gcgtcgctgcgggtcttgaagatgcgtacggcccagaggtatttgtctaatctgatcgcttccatttcgttttttcaattatatcgtacgggcaaaatccgatgtcgggaggctcggtggctccggcagattcggattttccgttgtgctgacgattcggggcaggatgtcggaacagagccgaagccggtagtgtgcggctgcgggttgtccgacggtcttcgaaccggaggtcggtagttgcatcgatccctcgggaacggcggtttcggtggggaagtgtcgcggactatttctcatagatgctttccgatttgggcatgtcgtgcgattgttcgtcgttctgtcggctgacgctcaagatcatgcccagggcgatagccgtgaagatcgtcgaggagccgccgcgtgagatgagcggcagggtttgtcccgtttcgggaatcaggtttaccgttaccatgatgtgcagcagcgcctggcaggtaatcaacagggccaatcccaggaccagcagacccggaaatgccgtgccgcaccgtcggaaaatttcgatggcacggaagaagatccacaggtagagcaacagcagcagcagcgccaggacgataccgtactcctcgacgaaaaaggcgtaggcgtaatcgctttccgggtggatcatctctacgcgcatggcgctctgtccggcgccttcgcccaggatgccgccgttgtggatggcgatcatcgaacgctcggtgtcggtcagctggtcgatcggcttttcggtttggggcttggtccagaggtcgatccaggtttccacgcggccgccggccgtttcgctgcgncccagnttcagcagnccggccagcatnncggcggcgaangccaggccnagnagtttcancagntcncngatccncacncgtccgataagcatcatcacccacgaggcgaagaagaccagcacggccgangaggtgtgggccgggaagatnactacncaggagagcagnacnggggccaggatgggccacgtgccctcgcgccagattttgcgctggtcggggcgcttccancgcagcgggttgagcgaggggatgatccgcannttgtcgatcacgctctgccggccggcgagctgccgggccagnaacagtacggtggcgaccttgagtgcttccgaaggctggaactggaaaggaccgagcggaatccagcgggcggcgccgttggtcgtggcgccgatgaaatagacggccagcgtcagcagaacgctgcctgcataggcgaccagcgccaggtggttgtatatccgggagttgatcttgtgtacgatgatgatcagcggaacgcagacgaaaaggatcagcagctgttggcgcaggaagtgggccgtcgaacgagccgtatgcgcatcgtaggccatcttcgccgtcgaggaatagaccaccagtacggaaatgacggccagtgccgcgataatgatccacagcaccttgtccccggcgaagagtttcatgccgggctcctgtccgggtgcgtcggtctgcacagtcgtaccctctgtgttcggattgccggccgttttctccgtctgtttttccgcttccatcttattatttcgcgtgttcggcgacccactgtttgaacagttcgccccggttttcgtaatttttgaagaggtcgaagctcgcacaggccggtgaaagcaacaccacgtcgcccggacgggaagctttgcgggccgcctgcatcgccgcgtcgagcgaatcggtcgaaatgatttcgggaattatgcccgtgaaactttcgaccagcttgcggttgtcgatgcccatgcagacgagcgtatgcactttttcgcgggcgaaccgcttgagcggctcgtagtcgttgcctttgtccgtaccgcctgcgatccagactacgggacgtttcatactctccagtgcgtaccacgtggaatcgacgttggtggctttcgagtcgttgatgtaggctacgccgccgatctctccggcgggttcgagccggtgttccaccggcgcgaagtcgtagatggagctgcggatgcgggtcggggatactccggccgcgagcgccgcgagcgccgccgccatagcattataagcgttgtgcagcccgggaatccgcattttggccgtgtcgatctccaccgactcccggccgaccgtcgcggtnaattttccgtccaggaggaacgcatcgcctgcgccgctcgccacggcgtttttggccgcgaaggggagctgcttcatccgcaggtcgtatttgggcaactgctgccagatcacctcgtcgtcgcccgaatagatgaagaagtcgcgcgaattctggttctgcgtaatncgcatcttggcatccacgtagttctggaaacagtagtcgtaacggtcgagatggtcgggcgtgatgttcgtcagcacgccgatatgggcgcggaaccggaacatgccgtcgagctggaacgagctcaactccagtacgtaccagtcgtaatcgccggtagcgaccgagtaggcgaaactctcgccgatgttgccgccgagggctacgttgtagccggcgtcgcgcaggatcttgtagatgagcgacgtagtagtcgtcttgccgttcgagccggtgacgcagatcgtccgggccttacccaggtagcggcccgcgaactccatttcggagatgaccggaatgcccgcttcgcggagtttgacgatcagcggcgccttgtccggaatgccgggcgacttgacgacctcgtccgccgcgaggatccgctcttcggagtggtgcccctcctcgtaggggacctgccactggtccagtttggctttgtagcggtcggcgatccgccccttgtcggagaggaaaacgtcgaatcctttcttcttggcgaggatcgcggagccgtagccgctgatgccgccgcccaggacaactatttttttcatggggttatcggattttaagcgttaccagggtaatggccgccagcagcagcgacacgatccagaaacgggtgacgatcttggtttcgaagaaaccctgtttctggtagtgatggtgcaggggggacatgagcagaatgcggcgtccttcgccgtatttgcgtttggtgtatttgaagtagctcacctgaagcatgaccgagaggctctcgaccaggaagatgccgcagagaaggggcagcagcagctccttgcggatgcagagagcgaagacggcgatgatgccgccgatggagagcgagccggtatcgcccatgaagatctgtgccgggaagctgttgtaccagaggaagccgaccagcgcaccggccagcgccgcngcgaagacgaccagttcgccgctgcccggaatgtacatgatgttcaggtagtcggcatagacgatgtgtccggagagataggccaggatgcccagcaccagtacgatcggggccgatacccccgtcaccaggccgtcgagtccgtccgtgaggttggcgccgttcgaaacggccgtgaccaccaggatcgccacgacgacgtagagaatccaagtgagggtgcggttgccgcccgtgagccagctgtaatcgaattcgttgtccttgacgaagggaatcgtggtctgggtcgtctgacggctctcggagctgacgatgcgccgctggatgtggtcggcgatggttcggccgtgttcgtcgaggtagatcgtttcgaccggttcggtcgtcttttcccggacgacgatgtcgggcgagaagcacatggtcgtacctacgataatgcccaggccgacctgtcccacgatcttgaaacgccctttgagcccctctttgtggtggcggaagactttgatgtagtcgtccagaaagccgatcagccccagccagatcgtcgaaaccagcatcagttggatatagacgttgtcgagctgtccgaaaagcagtacggggatgagaatggccagcaggatgattacgccgcccatcgtgggcgtgcctttcttc

SEQ ID NO: 1158 - DNA, 4000 bp, Escherichia coli
  misc_feature (2)..(3): n is a, c, g, or t
  misc_feature (5)..(10): n is a, c, g, or t
  misc_feature (12)..(12): n is a, c, g, or t
  misc_feature (14)..(16): n is a, c, g, or t
  misc_feature (18)..(19): n is a, c, g, or t
  misc_feature (21)..(21): n is a, c, g, or t
  misc_feature (24)..(24): n is a, c, g, or t
  misc_feature (26)..(26): n is a, c, g, or t
  misc_feature (28)..(33): n is a, c, g, or t
  misc_feature (35)..(35): n is a, c, g, or t
  misc_feature (37)..(37): n is a, c, g, or t
  misc_feature (39)..(40): n is a, c, g, or t
  misc_feature (42)..(42): n is a, c, g, or t
  misc_feature (44)..(44): n is a, c, g, or t
  misc_feature (46)..(46): n is a, c, g, or t
  misc_feature (48)..(49): n is a, c, g, or t
  misc_feature (52)..(52): n is a, c, g, or t
  misc_feature (54)..(54): n is a, c, g, or t
  misc_feature (57)..(57): n is a, c, g, or t
  misc_feature (61)..(63): n is a, c, g, or t
  misc_feature (65)..(72): n is a, c, g, or t
  misc_feature (74)..(75): n is a, c, g, or t
  misc_feature (77)..(77): n is a, c, g, or t
  misc_feature (81)..(82): n is a, c, g, or t
  misc_feature (85)..(85): n is a, c, g, or t
  misc_feature (90)..(90): n is a, c, g, or t
  misc_feature (96)..(96): n is a, c, g, or t
  misc_feature (101)..(102): n is a, c, g, or t
  misc_feature (104)..(105): n is a, c, g, or t
  misc_feature (110)..(112): n is a, c, g, or t
  misc_feature (114)..(116): n is a, c, g, or t
  misc_feature (118)..(118): n is a, c, g, or t
  misc_feature (120)..(124): n is a, c, g, or t
  misc_feature (126)..(128): n is a, c, g, or t
  misc_feature (131)..(131): n is a, c, g, or t
  misc_feature (133)..(133): n is a, c, g, or t
  misc_feature (136)..(142): n is a, c, g, or t
  misc_feature (144)..(144): n is a, c, g, or t
  misc_feature (147)..(147): n is a, c, g, or t
  misc_feature (149)..(149): n is a, c, g, or t
  misc_feature (151)..(153): n is a, c, g, or t
  misc_feature (155)..(159): n is a, c, g, or t
  misc_feature (161)..(161): n is a, c, g, or t
  misc_feature (163)..(163): n is a, c, g, or t
  misc_feature (165)..(166): n is a, c, g, or t
  misc_feature (169)..(169): n is a, c, g, or t
  misc_feature (173)..(174): n is a, c, g, or t
  misc_feature (176)..(181): n is a, c, g, or t
  misc_feature (183)..(183): n is a, c, g, or t
  misc_feature (186)..(186): n is a, c, g, or t
  misc_feature (191)..(191): n is a, c, g, or t
  misc_feature (193)..(196): n is a, c, g, or t
  misc_feature (198)..(198): n is a, c, g, or t
  misc_feature (201)..(202): n is a, c, g, or t
  misc_feature (205)..(205): n is a, c, g, or t
  misc_feature (207)..(207): n is a, c, g, or t
  misc_feature (209)..(209): n is a, c, g, or t
  misc_feature (211)..(211): n is a, c, g, or t
  misc_feature (213)..(213): n is a, c, g, or t
  misc_feature (219)..(219): n is a, c, g, or t
  misc_feature (221)..(221): n is a, c, g, or t
  misc_feature (223)..(224): n is a, c, g, or t
  misc_feature (227)..(230): n is a, c, g, or t
  misc_feature (234)..(234): n is a, c, g, or t
  misc_feature (236)..(236): n is a, c, g, or t
  misc_feature (238)..(242): n is a, c, g, or t
  misc_feature (244)..(245): n is a, c, g, or t
  misc_feature (247)..(247): n is a, c, g, or t
  misc_feature (249)..(249): n is a, c, g, or t
  misc_feature (254)..(254): n is a, c, g, or t
  misc_feature (257)..(257): n is a, c, g, or t
  misc_feature (259)..(259): n is a, c, g, or t
  misc_feature (261)..(261): n is a, c, g, or t
  misc_feature (264)..(264): n is a, c, g, or t
  misc_feature (266)..(267): n is a, c, g, or t
  misc_feature (269)..(269): n is a, c, g, or t
  misc_feature (271)..(272): n is a, c, g, or t
  misc_feature (274)..(274): n is a, c, g, or t
  misc_feature (277)..(277): n is a, c, g, or t
  misc_feature (279)..(279): n is a, c, g, or t
  misc_feature (281)..(282): n is a, c, g, or t
  misc_feature (286)..(287): n is a, c, g, or t
  misc_feature (289)..(289): n is a, c, g, or t
  misc_feature (292)..(292): n is a, c, g, or t
  misc_feature (294)..(294): n is a, c, g, or t
  misc_feature (296)..(297): n is a, c, g, or t
  misc_feature (299)..(302): n is a, c, g, or t
  misc_feature (304)..(306): n is a, c, g, or t
  misc_feature (310)..(311): n is a, c, g, or t
  misc_feature (313)..(314): n is a, c, g, or t
  misc_feature (316)..(316): n is a, c, g, or t
  misc_feature (319)..(319): n is a, c, g, or t
  misc_feature (324)..(324): n is a, c, g, or t
  misc_feature (328)..(329): n is a, c, g, or t
  misc_feature (336)..(337): n is a, c, g, or t
  misc_feature (339)..(339): n is a, c, g, or t
  misc_feature (341)..(346): n is a, c, g, or t
  misc_feature (348)..(348): n is a, c, g, or t
  misc_feature (351)..(352): n is a, c, g, or t
  misc_feature (354)..(355): n is a, c, g, or t
  misc_feature (357)..(357): n is a, c, g, or t
  misc_feature (361)..(362): n is a, c, g, or t
  misc_feature (372)..(372): n is a, c, g, or t
  misc_feature (375)..(375): n is a, c, g, or t
  misc_feature (378)..(378): n is a, c, g, or t
  misc_feature (380)..(383): n is a, c, g, or t
  misc_feature (387)..(388): n is a, c, g, or t
  misc_feature (392)..(393): n is a, c, g, or t
  misc_feature (395)..(396): n is a, c, g, or t
  misc_feature (398)..(398): n is a, c, g, or t
  misc_feature (400)..(402): n is a, c, g, or t
  misc_feature (404)..(404): n is a, c, g, or t
  misc_feature (408)..(408): n is a, c, g, or t
  misc_feature (417)..(419): n is a, c, g, or t
  misc_feature (422)..(424): n is a, c, g, or t
  misc_feature (429)..(429): n is a, c, g, or t
  misc_feature (433)..(438): n is a, c, g, or t
  misc_feature (442)..(442): n is a, c, g, or t
  misc_feature (444)..(445): n is a, c, g, or t
  misc_feature (447)..(447): n is a, c, g, or t
  misc_feature (450)..(450): n is a, c, g, or t
  misc_feature (453)..(453): n is a, c, g, or t
  misc_feature (455)..(455): n is a, c, g, or t
  misc_feature (458)..(458): n is a, c, g, or t
  misc_feature (460)..(460): n is a, c, g, or t
  misc_feature (463)..(464): n is a, c, g, or t
  misc_feature (469)..(472): n is a, c, g, or t
  misc_feature (476)..(479): n is a, c, g, or t
  misc_feature (481)..(484): n is a, c, g, or t
  misc_feature (486)..(487): n is a, c, g, or t
  misc_feature (491)..(493): n is a, c, g, or t
  misc_feature (497)..(498): n is a, c, g, or t
  misc_feature (500)..(504): n is a, c, g, or t
  misc_feature (506)..(506): n is a, c, g, or t
  misc_feature (508)..(510): n is a, c, g, or t
  misc_feature (512)..(512): n is a, c, g, or t
  misc_feature (514)..(518): n is a, c, g, or t
  misc_feature (520)..(520): n is a, c, g, or t
  misc_feature (523)..(523): n is a, c, g, or t
  misc_feature (526)..(527): n is a, c, g, or t
  misc_feature (529)..(529): n is a, c, g, or t
  misc_feature (532)..(533): n is a, c, g, or t
  misc_feature (536)..(536): n is a, c, g, or t
  misc_feature (540)..(540): n is a, c, g, or t
  misc_feature (543)..(546): n is a, c, g, or t
  misc_feature (551)..(552): n is a, c, g, or t
  misc_feature (555)..(557): n is a, c, g, or t
  misc_feature (561)..(561): n is a, c, g, or t
  misc_feature (563)..(566): n is a, c, g, or t
  misc_feature (570)..(571): n is a, c, g, or t
  misc_feature (573)..(573): n is a, c, g, or t
  misc_feature (577)..(579): n is a, c, g, or t
  misc_feature (582)..(582): n is a, c, g, or t
  misc_feature (586)..(586): n is a, c, g, or t
  misc_feature (588)..(588): n is a, c, g, or t
  misc_feature (590)..(597): n is a, c, g, or t
  misc_feature (600)..(601): n is a, c, g, or t
  misc_feature (603)..(603): n is a, c, g, or t
  misc_feature (606)..(606): n is a, c, g, or t
  misc_feature (608)..(608): n is a, c, g, or t
  misc_feature (610)..(610): n is a, c, g, or t
  misc_feature (612)..(613): n is a, c, g, or t
  misc_feature (616)..(616): n is a, c, g, or t
  misc_feature (618)..(618): n is a, c, g, or t
  misc_feature (620)..(620): n is a, c, g, or t
  misc_feature (624)..(625): n is a, c, g, or t
  misc_feature (627)..(627): n is a, c, g, or t
  misc_feature (629)..(629): n is a, c, g, or t
  misc_feature (631)..(631): n is a, c, g, or t
  misc_feature (633)..(634): n is a, c, g, or t
  misc_feature (643)..(643): n is a, c, g, or t
  misc_feature (646)..(647): n is a, c, g, or t
  misc_feature (649)..(651): n is a, c, g, or t
  misc_feature (654)..(658): n is a, c, g, or t
  misc_feature (666)..(667): n is a, c, g, or t
  misc_feature (669)..(669): n is a, c, g, or t
  misc_feature (673)..(674): n is a, c, g, or t
  misc_feature (676)..(676): n is a, c, g, or t
  misc_feature (682)..(682): n is a, c, g, or t
  misc_feature (684)..(684): n is a, c, g, or t
  misc_feature (686)..(687): n is a, c, g, or t
  misc_feature (690)..(694): n is a, c, g, or t
  misc_feature (705)..(706): n is a, c, g, or t
  misc_feature (709)..(710): n is a, c, g, or t
  misc_feature (1190)..(1190): n is a, c, g, or t
  misc_feature (1992)..(1994): n is a, c, g, or t
  misc_feature (1996)..(1996): n is a, c, g, or t
gnntnnnnnntngnnngnngngtnanannnnnncntncnntntngntnntgntnggntccnnntnnnnnnnngnngnttgnntgnagttnggtttnaaaannannttccnnncnnntngnnnnntnnncantnaannnnnnnantgntngnnngnnnnntngntnnttnaagnngnnnnnnangtnaaggntnnnntnganntancntncntnttgggntngnnggnnnnaaantnannnnngnnantnccttnttnancnacnannananncnaangnanntttnnanttncngnntnnnntnnnaaannanngnttnctttntttnncttcaanngnannnnnncnttnngnntnaaannctttttttcnttnggnannnnggannattnncnnangnnncnaccnccggatttnnnttnnngtttncaannnnnncccnanncnctnacngnaangnttnnatttnnnnattnnnncnnnntnntaannnggtnnannnnntnannnantnnnnntnccngtnntncannaantttngtnnnnggagnntannnaatnannnntttnngnattnnntcntttncntnnnnnnnnttnnanggnantnannccnananaatnncnantnannaaaaacaanttnntnnnatnnnnntaaaaaanntnttanngntatttnanannaannnnntcaaatttgtnnttnnaaaaataaacgatgtgtttattagtagttttaaaagaatcataaagaatctaattctgtgatgaaatatatagtgacgttatttccattcgatagtgacgatattccatagatatggtgacactatgttgagggcatagcgtcactatatttttatgagatttattttttcggaaattctcaaaattcccaaatcttttcagattttcccctcatctttgcaatataaattaaatgataacagtaaaaccaattaaaaaaacaacgattatgaaaaagttagtattcttattagtatgtttgtttactttgcaaacagtagcacgtgcagacgatgacaaaccaatccaggttactcaaatgccacaaccggctcaacagttcatcaaacagcattttgccgatagtaaagttgctttggcaaaaatggaaagtgatttcttctataaaagttatgaagtgattttcacgaatggcaatnaagtggagtttggcaagaatggaaactgggaggaggtgaattgcaaatatacttctgttcccacagctattatccccacaactattcagaaatatgtgacaactaattatcctgatactagagtgctgaaaattgaacgcgataaaaaggaatatgaagtgcaactttccaatcgtgtggaattaaagttcgatctgaaattcaatttgatcgatattgataactaaaccttaaaaaattagaactaatgatgaaacgaaagatttttacctttttattggtattaggtgttgcatggagcttacatagttgcgataataatgatgatgaatcaatagctgttcctgttgaattgcaaagtacattttcggctaaatatccgaatgccacaaacgtagaatgggaaaacaagtacggatattacgtagcagatttctatgacggacatgaagcatctgcatggtttactcaagaaggtaagtgggttttaacttcatgggaggtacatttcaacacattgcctgatcctgtaaaaaatacgattcatgctacatatcctggacgagttgatgacgacgacactgaatatgttgaagaagcaacgggtgctacatactacttgattgacatagaaaatagtgagatagatgtaaaaataagagctgacggacaaatacttgactaataattatacaataatcttattatggaacggtaacgaactattcatttatagtttcaggtagagtcaatcatgcgattattttttatgggtttcatgccttgaaaataagagtttccnnnanagaaactcttattttcaaggcatctgcgttttatcactgctcatgttgcctttttaatacagactttgctgtattggtatttccgatactgtctgtctgctgtttggacttttctttctgttttcgtttattacgtagcttccacttattccaaaagaacaggtcactccatttattgaaatctttcttgtacataatacctacaccttgtgtagtcagatttgtctttgtataatatcggtcgttcgtttcattgtaagctttcaaacgaatgtctcccgaacggtttatcagccattctgcttcaaagtcgcccacaaaattcgtgtttgccattggattatcccgataaccaaagtttccgttaataagtaaccggttattcagtaactgaccggacaagatgccttccacttccatatctgtccagcctttatcgcctgtgcttagatttgttccaatattccagttattcgtttcaaagacttgcgacaaggcgttattcaactgaccggagagggtggaagaaagtaccgaagacatcacgtttgaattttgattattacgtgcatcctccgtgtagaacttaccaatacccaatagataaaggatttgcatattcatctgttcttccgtactaatataattacgtaccaatgtttgtacttcatcccgttcgttcggaagctcaatacctaatttaatagtaggtcgtaccaatatcccgctcaaattcatgatacagttcaccttaacattgggttgttgtatgattgacgaagattcttccggtatcaggtcattcagagatgctgaatttaccgtgtaggaagcctgaatgtctaagtttgcatccagaggggcaccgttaaaggtaatcgtacttccgttcttgataacaaagtctttacggatcacttcctgcaaactgaatttatatactccctgattaatttggtagctaccgaacatcttcacatcccctttattgtaaaattctgttcgtatatttcctgtacccttgccactgatataatctccggcaacaggatccatgataatcttcattgttgcatctggcgtcgcatctacaagaatattcaatcgtatatccgtcttttgctcttcctcagcttcctgacgtttttgttgcaattgttcataataagaaattatttgaatagaatcctgaatagtgcggcggggagttttgtctacaaacttgataaactggttactcgtagctgatgcaacactaccattaatataagtaaagatgctatttcgattggtcgtcatggcgacattaacatctagtccctgtatggcatttccggtaagcaatgcatttccggtaccatacaccgtgccatagaaaggcatgtccgtcgattcttttgtattcattacaagcatgttgtttgcttgtatctcaaaacgataatttaagttcttaaaatgctggaaatgcagataaccgttcattcttcccgaatggccttccatatcagaaatatgtatattgttgaacgtcaatccggtaggagctaaaagaatggtatcctttatagcaaaatgagtattcaaaatatcaaaattcatggaagcatccgtcatgactgcgccatcgagattcaatcctttaaatttcccgtagaagtgtactttacccgttgcccgtccttttatatcatttgcaatagacttcatataatgttccagaaacttcagattcagttcatttgcttcgatatttaagtcaagcccactttccggttttagcggatgaatgatgccggtgacacgtgacggggtcgtagaaatatctttgatagatgcatccagtcggattcctctattttcattatcccattcgccatatatgttcaaatcgcccaaacgtccttgattaagagagaaattttttataaataaacgcgtattcatcacaggttttttgaaaacaccacttgcataggcagttcctgtagcatctccttcaaa

SEQ ID NO: 1159 - DNA, 4000 bp, Escherichia coli
  misc_feature (1)..(3): n is a, c, g, or t
  misc_feature (5)..(6): n is a, c, g, or t
  misc_feature (8)..(13): n is a, c, g, or t
  misc_feature (15)..(16): n is a, c, g, or t
  misc_feature (18)..(24): n is a, c, g, or t
  misc_feature (28)..(30): n is a, c, g, or t
  misc_feature (33)..(49): n is a, c, g, or t
  misc_feature (52)..(60): n is a, c, g, or t
  misc_feature (62)..(69): n is a, c, g, or t
  misc_feature (71)..(72): n is a, c, g, or t
  misc_feature (75)..(78): n is a, c, g, or t
  misc_feature (80)..(80): n is a, c, g, or t
  misc_feature (84)..(88): n is a, c, g, or t
  misc_feature (90)..(91): n is a, c, g, or t
  misc_feature (93)..(94): n is a, c, g, or t
  misc_feature (96)..(97): n is a, c, g, or t
  misc_feature (99)..(118): n is a, c, g, or t
  misc_feature (120)..(132): n is a, c, g, or t
  misc_feature (134)..(134): n is a, c, g, or t
  misc_feature (136)..(143): n is a, c, g, or t
  misc_feature (145)..(146): n is a, c, g, or t
  misc_feature (149)..(150): n is a, c, g, or t
  misc_feature (152)..(158): n is a, c, g, or t
  misc_feature (160)..(167): n is a, c, g, or t
  misc_feature (169)..(174): n is a, c, g, or t
  misc_feature (179)..(182): n is a, c, g, or t
  misc_feature (184)..(191): n is a, c, g, or t
  misc_feature (193)..(193): n is a, c, g, or t
  misc_feature (195)..(196): n is a, c, g, or t
  misc_feature (200)..(205): n is a, c, g, or t
  misc_feature (208)..(213): n is a, c, g, or t
  misc_feature (215)..(215): n is a, c, g, or t
  misc_feature (218)..(223): n is a, c, g, or t
  misc_feature (226)..(228): n is a, c, g, or t
  misc_feature (231)..(236): n is a, c, g, or t
  misc_feature (239)..(239): n is a, c, g, or t
  misc_feature (242)..(248): n is a, c, g, or t
  misc_feature (250)..(256): n is a, c, g, or t
  misc_feature (258)..(268): n is a, c, g, or t
  misc_feature (270)..(272): n is a, c, g, or t
  misc_feature (274)..(276): n is a, c, g, or t
  misc_feature (278)..(286): n is a, c, g, or t
  misc_feature (288)..(288): n is a, c, g, or t
  misc_feature (290)..(291): n is a, c, g, or t
  misc_feature (293)..(304): n is a, c, g, or t
  misc_feature (308)..(308): n is a, c, g, or t
  misc_feature (310)..(311): n is a, c, g, or t
  misc_feature (313)..(313): n is a, c, g, or t
  misc_feature (315)..(317): n is a, c, g, or t
  misc_feature (319)..(319): n is a, c, g, or t
  misc_feature (321)..(321): n is a, c, g, or t
  misc_feature (324)..(324): n is a, c, g, or t
  misc_feature (326)..(336): n is a, c, g, or t
  misc_feature (338)..(341): n is a, c, g, or t
  misc_feature (343)..(348): n is a, c, g, or t
  misc_feature (351)..(369): n is a, c, g, or t
  misc_feature (371)..(371): n is a, c, g, or t
  misc_feature (375)..(382): n is a, c, g, or t
  misc_feature (384)..(399): n is a, c, g, or t
  misc_feature (401)..(401): n is a, c, g, or t
  misc_feature (403)..(407): n is a, c, g, or t
  misc_feature (410)..(412): n is a, c, g, or t
  misc_feature (414)..(418): n is a, c, g, or t
  misc_feature (421)..(423): n is a, c, g, or t
  misc_feature (425)..(425): n is a, c, g, or t
  misc_feature (427)..(427): n is a, c, g, or t
  misc_feature (429)..(429): n is a, c, g, or t
  misc_feature (431)..(432): n is a, c, g, or t
  misc_feature (434)..(434): n is a, c, g, or t
  misc_feature (436)..(436): n is a, c, g, or t
  misc_feature (438)..(438): n is a, c, g, or t
  misc_feature (440)..(441): n is a, c, g, or t
  misc_feature (443)..(443): n is a, c, g, or t
  misc_feature (445)..(445): n is a, c, g, or t
  misc_feature (447)..(447): n is a, c, g, or t
  misc_feature (449)..(450): n is a, c, g, or t
  misc_feature (452)..(452): n is a, c, g, or t
  misc_feature (454)..(454): n is a, c, g, or t
  misc_feature (456)..(456): n is a, c, g, or t
  misc_feature (458)..(459): n is a, c, g, or t
  misc_feature (461)..(461): n is a, c, g, or t
  misc_feature (463)..(463): n is a, c, g, or t
  misc_feature (465)..(465): n is a, c, g, or t
  misc_feature (467)..(467): n is a, c, g, or t
  misc_feature (469)..(478): n is a, c, g, or t
  misc_feature (481)..(483): n is a, c, g, or t
  misc_feature (485)..(485): n is a, c, g, or t
  misc_feature (487)..(487): n is a, c, g, or t
  misc_feature (489)..(490): n is a, c, g, or t
  misc_feature (492)..(493): n is a, c, g, or t
  misc_feature (496)..(496): n is a, c, g, or t
  misc_feature (498)..(500): n is a, c, g, or t
  misc_feature (502)..(513): n is a, c, g, or t
  misc_feature (515)..(516): n is a, c, g, or t
  misc_feature (518)..(520): n is a, c, g, or t
  misc_feature (522)..(522): n is a, c, g, or t
  misc_feature (524)..(537): n is a, c, g, or t
  misc_feature (539)..(540): n is a, c, g, or t
  misc_feature (543)..(544): n is a, c, g, or t
  misc_feature (547)..(556): n is a, c, g, or t
  misc_feature (558)..(559): n is a, c, g, or t
  misc_feature (562)..(564): n is a, c, g, or t
  misc_feature (566)..(588): n is a, c, g, or t
  misc_feature (590)..(592): n is a, c, g, or t
  misc_feature (594)..(596): n is a, c, g, or t
  misc_feature (598)..(598): n is a, c, g, or t
  misc_feature (600)..(610): n is a, c, g, or t
  misc_feature (612)..(624): n is a, c, g, or t
  misc_feature (626)..(632): n is a, c, g, or t
  misc_feature (634)..(635): n is a, c, g, or t
  misc_feature (638)..(650): n is a, c, g, or t
  misc_feature (652)..(688): n is a, c, g, or t
  misc_feature (691)..(694): n is a, c, g, or t
  misc_feature (821)..(821): n is a, c, g, or t
  misc_feature (848)..(848): n is a, c, g, or t
  misc_feature (1427)..(1427): n is a, c, g, or t
  misc_feature (1686)..(1686): n is a, c, g, or t
  misc_feature (1976)..(1976): n is a, c, g, or t
  misc_feature (1991)..(1991): n is a, c, g, or t
  misc_feature (3578)..(3578): n is a, c, g, or t
  misc_feature (3659)..(3659): n is a, c, g, or t
  misc_feature (3758)..(3758): n is a, c, g, or t
  misc_feature (3788)..(3788): n is a, c, g, or t
  misc_feature (3809)..(3809): n is a, c, g, or t
nnncnngnnnnnngnngnnnnnnncgcnnncgnnnnnnnnnnnnnnnnncannnnnnnnngnnnnnnnncnngcnnnngncgannnnnanncnnanncnnnnnnnnnnnnnnnnnnnntnnnnnnnnnnnnncnannnnnnnncnnagnngnnnnnnnannnnnnnncnnnnnntgccnnnngnnnnnnnncnannatcnnnnnnccnnnnnncnccnnnnnncannncannnnnntcnggnnnnnnnannnnnnncnnnnnnnnnnngnnnannngnnnnnnnnncncnncnnnnnnnnnnnnggtncnngncnnncncngcncnnnnnnnnnnncnnnncnnnnnncgnnnnnnnnnnnnnnnnnnncngccnnnnnnnngnnnnnnnnnnnnnnnncngnnnnngcnnngnnnnngcnnngngngngnngngngngnngngngngnngngngngnngngngngngnnnnnnnnnngcnnntncntnncnnacntnnntnnnnnnnnnnnncnngnnncncnnnnnnnnnnnnnncnnacnnacnnnnnnnnnngnntgnnngnnnnnnnnnnnnnnnnnnnnnnngnnngnnngngnnnnnnnnnnncnnnnnnnnnnnnngnnnnnnntnnggnnnnnnnnnnnnngnnnnnnnnnnnnnnnnnnnnnnnnnnnnnnnnnnnnncgnnnntcgccctcctcgtatgcgcgtgtatgtgcgcacggtgtgccccaatcaccaaaaacatcgtaacgcgacaaatctaaattcacgagtgcgcgttgcgtcctatcctaaaacgcgcaccaacaactcngtggtgtagctgtaggttcccaggtanactgtgccgcctaatgccatgtaaacggttcgtggcagaacgccgcgccagaagccggcaaagccctcgacgcgcgcgagcgcgagcaccgtcttcgggagagagcgccgctcgcccggtttcaccgtccagagaacgtggcgcgtgcggatcacatcgaggggcgtcgtgaggaaggctgcgagcgcgccggcgcacgcgcctgcgagtgccccgtcaagggcgcgcggagaggcttcgacgccgtcggcgcgcgcgccgtgcgcgccgctgcccgtgcggaggcgcgagatgtggtgccggagcgcctcgtagagcgggaattggagcagcgcaaaaggcacatcgaggcaaagcgtcgcgccaagcccacgatagaaagtacagatgccgccctcggcccaggtcagacgcacggctccccaaagggagctgccgccgcccgcgcccgactgcatcttcatcttgatcagatcggcgggaacgcgaagcatgcagctcgatgcctcggcggtcgccgcagccacgcagcacgccgacgtcgagtcagaacctagccagttcttgacgccctcatangtgcagaagaaggcggcggcggaagggatggccggcaggacggccgcaccgataccgcgccaaagcgtgctcacctgtcgcaggcgctcgagcagcgtgccccgcatcgcgaacatcgggagcccttggatcgcccgagtcttgaacgtatccacaggatagagcgcgccatcgatggtcatcccagcgagaccaccagagagcaacgcgacgagctgtgacacctgctgcgactgctgcgacggcggcagcggcggcnacacgttcagtgacggcggtgctgcgggagattctgcagacgccttcgccgttgccgccgctaacggctcgagcacagcacaggcatcggcgctcgccagtggcagccgctgcagcgtgtctgcatgcgacggcggctgccgcgaagcaggcggcaactgcgacgacggcgggcgcgcgaggccagcagccaaactgaatgccttccacgaagtctgtgcatcggcgcccgatgggctctgcaccgtgagcagcagtgtcctcagcacggcctcatacacaccaaaaaanatgtaaccgcccaangccatccagccgacgcgcggcacgaagcccgagaagagcgcactcacgccgtgcatgcgcacgatctcctcgatctcgcgcagcagcccatggcgcgagtgcccgagcattcggcgcgtcttgagcacgtcgagcggcgtggtgaccgccgcggcgaccgagcccgcgaccgagccgcagagggcaccctgcgagggtgtgacgtcgccgcccgctccgacgagccgtttgagctgctcatagatcgggaactggatgaaagcgaaggggatctcgcgcgcgatggagatgctcagcccactgtaaaaggccaacggaccgccctcgagcgcgatgccgcggatggcggcgcgcaagccggaaaactggccaacctgcatccgctgctgcacgacaacggccggattgcgcagtacgctgctcgacgtcgcgccgatgcacgcggccgtcgcgtccatcatccagtgtggcacttggtgacgctcgctggccggctgccgctgtatcagcaccgagcgtgcgaactcatacgtgccaaagaagagggcgcctccgggagcggcgcccgcagcggcggcggtcacgccggagtagaggttgcggtagccgccggccgcgcgaaaaccgagtggtgattgcaacctcgtcttgatcgtgtccagcgggaagatggccacgtccacggccgacgaagcgcatccaccggcgagcaccgcaatcgcgaaggaaggggcatccactcccttcatgggagacccagtgccaaaccagcccgtgccggtgctgcccgacgtggaggcatccggccgacgtataacatcgacaaactcgggctccatctgagttcgacgcaggcgtcgccgtgccagacgagatggagtgcaagaggagttgagagatttcaaacaggccttgctttttcgtccgaggtgtgaatgcaaaacatcaaaaactgcgccggaccctccctgcactcccaacacaccagctacccccgagaccctacagtgaccactcatgtaaagcgtagatgtgcctattcgtcatcaagatttgcgcagtgatgttatggacccccaatgtgctcgtcatcttaagacctccccatacacgtgagccattcgctcaccatgcatgatcttcttgggtcacccgcctgcctgccccctttccgctcaattcttgcgctcgtgggccgggatgaagtcggacatgtccttggcgcacacatacaacgtgtggaagtacttgaagaactcgtccttgctcagccagaagatgccatcgtcggccacgaccggcttcaggaacgccttgacctgggggtacttttcccagccggggccgtcgtcatcaaactcaccattctcgatctcgcccttgccccaaggattgcgcatcttgatgaggtcgacgtccgtgccagccacgtcgttgacgcactcgagcaccgtgtacgcatgcccatcgacgatgccgtcggtggactgcgtgtccgagcccgccttcgtgcccgcggcgatgacgaagttggcgtcgtcccacgcgcacatgcgcatgaagagctcctcctcgtcgagctggagngtatagctgccgccgccgccgaccttgggccacgcgctcggccagagcccgcggaagcccttttgcggcgagttctcgagngcctcccacctcctctcgttggggttgaacttgctcaggcagccaaacttgccagtcttgcctttgcgaatggtgtactgctccttgcagcccgtgagnatgctccacgcgtgcgtgcactggccgccntcgatctcgtcccagccgccncagtggatcgcgaccgccttctcgaggtagcacacccacagctcgccatcgtggctgggcgagcatccaaggagcccgtcgcccgtcgccttggccgcaaggcgctcgtcgaccaccacgtcgacctccgtccaggtcgcgaggtcccacagcgagatcgtgtacttgttcgggccctccctgggcatgct

SEQ ID NO: 1160 - DNA, 4000 bp, Escherichia coli
  misc_feature (10)..(10): n is a, c, g, or t
  misc_feature (349)..(349): n is a, c, g, or t
  misc_feature (971)..(971): n is a, c, g, or t
  misc_feature (1224)..(1225): n is a, c, g, or t
  misc_feature (1987)..(1988): n is a, c, g, or t
  misc_feature (1990)..(1990): n is a, c, g, or t
  misc_feature (1993)..(1993): n is a, c, g, or t
  misc_feature (2045)..(2045): n is a, c, g, or t
  misc_feature (3202)..(3202): n is a, c, g, or t
  misc_feature (3580)..(3580): n is a, c, g, or t
  misc_feature (3967)..(3967): n is a, c, g, or t
tccgtctttntgcggtatccacaagggcgtactcccgtacttctcggtaaattccgccgacgggtcccacacggccccgaaataatgcataggtatcaagcataagtctacttttacttgatttaaaaaggctgaaacaccccattcacgagtacggcccaagcgtgcgtctacaggaaaaaaggccaaatccgtttcaccgatatccagtcgactcatttcccgtgcaaacagtttatccgcttctcgtctgtcagcttcagtatctccgtcccaatgccagtgattcaaatctccggcatgaaaaattcgtaacccgtccgtttctacataaaaggagcctccttcntcggtagagccgaactcatgcacatatacattatcttcacgccactcttcataaggcctcagaacgactgtttttttgtccttccacgccgataacggtacggttgcatccgtaatacgtcgagccgtcacatccgaaaaattgactatatacggattgaagtgatcggcatgactatggctgacaaaaaaccaaaaaggcttttcccctgcctgtaatctcggcaataccttttccggatccttataataatcaaaaatcagtaccttcgtatccgtttcgactgcaaaaccgctatggttcaaataatacactttcacaaaagtcattaattcctccggcatcaaaatagtacctgctactatcactatattataacaatcagaatgtaaagactcaacacctatgcccattccggtacatgagagtttgtcgacgtttctcgttgggaatatatctaaaaacacccctcccgaaaaaagcttcggaaatttttatttataaaaatacagtctgaaccaataccatatagcacaaggtaccgacaaacatgctgataagaaagtttttcttatataaatgaaccccaacggttacaatcagtgccagcccttcaggaatnccgtttggccaagtcataagactgacgtccttcaacgcataaacgaccaacatccccataacggcggccggcaacacctctcctaaatacgtaacgacatcaggcaacttcccgtcccgtttatgggcaaaaagtaaaaagggcgagaaccgtgtaacccaggtaccgaaagccactataaagattgtccacatcatctgttcactagtcatcatgagcaatcccccctaagcggtaacgtagtaaaaacacnnaaagtatacccgccatagccggtatcagaaaggaagcgggaccgcatatgaatagggctaccaaggtaatagccagccccataataccgcattttgccgatttggagcggcacagatccaaaaaaagaacaacaaacatagctgtcaacacaaatccaatccccttaagcggcaaaaaggtcagtgtacttccggctatagaaccgattaaaacacccataaaccaatatgcctgattcagcaatgtaacccaaaaataaaaccaaccttcatcaatattttcagggacctccgtagttacattaacagcaaagctttcatcacacatcccataaatgaggtacggtgttttccaaccttttcccctatacttaccgagcatcgtgatcgcgtaaaataaatgcctaccatttaccataagagccataataaaggctcccacgggatcaaagggttgaaataacagcgtcactgtaataaattccatagacccggcaaaaataagcaaacacataataagggggtaccctaaaggtagcccctgtgaaacggtaaataacccgtacgtaaggccaataaataaaaaaccggcagcaataggcacagttagtggaaaggcaaatcgtaatgcccgtaaaacagtttgtgacaacatgattgtctccttccattactttataagatataacgtacatcaaaaatcaggctaaatcaatagatatacaaactaccatagcataggagaaaatcataaatatactnnanttntgaaaatatattttattcttgacaattcttataacgacgtatagaattacanttaatttcacaagtacatgcaatgaccgaaacaagtacacatatgtacgggtcacacagagagtatcggccaccggctgaaaaccgatacagcagcccacttatgtcgaatgccttcgggagcaggattatcgaacaacagtagatagtcccgtatgactgacgttacaagtccttgagtggtaatcaatatatgattacaatcagagtggaaccgcggattcgacgtctctgtgagacgacgggtctttttttatacccttttatcaggaggttgtactacgtgttttcaagattacgtaaagatattcaagtaatcaaagatcgagatccggctgctaaaaacgtggcggaaatcttgctttgttacgccggtctgcacgcaatttgggcacacagactctctcattttttttaccgtcacggttattttgttacggctcgccttatttccaacatagcccgcttctttacaggcatcgaaatccatcccggtgcccgcatcggcgaaggacttttcatcgatcacggtacaggcattgtcattggagaaacaacgattatcggcaataatgtatcactctaccagggggttaccctcggcggcacaggtaaggaaaaggggaaacggcacccgaccatagaagacggtgtggtcgttgccagcggagccaaggttctcggttcttttaccgtcggagaaggctcaaaaataggtgccggctcggtcgtcttaagagaggttccgccatattcgacagtcgtcggcattccggggcatatcgtttcacagcggggcaagcgaattcgccgagtacttacggaacaggatattgacttggatcataccagtcttcccgatccgttggaagaggaaattgccgagctgaagcaacaagtgtgctttttacaaaagcgcctgaatgatttggactcatggaactccaacgttcgtcataatacggcacatcaccaatagtgccgatcgtattgcaaggggggaagcgataactatggaacaactatttgaaaaatttattctctgtaagcgatgttgtcgcctcataggcagagaataattaactatatttcgctaagatataaaaggagacatttatcatgacaaaaatagctacttctacattagatttaatcggncgtacacccttactcgaaccgcaacgttataacaaacaaactcaaagccttgccagaattcttgttaaagccgaagcttttaatccggcgggctccgtaaaagaccgtattgccaagggcatggttgaagcggctgaaaaagaaggtctgctaaaagaaggctccgtaatcattgaaccgactagtggtaacacgggtatcggtttagcggccgtcgcagcggctaagggctaccgcatcattttgaccatgccggaaaccatgtcggccgaacgccgtaaactcatgtccgcttacggcgccgaaatcgtacttacgcccggttctacaggaatgcagggggctgtcgacaaggccgcagaattggcaaaagaaatncccggatcctttattcccggccagtttaccaatcccgtaaatcctcaggttcattttgaaacaacaggtccggaaatttatgaagatactgacggaaaggtagatatcttcattgccggtgtcggtacaggcggtaccttatcaggtaccggtaagtacttaaagagcaaaaatcccgccgtcaaagtcgttgccgtcgaaccgaccggttcgcctctactttccgaaggccatgccggccctcataagattcaaggtatcggtgccaacttcattcccgataccttagatacaaaaatttatgacgaaatagttacggtcgacaatgatgcggctttcaaaacggctcaagcatttattaaagcggaaggcttcctcatcggcatntccggcggggcagccgtatatgccgcaaccgaa

SEQ ID NO: 1161 - DNA, 4000 bp, Escherichia coli
  misc_feature (1)..(1): n is a, c, g, or t
  misc_feature (3)..(7): n is a, c, g, or t
  misc_feature (9)..(12): n is a, c, g, or t
  misc_feature (14)..(17): n is a, c, g, or t
  misc_feature (19)..(24): n is a, c, g, or t
  misc_feature (26)..(35): n is a, c, g, or t
  misc_feature (37)..(40): n is a, c, g, or t
  misc_feature (42)..(49): n is a, c, g, or t
  misc_feature (51)..(56): n is a, c, g, or t
  misc_feature (58)..(63): n is a, c, g, or t
  misc_feature (66)..(68): n is a, c, g, or t
  misc_feature (70)..(71): n is a, c, g, or t
  misc_feature (73)..(75): n is a, c, g, or t
  misc_feature (78)..(83): n is a, c, g, or t
  misc_feature (86)..(104): n is a, c, g, or t
  misc_feature (106)..(112): n is a, c, g, or t
  misc_feature (114)..(130): n is a, c, g, or t
  misc_feature (132)..(150): n is a, c, g, or t
  misc_feature (153)..(167): n is a, c, g, or t
  misc_feature (169)..(170): n is a, c, g, or t
  misc_feature (172)..(174): n is a, c, g, or t
  misc_feature (176)..(177): n is a, c, g, or t
  misc_feature (179)..(191): n is a, c, g, or t
  misc_feature (193)..(200): n is a, c, g, or t
  misc_feature (203)..(206): n is a, c, g, or t
  misc_feature (208)..(217): n is a, c, g, or t
  misc_feature (219)..(224): n is a, c, g, or t
  misc_feature (227)..(249): n is a, c, g, or t
  misc_feature (251)..(251): n is a, c, g, or t
  misc_feature (253)..(254): n is a, c, g, or t
  misc_feature (256)..(259): n is a, c, g, or t
  misc_feature (261)..(267): n is a, c, g, or t
  misc_feature (271)..(271): n is a, c, g, or t
  misc_feature (273)..(279): n is a, c, g, or t
  misc_feature (281)..(287): n is a, c, g, or t
  misc_feature (289)..(291): n is a, c, g, or t
  misc_feature (293)..(296): n is a, c, g, or t
  misc_feature (298)..(302): n is a, c, g, or t
  misc_feature (304)..(305): n is a, c, g, or t
  misc_feature (308)..(316): n is a, c, g, or t
  misc_feature (318)..(326): n is a, c, g, or t
  misc_feature (328)..(330): n is a, c, g, or t
  misc_feature (333)..(336): n is a, c, g, or t
  misc_feature (339)..(340): n is a, c, g, or t
  misc_feature (344)..(345): n is a, c, g, or t
  misc_feature (347)..(349): n is a, c, g, or t
  misc_feature (352)..(356): n is a, c, g, or t
  misc_feature (358)..(358): n is a, c, g, or t
  misc_feature (360)..(369): n is a, c, g, or t
  misc_feature (371)..(373): n is a, c, g, or t
  misc_feature (377)..(381): n is a, c, g, or t
  misc_feature (383)..(389): n is a, c, g, or t
  misc_feature (392)..(395): n is a, c, g, or t
  misc_feature (397)..(399): n is a, c, g, or t
  misc_feature (401)..(402): n is a, c, g, or t
  misc_feature (405)..(411): n is a, c, g, or t
  misc_feature (413)..(420): n is a, c, g, or t
  misc_feature (423)..(427): n is a, c, g, or t
  misc_feature (430)..(432): n is a, c, g, or t
  misc_feature (435)..(438): n is a, c, g, or t
  misc_feature (440)..(441): n is a, c, g, or t
  misc_feature (443)..(444): n is a, c, g, or t
  misc_feature (451)..(453): n is a, c, g, or t
  misc_feature (455)..(462): n is a, c, g, or t
  misc_feature (464)..(466): n is a, c, g, or t
  misc_feature (468)..(472): n is a, c, g, or t
  misc_feature (474)..(476): n is a, c, g, or t
  misc_feature (478)..(479): n is a, c, g, or t
  misc_feature (482)..(485): n is a, c, g, or t
  misc_feature (489)..(490): n is a, c, g, or t
  misc_feature (492)..(493): n is a, c, g, or t
  misc_feature (496)..(496): n is a, c, g, or t
  misc_feature (499)..(502): n is a, c, g, or t
  misc_feature (504)..(505): n is a, c, g, or t
  misc_feature (507)..(512): n is a, c, g, or t
  misc_feature (514)..(517): n is a, c, g, or t
  misc_feature (520)..(520): n is a, c, g, or t
  misc_feature (523)..(524): n is a, c, g, or t
  misc_feature (526)..(526): n is a, c, g, or t
  misc_feature (530)..(531): n is a, c, g, or t
  misc_feature (534)..(537): n is a, c, g, or t
  misc_feature (540)..(541): n is a, c, g, or t
  misc_feature (544)..(548): n is a, c, g, or t
  misc_feature (550)..(559): n is a, c, g, or t
  misc_feature (561)..(565): n is a, c, g, or t
  misc_feature (568)..(569): n is a, c, g, or t
  misc_feature (571)..(571): n is a, c, g, or t
  misc_feature (573)..(581): n is a, c, g, or t
  misc_feature (583)..(584): n is a, c, g, or t
  misc_feature (586)..(596): n is a, c, g, or t
  misc_feature (598)..(600): n is a, c, g, or t
  misc_feature (603)..(607): n is a, c, g, or t
  misc_feature (609)..(609): n is a, c, g, or t
  misc_feature (611)..(612): n is a, c, g, or t
  misc_feature (616)..(626): n is a, c, g, or t
  misc_feature (628)..(630): n is a, c, g, or t
  misc_feature (634)..(635): n is a, c, g, or t
  misc_feature (638)..(641): n is a, c, g, or t
  misc_feature (643)..(644): n is a, c, g, or t
  misc_feature (646)..(651): n is a, c, g, or t
  misc_feature (653)..(654): n is a, c, g, or t
  misc_feature (657)..(661): n is a, c, g, or t
  misc_feature (663)..(668): n is a, c, g, or t
  misc_feature (671)..(674): n is a, c, g, or t
  misc_feature (677)..(682): n is a, c, g, or t
  misc_feature (684)..(684): n is a, c, g, or t
  misc_feature (686)..(689): n is a, c, g, or t
  misc_feature (692)..(697): n is a, c, g, or t
  misc_feature (699)..(699): n is a, c, g, or t
  misc_feature (701)..(701): n is a, c, g, or t
  misc_feature (704)..(710): n is a, c, g, or t
  misc_feature (715)..(716): n is a, c, g, or t
  misc_feature (718)..(723): n is a, c, g, or t
  misc_feature (725)..(727): n is a, c, g, or t
  misc_feature (729)..(733): n is a, c, g, or t
  misc_feature (736)..(737): n is a, c, g, or t
  misc_feature (739)..(743): n is a, c, g, or t
  misc_feature (746)..(746): n is a, c, g, or t
  misc_feature (751)..(751): n is a, c, g, or t
  misc_feature (753)..(753): n is a, c, g, or t
  misc_feature (755)..(758): n is a, c, g, or t
  misc_feature (760)..(760): n is a, c, g, or t
  misc_feature (763)..(763): n is a, c, g, or t
  misc_feature (765)..(771): n is a, c, g, or t
  misc_feature (773)..(773): n is a, c, g, or t
  misc_feature (775)..(784): n is a, c, g, or t
  misc_feature (786)..(788): n is a, c, g, or t
  misc_feature (790)..(793): n is a, c, g, or t
  misc_feature (795)..(799): n is a, c, g, or t
  misc_feature (801)..(802): n is a, c, g, or t
  misc_feature (807)..(807): n is a, c, g, or t
  misc_feature (811)..(818): n is a, c, g, or t
  misc_feature (820)..(820): n is a, c, g, or t
  misc_feature (822)..(822): n is a, c, g, or t
  misc_feature (825)..(825): n is a, c, g, or t
  misc_feature (827)..(827): n is a, c, g, or t
  misc_feature (829)..(830): n is a, c, g, or t
  misc_feature (833)..(835): n is a, c, g, or t
  misc_feature (838)..(844): n is a, c, g, or t
  misc_feature (847)..(847): n is a, c, g, or t
  misc_feature (849)..(850): n is a, c, g, or t
  misc_feature (853)..(860): n is a, c, g, or t
  misc_feature (862)..(865): n is a, c, g, or t
  misc_feature (867)..(868): n is a, c, g, or t
  misc_feature (870)..(870): n is a, c, g, or t
  misc_feature (873)..(885): n is a, c, g, or t
  misc_feature (887)..(889): n is a, c, g, or t
  misc_feature (891)..(891): n is a, c, g, or t
  misc_feature (893)..(902): n is a, c, g, or t
  misc_feature (905)..(905): n is a, c, g, or t
  misc_feature (907)..(907): n is a, c, g, or t
  misc_feature (909)..(916): n is a, c, g, or t
  misc_feature (919)..(924): n is a, c, g, or t
  misc_feature (926)..(927): n is a, c, g, or t
  misc_feature (929)..(934): n is a, c, g, or t
  misc_feature (937)..(938): n is a, c, g, or t
  misc_feature (940)..(940): n is a, c, g, or t
  misc_feature (943)..(946): n is a, c, g, or t
  misc_feature (948)..(948): n is a, c, g, or t
  misc_feature (951)..(959): n is a, c, g, or t
  misc_feature (962)..(964): n is a, c, g, or t
  misc_feature (966)..(982): n is a, c, g, or t
  misc_feature (984)..(986): n is a, c, g, or t
  misc_feature (988)..(996): n is a, c, g, or t
  misc_feature (998)..(1000): n is a, c, g, or t
  misc_feature (1003)..(1005): n is a, c, g, or t
  misc_feature (1007)..(1007): n is a, c, g, or t
  misc_feature (1009)..(1009): n is a, c, g, or t
  misc_feature (1012)..(1015): n is a, c, g, or t
  misc_feature (1017)..(1020): n is a, c, g, or t
  misc_feature (1022)..(1037): n is a, c, g, or t
  misc_feature (1041)..(1043): n is a, c, g, or t
  misc_feature (1046)..(1046): n is a, c, g, or t
  misc_feature (1048)..(1049): n is a, c, g, or t
  misc_feature (1053)..(1055): n is a, c, g, or t
  misc_feature (1058)..(1058): n is a, c, g, or t
  misc_feature (1061)..(1062): n is a, c, g, or t
  misc_feature (1065)..(1066): n is a, c, g, or t
  misc_feature (1068)..(1068): n is a, c, g, or t
  misc_feature (1071)..(1088): n is a, c, g, or t
  misc_feature (1091)..(1094): n is a, c, g, or t
  misc_feature (1096)..(1096): n is a, c, g, or t
  misc_feature (1099)..(1099): n is a, c, g, or t
  misc_feature (1101)..(1107): n is a, c, g, or t
  misc_feature (1110)..(1115): n is a, c, g, or t
  misc_feature (1117)..(1119): n is a, c, g, or t
  misc_feature (1121)..(1122): n is a, c, g, or t
  misc_feature (1125)..(1126): n is a, c, g, or t
  misc_feature (1128)..(1128): n is a, c, g, or t
  misc_feature (1131)..(1131): n is a, c, g, or t
  misc_feature (1133)..(1135): n is a, c, g, or t
  misc_feature (1137)..(1138): n is a, c, g, or t
  misc_feature (1140)..(1142): n is a, c, g, or t
  misc_feature (1144)..(1151): n is a, c, g, or t
  misc_feature (1153)..(1155): n is a, c, g, or t
  misc_feature (1157)..(1161): n is a, c, g, or t
  misc_feature (1163)..(1163): n is a, c, g, or t
  misc_feature (1165)..(1167): n is a, c, g, or t
  misc_feature (1169)..(1174): n is a, c, g, or t
  misc_feature (1176)..(1178): n is a, c, g, or t
  misc_feature (1181)..(1182): n is a, c, g, or t
  misc_feature (1184)..(1187): n is a, c, g, or t
  misc_feature (1189)..(1190): n is a, c, g, or t
  misc_feature (1195)..(1195): n is a, c, g, or t
  misc_feature (1197)..(1202): n is a, c, g, or t
  misc_feature (1204)..(1217): n is a, c, g, or t
  misc_feature (1220)..(1229): n is a, c, g, or t
  misc_feature (1231)..(1234): n is a, c, g, or t
  misc_feature (1238)..(1238): n is a, c, g, or t
  misc_feature (1240)..(1240): n is a, c, g, or t
  misc_feature (1242)..(1249): n is a, c, g, or t
  misc_feature (1251)..(1251): n is a, c, g, or t
  misc_feature (1253)..(1253): n is a, c, g, or t
  misc_feature (1258)..(1264): n is a, c, g, or t
  misc_feature (1267)..(1268): n is a, c, g, or t
  misc_feature (1271)..(1272): n is a, c, g, or t
  misc_feature (1275)..(1278): n is a, c, g, or t
  misc_feature (1280)..(1289): n is a, c, g, or t
  misc_feature (1291)..(1296): n is a, c, g, or t
  misc_feature (1298)..(1307): n is a, c, g, or t
  misc_feature (1309)..(1312): n is a, c, g, or t
  misc_feature (1314)..(1316): n is a, c, g, or t
  misc_feature (1318)..(1320): n is a, c, g, or t
  misc_feature (1323)..(1327): n is a, c, g, or t
  misc_feature (1330)..(1331): n is a, c, g, or t
  misc_feature (1333)..(1334): n is a, c, g, or t
  misc_feature (1336)..(1341): n is a, c, g, or t
  misc_feature (1343)..(1344): n is a, c, g, or t
  misc_feature (1347)..(1349): n is a, c, g, or t
  misc_feature (1351)..(1351): n is a, c, g, or t
  misc_feature (1353)..(1354): n is a, c, g, or t
  misc_feature (1356)..(1362): n is a, c, g, or t
  misc_feature (1364)..(1367): n is a, c, g, or t
  misc_feature (1371)..(1371): n is a, c, g, or t
  misc_feature (1374)..(1374): n is a, c, g, or t
  misc_feature (1380)..(1382): n is a, c, g, or t
  misc_feature (1384)..(1385): n is a, c, g, or t
  misc_feature (1389)..(1389): n is a, c, g, or t
  misc_feature (1395)..(1395): n is a, c, g, or t
  misc_feature (1400)..(1400): n is a, c, g, or t
  misc_feature (1404)..(1406): n is a, c, g, or t
  misc_feature (1408)..(1408): n is a, c, g, or t
  misc_feature (1410)..(1410): n is a, c, g, or t
  misc_feature (1412)..(1412): n is a, c, g, or t
  misc_feature (1414)..(1414): n is a, c, g, or t
  misc_feature (1425)..(1428): n is a, c, g, or t
  misc_feature (1430)..(1437): n is a, c, g, or t
  misc_feature (1439)..(1440): n is a, c, g, or t
  misc_feature (1443)..(1443): n is a, c, g, or t
  misc_feature (1448)..(1448): n is a, c, g, or t
  misc_feature (1454)..(1454): n is a, c, g, or t
  misc_feature (1456)..(1456): n is a, c, g, or t
  misc_feature (1474)..(1475): n is a, c, g, or t
  misc_feature (1487)..(1489): n is a, c, g, or t
  misc_feature (1497)..(1497): n is a, c, g, or t
  misc_feature (1517)..(1517): n is a, c, g, or t
  misc_feature (1520)..(1520): n is a, c, g, or t
  misc_feature (1523)..(1523): n is a, c, g, or t
  misc_feature (1535)..(1535): n is a, c, g, or t
  misc_feature (1544)..(1544): n is a, c, g, or t
  misc_feature (1566)..(1567): n is a, c, g, or t
  misc_feature (1577)..(1577): n is a, c, g, or t
  misc_feature (1579)..(1579): n is a, c, g, or t
  misc_feature (1583)..(1584): n is a, c, g, or t
  misc_feature (1589)..(1589): n is a, c, g, or t
  misc_feature (1598)..(1598): n is a, c, g, or t
  misc_feature (1648)..(1648): n is a, c, g, or t
  misc_feature (1733)..(1733): n is a, c, g, or t
  misc_feature (1745)..(1745): n is a, c, g, or t
  misc_feature (1822)..(1822): n is a, c, g, or t
  misc_feature (1836)..(1836): n is a, c, g, or t
  misc_feature (1853)..(1853): n is a, c, g, or t
  misc_feature (1865)..(1865): n is a, c, g, or t
  misc_feature (1871)..(1871): n is a, c, g, or t
  misc_feature (1967)..(1967): n is a, c, g, or t
  misc_feature (1994)..(1994): n is a, c, g, or t
  misc_feature (2478)..(2478): n is a, c, g, or t
  misc_feature (3461)..(3461): n is a, c, g, or t
  misc_feature (3575)..(3575): n is a, c, g, or t
nannnnngnnnnannnnannnnnncnnnnnnnnnncnnnngnnnnnnnngnnnnnnannnnnncannncnnannncannnnnntcnnnnnnnnnnnnnnnnnnngnnnnnnnannnnnnnnnnnnnnnnncnnnnnnnnnnnnnnnnnnngannnnnnnnnnnnnnnanntnnncnnannnnnnnnnnnnnannnnnnnnggnnnngnnnnnnnnnngnnnnnnagnnnnnnnnnnnnnnnnnnnnnnnangnntnnnntnnnnnnncaanannnnnnncnnnnnnngnnnannnntnnnnngnnaannnnnnnnngnnnnnnnnnannnttnnnnaanngttnntnnnaannnnnanannnnnnnnnnannntttnnnnnannnnnnnggnnnncnnnannccnnnnnnntnnnnnnnngannnnnaannnaannnnanncnnaattaannnannnnnnnncnnntnnnnngnnnanngcnnnncaanncnncgnaannnnannannnnnncnnnncantgnntnagcnnacnnnncgnngcnnnnnannnnnnnnnncnnnnnaannanannnnnnnnntnngnnnnnnnnnnntnnnttnnnnntnannccannnnnnnnnnnannncacnncannnnanngnnnnnngnnaannnnntnnnnnnggnnnnaannnnnnancnnnncannnnnnanancannnnnnnggcgnngnnnnnncnnnannnnnggnntnnnnnaanaaaangncnnnncnttncnnnnnnngntnnnnnnnnnnannnannnnannnnnannagaanaaannnnnnnngngnggngngnngannngannnnnnnaanannaannnnnnnncnnnncnngnaannnnnnnnnnnnncnnnanannnnnnnnnnccncncnnnnnnnnctnnnnnncnnannnnnnccnnanccnnnncnctnnnnnnnnnggnnngnnnnnnnnnnnnnnnnnannngnnnnnnnnnannngannngngnagnnnngnnnngnnnnnnnnnnnnnnnnaagnnnggnanngaannnggnttnnatnncntgnnnnnnnnnnnnnnnnnnccnnnncnaancnnnnnnncgnnnnnntnnnannggnngnccnannngnnannngnnnnnnnncnnncnnnnngntnnnannnnnngnnnggnngnnnnannaaacnannnnnncnnnnnnnnnnnnnntcnnnnnnnnnncnnnncggnangnnnnnnnncngngcggnnnnnnnaannaannaannnnannnnnnnnnngnnnnnntnnnnnnnnnnannnncnnngnnnagnnnnncgnnannannnnnntnnaannnancnngnnnnnnngnnnncccnggntttttnnncnncccncccccnagggngggnnncnancncnctcttgagcannnntnnnnnnnntnnccnagaanaaatancngaagagaatctgaaatcnngagggaatcaannngagaaatnttgtctggctcatgcacgtntcnctngatggttttgtngcgggtccnaatggagaaattgactgggtcnnttttgacgangncctnntcgangatgtccangctctggtagactcagctgacacggctctttttggacgagtgacctatcngctcatggaaagctactggccgactgcagcggatagtccgacagcgtcgaagcatgatcttgaccattcacgatggctcaatccngcacccaagatngtattctccagaactctgaaaaacgttcattggcagaatacgaggattgtcaaagatcatatcggcgaagaaattgntagactgcggaaanagcctggcaagaacctnatactattcgcnagcccnacgcttgggtcaacgttcatgaatctgaacttgatcgacgaatacttcttcaacatcaatcctgtcgttctcggcaagggaaagcccttgttcagngaccagagtgagatgcgtaggttgaanctactagaatccaagacgtacaagaacggagtcgtcagtctccgctatggcaagggaagttagtagaatgagaaggatagtcgtttcagagttcgtgtcgctggatggtgtcatgcaggctccaggcggacgggaggaggatgctagtggcagtttcaagcatggcggttggagtttcaagttccgcgacgatcaggttccgaaatacaagctggacgagctagctgccagcgacgcgctcttgctaggccgaaagacctacgagatattcgcagcctactggccaaaagcaaaggacgacgcgggtttcgctgacaagatgaacaatctggccaagcatgtggtttcaacgactctgaagaaagccgactggaacaattccaagctgattaggacgaatgtcgcggatgaagtgaggaagctgaagcagcagccgggaaaggacattcttgtctacggaagcgcgaagctggtgaacacgctnttgcagcatgacctcgtcgatgaactacggctcatggtccatcctgttgtcttgggaagcgggaggcggctcttcgatgatcatgcggagatgctgaagcctttgaaacttgcagagtcgaagaccttcccgtcaggcatcgtcctcctctcctaccaccaagcaaaatagcgatttttcttacagagtaacgtcctcaagctgaggtttggataatgcggaccatcttactgatgatccgttcgtgcttcttctcatctgtatcaatccattccagaagcagtctcgctataggatgtgagatcttcacggtatctttgagtgattgttcccccgccttgtcttctatttgcaggatcgcatcgaggaattctttcttcggaacatttagtgtgggctcgcgaggtagttcggtccatgagatgatctgagaaacaacatcagcatgcctcatgctgtctgccgcgatcattctaaggagcagttttgagtattgatcgtcaaactttacggcggattctaggcatctttccgatgctttcagttctagttccagtctttgtcgaagaacgtcgacgatttgcctattgttcttcggtgttgtctcttctagcatcttgctgcctttgctggcgattattagttggtcggcggcttccatcaattctggcatcctgactccttcccttacgccgctccggaccctttgcaggatcctctccgctagtgcctcgatagtgcggtcgagttgagcgggtcgtccaaccagtctacctcgctttcctttcagatactgcacgacggcagctggagtggtgttgagagccgcggcgatctccgtcaccctcagtccctcgcgttggaggaccattgcgaggcgggcgcgaacgactggaatcatgttttcgctacgcacgttttcagcgatatttcgcatggcgttgggacaggcgtctgctgttattaacggtgttaacggattncgttaacgtcgattggcttaaatgacgtatgtcataacctagggttgcgttgcggtttgatagactacgctcagctcttactcctaggcgcagtcgccgggctgaccatattcntgggcctgcccatggccctgctccccaacgttagccgcatgaagaagggattcctcaacgcactcgcgatgggaatcctagtattcctgataactgacgtattgtcccacgcctgggaccccgctaagttagcagcggtcgccggtttcacagggaaaggtccggttgcggacgctgcgatagatcttcttgcattgttcggcggcctgggtctgggactattgggactcgcactctacgaacaaaggtatctcagaagaatcatctcaaccaagaagaaactagcaatctcggaagaaaacaatcgccccggagcatcaaacacccctgctaaacctgacacagcgccccagcagcatggctctgagcttttcagcaatccacatcatcttgcgacgatgatcgctgtcggcatagggttgcac

SEQ ID NO: 1162 - DNA, 4000 bp, Escherichia coli
  misc_feature (1985)..(1985): n is a, c, g, or t
  misc_feature (1987)..(1987): n is a, c, g, or t
  misc_feature (1992)..(1992): n is a, c, g, or t
atgcgccaggctcggcgcactcgcaagcggacggacgctacccgggcgtaggaaagtcatcctattggccgcgctgggccccccgccccccacccagcccaatccgggtcacatggcggcctgctgtgggcttatcgggcgctcacgggctagattggctccgcccgccagcgtgggagccagcctgcagttcgacgccgagttgtatcaaacgcacgagcagcgacgccacgactgagtcggccgcggccggggtctcggcctggatggctgcgtgcagatcttcccgggccgattcgatccaggaccattcccgccggaatccgtctgccttggcccagtagccacgctgctcccaggcgagcgcagttgcctccacggatgcggcaaccaaatggagctgctcgcgcacgaacaccaggcgctcctgctcccccgcttggcggaaggagtccgccggcgtcggctgcaacgccgtgcggatccggcgcagacaggcctgccgaacgctggcgggagactgaggacgaaggatcccgggcatctgaggctcctggctagtatagccgcagcctcgatgcggcaacccagcaggggagcatgccgccgtgctagaatgcctgtaggcggcacgcgcagcgctgcccgatcactcgaggcgtccaagcagacgacaagcaggatggaagacgggatcaaggtcgttgcgaccaaccgcaaggctcaacacgactacttcctcgaggatcgcctcgaggtcgggatggtgctcaagggtaccgagatcaagtcgattcggttgggccaggtcagcattcgtgaggccttcgtccgcctggaccagggcgagctatggctgcaaaacgcccacatcgcgccgtacgaccctgcgagccaaatgaaccatgacccgaaacggccgcgcaagttgctgatgcaccggcgcgagatcgctaagttggaaggatcgatccgtcagcgggggtatgcgctgatcccgacccggctgtacttgaaagacggccgggcaaagctcgagatcgcgctggcccgcggcaagcgacaatatgacaagcgcaaagcgctggcggagaaggacgcccagcgggccatgcagcgcgagctgggccggcgcggccccagatgatccagcagtccatcggcgccatcaactacctttcagcggctgagcggcgggcgatctatgctcgcttcgttccccctgagctgtcagagcagttgggcctatccccacagctgcgagacgccacgggtgccgacttgcttgaggtgcggggggagcgcggcgccccggacgtgcaggtgatcctgcgacatcagaccggcgcgcgcgatccggtgctgtacgcgcatctggcggacaccgtgcatgggcaggtccacgtcttgctgtacatcatcaacgacccggcctcgccacgcttcgacgtcgacgtcatgccggacggccgccccacccgcttcggcacccagctgcgcaatctgccagcggaggcaggcgcgttgactgccgggttggcgccgggacaggtgcggcgcgggctgcgcgttctgccatccgcgatccaggccttcgaggcattcgtcgcctcgctggatcaggagctgttctttgttgagccgctttactaccacaacgccgtccacttcgagcgcttcggcttcgcttatcagcagggtttgcagctgatgcgccgcattgcgggcggcttcggcccgaagggcgatctgaccagccgcctcgacgggtcaagtccgtttcgcgatcctgcggcctaccgctcgattcgcctgcgtagctgggcggtgcatgacggcgttctgggtgatccattcacgggggtgctcatgtaccgccggcttggcgcccccgtcacggtcgacacggcaccgtcgattccctggtaggacaggatgcgcatagcctcctgctgctttgggatgtgaacggcaagattacgggncncactngtggctatgcgcatgacgtgcgcattccgtctgctacaatggccgcatggggatgaaaggtttcgacgggggtggatagcgctgcacggcagaccgagaggcgccgatctcgtaaaatccgcgcacccataagtgccaaccgcacttcgtacgcggcgctcccgctcgcagcttagctcgagtgtgaccgcccggcgcccttgaggcgcccgcccgcccgaacctccctcgaccggctccgggatgcggcgaccaaaggccgaggtgccgtgcggatgccacgggccgcacctaagaccgccctccgggcgacgtggctggcaacaggaccgtctgggtcaccgcagacacctggcgcgagatctctcaggtgactacgtctgtagatgtgcagtgacagaagccttcggacgcgggttcgactcccgccatctccaccaagccggcagccgcacacggctgccggtcgctttgctgccgagctgacgcccagccacttcgtgcttgtgcgcccaaggcccgcatcagcgggctggggcttgcgcgttgacgtggaccggctctctgccaaccgctgtaggcggggcagcacgttctggtctagctgatcgccttgaggcgaaatcccaggccgcgcaccgtctcgatgaaagtcacgcccggcccatgctccgacagccgctcgcgcagccgccggaccaaggcgtcgatcgcctgctcactgaccccgctgcccaggctctcctgccagacaatttcaacgatttcttcgcgcgtcacgatgcgggtgggattcaggtacagcaattcgagcagccggaactgctgcggcgagagcggcggatcaagctcgctctcccctacccacaggcggtgtgccgcccggtcaaggcgaagcaagcccaggtcgtgcgccgccgcctcgtcgctgcccaaggggacggttgcgtctaggccgatgaacaccagcttcgccgccagcgcgatctggatcaggtcgccatcctggagttgcacttgggcgctgactaccgccccattcacatgcgtcccattcttgctgcccagatcctcgatccaatagccatcggccttccgccggatccgggcatggcggcgcgatatctggcggtccggtatcaccacctggcaatccacgtcgcggccaatcaccgtctccgcctcggtcagcggccagcggctgccctgtgccgtgccggattggccgatcaggaccgggccttgaggatcgcgcgctgcttccgtcattcgcctaaggccccgcgaccgccgtataggtataatcctggcaacatgcgaacaacatcctgcccggaagatgacggctgtgccgagcctgcttgagcccggtgctgtcctgcgcgagcgctacgccgtgagagagatcgttggccgcggcgggatgggctcgatctaccttgccgaggacctgcgccttcccgggcgctcctgcgccctcaaggaggtcgagtccgatccatccctgccccagacgctgcgcgaccagggccgcgcccagttctatcgggaggcctccgtgctcgcccgtctcgatcatcccaatctccccaaggtgtccgacttcttcgcggagggaaacgccgactacctggtgatggactacgtcccgggcgaggacctcaagtcgaaactggatgaggcgcgccgcgtcgggagcttcctcaatctcaccgaagtcctgcgctgggcggatcagatcaccgatgccctggagtacctccactcccaggacccccctgttgtgcaccgtgacatcaagcccagcaacctcaagttgaccccgtccggcctgatcaagctcgtcgacttcggcctggtcaagcaaatggcccccgacgagatgacggtcacggtgatccaggggcgcggcaccgcctactacaccccgctcgagcagtacggtggggatgacggtcacaccagccctcgcacggacctgtacgcctttgccgccacgctctaccac

SEQ ID NO: 1163 - DNA, 4000 bp, Escherichia coli
tgatgatcctttgaatcaatttttgcagctagtgcaattccaacagaataagacagaccagtacctaacgaacctccacaaaattcaactccaggacattttagatcaggatgtccctgtaatctactgccgaattttcgtaaagtttcaatttcagattctggaaaatatcctgctactgccatattagagaacaaaccaggagcagcatgtcctttagacaatactaaccgatctctatcttcccattgagggttttgaacatcaaatttcaaatgtttgttaaacaaacaacccaaaatttcagccatggaaaaagagccgccaggatgaccggaacctgctgtattagttgccttgattactaatttacgagctcttagaatatttttttttatttgataatagttaagacccatctggaacgtatctctataaatcgaataaaaatctacttctgtaaaattttaatttgatcgcaattatgtctaattatgagaattaaagatgaaattccaattgtgctttttgatgatcagtgttatgtttgtataaaatttgcaacaattgtaaattttttggctaaaggtaaaattacaatggtagggcactattcaaattttggaataaaaattagaaatgaacttttagatgaatcagcattagagatgttttggtttattgatgagaaaagggcaagtgggggaagagctgcattatttccactaattaaagcaattttttctacaaaatcaagaaaaacaaaatttgctcaaatggataacatctgtagcgatgattgtaaaagtgccaaagcagtatttgttagatcatttacactaattacaaatagtaaaaaaatcgacttatagaaaatctaaataatgctttaaaaaacatgattttatcgtgaagattaaaactgagaattccagtaaaagaaaaacagaacttctatgtggatttgtgttagaagattctaacaaagttctaggattaccaaaatttgatacaaaaacatcatcatctatcaatcaatctctaaaagatatgaacggtaaactaggaaaattagcaatcattccagttccaggtaaaaaacaagctcaaagaatacttcttgcaggtattggtaaaaaagaaaacttaacacaagataccataagatttgtttcaggtaaaattgcacagaaaactagggaattaaaattaaaagagttttcaattatagtgccaccaacttttgtaatggattcaatttcatcagtttctcagattatagaaggtgcaaaaatgtcattatacaaatttgataaatttaaagcagaaaaagtggataaaacgccagatatgacaatcatagtttctaaatcaaataaaatctcaaaagcaattaaaattgccgaagctgttgcagaaggtgcaatatttactaaaagtgttgcaaatttaccaccaaacgaatgtactcctacaacactagcaaattttgctaaagatatttctaaaaaaaataaaatgaaatgcactataatttcacagccggaattaaagaaaaaaggttttggaggaattacagcagtaggcaaaggaagtaaaaacgagcctaaactaatcaccatagagcataatcatggacctaaaactcaaaaaccaattgttctagttggaaaagctgtgacatttgatacgggaggaatttcattaaaaccaggtcaaggcatggacgaaatgaaatttgataaatgtgggggttgtacagttttaggaattatgaaatcagtttcagaattaaaattaccaattaacgtagtaggaattatcccatcggtggaaaatatgccgggaggagaggcatacaggccgggagatattataaaattatacaatggaaaaactgcagagattctaaatacagatgcagaaggtagattgattttagcagatgcattagcatacggagaaaaacaatacactccaaaagtaattattgattttgctactttaacaggagcatgtatagtagcattaggaaataacgtagctgcaatcgtatcaaacgacaaacagctaacaaaagaaattacaaattcatccaaaactacaacagaagaagtttgggaattaccattaacacaagactatatggacatgataaaatcagatgtggcggacattaaaaatgtcggaataggaaaagcagcaggaactatcacagctgctgcatttttgaaaagtgcaatcaaagacacgccatgggtacatttcgatattgcgggagttgcatggactcagggagcagctacaaaacaaaaaccatacaatccaaaaggagctacaggttttggagtaagactgattttagattatttgcaaaaattataaaattaataacccctgctatttctatcaggtttgctaacatttggatttctccagccatgtttttccatcatgtgatttagtaatcggatgtcattgtcagatttttctccacagacgctacaatttggcattgaaatcaattcaatccaagattgtggatattaaaagattgattaataattgaaaaatgccagcactattgcttcccaacagctctcgcatgttagtaacacaatagcgctatcaggtttgacttctaagttcggaatgggattaggtcgcaccctgacgctatggccggcttgaaaactgttcaataattcttatctattaaggtaacgaaatatttcaaatcaactcaaaataggtataaagcaaagaaaatatcgaattacaatcatgacacacagagttgcagtactggatcaggatttatgccagccacaaaaatgcggattagagtgtataaagtattgtccagttaacaaatcaggtgcagaatgtgttacaattaacgaagtatcaaaaaaagcccaaattgatgaggatatttgtaacgggtgtggaatatgtgtcaaagtatgtccatttgatgcaataacaattgtaaatttagcaagtgaattggctacagataaaattcaccaatatggaacaaattcctttagattatacaaattaccgactccaagaaagggagaggttgtaggattattaggcagaaatggaatgggaaaaagtactgtagttaacatactttctggaaaattaaaaccaaatcttggaagatacgaagatccgccagaatggaatgaaatttttaaacattatagtggaacagaattaaaaaatcattttcaaaaaatagaacgaaatgaaattcgtgcttcaataaaaccgcaacagattcatcgtcttgcagaagcgtttgatgggacaggaaacgaattacttgagaaatatgatgaacgaggggtaacaagagaattagttagagaattaggattacaaaattccatggaaaaaagtttgaaagaacttagtggaggagaactacaaagaattgcagttgctgcagctgcatcaaaagatacagagttttacttttttgatgagccatcatcatacaatgatgtatatcaaagaataggggttgccagagtaatacaaggtttagcaaaaattggaaaaagcgtgatgattgtagaacacgatttaacattacttgattttcttagtgattatatcgaagtcttgtatggtgaaccaacagcatatggaatcgtatcaaatatcctatcaactaaaattggaatcaatgtttttcttgatggatatttaccaaatgaaaatgtcaggtttagagataaaagattctccatggatgtatcatcatcatctacggatattttccaagaaggtagcgatgttgtaatttatccaaaacttgaaaagaaatttgattcattttcagtagcaattgagccgggaaaagtacgaaagggcgaagttttaggaataatgggtgcaaatgcacttggaaaaacaaccatgatgaaaatgattgcaggtgtggaaaaaccagatagtggttcaattgataaaaaaataaaga

SEQ ID NO: 1164 - DNA, 4000 bp, Escherichia coli
  misc_feature (1)..(6): n is a, c, g, or t
  misc_feature (10)..(17): n is a, c, g, or t
  misc_feature (19)..(24): n is a, c, g, or t
  misc_feature (26)..(28): n is a, c, g, or t
  misc_feature (30)..(31): n is a, c, g, or t
  misc_feature (33)..(36): n is a, c, g, or t
  misc_feature (38)..(49): n is a, c, g, or t
  misc_feature (51)..(52): n is a, c, g, or t
  misc_feature (57)..(60): n is a, c, g, or t
  misc_feature (62)..(64): n is a, c, g, or t
  misc_feature (66)..(74): n is a, c, g, or t
  misc_feature (76)..(80): n is a, c, g, or t
  misc_feature (82)..(82): n is a, c, g, or t
  misc_feature (84)..(92): n is a, c, g, or t
  misc_feature (94)..(94): n is a, c, g, or t
  misc_feature (96)..(96): n is a, c, g, or t
  misc_feature (98)..(100): n is a, c, g, or t
  misc_feature (102)..(109): n is a, c, g, or t
  misc_feature (111)..(114): n is a, c, g, or t
  misc_feature (116)..(118): n is a, c, g, or t
  misc_feature (121)..(124): n is a, c, g, or t
  misc_feature (126)..(138): n is a, c, g, or t
  misc_feature (140)..(143): n is a, c, g, or t
  misc_feature (145)..(150): n is a, c, g, or t
  misc_feature (153)..(156): n is a, c, g, or t
  misc_feature (158)..(163): n is a, c, g, or t
  misc_feature (166)..(167): n is a, c, g, or t
  misc_feature (172)..(180): n is a, c, g, or t
  misc_feature (182)..(182): n is a, c, g, or t
  misc_feature (184)..(185): n is a, c, g, or t
  misc_feature (188)..(190): n is a, c, g, or t
  misc_feature (192)..(192): n is a, c, g, or t
  misc_feature (194)..(196): n is a, c, g, or t
  misc_feature (198)..(199): n is a, c, g, or t
  misc_feature (203)..(210): n is a, c, g, or t
  misc_feature (213)..(213): n is a, c, g, or t
  misc_feature (215)..(215): n is a, c, g, or t
  misc_feature (217)..(222): n is a, c, g, or t
  misc_feature (226)..(226): n is a, c, g, or t
  misc_feature (231)..(233): n is a, c, g, or t
  misc_feature (235)..(241): n is a, c, g, or t
  misc_feature (243)..(243): n is a, c, g, or t
  misc_feature (245)..(247): n is a, c, g, or t
  misc_feature (250)..(250): n is a, c, g, or t
  misc_feature (252)..(253): n is a, c, g, or t
  misc_feature (255)..(256): n is a, c, g, or t
  misc_feature (258)..(260): n is a, c, g, or t
  misc_feature (262)..(265): n is a, c, g, or t
  misc_feature (267)..(268): n is a, c, g, or t
  misc_feature (270)..(272): n is a, c, g, or t
  misc_feature (274)..(275): n is a, c, g, or t
  misc_feature (277)..(279): n is a, c, g, or t
  misc_feature (281)..(284): n is a, c, g, or t
  misc_feature (286)..(291): n is a, c, g, or t
  misc_feature (293)..(294): n is a, c, g, or t
  misc_feature (296)..(297): n is a, c, g, or t
  misc_feature (300)..(304): n is a, c, g, or t
  misc_feature (309)..(309): n is a, c, g, or t
  misc_feature (311)..(311): n is a, c, g, or t
  misc_feature (313)..(319): n is a, c, g, or t
  misc_feature (322)..(335): n is a, c, g, or t
  misc_feature (337)..(338): n is a, c, g, or t
  misc_feature (343)..(343): n is a, c, g, or t
  misc_feature (345)..(347): n is a, c, g, or t
  misc_feature (349)..(349): n is a, c, g, or t
  misc_feature (351)..(352): n is a, c, g, or t
  misc_feature (354)..(357): n is a, c, g, or t
  misc_feature (359)..(366): n is a, c, g, or t
  misc_feature (368)..(374): n is a, c, g, or t
  misc_feature (376)..(376): n is a, c, g, or t
  misc_feature (378)..(381): n is a, c, g, or t
  misc_feature (383)..(384): n is a, c, g, or t
  misc_feature (386)..(387): n is a, c, g, or t
  misc_feature (390)..(392): n is a, c, g, or t
  misc_feature (394)..(396): n is a, c, g, or t
  misc_feature (398)..(400): n is a, c, g, or t
  misc_feature (402)..(418): n is a, c, g, or t
  misc_feature (420)..(422): n is a, c, g, or t
  misc_feature (424)..(425): n is a, c, g, or t
  misc_feature (429)..(430): n is a, c, g, or t
  misc_feature (432)..(435): n is a, c, g, or t
  misc_feature (438)..(438): n is a, c, g, or t
  misc_feature (442)..(445): n is a, c, g, or t
  misc_feature (447)..(459): n is a, c, g, or t
  misc_feature (461)..(464): n is a, c, g, or t
  misc_feature (466)..(478): n is a, c, g, or t
  misc_feature (480)..(480): n is a, c, g, or t
  misc_feature (484)..(498): n is a, c, g, or t
  misc_feature (500)..(500): n is a, c, g, or t
  misc_feature (502)..(504): n is a, c, g, or t
  misc_feature (507)..(510): n is a, c, g, or t
  misc_feature (513)..(515): n is a, c, g, or t
  misc_feature (517)..(517): n is a, c, g, or t
  misc_feature (521)..(526): n is a, c, g, or t
  misc_feature (528)..(529): n is a, c, g, or t
  misc_feature (531)..(532): n is a, c, g, or t
  misc_feature (534)..(537): n is a, c, g, or t
  misc_feature (539)..(542): n is a, c, g, or t
  misc_feature (546)..(547): n is a, c, g, or t
  misc_feature (550)..(551): n is a, c, g, or t
  misc_feature (555)..(555): n is a, c, g, or t
  misc_feature (558)..(559): n is a, c, g, or t
  misc_feature (561)..(561): n is a, c, g, or t
  misc_feature (563)..(563): n is a, c, g, or t
  misc_feature (565)..(566): n is a, c, g, or t
  misc_feature (568)..(569): n is a, c, g, or t
  misc_feature (571)..(574): n is a, c, g, or t
  misc_feature (576)..(579): n is a, c, g, or t
  misc_feature (581)..(582): n is a, c, g, or t
  misc_feature (586)..(587): n is a, c, g, or t
  misc_feature (589)..(590): n is a, c, g, or t
  misc_feature (593)..(594): n is a, c, g, or t
  misc_feature (596)..(597): n is a, c, g, or t
  misc_feature (599)..(599): n is a, c, g, or t
  misc_feature (603)..(605): n is a, c, g, or t
  misc_feature (607)..(607): n is a, c, g, or t
  misc_feature (609)..(609): n is a, c, g, or t
  misc_feature (612)..(612): n is a, c, g, or t
  misc_feature (614)..(616): n is a, c, g, or t
  misc_feature (618)..(624): n is a, c, g, or t
  misc_feature (626)..(627): n is a, c, g, or t
  misc_feature (630)..(631): n is a, c, g, or t
  misc_feature (633)..(633): n is a, c, g, or t
  misc_feature (635)..(635): n is a, c, g, or t
  misc_feature (638)..(639): n is a, c, g, or t
  misc_feature (642)..(643): n is a, c, g, or t
  misc_feature (645)..(655): n is a, c, g, or t
  misc_feature (657)..(657): n is a, c, g, or t
  misc_feature (659)..(665): n is a, c, g, or t
  misc_feature (667)..(668): n is a, c, g, or t
  misc_feature (670)..(671): n is a, c, g, or t
  misc_feature (673)..(675): n is a, c, g, or t
  misc_feature (678)..(678): n is a, c, g, or t
  misc_feature (680)..(681): n is a, c, g, or t
  misc_feature (683)..(685): n is a, c, g, or t
  misc_feature (687)..(688): n is a, c, g, or t
  misc_feature (691)..(691): n is a, c, g, or t
  misc_feature (693)..(696): n is a, c, g, or t
  misc_feature (698)..(702): n is a, c, g, or t
  misc_feature (704)..(704): n is a, c, g, or t
  misc_feature (707)..(712): n is a, c, g, or t
  misc_feature (714)..(716): n is a, c, g, or t
  misc_feature (719)..(721): n is a, c, g, or t
  misc_feature (723)..(723): n is a, c, g, or t
  misc_feature (725)..(725): n is a, c, g, or t
  misc_feature (727)..(729): n is a, c, g, or t
  misc_feature (731)..(736): n is a, c, g, or t
  misc_feature (738)..(740): n is a, c, g, or t
  misc_feature (742)..(742): n is a, c, g, or t
  misc_feature (745)..(751): n is a, c, g, or t
  misc_feature (755)..(755): n is a, c, g, or t
  misc_feature (757)..(758): n is a, c, g, or t
  misc_feature (761)..(762): n is a, c, g, or t
  misc_feature (765)..(766): n is a, c, g, or t
  misc_feature (768)..(769): n is a, c, g, or t
  misc_feature (771)..(771): n is a, c, g, or t
  misc_feature (774)..(783): n is a, c, g, or t
  misc_feature (786)..(788): n is a, c, g, or t
  misc_feature (790)..(790): n is a, c, g, or t
  misc_feature (792)..(794): n is a, c, g, or t
  misc_feature (797)..(802): n is a, c, g, or t
  misc_feature (804)..(804): n is a, c, g, or t
  misc_feature (806)..(807): n is a, c, g, or t
  misc_feature (809)..(810): n is a, c, g, or t
  misc_feature (812)..(812): n is a, c, g, or t
  misc_feature (814)..(814): n is a, c, g, or t
  misc_feature (817)..(820): n is a, c, g, or t
  misc_feature (822)..(822): n is a, c, g, or t
  misc_feature (824)..(824): n is a, c, g, or t
  misc_feature (826)..(830): n is a, c, g, or t
  misc_feature (832)..(832): n is a, c, g, or t
  misc_feature (835)..(836): n is a, c, g, or t
  misc_feature (839)..(841): n is a, c, g, or t
  misc_feature (844)..(847): n is a, c, g, or t
  misc_feature (849)..(849): n is a, c, g, or t
  misc_feature (852)..(853): n is a, c, g, or t
  misc_feature (2657)..(2657): n is a, c, g, or t
  misc_feature (3092)..(3092): n is a, c, g, or t
nnnnnnctgnnnnnnnntnnnnnncnnnanntnnnnannnnnnnnnnnnannatttnnnnannngnnnnnnnnngnnnnnanannnnnnnnntntntnnngnnnnnnnncnnnnannntgnnnngnnnnnnnnnnnnnannnngnnnnnncannnntnnnnnnagnngatgnnnnnnnnntncnntcnnntnannntnntgannnnnnnnctnanannnnnnatgnttatnnngnnnnnnntncnnntgntnntnntnnngnnnntnntnnngnnannncnnnngnnnnnnanngnncannnnnatttnanannnnnnntannnnnnnnnnnnnnanntctantnnnananntnnnntnnnnnnnnannnnnnntntnnnntnngnngcnnnannnannntnnnnnnnnnnnnnnnnntnnngnntatnntnnnnttnatgnnnntnnnnnnnnnnnnntnnnngnnnnnnnnnnnnnangtcnnnnnnnnnnnnnnntntnnngtnnnnctnnnanagannnnnntnntnntnnnncnnnngatnnaanntatnatnnancngnngnntnnnnannnnannaaanngnngcnnanngnatcnnnananaanannntnnnnnnntnnccnnananaannatnngnnnnnnnnnnnanannnnnnngnntnngnnnttnannannnannagnannnnannnnnangannnnnnannnaannntnangnnnannnnnnannnantannnnnnnatanannttnncanntnnancannnnnnnnnntcnnngntnnnacnnnnnnangnntnntngntannnncncngnnnnncnggnnggnnncgnnnngngcnncagcgagaccgtagaatgtattgaatggtacgatccttcaacagatgagccaacaccaccccttgcttttaaaatgacggcatttgattatggcgagtctgcagcaacaaataccctcgctacctccgcacaggatgttagtagtaattcatatcaagcagacttttatgttaattatgaaaacacagcaaaaataattgaaatccctctcactacaagaactctaaaagttgtagataatcctcccacagcccttgatattatgccttatcaggttgtggatgattcacaacagataggatttcacttaaaagatgatacttttgttcctgctacttatccaacaaatattaacgccgacaatttagtgcttcgagatgactatttaaatgccaataatttagcaataagtgataaattagaaattgattctgtgtcgaggagcagatatattcagatctttcgaatgaacgaaaaaccagagaggttttctgattttagtggccacgaaattgctttaatcgatttggcgattcccggctctaatgaggtatcttccacttatcgttttcttgagaaaagagcagcaaacaaaaaatattattatttatttagggcgctaaatgaacacaagcagcctggatatgtatttgagatatatgaagcagagatagtgaacgatggtggttataaacatgcacgattcaactctttatacgaagaagatttagcagtagacgtttataaagaaccgtcacgaacagcgaaaaatttattacaacttaagccaacatatggacagctagcattaaattacaataacgccgattttgacgaaacagcacattcacaattgactaatataagtgttggcgttgaagataatgttttgtggggcaaaacattcaaagttcgtttaacgtctagaaagactggcaaaaaaattgatttgaacattacttatgattatgaggatgcaacataatcatgtcttttttaaacaaagctggcacaatcgtaattgatgcaacgctaactgataccggccgaaaatatatggcagatggaaatttcacaattgctaaatttgctctcggagatgatgaaatagactattcgttgatgagcaccgagatcgacggccatgccggcacgccgacgttaataaatgcatctactactccactttttgaagccttttctcaacaaaatgcaaatatcaattatggcttgatggatcacgagcgaaaagatttgctttacataccgatattaaaaataaacgataaattagaaaattcagcattgcctcaaacaggcgccttagagccagcacatacaaaaggaggagaaatatattatttatctgttaatgatgaaactactagcaaacttaaagatagtattgggtggcaatcggcacacattttagaatctaatgtttctgaaaaaacaaaactcattatagaatctggaattgatttaagtccaactggttcttataatacgagcgccgggaccccggatcctatttccggcaagcgcaccgctgccgatagagaggcttttattttacaaactgagcttttggacagcgcagtctatatttattgtgacaataggttttttactagcgtgttgattcccgctggcgaatctaaatttagtagtgcacgcggaagctcaaaagttaattttgagacactgaaccctgcaacttctatatcagagccgagatatatagaaaattttagtactttttatgcaccgacaattgacaatttagtatatgaaacaggaacanactcttctgatttagatatttcagttgtttgtgggcctcgtggcagcgcgctggcaattaatttagtagtggacaatatgttaacttctaaatcaactggcaccactaattataaatactctacttatggcacttccaatactagcttgcttggtggaagtaataagtttgattatatcgacaccgccctatatatagaaggtgcgaccacttccgctaggttaatgattccaataagaattataagatatgcgggcacctaaaaagtttgaagactaattaatataattactatttatgaaggagagagataaataaatgtcttttttagataactccggcgatatcatcctcgacgctgtgttaacagatgtgggtagaaagaggatggcacagggagctttccagatctcgcgctttgctctcggcgacgangagatagattattcacaatgggttagcgcaacgggctccgcttaccaagacttgactattttgcaaacccctgtttttgtagcacacaccaaagtgcccggtattaattacggacttttaaatattgcccgcaatgatttatattatatgccaggaatacagattagcaactcctcgaaagttgccaacgctgttgatgagaacagtgggatatattatctcgcagtaaatgcagaaacagcgactcaacttgaaaagtctacggcattaaattccaaatataaattcttaactacggccctcacctccggccgaaaattaataatggaattcggccttaaagattcgtcaaacgacggtattgttcccactcctgcgaatataactaattatttatctgcccagaatattggtctgctggatcctgcagcacgcgtaagggtagacagccgatttgtttcagcagttttgggagcctcgaatggctcaaagtttgcaaatgatgccgatggtaatccagatattgacattacacttacctcgcgcgatgctgcctccaacgttgcttctatgtccaattatgtagaatggacaattccgctcattaacaatggggtcacctataatacctcacaaacagaaaacaacataattgttactaatggggttgttggtacagttggagcatttaattttagcgtattcaacgcattgaaaacaaagtctacggctacgacctctcgtagcgcttattatacattatacggctcaacagatgttgttggaacaaacgcacgccttgggttctccggcgcacaaaagtgggattttattgatacaactgtatatatctatggagaggccagcacgactatgaaacagatcaccctaagaatcattcggtatgc

SEQ ID NO: 1165 - DNA, 4000 bp, Escherichia coli
  misc_feature (1237)..(1237): n is a, c, g, or t
  misc_feature (1986)..(1987): n is a, c, g, or t
  misc_feature (2016)..(2016): n is a, c, g, or t
  misc_feature (2246)..(2246): n is a, c, g, or t
  misc_feature (2374)..(2374): n is a, c, g, or t
  misc_feature (2441)..(2441): n is a, c, g, or t
  misc_feature (2496)..(2496): n is a, c, g, or t
  misc_feature (2509)..(2509): n is a, c, g, or t
  misc_feature (2511)..(2512): n is a, c, g, or t
  misc_feature (2518)..(2518): n is a, c, g, or t
  misc_feature (2531)..(2531): n is a, c, g, or t
  misc_feature (2566)..(2569): n is a, c, g, or t
  misc_feature (2572)..(2572): n is a, c, g, or t
  misc_feature (2582)..(2582): n is a, c, g, or t
  misc_feature (2587)..(2587): n is a, c, g, or t
  misc_feature (2605)..(2610): n is a, c, g, or t
  misc_feature (2612)..(2612): n is a, c, g, or t
  misc_feature (2618)..(2620): n is a, c, g, or t
  misc_feature (2624)..(2625): n is a, c, g, or t
  misc_feature (2627)..(2629): n is a, c, g, or t
  misc_feature (2631)..(2631): n is a, c, g, or t
  misc_feature (2633)..(2640): n is a, c, g, or t
  misc_feature (2644)..(2644): n is a, c, g, or t
  misc_feature (2653)..(2653): n is a, c, g, or t
  misc_feature (2659)..(2659): n is a, c, g, or t
  misc_feature (2662)..(2662): n is a, c, g, or t
  misc_feature (2665)..(2665): n is a, c, g, or t
  misc_feature (2668)..(2670): n is a, c, g, or t
  misc_feature (2672)..(2672): n is a, c, g, or t
  misc_feature (2674)..(2675): n is a, c, g, or t
  misc_feature (2677)..(2679): n is a, c, g, or t
  misc_feature (2683)..(2683): n is a, c, g, or t
  misc_feature (2689)..(2690): n is a, c, g, or t
  misc_feature (2692)..(2692): n is a, c, g, or t
  misc_feature (2701)..(2701): n is a, c, g, or t
  misc_feature (2708)..(2708): n is a, c, g, or t
  misc_feature (2712)..(2712): n is a, c, g, or t
  misc_feature (2717)..(2717): n is a, c, g, or t
  misc_feature (2725)..(2725): n is a, c, g, or t
  misc_feature (2727)..(2727): n is a, c, g, or t
  misc_feature (2731)..(2731): n is a, c, g, or t
  misc_feature (2742)..(2744): n is a, c, g, or t
  misc_feature (2747)..(2747): n is a, c, g, or t
  misc_feature (2756)..(2756): n is a, c, g, or t
  misc_feature (2758)..(2759): n is a, c, g, or t
  misc_feature (2789)..(2790): n is a, c, g, or t
  misc_feature (2794)..(2794): n is a, c, g, or t
  misc_feature (2796)..(2796): n is a, c, g, or t
  misc_feature (2807)..(2809): n is a, c, g, or t
  misc_feature (2815)..(2819): n is a, c, g, or t
  misc_feature (2830)..(2831): n is a, c, g, or t
  misc_feature (2836)..(2836): n is a, c, g, or t
  misc_feature (2838)..(2839): n is a, c, g, or t
  misc_feature (2844)..(2844): n is a, c, g, or t
  misc_feature (2850)..(2851): n is a, c, g, or t
  misc_feature (2853)..(2858): n is a, c, g, or t
  misc_feature (2861)..(2864): n is a, c, g, or t
  misc_feature (2867)..(2868): n is a, c, g, or t
  misc_feature (2870)..(2870): n is a, c, g, or t
  misc_feature (2875)..(2876): n is a, c, g, or t
  misc_feature (2879)..(2879): n is a, c, g, or t
  misc_feature (2882)..(2882): n is a, c, g, or t
  misc_feature (2885)..(2886): n is a, c, g, or t
  misc_feature (2888)..(2891): n is a, c, g, or t
  misc_feature (2894)..(2896): n is a, c, g, or t
  misc_feature (2898)..(2905): n is a, c, g, or t
  misc_feature (2907)..(2908): n is a, c, g, or t
  misc_feature (2910)..(2915): n is a, c, g, or t
  misc_feature (2918)..(2921): n is a, c, g, or t
  misc_feature (2924)..(2930): n is a, c, g, or t
  misc_feature (2933)..(2936): n is a, c, g, or t
  misc_feature (2938)..(2939): n is a, c, g, or t
  misc_feature (2941)..(2942): n is a, c, g, or t
  misc_feature (2944)..(2944): n is a, c, g, or t
  misc_feature (2948)..(2949): n is a, c, g, or t
  misc_feature (2954)..(2957): n is a, c, g, or t
  misc_feature (2959)..(2959): n is a, c, g, or t
  misc_feature (2964)..(2964): n is a, c, g, or t
  misc_feature (2967)..(2974): n is a, c, g, or t
  misc_feature (2977)..(2980): n is a, c, g, or t
  misc_feature (2982)..(2985): n is a, c, g, or t
  misc_feature (2989)..(2990): n is a, c, g, or t
  misc_feature (2992)..(2992): n is a, c, g, or t
  misc_feature (2994)..(2996): n is a, c, g, or t
  misc_feature (2998)..(3004): n is a, c, g, or t
  misc_feature (3008)..(3009): n is a, c, g, or t
  misc_feature (3011)..(3014): n is a, c, g, or t
  misc_feature (3017)..(3018): n is a, c, g, or t
  misc_feature (3020)..(3020): n is a, c, g, or t
  misc_feature (3024)..(3026): n is a, c, g, or t
  misc_feature (3030)..(3031): n is a, c, g, or t
  misc_feature (3036)..(3044): n is a, c, g, or t
  misc_feature (3046)..(3048): n is a, c, g, or t
  misc_feature (3052)..(3052): n is a, c, g, or t
  misc_feature (3059)..(3059): n is a, c, g, or t
  misc_feature (3062)..(3062): n is a, c, g, or t
  misc_feature (3065)..(3065): n is a, c, g, or t
  misc_feature (3067)..(3068): n is a, c, g, or t
  misc_feature (3075)..(3076): n is a, c, g, or t
  misc_feature (3079)..(3080): n is a, c, g, or t
  misc_feature (3083)..(3083): n is a, c, g, or t
  misc_feature (3085)..(3088): n is a, c, g, or t
  misc_feature (3090)..(3091): n is a, c, g, or t
  misc_feature (3093)..(3093): n is a, c, g, or t
  misc_feature (3095)..(3095): n is a, c, g, or t
  misc_feature (3097)..(3099): n is a, c, g, or t
  misc_feature (3102)..(3106): n is a, c, g, or t
  misc_feature (3108)..(3108): n is a, c, g, or t
  misc_feature (3110)..(3112): n is a, c, g, or t
  misc_feature (3114)..(3116): n is a, c, g, or t
  misc_feature (3118)..(3119): n is a, c, g, or t
  misc_feature (3121)..(3122): n is a, c, g, or t
  misc_feature (3126)..(3126): n is a, c, g, or t
  misc_feature (3129)..(3130): n is a, c, g, or t
  misc_feature (3132)..(3132): n is a, c, g, or t
  misc_feature (3135)..(3136): n is a, c, g, or t
  misc_feature (3138)..(3143): n is a, c, g, or t
  misc_feature (3145)..(3148): n is a, c, g, or t
  misc_feature (3150)..(3152): n is a, c, g, or t
  misc_feature (3154)..(3158): n is a, c, g, or t
  misc_feature (3160)..(3163): n is a, c, g, or t
  misc_feature (3168)..(3168): n is a, c, g, or t
  misc_feature (3170)..(3170): n is a, c, g, or t
  misc_feature (3172)..(3173): n is a, c, g, or t
  misc_feature (3176)..(3177): n is a, c, g, or t
  misc_feature (3180)..(3183): n is a, c, g, or t
  misc_feature (3185)..(3187): n is a, c, g, or t
  misc_feature (3190)..(3192): n is a, c, g, or t
  misc_feature (3194)..(3198): n is a, c, g, or t
  misc_feature (3200)..(3200): n is a, c, g, or t
  misc_feature (3204)..(3208): n is a, c, g, or t
  misc_feature (3211)..(3215): n is a, c, g, or t
  misc_feature (3218)..(3221): n is a, c, g, or t
  misc_feature (3223)..(3224): n is a, c, g, or t
  misc_feature (3226)..(3227): n is a, c, g, or t
  misc_feature (3229)..(3229): n is a, c, g, or t
  misc_feature (3231)..(3231): n is a, c, g, or t
  misc_feature (3233)..(3234): n is a, c, g, or t
  misc_feature (3238)..(3241): n is a, c, g, or t
  misc_feature (3243)..(3244): n is a, c, g, or t
  misc_feature (3247)..(3247): n is a, c, g, or t
  misc_feature (3253)..(3253): n is a, c, g, or t
  misc_feature (3255)..(3258): n is a, c, g, or t
  misc_feature (3260)..(3260): n is a, c, g, or t
  misc_feature (3263)..(3268): n is a, c, g, or t
  misc_feature (3270)..(3270): n is a, c, g, or t
  misc_feature (3272)..(3273): n is a, c, g, or t
  misc_feature (3275)..(3276): n is a, c, g, or t
  misc_feature (3278)..(3278): n is a, c, g, or t
  misc_feature (3281)..(3282): n is a, c, g, or t
  misc_feature (3285)..(3285): n is a, c, g, or t
  misc_feature (3289)..(3290): n is a, c, g, or t
  misc_feature (3292)..(3292): n is a, c, g, or t
  misc_feature (3295)..(3298): n is a, c, g, or t
  misc_feature (3302)..(3303): n is a, c, g, or t
  misc_feature (3305)..(3308): n is a, c, g, or t
  misc_feature (3310)..(3310): n is a, c, g, or t
  misc_feature (3313)..(3313): n is a, c, g, or t
  misc_feature (3315)..(3317): n is a, c, g, or t
  misc_feature (3321)..(3325): n is a, c, g, or t
  misc_feature (3327)..(3327): n is a, c, g, or t
  misc_feature (3330)..(3334): n is a, c, g, or t
  misc_feature (3338)..(3340): n is a, c, g, or t
  misc_feature (3343)..(3345): n is a, c, g, or t
  misc_feature (3349)..(3350): n is a, c, g, or t
  misc_feature (3352)..(3353): n is a, c, g, or t
  misc_feature (3355)..(3357): n is a, c, g, or t
  misc_feature (3361)..(3363): n is a, c, g, or t
  misc_feature (3367)..(3369): n is a, c, g, or t
  misc_feature (3371)..(3372): n is a, c, g, or t
  misc_feature (3374)..(3374): n is a, c, g, or t
  misc_feature (3376)..(3380): n is a, c, g, or t
  misc_feature (3384)..(3386): n is a, c, g, or t
  misc_feature (3392)..(3392): n is a, c, g, or t
  misc_feature (3394)..(3395): n is a, c, g, or t
  misc_feature (3399)..(3399): n is a, c, g, or t
  misc_feature (3401)..(3401): n is a, c, g, or t
  misc_feature (3403)..(3404): n is a, c, g, or t
  misc_feature (3406)..(3407): n is a, c, g, or t
  misc_feature (3409)..(3409): n is a, c, g, or t
  misc_feature (3419)..(3419): n is a, c, g, or t
  misc_feature (3422)..(3422): n is a, c, g, or t
  misc_feature (3425)..(3425): n is a, c, g, or t
  misc_feature (3428)..(3428): n is a, c, g, or t
  misc_feature (3432)..(3432): n is a, c, g, or t
  misc_feature (3439)..(3439): n is a, c, g, or t
  misc_feature (3442)..(3442): n is a, c, g, or t
  misc_feature (3445)..(3450): n is a, c, g, or t
  misc_feature (3453)..(3454): n is a, c, g, or t
  misc_feature (3457)..(3457): n is a, c, g, or t
  misc_feature (3459)..(3459): n is a, c, g, or t
  misc_feature (3461)..(3463): n is a, c, g, or t
  misc_feature (3467)..(3469): n is a, c, g, or t
  misc_feature (3471)..(3472): n is a, c, g, or t
  misc_feature (3474)..(3477): n is a, c, g, or t
  misc_feature (3479)..(3479): n is a, c, g, or t
  misc_feature (3484)..(3485): n is a, c, g, or t
  misc_feature (3488)..(3488): n is a, c, g, or t
  misc_feature (3491)..(3491): n is a, c, g, or t
  misc_feature (3493)..(3494): n is a, c, g, or t
  misc_feature (3497)..(3498): n is a, c, g, or t
  misc_feature (3501)..(3501): n is a, c, g, or t
  misc_feature (3506)..(3506): n is a, c, g, or t
  misc_feature (3511)..(3512): n is a, c, g, or t
  misc_feature (3514)..(3514): n is a, c, g, or t
  misc_feature (3518)..(3520): n is a, c, g, or t
  misc_feature (3522)..(3522): n is a, c, g, or t
  misc_feature (3524)..(3526): n is a, c, g, or t
  misc_feature (3528)..(3528): n is a, c, g, or t
  misc_feature (3531)..(3531): n is a, c, g, or t
  misc_feature (3537)..(3537): n is a, c, g, or t
  misc_feature (3539)..(3539): n is a, c, g, or t
  misc_feature (3541)..(3543): n is a, c, g, or t
  misc_feature (3545)..(3545): n is a, c, g, or t
  misc_feature (3552)..(3552): n is a, c, g, or t
  misc_feature (3557)..(3558): n is a, c, g, or t
  misc_feature (3560)..(3560): n is a, c, g, or t
  misc_feature (3564)..(3564): n is a, c, g, or t
  misc_feature (3566)..(3568): n is a, c, g, or t
  misc_feature (3571)..(3572): n is a, c, g, or t
  misc_feature (3574)..(3574): n is a, c, g, or t
  misc_feature (3577)..(3578): n is a, c, g, or t
  misc_feature (3583)..(3583): n is a, c, g, or t
  misc_feature (3585)..(3585): n is a, c, g, or t
  misc_feature (3587)..(3587): n is a, c, g, or t
  misc_feature (3590)..(3590): n is a, c, g, or t
  misc_feature (3593)..(3594): n is a, c, g, or t
  misc_feature (3598)..(3598): n is a, c, g, or t
  misc_feature (3600)..(3600): n is a, c, g, or t
  misc_feature (3602)..(3602): n is a, c, g, or t
  misc_feature (3604)..(3604): n is a, c, g, or t
  misc_feature (3607)..(3607): n is a, c, g, or t
  misc_feature (3610)..(3610): n is a, c, g, or t
  misc_feature (3613)..(3613): n is a, c, g, or t
  misc_feature (3615)..(3616): n is a, c, g, or t
  misc_feature (3618)..(3618): n is a, c, g, or t
  misc_feature (3621)..(3621): n is a, c, g, or t
  misc_feature (3624)..(3624): n is a, c, g, or t
  misc_feature (3627)..(3627): n is a, c, g, or t
  misc_feature (3630)..(3634): n is a, c, g, or t
  misc_feature (3636)..(3638): n is a, c, g, or t
  misc_feature (3640)..(3640): n is a, c, g, or t
  misc_feature (3642)..(3642): n is a, c, g, or t
  misc_feature (3644)..(3645): n is a, c, g, or t
  misc_feature (3648)..(3648): n is a, c, g, or t
  misc_feature (3652)..(3654): n is a, c, g, or t
  misc_feature (3658)..(3658): n is a, c, g, or t
  misc_feature (3662)..(3673): n is a, c, g, or t
  misc_feature (3675)..(3677): n is a, c, g, or t
  misc_feature (3680)..(3681): n is a, c, g, or t
  misc_feature (3684)..(3684): n is a, c, g, or t
  misc_feature (3687)..(3687): n is a, c, g, or t
  misc_feature (3690)..(3690): n is a, c, g, or t
  misc_feature (3693)..(3693): n is a, c, g, or t
  misc_feature (3696)..(3696): n is a, c, g, or t
  misc_feature (3698)..(3701): n is a, c, g, or t
  misc_feature (3703)..(3703): n is a, c, g, or t
  misc_feature (3705)..(3708): n is a, c, g, or t
  misc_feature (3710)..(3710): n is a, c, g, or t
  misc_feature (3713)..(3715): n is a, c, g, or t
  misc_feature (3717)..(3722): n is a, c, g, or t
  misc_feature (3725)..(3725): n is a, c, g, or t
  misc_feature (3728)..(3728): n is a, c, g, or t
  misc_feature (3732)..(3732): n is a, c, g, or t
  misc_feature (3735)..(3735): n is a, c, g, or t
  misc_feature (3739)..(3742): n is a, c, g, or t
  misc_feature (3744)..(3747): n is a, c, g, or t
  misc_feature (3749)..(3751): n is a, c, g, or t
  misc_feature (3753)..(3753): n is a, c, g, or t
  misc_feature (3756)..(3759): n is a, c, g, or t
  misc_feature (3763)..(3763): n is a, c, g, or t
  misc_feature (3765)..(3765): n is a, c, g, or t
  misc_feature (3768)..(3768): n is a, c, g, or t
  misc_feature (3770)..(3770): n is a, c, g, or t
  misc_feature (3773)..(3776): n is a, c, g, or t
  misc_feature (3778)..(3778): n is a, c, g, or t
  misc_feature (3781)..(3784): n is a, c, g, or t
  misc_feature (3786)..(3787): n is a, c, g, or t
  misc_feature (3790)..(3792): n is a, c, g, or t
  misc_feature (3795)..(3795): n is a, c, g, or t
  misc_feature (3797)..(3797): n is a, c, g, or t
  misc_feature (3803)..(3807): n is a, c, g, or t
  misc_feature (3809)..(3811): n is a, c, g, or t
  misc_feature (3813)..(3813): n is a, c, g, or t
  misc_feature (3817)..(3817): n is a, c, g, or t
  misc_feature (3819)..(3819): n is a, c, g, or t
  misc_feature (3822)..(3822): n is a, c, g, or t
  misc_feature (3826)..(3826): n is a, c, g, or t
  misc_feature (3828)..(3831): n is a, c, g, or t
  misc_feature (3834)..(3836): n is a, c, g, or t
  misc_feature (3838)..(3847): n is a, c, g, or t
  misc_feature (3849)..(3850): n is a, c, g, or t
  misc_feature (3852)..(3853): n is a, c, g, or t
  misc_feature (3856)..(3856): n is a, c, g, or t
  misc_feature (3859)..(3860): n is a, c, g, or t
  misc_feature (3862)..(3863): n is a, c, g, or t
  misc_feature (3869)..(3869): n is a, c, g, or t
  misc_feature (3872)..(3872): n is a, c, g, or t
  misc_feature (3874)..(3874): n is a, c, g, or t
  misc_feature (3878)..(3884): n is a, c, g, or t
  misc_feature (3886)..(3886): n is a, c, g, or t
  misc_feature (3888)..(3891): n is a, c, g, or t
  misc_feature (3894)..(3896): n is a, c, g, or t
  misc_feature (3898)..(3902): n is a, c, g, or t
  misc_feature (3904)..(3904): n is a, c, g, or t
  misc_feature (3906)..(3907): n is a, c, g, or t
  misc_feature (3909)..(3909): n is a, c, g, or t
  misc_feature (3912)..(3913): n is a, c, g, or t
  misc_feature (3916)..(3916): n is a, c, g, or t
  misc_feature (3919)..(3920): n is a, c, g, or t
  misc_feature (3922)..(3923): n is a, c, g, or t
  misc_feature (3925)..(3925): n is a, c, g, or t
  misc_feature (3932)..(3932): n is a, c, g, or t
  misc_feature (3935)..(3935): n is a, c, g, or t
  misc_feature (3938)..(3941): n is a, c, g, or t
  misc_feature (3943)..(3943): n is a, c, g, or t
  misc_feature (3946)..(3946): n is a, c, g, or t
  misc_feature (3948)..(3948): n is a, c, g, or t
  misc_feature (3951)..(3952): n is a, c, g, or t
  misc_feature (3955)..(3955): n is a, c, g, or t
  misc_feature (3957)..(3958): n is a, c, g, or t
  misc_feature (3961)..(3962): n is a, c, g, or t
  misc_feature (3964)..(3965): n is a, c, g, or t
  misc_feature (3968)..(3968): n is a, c, g, or t
  misc_feature (3970)..(3970): n is a, c, g, or t
  misc_feature (3976)..(3976): n is a, c, g, or t
  misc_feature (3978)..(3980): n is a, c, g, or t
  misc_feature (3983)..(3983): n is a, c, g, or t
  misc_feature (3985)..(3986): n is a, c, g, or t
  misc_feature (3989)..(3991): n is a, c, g, or t
  misc_feature (3994)..(4000): n is a, c, g, or t
ggagtactatcgatggcggcggtgccgttcaattgacgagcgcggatttacataaacacgattcgaactcttttctcaagttcgacgaggaaaacgaagaaagcatcgccaacgtagagatgaagaaagcagtggagcagtagattatatttagttctttatataccaagtacttttcaacacttctcatcaaagctcttcgtttcgtatgtctatgctcgctaaggcgtctacgattcgggaccacaatttttcatccacgtctcgaggtctcgagctcgtgtcgatgacgccagtttctcgggtaacttccgccgcgttgtataacttcatcaacgtttttgtctcggctaagacgacaaagtgtaacgcctgtctcgagtgctctagtttatttctcaagtcgcgctctttgattttcatcttgttctctttcgcttgcacgtccacttcgaggcgagctctcgtttcgacttcttcgttgactttgactaacgcgttggcagcatccaactcagccgctttcacgcggtcttcgcaccgctccaactgtctctctaaactttgcacttgcattttcatcgctcggttttctgagattgccgccgactctttccgcttcaacgccatctccgcgtctgttttcgcgttgcgaacggctctctcggcttgaaatttctcctcttcggctgatttcaacgcctctctcgccgctctgtgcgttttttccaacatttccaagtgtaaatctgccgcttgtaacttttcttccgtgaattcgtgctctcttttgagtttatcgaacgcataagatatgtttttgttctcatcgcgaagcgcgttggcgtctcgaatctccttttcgagttctttttggagggtccatcgagtagcgtctaatcgtttcaattcctccgaacgctcgtactcttcttgtttccgctcggcttgttcgtaccgtgtttgcatttctgtcttcacgccaccttgatggtgatgtgtgttctcttcgtcatggttgtagtatccatcgtcttcttcgtcttcctcgtccagcgggtcgttcaataaaaccgattgttgttttcgctgttgttgcttcttcgcagcgacgttcatagacgaaggggaggaagaagtagaagcattcttcgatctcgcattggccaactccaatcgcaaactcgcaatcttttccgtcttactcttcaactcatcctcgaacgaacaaatcaantccgtcacgtcttttcgttcggcttccagctttctctccgcctcgtccgcttttcgttcggcttcgtgcgtcgcctttgccaacgcttctttgaaatcaactctttgtttcatcgatgaattcgacgcgatcgatcgtgcctcgtctaaaacgaccagcttcttgtcctctaaagcgctgtacaacaaatcgttctccttcctcttgttttctatttgttcggttaaatcttccacctcgctcgataactttacgttttcctcctttgtccgttcattttccactttcagtttcgaacaactcacgacggcttcctcgtgcgctttcgacaacgccacgcacctcgcctgcgtcgctgccaactcctttgcccctctttccgcttcaatcaacgccacgtctctctcgcgcgacatcaacatttctcggccttgactcctagacagcgactgctccaaatcttccacgtgtaacgttttattcttcacctcttcctctaaatcctcgagttctcgcgtttctttattcctcaaccggtcgttctcaatcgtcaaacgttgaatatcctcttttgtttcgttccgtatcgacgccaatttttcatccaaattcgcaacctcctcgtccgccaaccttcgctctcgctcgataactctcagctgtttatacactttctgcgcttccactaaatctttctgcaatcgattgctgtacgcgtcttgttccttgatgtgctcgttcgcgtcgannagctttgcctgtttgaaagtgtgattganaaggaaaatcatcgttttaaaatgtcaatttaaagcgctcatcacgtttacgtcgtcgcgcgcgaaagaaagattgaaaacagtgacgagttcgagaagaagaggaagacatttgagacgaagaattgtacgcacctcgagcgtgtccactctcctgtttaatatcagcaccttatccatcgccgtcgctttaaaacgagcactgctcggagaatttcctcctccgcacnatactccgtgttctttgttccatttccttcgcaccgtcatcggtgagtctttctctcgaactctttgttcgtcctcttcgtcgtcgtcgttgatttccccgagcggcgttcgatggtgatatcttttntgagaaaatgacgacgatatttttttcttcgcgaggacagttgtgactccccctcgcgatgatttcntcatctctctctctctctctctttcggtaccacgcgtcgcggtgaataatactcngtattctttcttntnncgcgtngtaatagccagcngtgttcttttgtatctaaaaatgaagagagagagnnnngantttttctttngtttntcttcccccttttttcannnnnntntgtttnnntttnncnnncncnnnnnnnnaaanaacagacanaaaaanaanaanaannntntnnannntttntttttnncncacaaacanaagaganatgngcaanaaataaananaccnaaaacctcttnnnaangagagagangnntgagagggaaaagagagagagagagagagnncacncncgcgcgcgcgnnnacgggnnnnntttattaaaannaaaanannaaaanaaaaannannnnnnatnnnnagnngnaaaannaanttntanntnnnnaannnannnnnnnnanntnnnnnnaannnntannnnnnnagnnnngnngnntntganngcgannnnanagaangannnnnnnntannnnannnngagnngngnnnannnnnnnacanntnnnncannanaatnnntttnnatgannnnnnnnngnnnaaanaaaaganganggngnnggaaaannagnnggngnnnngnnanangnnnccnnnnnanannntnnngnngnncaanaannanaannannnnnnannnntnnngnnnnngnnnncgacngngnncgnnatnnnngnnncgnnntnnnnngncacnnnnncgnnnnnatnnnnanngnntngnannagannnntnntcncgcacncnnnnangannnnnngngnnannanagnncgngagnngntcnnnntgtnntnnnngngtnannnaaannnnnanaannnnnagannnaannngagnngnngnnngcgnnngcgnnnanngngnnnnngagnnngtgtgngnncgancncnngnnangcgcgagagnganganaangagngagaganaanagnnnnnngannttnanannnagannnanngnnnnanagagnnagngangnngannagnaaaanaaagnngnagannnanannnanagnaaaaananannngngaaggangaggnngnagangnnnagnngnggnngaggngngngcngtnngagnangnanaanaanaanannanaanaanaangannnnnannngnanannaangcgnnngagngagnnnnnnnnnnnntnnncannaanaanaanaanaanannnntntnnnntnttnnntnnnnnnagnganaganaanaaannnnannnnannntntcnnnntttnanaananaannnnantannnntnnacnnnttnantaaaannnnncnnntnctcncnccncccncnnnnacnnnannnnnnnnnncnntnnttntcnngnntccctntcncnttcnnnnnnncncnnnnacnnnannnnnananntnttnnttntcnngnntncctttcnctntcnnnnanacncnctnntananntcnncnnacncnttttcntnnnccntnnccnnnttnnnnnnn

SEQ ID NO: 1166 - DNA, 4000 bp, Escherichia coli
  misc_feature (1359)..(1359): n is a, c, g, or t
  misc_feature (1991)..(1992): n is a, c, g, or t
  misc_feature (2450)..(2450): n is a, c, g, or t
  misc_feature (3234)..(3234): n is a, c, g, or t
  misc_feature (3269)..(3269): n is a, c, g, or t
  misc_feature (3371)..(3371): n is a, c, g, or t
cgctttgtaaaaaatcagaaaaaaagttataatatataagcaagttcatgcttctcggtcaggtcgtccgggaggtatgaaaaatttaaaattaaaacaacaataaagcctaccttagtcacgctctgcgggacttgggcgaggcgctgaccgaagcacatatttatgtgcttggtcgcgaagggaggtgtaaaaaattaaatgtttaagaaaaaacgaggtttcaccttaattgagttattggtggttatcgccattatcggtattctggctacaattgtgctcgtctcattaaacaccgcaagagttaaggcgagagatgctcgacgtcaatccgatatgcaccaaatcgctttggcaatggaaatgtgttatgatgatacagcttgtaatggtggtgccgtaggacagtatctagaagttacagcagtcactgggccaactgcgataggaacttatatgcctgttgttcccactactgcaggtggcgctggcactgcttatagctgggttgttaataccggaaatcaaagtaaatatttagtttgcgctgcgcttgaaataagtggagctgggtatgtttattctacccaaaatggaacaaagactgtaactggaacttgcccaaccgttttagagtaagaactgattgcctcgctttagcggggctagacaagttgctactgcatcaacagaagcaaattgtcactcaggttctgattttatttttaatttaaattttattatataaacgaagaacagccctttttatattggactgttcttttgttttcttaaaacctgtaacttgtggaaaaagatttgtttaaaggaggccaaaaagatataataaaaataaggttccgttctcaagcagattttttagagtgaaaaataaaattttaaaaaaatcaaaaattatgattaaatttttaaataaaaaatccttaagtttcaccctcacgtcaaaatttggtctgggccgtcaaaagcaagcaagctttaccttaatcgaacttttggtcgtcattgccattatcggcattttggctaccattgtccttgtttcattatcaaatgcccggactaaagccagagatgctcggcgtgaaaccgacatgcatcaattctctgttgcaatggaaatgtattatggcgccgacaacaacaatccgcattatcctgatttgccccctgatgtcgcaactgcaattcctgcactcgcccataatttagcaccttttatggatccggcagctttagatccgtcaaatcccagccgtcaatatttttggagcgactgtggcgacattactcatcagcaatattgcgtttgggctacgcttgaaaatcccagcnccccgacaacttattatattgccaatccaagaggtactaaagagacgacaattccaccttcttgttcggctacgccgaagtgttacgatttataaataaagttaatttcattaattttttaaacactatctttttggatagtgttttatgttaataacgagattgtttttagctgttatttttagtaaaatatagagagacattaattttataaattttaagatttaaaatattaaaataaataaaagcgcctttaccccgttagaaattccaaagaacaaattgttaactgggcaagacataaataaacggagtaaatttctaacggggtttactttaattgaacttttggtggtaattgccattatcggtattttggcgactattgttttggttactttaaataatgccaggcaaaaggcgcgcgatgccaggcgatggagcgatatgacacaaatttccaaagccatggctttatattatgatgcggctaacccgaattcttatcccaatatagcaaataatcagcaatcaattactacgaataggtggaataatagcgggctaaataaatacattgttaaggctcctgttgatccgggcggcaggacttattattggaaagacaggannacaccgcttacgtgtttttgcgtctatgttcagatagaaaatgaggccagcaggtggattttggataatccaaacggggtgaaaaaggttaattcaaatcccaacagcggcaactgctgcacccagtaaatatctttgaagctgttgaagtctgacttcaacaagattaaataaaatgctttatttttttatatttatattcggtctttgcgtgggaagttttttgaacgtgcttatatttcgactggggtcagacggcggagagaatgtaattggcggccacgctgagcgtggccaaagtccagctaagctgggcggccgttcccattgccccaagtgcgggcatcagcttgcctggcaggatctggtgccggttttgagttttgttttgctcaaaggccggtgccggtattgtcagaaggcgattagctggcaatacccgatagttgagctggccncgggtttattatttttaatcctatcgctgtccgacagcgataggattttttcgctgtcggacagcataacattgatttattttttgttcattgcttcctgtctaatagtcatttttgtctccgacctaaaatattttattattcctgacgaaattattattgcgggcgtgattgggacgtttttatataaattgttgtcagccttcgacttcgcttcgcttcgctcaggcaataatttataccctgagcttgtcgaagggcttaaattattgttgccgtttgcattgtccgctgtcatagcttcggcttttttcttggtcattgtgcttataactcgcggccgcggtatgggtttgggcgatgcaaagctggcatttttgatgggcttggttttgggctggccgaagattttgcccgctttgcttttggcttttgtttcgggcgccctagtcggccttatcttaattttagccggcaaagccaaaatgaaatccgaaatcccctttggcacatttttggccgccaatacatttttaataatgcttttgggcgagaagattttaattagatatattaatttaataatttaaactttaaattaaagataagataattacaaaagtgccaaaatagattcgacaagctcactataaattttattccctgagctagtttaccctgagtttatcgaagggaagggtaaaattttggcaggaaaccagtgaaattagcttttgactccagttcaccctgagcgaaatcgaagggctcaggcccagctaanctgggcaggcaataacgagttttgtaaccatctcnataagaattattttcagcatctttaaaattgtgtggataactcaattctttttagggagattatattatataattgaaattgatagaactggtagcgagtanaacccacttgtcattcccgcgaaagcgggaatccaggcaaataaggcaaaatctggattccgggtcaagcccggaatgacagcaagagagcatatcgctttttaccttatttggggcatttgtgcagtttactcgctatgacttcataaacagaaataaatacaatgtccaaacatcagaaaggttttacccccacaccttattttttatttatgaataactcagcaacaaaaaaagttttttttaataatagactgcttattggaaaaagaaaggtgtgggggtttactctttttgagatgttggtggttatagctattattggaataatagccgctttaattttggttcgttacagagaaggtcaaaaaacttataccttatcgcaagcggcgcaaatattggtcagcgatttgcgccaagcacaaaccatggcaataactggcgctgacgtgaaaaagcccgacgggacggattatccatcgatagggggctatggtatttatataaacgatgccaattcctattatctctttttaaataccaattccgatcctttgaatggctgtccccaaggtgcagtcccggaagtaatcttaaaaacagttaatttttcaagtggcataact

SEQ ID NO: 1167 - DNA, 4000 bp, Escherichia coli
  misc_feature (58)..(58): n is a, c, g, or t
  misc_feature (79)..(79): n is a, c, g, or t
  misc_feature (82)..(82): n is a, c, g, or t
  misc_feature (103)..(103): n is a, c, g, or t
  misc_feature (118)..(118): n is a, c, g, or t
  misc_feature (121)..(121): n is a, c, g, or t
  misc_feature (127)..(127): n is a, c, g, or t
  misc_feature (133)..(133): n is a, c, g, or t
  misc_feature (178)..(178): n is a, c, g, or t
  misc_feature (181)..(181): n is a, c, g, or t
  misc_feature (199)..(199): n is a, c, g, or t
  misc_feature (202)..(202): n is a, c, g, or t
  misc_feature (214)..(214): n is a, c, g, or t
  misc_feature (220)..(220): n is a, c, g, or t
  misc_feature (256)..(256): n is a, c, g, or t
  misc_feature (262)..(262): n is a, c, g, or t
  misc_feature (289)..(289): n is a, c, g, or t
  misc_feature (354)..(355): n is a, c, g, or t
  misc_feature (367)..(367): n is a, c, g, or t
  misc_feature (385)..(385): n is a, c, g, or t
  misc_feature (714)..(714): n is a, c, g, or t
  misc_feature (749)..(749): n is a, c, g, or t
  misc_feature (752)..(752): n is a, c, g, or t
  misc_feature (1031)..(1031): n is a, c, g, or t
  misc_feature (1046)..(1046): n is a, c, g, or t
  misc_feature (1073)..(1073): n is a, c, g, or t
  misc_feature (1085)..(1085): n is a, c, g, or t
  misc_feature (1091)..(1091): n is a, c, g, or t
  misc_feature (1094)..(1094): n is a, c, g, or t
  misc_feature (1109)..(1109): n is a, c, g, or t
  misc_feature (1130)..(1130): n is a, c, g, or t
  misc_feature (1136)..(1136): n is a, c, g, or t
  misc_feature (1166)..(1166): n is a, c, g, or t
  misc_feature (1175)..(1175): n is a, c, g, or t
  misc_feature (1193)..(1193): n is a, c, g, or t
  misc_feature (1199)..(1199): n is a, c, g, or t
  misc_feature (1313)..(1313): n is a, c, g, or t
  misc_feature (1358)..(1358): n is a, c, g, or t
  misc_feature (1496)..(1496): n is a, c, g, or t
  misc_feature (1508)..(1508): n is a, c, g, or t
  misc_feature (1550)..(1550): n is a, c, g, or t
  misc_feature (1607)..(1607): n is a, c, g, or t
  misc_feature (1613)..(1613): n is a, c, g, or t
  misc_feature (1730)..(1730): n is a, c, g, or t
  misc_feature (1754)..(1754): n is a, c, g, or t
  misc_feature (1757)..(1757): n is a, c, g, or t
  misc_feature (1940)..(1940): n is a, c, g, or t
  misc_feature (2518)..(2518): n is a, c, g, or t
  misc_feature (2810)..(2810): n is a, c, g, or t
  misc_feature (3530)..(3530): n is a, c, g, or t
  misc_feature (3634)..(3634): n is a, c, g, or t
  misc_feature (3748)..(3748): n is a, c, g, or t
  misc_feature (3961)..(3961): n is a, c, g, or t
cgcagtgtacttcatttctatctggaaagcatagcctttgaagcgaacttcgtcgagnggaatggtttcgagcaccttncgncgatagcaaacaaagcctgcngtggtgtcgtgaacntgnaatccngttacnaaacgtacatacttgctggcaaaatagctcatcaaaacacgtccnatnggccagttcaccacattnacnccgcttacatancgtganccaacagccacatcgaagccctcgtcgtgcgtagcngcatanaggcgaggaaggtcgttagggtcgtgnctgaagtctgcgtccatctcaaatatatagtcatagccatgctccaatgcccatttgaaaccacnnatataagcggtnccaagtcctaacttaccngaacgctcaatgataaataagcggtcggcaaactcttcttttatgagtcggtgtacaatctgtgcggttccgtcaggacttccgtcgtcaattactaagatatgaaaacacttctccaaaccgaaaacagctcggataatattctccatattctctttttcgttgtatgtaggaattattactatactatcgcttgtcataccaaatatattctatactgcaaaagtaagataaatatccgaatatcccaaatgttataaacagtttgcacttaaaagcacgttaaatgactttgtgcgtatctattgttagacgaatatattatagcnctttcggtctccattctctatatgtttagacgaanttnatatcatattaaactggatataacgctatattctttagcgcatcacatcatattagaacactgcactttacagatgcacttttttttagacataacactgagttcattatcagccttgattttgtggtaaaactggctttaaatagcaagagccaacacgctgtacggcatgtcggctcttacggttcttatatatattgcaaatgcaaaagagttcctttagtctattcgtcttcgtccttaacttctgcttcgtgttcagcaatgagggtctgctgnagttcgttaggcacnagttcgtagcttgagaacttggtggtnaaacttgcacgnccaccngtnagcgaactcagaganatgctgtagcttgccaattcnttcaanggaatcttggcttgcagcttctggtagccngcttcgctntccattcccattatcatngcacgncgtccttgcaagtcgctcattacgtcgcccatgtaatcgcccggcacataaacttccaaatcgtatataggctcgagaattttcggtcctgcaattttgaaagcatcagagaangcgtggcgagcagcaagtgtaaacgaaagttcattagagtctacngggtgcatcttaccatcgtaaacaaccacgcgaacgtcgcgagcgtagcttccagtcaatggtccgcgttccatacagtccataatacccttcaaaatagctggcataaagcgtgtgtcgatggctccacctacaacngaattgatgaanacgagcttaccgccccaaggcaatgtcttttcttccttaccntttatattcatcttaaactcttgtccgttgaacttatacattgttgggtctggcatnccttcngcgtatggctctacgatgaggtgcacttcgccaaactgtcctgcgccaccgctctgcttcttgtggcgatattcagccttcgcctgcttggtaatggtttcacgataaggtatgcgngcttccttgaatacggtttgaagnttntcattattctccaaacgccacttcaaagtgcgcaagtggaattcgccttgtccttttacgatggtctgacgtaactctttactttgctcaacaagccatgttggatcttcttgacgcatcttcaacaatgccgccataagcttttctgtatcttgagagtttacagcctcgatggcacgcatntactttggattcggatacttaatgaagtcgaagtgctgttctacacccttaccattcaatgtattgcctgtcttaacgtctttcaatttcactgtacaaccaatatctccagcattaacttgctcaacaggtatacggtttgcacctgcacaagcaaacagttgtccgatgcgttctttagatcctcggtctgcgttagttaagtcgtcgcccaccttaatggctccactcataactttaaaatagctcacctctccgatatgtggttctactcctgttttgaagaagtaaacagattcaggaccatttgagtcgggtgtaacttcttctccacgtgcgttatgtatttttggcatctcgctaacgaaaggtacaacgttacccaaaaactccattaagcgacgcacgcccatatctttaccagcacaaacacagaatacaggaaagatgctacgtgcaataagtcctttacgaataccctcgcgcatttcgtcttctgttaatgtttcagtctcaaagaacttttccatcaatgtttcgtcattctctgcggcagcttcaaccaatgctttgtgtanctccatagccttatccatttcttcagcaggaatatcttctatgataggcatacctccttctggtttccaactgtacttcttcatcaacaaaacatctataatactgttaaagtttgcgcctgttgctgtgggatattgtatttgtacacatttaggtccatatatttcccgcatactattcataacgttatcgaagtcgcatttgtcggaatctaattgattgactaagaagattacaggtttcttcaacttctctgtgtagcggaagttgttctgtgttcctacttcaggnccatattgtccgttgataagaatcactgcctggtcggtaacattcaatgctgttatcgcaccacctacgaaatcatcgcttccagggcaatcaattatgtttagctttttgttgttccattctacatggaacactgtaggaaatacagaatagccgtattcttgttctacgggaaagtaatcgcaaacagtattctttgcttctactgtaccacggcgctttattataccagcaccaaataacatactttcggcaagagtagtcttgccgctacccgcactgccaagcaatgcaatgttcttaatctcgtttgttttatatactctcataaccacaatagatttaaaaggtgtttctaaaagtctactatgcaatacatataagtctgttagaacgctaccttaaggttgttagtattatgttttgtgtagggttataagctatgcttattactactgacgcctaagttatacattttattttatctaaccaaactattcgctacaaataataaaagtattaaaagaaattattaattttgcactgaaataattcgtttcaaagcttatcaccttatataatatatggcaggactttatttccatattcctttttgtgcaagccgatgcatttattgtggcttttattctaccataacaccacacgctgagaaagcaaatacgatggatttgtatgtagatgcattatgcaaagaagccntaacagaaaagaattaccttttcggagaatattctaacactgctgaacgcattgaaacaatttactttggaggtggtacaccatcgcaattgcaggcttgccanattgagaagatattccgctgtattgccgataactatgccgacagaatgttaaactacagcgatatggaaatatctttggagtgtaaccctgatgatattactcccgaatttgcngaaaacctcagacacttgcctatcaatcgcatatcgatgggtgcacagactttctcggacgaacgattaaagtttctccgccgacgtcataaagcttccgatgtacgaactgctattgagcgtctgcgccgtgtaggaatagagaatatttccatcgaccttatgtttggctttcctaacgaaaccatagaacaatggcaactcgacatcganaaagccattgccttaaacgttgaacatatttcggcttac

SEQ ID NO: 1168 - DNA, 4000 bp, Escherichia coli
  misc_feature (1)..(3): n is a, c, g, or t
  misc_feature (5)..(5): n is a, c, g, or t
  misc_feature (7)..(10): n is a, c, g, or t
  misc_feature (12)..(16): n is a, c, g, or t
  misc_feature (19)..(20): n is a, c, g, or t
  misc_feature (22)..(23): n is a, c, g, or t
  misc_feature (27)..(28): n is a, c, g, or t
  misc_feature (35)..(35): n is a, c, g, or t
  misc_feature (37)..(38): n is a, c, g, or t
  misc_feature (42)..(44): n is a, c, g, or t
  misc_feature (48)..(48): n is a, c, g, or t
  misc_feature (50)..(51): n is a, c, g, or t
  misc_feature (53)..(54): n is a, c, g, or t
  misc_feature (58)..(59): n is a, c, g, or t
  misc_feature (64)..(64): n is a, c, g, or t
  misc_feature (67)..(67): n is a, c, g, or t
  misc_feature (71)..(71): n is a, c, g, or t
  misc_feature (73)..(74): n is a, c, g, or t
  misc_feature (77)..(78): n is a, c, g, or t
  misc_feature (80)..(80): n is a, c, g, or t
  misc_feature (83)..(84): n is a, c, g, or t
  misc_feature (87)..(87): n is a, c, g, or t
  misc_feature (89)..(90): n is a, c, g, or t
  misc_feature (92)..(97): n is a, c, g, or t
  misc_feature (100)..(100): n is a, c, g, or t
  misc_feature (103)..(103): n is a, c, g, or t
  misc_feature (105)..(105): n is a, c, g, or t
  misc_feature (113)..(114): n is a, c, g, or t
  misc_feature (116)..(117): n is a, c, g, or t
  misc_feature (119)..(119): n is a, c, g, or t
  misc_feature (121)..(125): n is a, c, g, or t
  misc_feature (127)..(128): n is a, c, g, or t
  misc_feature (135)..(137): n is a, c, g, or t
  misc_feature (140)..(142): n is a, c, g, or t
  misc_feature (148)..(148): n is a, c, g, or t
  misc_feature (153)..(153): n is a, c, g, or t
  misc_feature (161)..(162): n is a, c, g, or t
  misc_feature (169)..(171): n is a, c, g, or t
  misc_feature (173)..(175): n is a, c, g, or t
  misc_feature (178)..(179): n is a, c, g, or t
  misc_feature (184)..(184): n is a, c, g, or t
  misc_feature (186)..(187): n is a, c, g, or t
  misc_feature (190)..(190): n is a, c, g, or t
  misc_feature (194)..(200): n is a, c, g, or t
  misc_feature (202)..(202): n is a, c, g, or t
  misc_feature (205)..(207): n is a, c, g, or t
  misc_feature (209)..(211): n is a, c, g, or t
  misc_feature (214)..(214): n is a, c, g, or t
  misc_feature (217)..(217): n is a, c, g, or t
  misc_feature (220)..(220): n is a, c, g, or t
  misc_feature (222)..(222): n is a, c, g, or t
  misc_feature (225)..(227): n is a, c, g, or t
  misc_feature (231)..(231): n is a, c, g, or t
  misc_feature (235)..(236): n is a, c, g, or t
  misc_feature (239)..(240): n is a, c, g, or t
  misc_feature (243)..(243): n is a, c, g, or t
  misc_feature (252)..(253): n is a, c, g, or t
  misc_feature (257)..(258): n is a, c, g, or t
  misc_feature (264)..(264): n is a, c, g, or t
  misc_feature (266)..(267): n is a, c, g, or t
  misc_feature (271)..(273): n is a, c, g, or t
  misc_feature (276)..(276): n is a, c, g, or t
  misc_feature (279)..(281): n is a, c, g, or t
  misc_feature (284)..(284): n is a, c, g, or t
  misc_feature (287)..(288): n is a, c, g, or t
  misc_feature (290)..(290): n is a, c, g, or t
  misc_feature (292)..(292): n is a, c, g, or t
  misc_feature (303)..(303): n is a, c, g, or t
  misc_feature (305)..(305): n is a, c, g, or t
  misc_feature (308)..(308): n is a, c, g, or t
  misc_feature (310)..(310): n is a, c, g, or t
  misc_feature (316)..(316): n is a, c, g, or t
  misc_feature (318)..(319): n is a, c, g, or t
  misc_feature (321)..(321): n is a, c, g, or t
  misc_feature (324)..(324): n is a, c, g, or t
  misc_feature (326)..(326): n is a, c, g, or t
  misc_feature (328)..(329): n is a, c, g, or t
  misc_feature (331)..(331): n is a, c, g, or t
  misc_feature (336)..(337): n is a, c, g, or t
  misc_feature (339)..(341): n is a, c, g, or t
  misc_feature (343)..(343): n is a, c, g, or t
  misc_feature (346)..(346): n is a, c, g, or t
  misc_feature (349)..(349): n is a, c, g, or t
  misc_feature (355)..(355): n is a, c, g, or t
  misc_feature (362)..(362): n is a, c, g, or t
  misc_feature (364)..(366): n is a, c, g, or t
  misc_feature (369)..(371): n is a, c, g, or t
  misc_feature (374)..(376): n is a, c, g, or t
  misc_feature (378)..(378): n is a, c, g, or t
  misc_feature (380)..(382): n is a, c, g, or t
  misc_feature (385)..(386): n is a, c, g, or t
  misc_feature (388)..(390): n is a, c, g, or t
  misc_feature (392)..(392): n is a, c, g, or t
  misc_feature (394)..(396): n is a, c, g, or t
  misc_feature (398)..(398): n is a, c, g, or t
  misc_feature (404)..(404): n is a, c, g, or t
  misc_feature (407)..(408): n is a, c, g, or t
  misc_feature (410)..(411): n is a, c, g, or t
  misc_feature (413)..(415): n is a, c, g, or t
  misc_feature (419)..(419): n is a, c, g, or t
  misc_feature (423)..(423): n is a, c, g, or t
  misc_feature (425)..(425): n is a, c, g, or t
  misc_feature (429)..(432): n is a, c, g, or t
  misc_feature (436)..(437): n is a, c, g, or t
  misc_feature (445)..(445): n is a, c, g, or t
  misc_feature (448)..(450): n is a, c, g, or t
  misc_feature (454)..(454): n is a, c, g, or t
  misc_feature (456)..(457): n is a, c, g, or t
  misc_feature (465)..(467): n is a, c, g, or t
  misc_feature (470)..(470): n is a, c, g, or t
  misc_feature (474)..(475): n is a, c, g, or t
  misc_feature (479)..(479): n is a, c, g, or t
  misc_feature (486)..(488): n is a, c, g, or t
  misc_feature (492)..(493): n is a, c, g, or t
  misc_feature (496)..(496): n is a, c, g, or t
  misc_feature (499)..(499): n is a, c, g, or t
  misc_feature (501)..(501): n is a, c, g, or t
  misc_feature (504)..(505): n is a, c, g, or t
  misc_feature (507)..(508): n is a, c, g, or t
  misc_feature (514)..(516): n is a, c, g, or t
  misc_feature (518)..(522): n is a, c, g, or t
  misc_feature (524)..(524): n is a, c, g, or t
  misc_feature (528)..(528): n is a, c, g, or t
  misc_feature (533)..(533): n is a, c, g, or t
  misc_feature (536)..(538): n is a, c, g, or t
  misc_feature (540)..(542): n is a, c, g, or t
  misc_feature (544)..(545): n is a, c, g, or t
  misc_feature (548)..(548): n is a, c, g, or t
  misc_feature (551)..(552): n is a, c, g, or t
  misc_feature (554)..(558): n is a, c, g, or t
  misc_feature (560)..(564): n is a, c, g, or t
  misc_feature (568)..(568): n is a, c, g, or t
  misc_feature (570)..(572): n is a, c, g, or t
  misc_feature (576)..(576): n is a, c, g, or t
  misc_feature (579)..(579): n is a, c, g, or t
  misc_feature (581)..(581): n is a, c, g, or t
  misc_feature (584)..(584): n is a, c, g, or t
  misc_feature (586)..(589): n is a, c, g, or t
  misc_feature (591)..(591): n is a, c, g, or t
  misc_feature (596)..(597): n is a, c, g, or t
  misc_feature (599)..(600): n is a, c, g, or t
  misc_feature (602)..(602): n is a, c, g, or t
  misc_feature (608)..(608): n is a, c, g, or t
  misc_feature (614)..(614): n is a, c, g, or t
  misc_feature (621)..(621): n is a, c, g, or t
  misc_feature (624)..(626): n is a, c, g, or t
  misc_feature (630)..(630): n is a, c, g, or t
  misc_feature (632)..(632): n is a, c, g, or t
  misc_feature (636)..(637): n is a, c, g, or t
  misc_feature (643)..(644): n is a, c, g, or t
  misc_feature (646)..(647): n is a, c, g, or t
  misc_feature (652)..(652): n is a, c, g, or t
  misc_feature (654)..(657): n is a, c, g, or t
  misc_feature (659)..(659): n is a, c, g, or t
  misc_feature (667)..(668): n is a, c, g, or t
  misc_feature (670)..(670): n is a, c, g, or t
  misc_feature (672)..(672): n is a, c, g, or t
  misc_feature (676)..(676): n is a, c, g, or t
  misc_feature (679)..(680): n is a, c, g, or t
  misc_feature (683)..(685): n is a, c, g, or t
  misc_feature (688)..(689): n is a, c, g, or t
  misc_feature (694)..(694): n is a, c, g, or t
  misc_feature (697)..(697): n is a, c, g, or t
  misc_feature (700)..(701): n is a, c, g, or t
  misc_feature (707)..(707): n is a, c, g, or t
  misc_feature (712)..(713): n is a, c, g, or t
  misc_feature (716)..(716): n is a, c, g, or t
  misc_feature (719)..(719): n is a, c, g, or t
  misc_feature (721)..(721): n is a, c, g, or t
  misc_feature (725)..(725): n is a, c, g, or t
  misc_feature (737)..(737): n is a, c, g, or t
  misc_feature (739)..(741): n is a, c, g, or t
  misc_feature (747)..(747): n is a, c, g, or t
  misc_feature (751)..(752): n is a, c, g, or t
  misc_feature (755)..(755): n is a, c, g, or t
  misc_feature (758)..(759): n is a, c, g, or t
  misc_feature (762)..(762): n is a, c, g, or t
  misc_feature (764)..(766): n is a, c, g, or t
  misc_feature (768)..(768): n is a, c, g, or t
  misc_feature (771)..(771): n is a, c, g, or t
  misc_feature (1269)..(1269): n is a, c, g, or t
  misc_feature (1452)..(1452): n is a, c, g, or t
  misc_feature (1859)..(1859): n is a, c, g, or t
  misc_feature (1878)..(1878): n is a, c, g, or t
  misc_feature (1977)..(1977): n is a, c, g, or t
  misc_feature (1986)..(1986): n is a, c, g, or t
  misc_feature (1998)..(1998): n is a, c, g, or t
  misc_feature (2209)..(2209): n is a, c, g, or t
  misc_feature (2253)..(2253): n is a, c, g, or t
  misc_feature (2361)..(2361): n is a, c, g, or t
  misc_feature (2428)..(2428): n is a, c, g, or t
  misc_feature (2431)..(2431): n is a, c, g, or t
  misc_feature (2556)..(2556): n is a, c, g, or t
  misc_feature (2610)..(2610): n is a, c, g, or t
  misc_feature (2643)..(2643): n is a, c, g, or t
  misc_feature (2655)..(2655): n is a, c, g, or t
  misc_feature (2686)..(2686): n is a, c, g, or t
  misc_feature (2694)..(2694): n is a, c, g, or t
  misc_feature (2709)..(2709): n is a, c, g, or t
  misc_feature (2712)..(2712): n is a, c, g, or t
  misc_feature (2715)..(2715): n is a, c, g, or t
  misc_feature (2717)..(2717): n is a, c, g, or t
  misc_feature (2811)..(2811): n is a, c, g, or t
  misc_feature (2934)..(2934): n is a, c, g, or t
  misc_feature (2962)..(2962): n is a, c, g, or t
  misc_feature (2995)..(2995): n is a, c, g, or t
  misc_feature (3089)..(3089): n is a, c, g, or t
  misc_feature (3099)..(3100): n is a, c, g, or t
  misc_feature (3103)..(3104): n is a, c, g, or t
  misc_feature (3109)..(3112): n is a, c, g, or t
  misc_feature (3115)..(3115): n is a, c, g, or t
  misc_feature (3120)..(3120): n is a, c, g, or t
  misc_feature (3123)..(3123): n is a, c, g, or t
  misc_feature (3126)..(3126): n is a, c, g, or t
  misc_feature (3129)..(3129): n is a, c, g, or t
  misc_feature (3132)..(3132): n is a, c, g, or t
  misc_feature (3135)..(3135): n is a, c, g, or t
  misc_feature (3139)..(3139): n is a, c, g, or t
  misc_feature (3144)..(3145): n is a, c, g, or t
  misc_feature (3154)..(3156): n is a, c, g, or t
  misc_feature (3159)..(3159): n is a, c, g, or t
  misc_feature (3163)..(3163): n is a, c, g, or t
  misc_feature (3167)..(3167): n is a, c, g, or t
  misc_feature (3172)..(3174): n is a, c, g, or t
  misc_feature (3180)..(3181): n is a, c, g, or t
  misc_feature (3184)..(3184): n is a, c, g, or t
  misc_feature (3188)..(3190): n is a, c, g, or t
  misc_feature (3193)..(3194): n is a, c, g, or t
  misc_feature (3198)..(3198): n is a, c, g, or t
  misc_feature (3200)..(3200): n is a, c, g, or t
  misc_feature (3210)..(3212): n is a, c, g, or t
  misc_feature (3215)..(3215): n is a, c, g, or t
  misc_feature (3221)..(3221): n is a, c, g, or t
  misc_feature (3223)..(3223): n is a, c, g, or t
  misc_feature (3225)..(3229): n is a, c, g, or t
  misc_feature (3232)..(3233): n is a, c, g, or t
  misc_feature (3235)..(3235): n is a, c, g, or t
  misc_feature (3238)..(3239): n is a, c, g, or t
  misc_feature (3241)..(3242): n is a, c, g, or t
  misc_feature (3245)..(3246): n is a, c, g, or t
  misc_feature (3248)..(3248): n is a, c, g, or t
  misc_feature (3250)..(3250): n is a, c, g, or t
  misc_feature (3254)..(3255): n is a, c, g, or t
  misc_feature (3257)..(3257): n is a, c, g, or t
  misc_feature (3259)..(3259): n is a, c, g, or t
  misc_feature (3262)..(3262): n is a, c, g, or t
  misc_feature (3264)..(3265): n is a, c, g, or t
  misc_feature (3268)..(3269): n is a, c, g, or t
  misc_feature (3274)..(3274): n is a, c, g, or t
  misc_feature (3277)..(3277): n is a, c, g, or t
  misc_feature (3283)..(3283): n is a, c, g, or t
  misc_feature (3287)..(3288): n is a, c, g, or t
  misc_feature (3291)..(3291): n is a, c, g, or t
  misc_feature (3295)..(3299): n is a, c, g, or t
  misc_feature (3302)..(3302): n is a, c, g, or t
  misc_feature (3310)..(3310): n is a, c, g, or t
  misc_feature (3312)..(3312): n is a, c, g, or t
  misc_feature (3314)..(3315): n is a, c, g, or t
  misc_feature (3317)..(3322): n is a, c, g, or t
  misc_feature (3331)..(3331): n is a, c, g, or t
  misc_feature (3343)..(3343): n is a, c, g, or t
  misc_feature (3346)..(3346): n is a, c, g, or t
  misc_feature (3364)..(3364): n is a, c, g, or t
  misc_feature (3403)..(3403): n is a, c, g, or t
  misc_feature (3411)..(3411): n is a, c, g, or t
  misc_feature (3445)..(3445): n is a, c, g, or t
  misc_feature (3490)..(3490): n is a, c, g, or t
  misc_feature (3505)..(3505): n is a, c, g, or t
  misc_feature (3517)..(3517): n is a, c, g, or t
  misc_feature (3523)..(3523): n is a, c, g, or t
  misc_feature (3544)..(3544): n is a, c, g, or t
  misc_feature (3550)..(3550): n is a, c, g, or t
  misc_feature (3553)..(3553): n is a, c, g, or t
  misc_feature (3559)..(3559): n is a, c, g, or t
  misc_feature (3568)..(3568): n is a, c, g, or t
  misc_feature (3571)..(3571): n is a, c, g, or t
  misc_feature (3598)..(3598): n is a, c, g, or t
  misc_feature (3606)..(3606): n is a, c, g, or t
  misc_feature (3615)..(3615): n is a, c, g, or t
  misc_feature (3630)..(3631): n is a, c, g, or t
  misc_feature (3633)..(3633): n is a, c, g, or t
  misc_feature (3635)..(3635): n is a, c, g, or t
  misc_feature (3644)..(3646): n is a, c, g, or t
  misc_feature (3649)..(3653): n is a, c, g, or t
  misc_feature (3658)..(3658): n is a, c, g, or t
  misc_feature (3660)..(3661): n is a, c, g, or t
  misc_feature (3664)..(3666): n is a, c, g, or t
  misc_feature (3668)..(3674): n is a, c, g, or t
  misc_feature (3677)..(3679): n is a, c, g, or t
  misc_feature (3681)..(3685): n is a, c, g, or t
  misc_feature (3688)..(3690): n is a, c, g, or t
  misc_feature (3695)..(3695): n is a, c, g, or t
  misc_feature (3700)..(3705): n is a, c, g, or t
  misc_feature (3707)..(3709): n is a, c, g, or t
  misc_feature (3712)..(3713): n is a, c, g, or t
  misc_feature (3716)..(3719): n is a, c, g, or t
  misc_feature (3723)..(3723): n is a, c, g, or t
  misc_feature (3726)..(3728): n is a, c, g, or t
  misc_feature (3730)..(3730): n is a, c, g, or t
  misc_feature (3732)..(3738): n is a, c, g, or t
  misc_feature (3741)..(3744): n is a, c, g, or t
  misc_feature (3747)..(3747): n is a, c, g, or t
  misc_feature (3751)..(3751): n is a, c, g, or t
  misc_feature (3757)..(3758): n is a, c, g, or t
  misc_feature (3760)..(3760): n is a, c, g, or t
  misc_feature (3763)..(3764): n is a, c, g, or t
  misc_feature (3766)..(3769): n is a, c, g, or t
  misc_feature (3771)..(3771): n is a, c, g, or t
  misc_feature (3773)..(3775): n is a, c, g, or t
  misc_feature (3777)..(3778): n is a, c, g, or t
  misc_feature (3781)..(3781): n is a, c, g, or t
  misc_feature (3783)..(3785): n is a, c, g, or t
  misc_feature (3789)..(3789): n is a, c, g, or t
  misc_feature (3792)..(3800): n is a, c, g, or t
  misc_feature (3802)..(3802): n is a, c, g, or t
  misc_feature (3804)..(3806): n is a, c, g, or t
  misc_feature (3808)..(3808): n is a, c, g, or t
  misc_feature (3810)..(3814): n is a, c, g, or t
  misc_feature (3816)..(3816): n is a, c, g, or t
  misc_feature (3819)..(3823): n is a, c, g, or t
  misc_feature (3825)..(3826): n is a, c, g, or t
  misc_feature (3830)..(3831): n is a, c, g, or t
  misc_feature (3834)..(3836): n is a, c, g, or t
  misc_feature (3840)..(3842): n is a, c, g, or t
  misc_feature (3844)..(3844): n is a, c, g, or t
  misc_feature (3846)..(3848): n is a, c, g, or t
  misc_feature (3851)..(3852): n is a, c, g, or t
  misc_feature (3855)..(3855): n is a, c, g, or t
  misc_feature (3857)..(3859): n is a, c, g, or t
  misc_feature (3861)..(3862): n is a, c, g, or t
  misc_feature (3864)..(3868): n is a, c, g, or t
  misc_feature (3870)..(3870): n is a, c, g, or t
  misc_feature (3872)..(3881): n is a, c, g, or t
  misc_feature (3883)..(3883): n is a, c, g, or t
  misc_feature (3885)..(3894): n is a, c, g, or t
  misc_feature (3896)..(3899): n is a, c, g, or t
  misc_feature (3901)..(3901): n is a, c, g, or t
  misc_feature (3903)..(3911): n is a, c, g, or t
  misc_feature (3915)..(3920): n is a, c, g, or t
  misc_feature (3922)..(3925): n is a, c, g, or t
  misc_feature (3928)..(3929): n is a, c, g, or t
  misc_feature (3931)..(3934): n is a, c, g, or t
  misc_feature (3936)..(3940): n is a, c, g, or t
  misc_feature (3942)..(3946): n is a, c, g, or t
  misc_feature (3948)..(3950): n is a, c, g, or t
  misc_feature (3953)..(3953): n is a, c, g, or t
  misc_feature (3955)..(3955): n is a, c, g, or t
  misc_feature (3959)..(3964): n is a, c, g, or t
  misc_feature (3966)..(3966): n is a, c, g, or t
  misc_feature (3968)..(3968): n is a, c, g, or t
  misc_feature (3970)..(3980): n is a, c, g, or t
  misc_feature (3982)..(3982): n is a, c, g, or t
  misc_feature (3984)..(3984): n is a, c, g, or t
  misc_feature (3986)..(3986): n is a, c, g, or t
  misc_feature (3988)..(3989): n is a, c, g, or t
  misc_feature (3991)..(3998): n is a, c, g, or t
  misc_feature (4000)..(4000): n is a, c, g, or t
nnntntnnnncnnnnnttnngnnaaannccaaatntnnttcnnnaagnanncnnaaannttttnttncctntnngtnnanatnnttntnngnnnnnnttnttncncttttttnnanngngnnnnnanntgttttnnnatnnnattgcnttccnaaaagagnnaaagagnnntnnntcnnattanannctntttnnnnnnntnttnnntnnntanccnccnanaannntttntttnncannacnttaaagaannttanngtttgntnntccnnnggnttnnngtntanncngnttttgtatatntnttnantttttngnnanaanancnntncaganntnnntnttncgnggaggngttcttnannntgnnnaannnantnnnttnnannncntnnntnaaaacnctnntnntnnngcanaaancntttnnnnaaannctctttangtnnntgantnncccaaatnnnaanccgnnttcnttgttgnnntttnnccngananccnncnnaaatannnannnnnanattntaatnttnnncnnnannttnttnncnnnnngnnnnngttntnnnaaanttngnaanannnnantttcnntnnanttctcnttcttnaaaaatnttnnnaatntntcgnnatatannanntttancnnnncnaaaaagannancnattnggnntannnaannccatnttnttnnatcttnaaagnntanatntntttnaatatcaccttntnnnttttgntatnnganaanntgngnnncnatngggggtatgaatttcctttttactaattgtaaaaaaggctaccacattactgaggcagccttttttaggattgctatgcttattttttaaacttagcgtatttgtttttaaatttatcgatacgtccggcagtatcaataagtttagatttacctgtgtagtaagggtgtgaagtgcgtgaaatttccaactttactaaaggatactctaccccttctacttcaatggtttctttggtctctactgtcgatttggtgataaagatatcgtcgttcgacatatctttgaaagccaccaaacgataagattctgggtgaatttcttttttcattgcaatgttaattcttttattacgtaattttcagggcgcaaaagtataacattttttttaaatagccaaattactccgagtattttttgatgaggcgcaccattaggtcgcttagtttctctacctgatactcgccaacgctgggctctaaatgcttgtttcctatnccgctatggtcggtgataaacacataggtaccattggtgtacatcgctataaatcgcatcagaaactcagtagttttatctattccactggctactacaggtatgagtttaatgccactagcagcagccgttttcactgagtattgtatactgctgattaccgcaggcttattatgagggggngcatcgagtactaagaaagcgatacgtgtgcgtgcctcaggttgccattgcagttggtttagctgtacgagggctttgtctaccgcttcagggaaatcacccccaccatcagcgcgctgttggctgataaactctgtagtctggttaatatcttcagtaaaaggactgtgttttaccacatactcatcaccctcatcgcgatagaaaaccgtagccgtactgattttcagttgcgtattagtcttttgtacctcattaatcacctttttcaagtccattttcaggaactcaagttcatcgcccatagagcctgtagcatctaccataaaggctatttgcacaaggttagtaggcgaggggagagtctcatcaagggcaatacggttcacctgagtttcgctgatagnagctgtagatacccactgntcattcacttttagccgaagcagagcggtgttgagttctttttctttctgaaaagctcctacccacagttcagcccttccgaggttatcggttttagcngtccaaatnggggtatcgttncgaaagagtgtaacggtagcattagcagccggcttatttttagcggttatggctactgctatacggtgattggtatacatttgccaatcgtcaggaaaacctttgaatggctctttcataagagttttttgatagaaatcccagttgtctaggtcgttccattcgccggcagtcactaagccaccttgaggttgaatacctccttgaccanctttgctttctttagaatgcatagaataatcgtcgtgcattccntcatcaggtctagcgcacgcacttagtaaaagtgctgctataaacgaaagaaaatacagttttttcatatcttaaaatgatttattgattttatttccagccctatcnacagccgttactaccactttactatcagtggcagcagcgtttagtgccgtagtaacatactcccacntantatctacaaatatagcgcttccctcttctattatcgtcacatcatttataatgctaaccgttacccccactactttaaaagtatcagctacctcaatagttatgacctctccctgtttgctaccngtatagttcgcaacatctattgccttaatttcaggcagtctcaaacaatccganagcgccatattataggcattgataaccccgcgncgtttagcttcngcactgtagagagcctttagttcaggatttngcataacncttttagcataagcngtngcnantttaaatccttgagcgcacatctgctgcttggcactgcgggcagcaggttttttcggcattttcgataagaccgtctttccgtgcacccgcttnagcaccacctgttttcctatatttccagagactttttgtagtataatattatcatttgtccgcgccataatccatcgttttatcaaagcacaaagatacaaaataatccctaaactaccaaancttttgtgtaggaaaatcagcgaactgncgcagcttagtatatgatgtaaagtcagtgtangatcagtgtaggattagtgtaagatcagtgtaggatcaaagtatcagcaagcagctaaaatcatttatttgctaaatttcaatcttgcacattnaaaaaaaaannctnnttttnnnncantaaanttnatnatnaancanaatnaaaannaaaatattnnnatntgcnaaantattnnnaatggnngtnatcnnnttnngcancnttgtttttannnccngttcancncnnnnnctnnanttnnannagnnananttgnncntnacnannctnnacggnaanaccatncccnnaanagtnnnnnttnctcgctcnanannannnnnntcaaaaggntatatggggcgnganaatattcccgaaggaacnggtatgctttttatttttaaaagagacgaaaagttaagnttttggangaaaaatacgcctacccccctttcaattgcgttnattaactcgagtggtgaaatccgcgaaacacgcaatatgacaccnttcagccatcaaagngtggactcatcngaaccngtgcgttatgcccttgaagtncctcanggntggttngaaaagaanaanataggaaagggttgtataatcaaactnccatagcngataaagtnaaattaaataataannanantgaaaaaannnaannnnnttttntnnacnnnannnnnnnaannntnnnnnaannnaatanaaatnnnnnnannnatnnatnnnntttnagnnnanannnnnnnttnnnnaanaaanactccnngnganntnnnnanannncnnggngnnntttnttnnnnnnnnnantnnnantnnnnngntannnnntnnaaannttnnntctnnntntnnncgnntanannnannannnnnanannnnnnnnnngntnnnnnnnnnngnnnntnannnnnnnnnagcnnnnnntnnnntanntnnnntnnnnngnnnnngnnnaananaaannnnnnantntnnnnnnnnnnnananananntnnnnnnnnan

SEQ ID NO: 1169 - DNA, 4000 bp, Escherichia coli
  misc_feature (429)..(429): n is a, c, g, or t
  misc_feature (776)..(776): n is a, c, g, or t
  misc_feature (858)..(858): n is a, c, g, or t
  misc_feature (861)..(861): n is a, c, g, or t
  misc_feature (1493)..(1493): n is a, c, g, or t
  misc_feature (1990)..(1990): n is a, c, g, or t
  misc_feature (1999)..(1999): n is a, c, g, or t
  misc_feature (2005)..(2005): n is a, c, g, or t
  misc_feature (2021)..(2021): n is a, c, g, or t
  misc_feature (2031)..(2031): n is a, c, g, or t
ctacatcggcgtgaagaaagcacatgcggtgctcagggaccgggacgcgagcgcgccgaagacgtactcgttttgagaacgagaaagacgagagagaagaaaaagcggggacgcgacgcacggcgtgggaaccaggcaaatagacttagcaagacaagcgagcgcgcgtaagaacaagaatttaatcagcgcaatagaaagacatcgtataactaacatctcgtaccctacacggaaggctggagacgtcgagcagatgcggtggcggaataaatattgacttgagcatcacccccgtggcaccttcggaggcatcctgggcgccaaaagatgtgtttccccgcggggactcgaaccccggaaggccgggtgaaagccgacactgataaccactacatcacgtctccctggtgaaacccagcacggggngcgcgggtgatgagacaattattttttgttctatcttaaaacaaaacgttcacgtctaccacagcccctgaacaaacaccttcatggatccagcccacgcgcgggtgttgtcacttcatggggcagccgttcgcttttgcccacttccacaccttgagttgcctgcgctttgtcgcgtgtgagcacgtcctcctgtcccacgggcagccgttcgagtgcgcccactgcagcgtctcgaggtgcccgccctccgccgcggactcgcacgtctcctcgttccaggggcagccgttcgcgcgcaaccactgcagcacctcgaggtgtccttctctcgccgcccacgcgcncgtcttcttgtcaaacgggcagccgttcgagtgcgcccaccgcagtatctcgaggtgcccgcctcccgccgccaatctgcangtnttctcgtcccacgggaagtcattctcgcgcaaccactttagtattcgagttgtccctccttcgccgcccaaacgcacaacctatcggagtcgtcatccaggtcacctcgctgatgcataagttgcagcccgattgggtctccgaactctatggctttctcagctcccagttcgtacactttacgccccgtcgccgccaccgcatcgcgcatctcacgactcaccgctcggagccgtgcgagatctgagggatcgggcagattgcgcgaactcaggacgtgcgtaatgaggatgtggactggcagagccgcgaaggcggcgccagcatcacgctggtgcgcgatattactaaagtcaggagtgttggggtgggatgtcggcatgctgcgtcgttgcgcgggcgagtgtgacttgagacgcgtttcgtcgcttccgagaaaaggcgtttttttttaaattaaaagtctgaaaataaattcacttctcgcttccttctcgacaccaaaacgctcaaggacgcgcgacggcgccgtcaaccacaacctgcgccgcgtcacaaaccgccgtgacgagcggcgatgtcgcgacttggaacacgtcagtcgaggtggggaggctgtccggccggcagcnaaaaggcaaaaacattttcgcaaaaagtgtgagtttttgtttgcgcgcgtctgtgctcgataagcttcactgcttcaggctcaattttgaccggcatggcggtttcgaagggggcttcaccgaggcggtcaagatgcaaaaacgggctggcagatatgccatgcatcgaaccgccgacgcaacaaacgtcaaaattttggacatcgtttttccaaaaatgatttcccaagattgagcttcacccatgcgacagtgcgatgctcacggaggcactgatggatgcaaaaactgatggatgcaaaagatgtgtttccccgcggggattcgaaccccggtatgccacgtgagaggcgactatgctaaccaactacatcacggggaacacaggcgcaacttccgtaaagttgttgcggtctgtatttcagccaggagttaaccggcttggtggcgattttcgaatctgtctctccattaggagaggcggtttgagcagcagnccacggaangaaggnttataaccacagatanaaaatatacnatctcagagcttatttagtcggcgaaaaacgcaaatccttacgactcaagatcgaggggttaaacgtgccatatacactctagggaaaaacaaaactgagaagcccaaggggcgaagcaacgacacttcccgacactccaacaccgcgccgtgctgtcccctctccacgctcttctcccgcgaagacaccacaccacgccttctctgcgtctcacacgagtctctcacgaaatacgcaccatgcgctcgctgaactggaacacgcgaaccgtcgcggtcgccgcgctggtactcgccgtcgcgtcacaccttcctcacgtcgcactcgcctcgggagacccggaggtggttgacggcgtcgagcctacccacgaaggctccaccgcgttcatcatgggagatgtcgccacgctccttgacgtgaaagacatgcaagaaaccgactcagccgctccggacgagctcgcgaaagggtgggaggacgccttggaagtctcaacgcagcctcgtaggttcgactttgttttcacctcgcctcgccgcgcggtggaaaccatgttccccatgtcttgggacgtccccctgacgccttccacgatgatcacgtccgtgccgcgacggagcttacgaccgtgccatcacggcggtgatgacatgatgcgatacgctgatctgttttccctgacccgcgcgcgcgacgaaaccgacgacgctccgtggttgcgtccgtccatggcgttcaccaccacgaacacgaaaacgctcaccacctgggtcgtgtgcgttgacgtcatcgcgcttctagtcaccgtcgtcgcgctggtgatcattaccgtcctcgccatgcttctcctcgatctgtgcatgtgctgtttcggagtgcgggacggagacgacgaggacggaccggaaaccgcggacgcgtcgacggaaacgcttctcccgttgacggattcgcgtacggagaaacaaaaacaattcgcggaagacgaattgctggttacacaccaatgctgaacactacctctccgtcgctgctgaacacgcgatgtgcgtaccgccgcttgaaacaaacgcgcctacggtgcgttccgggaggtgagaaaataagatcgaaagaacgtgaatcgagaacagacgaaagaacgcaaacagagagactgaaattggacgtaatagtacggacgtagagactgagattggatgtaatacggatgtagagatacggatgtagagactgaggttggatgtaattggatgcataaattggatctccatacaaaacaacgctcatcatcatcatcatccctccttctttctattgctgcagaagccgttccgcgatgaacatgtcttccggcgtggtgactttgatgttgacgtacgacccttccgtgatctgcacgcgtccccccatgaactccacgattgacacgtcgtcggtgacttcgtaccctttttcgttgaccagcgcgaacccgcgtttcagtaaatcgggcttgatcacctgcggcgtttgcatttcccacagtttgcttcggtccaaggtcttggcgattgataaatcgtcgttcacctccttcaccgttgctttgcacggcaccgctaagaccgcggcgccgtgcgtcatggcgtctacgaaacaccgcgccgcgtctttcacgtcggtcaggggacgcgcgctgtcgtggatcgcggcaagcgcggcgccgtcgcgaacggcggacaagccgttgaacaccgaatcctgacgttccttgccgggcagcgcgaaaatcacgggcttgggcactttacagttctcgaacacgtcccggtacgacgggtcgcacaccaccacgatctcccccacctcgtccatctccgcgaacttctggaagctgtacagcgcgatgggcgtgccgagcaggggcaggtactgtttcggcatgtcagcgcccatgcgcttacccacgccgcccgcgagcag

SEQ ID NO: 1170 - DNA, 4000 bp, Escherichia coli
  misc_feature (113)..(113): n is a, c, g, or t
  misc_feature (1168)..(1168): n is a, c, g, or t
  misc_feature (1176)..(1176): n is a, c, g, or t
  misc_feature (1204)..(1204): n is a, c, g, or t
  misc_feature (2003)..(2003): n is a, c, g, or t
  misc_feature (2408)..(2408): n is a, c, g, or t
  misc_feature (2702)..(2702): n is a, c, g, or t
  misc_feature (3053)..(3053): n is a, c, g, or t
atttgctggagcctaccttgaacctcttgagctatattctctctaccaactgttaatgtttgttctaaagtgttgtcaccaacaacatgtcttaacgcactttcaattgcttntcttaggctgccttctggatctttaacatttaaaacaaaatcttttaaattagcaattctatattgtgctgacacagttacatctacaatattttcgtctttggttaacatgctattggtctgggtataacgtctagtcaatgaaacattctcaatatagcgttcgtctattccagccaacctaaagtttaaaccctcttgttgttcttcataaaacttaccaaatctcaaaatgacagctctctcagaagcatctagctgataaatacactgtgatccatagattattaaaaatgcaaaaaaaccatataaaaagattcttgttgttggtattttcatacctccgccatttccagatccagttccagaaccttttccagatgagctatctttaccgccaataaatgctgaaaactttttaattagatcatcgaagtcaggggcatcatttttgcctccccacggatctttatcttgattatcccaattcacaatagattacctcttaatttattctttattataaacctaatttaaggccataaacctttatttaaagggtaaaagacaaactttctacctcttctttgatttgttcttttgaactaaggtcatatttctttaaatccttccatgatctcatccatgttgtttgtctttttgctaattgccttgttgcaaagagagctctatcaaaaaactcactgtcatcatactcattattgattctagctatagcttgtttgtaatttacagattttcggattggatgattttcagaaatattgtattttttaaggagcgagctaacctcatcaagcaggcctgatttaataatttgtttaagtctttgttctattcttgagtgaatcaaggacctatcatcttcaaaaataccatattgatgcacattaaagcgatttgaaagatttgcttcactatttaaccctatttgagagctaaatgactttcctgttatctctattacctcaagagctcttacaattctttgctcatctaactcattaacttggtttgcataattgatatctttntcgatcancataagatggagctcttttatccctttngttaatataattttttcaagattttctctaatctcattatccctttcaggtaaatcatctaagccatttagcaaagatttgaaatacatcattgttccgccaacaaaaacaggaattttttctctctcatgaatagaattaatcagttttattgattgtttataaaaatctgaaactgtaaaaatagattctggttcgatgcaattaactagatggtgaggatacttccttaagatctctttgtttggctttgcagatcctatatcgcaacctttgtagaccattacagaatctacactaattatttctattgcagatgaatcatatatatcaatggccagatcagtcttgcctgatgctgttgaccctaaaataaaaacaattgattttttgatactattcttttttataaggcttcttcgttagtctcacccgttcttattctaataacttcatctatttgcgttatgaatatcttgccatcaccaatttttccagatccagcagattcaataatcgcattctttacagactcgactaattcatcagatgttgctatttcaattttaatttttggaagaaaatcaatagtatattctgcacctctatatagctcagtgtgccccttctgtcttccaaagccctttacctcagtcatggtcatacctgaaacacctattttatctaaagatgctcttacttcttctactttaaatggtttaattattgctgttactagtttcaacttatcacctcttttatattaatcatttctataatgcccgtacactgcttatcngttgagcctttgttctttaaacaaatttcaaaagccttagaagacatattttctcttaaaccattgttattaagcaagtctttgaatccacttaacacatctaaatttttatctatctgcaaacatgcatcttcatcgacaaataattttaagatatcttgaaagttatgcatatgtgggccaacaataaatgggcatctttcaaaggctggctcaataatattatgaccaccattactctgaaataaactcccgccaacaaaagcaaattgagcttttgaataaagctctcttaacattccagtgccctgaattatttcaatgcttttattagcaatatctatgggtacttcttctaagattcttgcattgagattcgatttatctaatagttttttgatcgcnaaggctctctctggatgtctaggggctattacaagaccaattcctggattctctttaacaatcttcttataagcatcaatgattatttcatcttcaccagcatgagtgctcgcagctaaaataaatggtttgttatttttaaaaaaggtttcttctgcattatgatcaatatcaaactttaccgatccaacacactctattttttctgatagtgccccaagtttttcaaaacgtgacgcatgagatttactttgtgtataaattattgatatttttgaaattattttcttaganaagagattaagttttttatagtttttaaatgatttttcagacattcgtgcatttgaaagaatgattggaatattttttgagtgagcaatcgatatcatgcttggccaaatctctgtttcaaaaagtattaatgcttttggattgaaggatctaaaaaaccctgaggtaaaaaatttaaaatcccatggtgcatatacgaccttcaaccttgatccaaatattttatttgcctctctgagaccggtaggagttgagaccgtcaatataacatcatggttttcgagtatcttattaacgatcttagctgaagaaataacttctccaaggctaacagcatgaaaccaaacactnttatcagcttttgagttgtatattccaaatctatttaaaaaattagatctgtagtccttgtcattaaagcttttaaataggattctaataatcagaactggaatcattagaaaaataaaaaggttatataaaaagagaatcatttcttagtcatgcacatttataatgtaataatacagcttaaaagacatgaatagaattttattaaaccttcttataagtttctggaagataatactgctttttcctagacctgttcatataaagcttggttttgccttggggtatttcttttataaatcaaatatgaaaagaaatagatttagtaaggcaaatattgatttatgttttagtattttaagtcctgttgaaagagccaatatagttaaatcaaatatcctaatgtcagggtccattctgtttgatactggaatagcctggttttggtctgacaaaaaaataaataaaaatattaactatgagataagtggcttggatcaacttattgaagagcaaaataataacaatggagtgcttctgttttttaagcattctcttcatctagagctagatgctagattattaggtatgaatgctgacatctatggagtggaaagagttcataattcaaattcatttgactccattcagaactcgggaagactaaaaagccttaaaggtgcttgtgatagaaacaatccaattaaatttatacgctggttaaaaaaaggtaaaacagtcttatatgcaactgaccaagactatggcctaggtcagtcagatgttgttaatttctttggcaatcctgcagcaactatttctgcgcctctaaagattgttaaagccacatcatgcaagacatattttttaaatagctttgttaaaaataataagtacttcatagaaattgaagagttggatttaaataaagagtctggaataacttt

SEQ ID NO: 1171 - DNA, 4000 bp, Escherichia coli
  misc_feature (11)..(11): n is a, c, g, or t
  misc_feature (342)..(343): n is a, c, g, or t
  misc_feature (373)..(373): n is a, c, g, or t
  misc_feature (561)..(561): n is a, c, g, or t
  misc_feature (619)..(619): n is a, c, g, or t
  misc_feature (1473)..(1473): n is a, c, g, or t
  misc_feature (1497)..(1497): n is a, c, g, or t
  misc_feature (1987)..(1988): n is a, c, g, or t
  misc_feature (2007)..(2007): n is a, c, g, or t
  misc_feature (2307)..(2307): n is a, c, g, or t
  misc_feature (2350)..(2350): n is a, c, g, or t
  misc_feature (3196)..(3196): n is a, c, g, or t
  misc_feature (3219)..(3219): n is a, c, g, or t
  misc_feature (3423)..(3423): n is a, c, g, or t
  misc_feature (3564)..(3564): n is a, c, g, or t
  misc_feature (3567)..(3567): n is a, c, g, or t
  misc_feature (3576)..(3576): n is a, c, g, or t
  misc_feature (3591)..(3591): n is a, c, g, or t
ggcacgtcaanctgtcaccatcgaagaaggtttgtcagcactcaatcattttggattttcactcattagttttttattagcactcccgtttatgcagccatttccagtgggtcctatcagtgtattaggaggggttactttcgcagcatttggctggcaaattttaaaagggtataccgtcccgcatttgcctcagaaaataaacgggattgttttaagtgctgataattggcgacgcattacaaatgctgccattaaaattattcagtggactgaaaaatttactaggccacgtttagctttgttaattcgaggttctttaggtgtcaaaattgaagcttnnattctcattctctcaggtgtcctcatggcngttccttttggcatactcccattaaataatttcttcccaggccttgccattgtattttgtgcattaggtcaactccataaagatggattttttattttgattgcattcttttggattctttttaccattctttattttgctgcattttttataggtctctatcttttagggctagaaggactgcatantttcagccactggctccatcaactcgtttcatgaaatcatttgctgacctcttaattncttggcatgccaagtcaggtcggcaccatttaccctggcagcaatcaaaagacccttacaatgtttgggtatcagaaatcatgttgcaacaaactcaagttgcaattgtcattgattattatcatcgattcatgaaaaaattcccgaccattaaggcattggcagatgccgatgaagaagaagtcatgcaattatggagtggtttaggatattaccgccgtgcgcgttttttacacgaaggtgctcaaatgattatggaagagatggaaggtgtctttccttctcaattcgatatgatgatgaaaatacctggcattggacgctctaccgcaggtgccatttcagcattttcgttcaatcaaaaaaaagcaattctcgatggtaatgtaaaacgtgtcttgagccgctattttttagttagagaatggacaggattacctaaaacagaaaaaaaattatggggttatgctgagtcgcttcttccagataaaaacattgcaacttatacgcaagcactgatggatttaggcgctaccgtatgcagcaaaaaaactttgtgtgaaacttgcccattaaaaaaaacatgccttgcatttcagaagaataaagtgcatctggtaccagcttctcgacctcataaaaaaattccaaatgaaacaacacacatggtcattgttaaacatcatgacgaagttttacttattaagagacctcagggaggtatatggggtgggctatggtcgctacctcagtatgaagatcaagctgcgacatctaaagcttggattaaaaaacatttcggattagaaacgagcttgatagaaaaggatcttaaagcttcaacgacattcacncattacaagctcgatattacttanagtatattggaagctaaatcacagcgcgctaaatctcctcacacgtggctctcaataaatactcttgagggtgcagccattcctgccatcatcaggaaaatacttttaaaactctaatgtcatatcgcggtgcagtatttcagcatccaaatatgtgtcgcccgtaacttcaaatccaaacttcacataaaaattgatggcgttacattgagcactgatatgaatactagagagttgtttaagttttgcagtcacaatcgcattttctattaaagtgctcccaacaccttgacctcgatattcttttaatactgccatgcgtcctaattgcatttgacttttaattacaatagccctcgcacacccaatagcttcctcatctttaaaaactaaaaagtgtattgccttttcatccatgccatcccactctaattcaggcgtcactttttgttcttgaataaatactttctcgcgaatattcttgagttgnncatggctatctatccactntacgatctcaactttcagattatttttcataagtgaaatgcttgcatcttaatgctgttagaggcatgatgtgttttctttatatctaattttaaggattatatgaataaatttttacctgctattggacgtgtatttattgcacaaatttttcttgtatccattcttatatcacttaacggcattatgaacacacctgatggttatattgcctaccaaaatggattgatgagtcatggtcttccaggtatttttgctccgatctccgtcattgtgcaacttttgggtggctttgctctntttgtgggttttaagacaagactgtttgcacttatattaacgntttatacatttatcaatgcattgtcttatttttataccgctacattactgccctctccggtgttcctcattccgcttcaacaagcacttcagtacacagcgattacaggcggccttattattttaatgcagaatccggtcacgatctttgcgcttgataatgtaacaaacacaaaaaaacgtaaataagatttatgagcatttaaaaaagcagccatcaaggctgctttttttatattgatctatgtcacatattgttatcaatcatggttagcattaaaatatctcattaagttagaatagaacttatagtttactaatattaaggaatttattatggcagcagcatccacaaaatatacaaagaccgcgatcgtccttcattggctcattggttttggcattatctttatgtttttattaggctggtatatggagggcttaccgaaagaagctcctaaagctatgagttttgatttatttgatttaggcatttatacatggcaattatctgaagaaacttcaccgcgttctttttactttaatttacataaatcaattggtattacgatcttagctcttattgtatttagaattttttggagaattacacatccagcaccagcgcttattaaaaccatgaaagcttgggaaaagaaattagcgaatgctacccaccatgctttatatctcattatggtgttattgcctgtatcgggtgtagtaatggcactctctagtaaatacggcattaaatggtttggtatccctttagcagaaggctttggcaatgaaactgtgagagacttctttaaagtgacacatgaaaatattggtatattactantcgctctttttgcccttcacgtncttggtgttcttaaacatacatttgtgaataaagatggcactttaaagcgcatgacgtttaaataaatttattgatatcttaaagcttcaattggatgaagcttggcggccttagttgctggataataaccaaagaagacgcccacactcgcggccactgaaaaagctaatacgatggatcgcattgaaattaaaatttcagcncccaccattttttttacaagaagtgcaccgcccaatccaagcgcaattccaatcacgcaacctacaatagaaatcacacacgcctctaaaagaaactgaagcagaatatctttttcacgcgcgcctatcgccatacgaatnccnatttcacgngtgcgctcagtgacngacaccaacatgatattcataataccgatgccacctacaagaagcgagatagaagcaatggctcccaataacatcgacatcgtttttgcagtttcacttgcagttttggccatagccgttaaatttctcactgaaaaatcactttctgcattttcacggatattatgtcgctgacgaatcaaatcgttaatcgcatcttcagcaacccccatatatttttctgatttggcttgcgccatgatcatacgaacacttcctggaatttgattaccaaataattttctctgcgctgttgtgatggggacaataatagtatcgtcctgatctcggccatcgaagctttgtcctttactttctaatacacccaaaatcataaatgggctttttttaatacgaatcgttttaccaa

SEQ ID NO: 1172 - DNA, 4000 bp, Escherichia coli
  misc_feature (1973)..(1973): n is a, c, g, or t
  misc_feature (1990)..(1990): n is a, c, g, or t
  misc_feature (2077)..(2077): n is a, c, g, or t
  misc_feature (2079)..(2079): n is a, c, g, or t
  misc_feature (2139)..(2141): n is a, c, g, or t
  misc_feature (2145)..(2145): n is a, c, g, or t
  misc_feature (2147)..(2148): n is a, c, g, or t
  misc_feature (2150)..(2157): n is a, c, g, or t
  misc_feature (2159)..(2160): n is a, c, g, or t
  misc_feature (2163)..(2169): n is a, c, g, or t
  misc_feature (2171)..(2177): n is a, c, g, or t
  misc_feature (2179)..(2181): n is a, c, g, or t
  misc_feature (2183)..(2183): n is a, c, g, or t
  misc_feature (2185)..(2189): n is a, c, g, or t
  misc_feature (2197)..(2197): n is a, c, g, or t
  misc_feature (2201)..(2208): n is a, c, g, or t
  misc_feature (2211)..(2212): n is a, c, g, or t
  misc_feature (2214)..(2218): n is a, c, g, or t
  misc_feature (2221)..(2223): n is a, c, g, or t
  misc_feature (2225)..(2228): n is a, c, g, or t
  misc_feature (2230)..(2238): n is a, c, g, or t
  misc_feature (2240)..(2250): n is a, c, g, or t
  misc_feature (2252)..(2254): n is a, c, g, or t
  misc_feature (2256)..(2256): n is a, c, g, or t
  misc_feature (2258)..(2263): n is a, c, g, or t
  misc_feature (2268)..(2269): n is a, c, g, or t
  misc_feature (2274)..(2276): n is a, c, g, or t
  misc_feature (2278)..(2282): n is a, c, g, or t
  misc_feature (2284)..(2297): n is a, c, g, or t
  misc_feature (2299)..(2299): n is a, c, g, or t
  misc_feature (2301)..(2304): n is a, c, g, or t
  misc_feature (2306)..(2322): n is a, c, g, or t
  misc_feature (2325)..(2326): n is a, c, g, or t
  misc_feature (2328)..(2329): n is a, c, g, or t
  misc_feature (2331)..(2332): n is a, c, g, or t
  misc_feature (2336)..(2339): n is a, c, g, or t
  misc_feature (2341)..(2343): n is a, c, g, or t
  misc_feature (2346)..(2351): n is a, c, g, or t
  misc_feature (2355)..(2356): n is a, c, g, or t
  misc_feature (2359)..(2359): n is a, c, g, or t
  misc_feature (2361)..(2361): n is a, c, g, or t
  misc_feature (2363)..(2363): n is a, c, g, or t
  misc_feature (2365)..(2365): n is a, c, g, or t
  misc_feature (2367)..(2370): n is a, c, g, or t
  misc_feature (2372)..(2373): n is a, c, g, or t
  misc_feature (2375)..(2379): n is a, c, g, or t
  misc_feature (2382)..(2394): n is a, c, g, or t
  misc_feature (2401)..(2405): n is a, c, g, or t
  misc_feature (2411)..(2412): n is a, c, g, or t
  misc_feature (2414)..(2414): n is a, c, g, or t
  misc_feature (2419)..(2419): n is a, c, g, or t
  misc_feature (2423)..(2423): n is a, c, g, or t
  misc_feature (2426)..(2427): n is a, c, g, or t
  misc_feature (2430)..(2430): n is a, c, g, or t
  misc_feature (2432)..(2433): n is a, c, g, or t
  misc_feature (2436)..(2436): n is a, c, g, or t
  misc_feature (2439)..(2440): n is a, c, g, or t
  misc_feature (2442)..(2443): n is a, c, g, or t
  misc_feature (2445)..(2445): n is a, c, g, or t
  misc_feature (2447)..(2447): n is a, c, g, or t
  misc_feature (2449)..(2449): n is a, c, g, or t
  misc_feature (2451)..(2459): n is a, c, g, or t
  misc_feature (2462)..(2462): n is a, c, g, or t
  misc_feature (2466)..(2471): n is a, c, g, or t
  misc_feature (2475)..(2475): n is a, c, g, or t
  misc_feature (2480)..(2491): n is a, c, g, or t
  misc_feature (2493)..(2501): n is a, c, g, or t
  misc_feature (2504)..(2506): n is a, c, g, or t
  misc_feature (2509)..(2516): n is a, c, g, or t
  misc_feature (2518)..(2519): n is a, c, g, or t
  misc_feature (2525)..(2525): n is a, c, g, or t
  misc_feature (2528)..(2529): n is a, c, g, or t
  misc_feature (2531)..(2534): n is a, c, g, or t
  misc_feature (2538)..(2538): n is a, c, g, or t
  misc_feature (2541)..(2549): n is a, c, g, or t
  misc_feature (2551)..(2551): n is a, c, g, or t
  misc_feature (2553)..(2553): n is a, c, g, or t
  misc_feature (2559)..(2559): n is a, c, g, or t
  misc_feature (2561)..(2561): n is a, c, g, or t
  misc_feature (2564)..(2567): n is a, c, g, or t
  misc_feature (2569)..(2569): n is a, c, g, or t
  misc_feature (2571)..(2571): n is a, c, g, or t
  misc_feature (2573)..(2578): n is a, c, g, or t
  misc_feature (2580)..(2580): n is a, c, g, or t
  misc_feature (2583)..(2584): n is a, c, g, or t
  misc_feature (2586)..(2593): n is a, c, g, or t
  misc_feature (2595)..(2602): n is a, c, g, or t
  misc_feature (2604)..(2608): n is a, c, g, or t
  misc_feature (2611)..(2614): n is a, c, g, or t
  misc_feature (2616)..(2618): n is a, c, g, or t
  misc_feature (2627)..(2629): n is a, c, g, or t
  misc_feature (2632)..(2634): n is a, c, g, or t
  misc_feature (2636)..(2636): n is a, c, g, or t
  misc_feature (2641)..(2641): n is a, c, g, or t
  misc_feature (2643)..(2643): n is a, c, g, or t
  misc_feature (2646)..(2647): n is a, c, g, or t
  misc_feature (2649)..(2649): n is a, c, g, or t
  misc_feature (2651)..(2652): n is a, c, g, or t
  misc_feature (2658)..(2662): n is a, c, g, or t
  misc_feature (2664)..(2664): n is a, c, g, or t
  misc_feature (2667)..(2669): n is a, c, g, or t
  misc_feature (2674)..(2676): n is a, c, g, or t
  misc_feature (2679)..(2680): n is a, c, g, or t
  misc_feature (2682)..(2682): n is a, c, g, or t
  misc_feature (2686)..(2686): n is a, c, g, or t
  misc_feature (2690)..(2690): n is a, c, g, or t
  misc_feature (2693)..(2693): n is a, c, g, or t
  misc_feature (2696)..(2697): n is a, c, g, or t
  misc_feature (2700)..(2702): n is a, c, g, or t
  misc_feature (2706)..(2706): n is a, c, g, or t
  misc_feature (2708)..(2708): n is a, c, g, or t
  misc_feature (2710)..(2715): n is a, c, g, or t
  misc_feature (2718)..(2723): n is a, c, g, or t
  misc_feature (2725)..(2725): n is a, c, g, or t
  misc_feature (2727)..(2727): n is a, c, g, or t
  misc_feature (2730)..(2733): n is a, c, g, or t
  misc_feature (2736)..(2737): n is a, c, g, or t
  misc_feature (2742)..(2743): n is a, c, g, or t
  misc_feature (2746)..(2747): n is a, c, g, or t
  misc_feature (2751)..(2751): n is a, c, g, or t
  misc_feature (2753)..(2753): n is a, c, g, or t
  misc_feature (2756)..(2756): n is a, c, g, or t
  misc_feature (2758)..(2758): n is a, c, g, or t
  misc_feature (2760)..(2760): n is a, c, g, or t
  misc_feature (2763)..(2764): n is a, c, g, or t
  misc_feature (2767)..(2771): n is a, c, g, or t
  misc_feature (2773)..(2774): n is a, c, g, or t
  misc_feature (2776)..(2777): n is a, c, g, or t
  misc_feature (2779)..(2779): n is a, c, g, or t
  misc_feature (2781)..(2784): n is a, c, g, or t
  misc_feature (2789)..(2790): n is a, c, g, or t
  misc_feature (2793)..(2794): n is a, c, g, or t
  misc_feature (2796)..(2815): n is a, c, g, or t
  misc_feature (2817)..(2817): n is a, c, g, or t
  misc_feature (2821)..(2821): n is a, c, g, or t
  misc_feature (2824)..(2824): n is a, c, g, or t
  misc_feature (2826)..(2828): n is a, c, g, or t
  misc_feature (2830)..(2830): n is a, c, g, or t
  misc_feature (2832)..(2833): n is a, c, g, or t
  misc_feature (2835)..(2835): n is a, c, g, or t
  misc_feature (2837)..(2838): n is a, c, g, or t
  misc_feature (2841)..(2842): n is a, c, g, or t
  misc_feature (2844)..(2846): n is a, c, g, or t
  misc_feature (2851)..(2851): n is a, c, g, or t
  misc_feature (2856)..(2856): n is a, c, g, or t
  misc_feature (2859)..(2859): n is a, c, g, or t
  misc_feature (2863)..(2863): n is a, c, g, or t
  misc_feature (2866)..(2868): n is a, c, g, or t
  misc_feature (2870)..(2872): n is a, c, g, or t
  misc_feature (2874)..(2875): n is a, c, g, or t
  misc_feature (2877)..(2877): n is a, c, g, or t
  misc_feature (2880)..(2884): n is a, c, g, or t
  misc_feature (2889)..(2891): n is a, c, g, or t
  misc_feature (2897)..(2902): n is a, c, g, or t
  misc_feature (2904)..(2906): n is a, c, g, or t
  misc_feature (2914)..(2915): n is a, c, g, or t
  misc_feature (2917)..(2917): n is a, c, g, or t
  misc_feature (2922)..(2922): n is a, c, g, or t
  misc_feature (2925)..(2926): n is a, c, g, or t
  misc_feature (2929)..(2932): n is a, c, g, or t
  misc_feature (2934)..(2935): n is a, c, g, or t
  misc_feature (2937)..(2937): n is a, c, g, or t
  misc_feature (2940)..(2941): n is a, c, g, or t
  misc_feature (2944)..(2950): n is a, c, g, or t
  misc_feature (2952)..(2953): n is a, c, g, or t
  misc_feature (2955)..(2956): n is a, c, g, or t
  misc_feature (2958)..(2958): n is a, c, g, or t
  misc_feature (2962)..(2962): n is a, c, g, or t
  misc_feature (2964)..(2964): n is a, c, g, or t
  misc_feature (2967)..(2974): n is a, c, g, or t
  misc_feature (2976)..(2978): n is a, c, g, or t
  misc_feature (2981)..(2982): n is a, c, g, or t
  misc_feature (2984)..(2986): n is a, c, g, or t
  misc_feature (2988)..(2991): n is a, c, g, or t
  misc_feature (2993)..(2995): n is a, c, g, or t
  misc_feature (2997)..(2997): n is a, c, g, or t
  misc_feature (2999)..(3000): n is a, c, g, or t
  misc_feature (3004)..(3004): n is a, c, g, or t
  misc_feature (3006)..(3008): n is a, c, g, or t
  misc_feature (3010)..(3011): n is a, c, g, or t
  misc_feature (3013)..(3016): n is a, c, g, or t
  misc_feature (3018)..(3021): n is a, c, g, or t
  misc_feature (3023)..(3023): n is a, c, g, or t
  misc_feature (3025)..(3029): n is a, c, g, or t
  misc_feature (3032)..(3037): n is a, c, g, or t
  misc_feature (3039)..(3048): n is a, c, g, or t
  misc_feature (3050)..(3050): n is a, c, g, or t
  misc_feature (3052)..(3052): n is a, c, g, or t
  misc_feature (3057)..(3062): n is a, c, g, or t
  misc_feature (3065)..(3067): n is a, c, g, or t
  misc_feature (3071)..(3071): n is a, c, g, or t
  misc_feature (3073)..(3073): n is a, c, g, or t
  misc_feature (3078)..(3081): n is a, c, g, or t
  misc_feature (3083)..(3083): n is a, c, g, or t
  misc_feature (3085)..(3085): n is a, c, g, or t
  misc_feature (3087)..(3087): n is a, c, g, or t
  misc_feature (3089)..(3089): n is a, c, g, or t
  misc_feature (3091)..(3092): n is a, c, g, or t
  misc_feature (3094)..(3101): n is a, c, g, or t
  misc_feature (3103)..(3105): n is a, c, g, or t
  misc_feature (3107)..(3110): n is a, c, g, or t
  misc_feature (3112)..(3115): n is a, c, g, or t
  misc_feature (3117)..(3117): n is a, c, g, or t
  misc_feature (3120)..(3120): n is a, c, g, or t
  misc_feature (3123)..(3123): n is a, c, g, or t
  misc_feature (3126)..(3127): n is a, c, g, or t
  misc_feature (3130)..(3130): n is a, c, g, or t
  misc_feature (3133)..(3135): n is a, c, g, or t
  misc_feature (3137)..(3137): n is a, c, g, or t
  misc_feature (3140)..(3141): n is a, c, g, or t
  misc_feature (3147)..(3147): n is a, c, g, or t
  misc_feature (3151)..(3152): n is a, c, g, or t
  misc_feature (3155)..(3156): n is a, c, g, or t
  misc_feature (3158)..(3159): n is a, c, g, or t
  misc_feature (3163)..(3163): n is a, c, g, or t
  misc_feature (3166)..(3166): n is a, c, g, or t
  misc_feature (3168)..(3168): n is a, c, g, or t
  misc_feature (3170)..(3171): n is a, c, g, or t
  misc_feature (3175)..(3176): n is a, c, g, or t
  misc_feature (3180)..(3180): n is a, c, g, or t
  misc_feature (3183)..(3189): n is a, c, g, or t
  misc_feature (3191)..(3191): n is a, c, g, or t
  misc_feature (3193)..(3193): n is a, c, g, or t
  misc_feature (3195)..(3196): n is a, c, g, or t
  misc_feature (3200)..(3205): n is a, c, g, or t
  misc_feature (3207)..(3213): n is a, c, g, or t
  misc_feature (3215)..(3215): n is a, c, g, or t
  misc_feature (3217)..(3218): n is a, c, g, or t
  misc_feature (3220)..(3225): n is a, c, g, or t
  misc_feature (3231)..(3231): n is a, c, g, or t
  misc_feature (3234)..(3236): n is a, c, g, or t
  misc_feature (3238)..(3239): n is a, c, g, or t
  misc_feature (3241)..(3242): n is a, c, g, or t
  misc_feature (3244)..(3247): n is a, c, g, or t
  misc_feature (3250)..(3250): n is a, c, g, or t
  misc_feature (3252)..(3253): n is a, c, g, or t
  misc_feature (3255)..(3256): n is a, c, g, or t
  misc_feature (3258)..(3259): n is a, c, g, or t
  misc_feature (3261)..(3262): n is a, c, g, or t
  misc_feature (3264)..(3264): n is a, c, g, or t
  misc_feature (3267)..(3267): n is a, c, g, or t
  misc_feature (3270)..(3270): n is a, c, g, or t
  misc_feature (3272)..(3272): n is a, c, g, or t
  misc_feature (3276)..(3277): n is a, c, g, or t
  misc_feature (3280)..(3283): n is a, c, g, or t
  misc_feature (3285)..(3285): n is a, c, g, or t
  misc_feature (3287)..(3288): n is a, c, g, or t
  misc_feature (3291)..(3292): n is a, c, g, or t
  misc_feature (3295)..(3299): n is a, c, g, or t
  misc_feature (3301)..(3301): n is a, c, g, or t
  misc_feature (3303)..(3303): n is a, c, g, or t
  misc_feature (3306)..(3310): n is a, c, g, or t
  misc_feature (3312)..(3313): n is a, c, g, or t
  misc_feature (3315)..(3319): n is a, c, g, or t
  misc_feature (3321)..(3322): n is a, c, g, or t
  misc_feature (3324)..(3327): n is a, c, g, or t
  misc_feature (3329)..(3329): n is a, c, g, or t
  misc_feature (3333)..(3335): n is a, c, g, or t
  misc_feature (3337)..(3342): n is a, c, g, or t
  misc_feature (3345)..(3345): n is a, c, g, or t
  misc_feature (3347)..(3347): n is a, c, g, or t
  misc_feature (3349)..(3349): n is a, c, g, or t
  misc_feature (3354)..(3354): n is a, c, g, or t
  misc_feature (3356)..(3356): n is a, c, g, or t
  misc_feature (3359)..(3361): n is a, c, g, or t
  misc_feature (3364)..(3365): n is a, c, g, or t
  misc_feature (3368)..(3371): n is a, c, g, or t
  misc_feature (3378)..(3381): n is a, c, g, or t
  misc_feature (3383)..(3384): n is a, c, g, or t
  misc_feature (3387)..(3388): n is a, c, g, or t
  misc_feature (3392)..(3396): n is a, c, g, or t
  misc_feature (3401)..(3401): n is a, c, g, or t
  misc_feature (3403)..(3404): n is a, c, g, or t
  misc_feature (3406)..(3406): n is a, c, g, or t
  misc_feature (3410)..(3410): n is a, c, g, or t
  misc_feature (3412)..(3412): n is a, c, g, or t
  misc_feature (3415)..(3419): n is a, c, g, or t
  misc_feature (3422)..(3424): n is a, c, g, or t
  misc_feature (3428)..(3428): n is a, c, g, or t
  misc_feature (3433)..(3433): n is a, c, g, or t
  misc_feature (3435)..(3435): n is a, c, g, or t
  misc_feature (3438)..(3439): n is a, c, g, or t
  misc_feature (3442)..(3444): n is a, c, g, or t
  misc_feature (3447)..(3451): n is a, c, g, or t
  misc_feature (3454)..(3454): n is a, c, g, or t
  misc_feature (3456)..(3457): n is a, c, g, or t
  misc_feature (3459)..(3459): n is a, c, g, or t
  misc_feature (3461)..(3461): n is a, c, g, or t
  misc_feature (3463)..(3463): n is a, c, g, or t
  misc_feature (3465)..(3469): n is a, c, g, or t
  misc_feature (3471)..(3471): n is a, c, g, or t
  misc_feature (3473)..(3473): n is a, c, g, or t
  misc_feature (3475)..(3475): n is a, c, g, or t
  misc_feature (3477)..(3479): n is a, c, g, or t
  misc_feature (3481)..(3482): n is a, c, g, or t
  misc_feature (3484)..(3484): n is a, c, g, or t
  misc_feature (3489)..(3490): n is a, c, g, or t
  misc_feature (3493)..(3496): n is a, c, g, or t
  misc_feature (3498)..(3498): n is a, c, g, or t
  misc_feature (3502)..(3503): n is a, c, g, or t
  misc_feature (3505)..(3507): n is a, c, g, or t
  misc_feature (3509)..(3509): n is a, c, g, or t
  misc_feature (3512)..(3514): n is a, c, g, or t
  misc_feature (3516)..(3518): n is a, c, g, or t
  misc_feature (3521)..(3530): n is a, c, g, or t
  misc_feature (3532)..(3532): n is a, c, g, or t
  misc_feature (3534)..(3534): n is a, c, g, or t
  misc_feature (3537)..(3543): n is a, c, g, or t
  misc_feature (3545)..(3546): n is a, c, g, or t
  misc_feature (3550)..(3556): n is a, c, g, or t
  misc_feature (3558)..(3559): n is a, c, g, or t
  misc_feature (3564)..(3565): n is a, c, g, or t
  misc_feature (3567)..(3568): n is a, c, g, or t
  misc_feature (3570)..(3572): n is a, c, g, or t
  misc_feature (3574)..(3576): n is a, c, g, or t
  misc_feature (3581)..(3583): n is a, c, g, or t
  misc_feature (3586)..(3588): n is a, c, g, or t
  misc_feature (3590)..(3592): n is a, c, g, or t
  misc_feature (3594)..(3596): n is a, c, g, or t
  misc_feature (3598)..(3598): n is a, c, g, or t
  misc_feature (3601)..(3601): n is a, c, g, or t
  misc_feature (3603)..(3605): n is a, c, g, or t
  misc_feature (3607)..(3607): n is a, c, g, or t
  misc_feature (3609)..(3609): n is a, c, g, or t
  misc_feature (3611)..(3611): n is a, c, g, or t
  misc_feature (3613)..(3613): n is a, c, g, or t
  misc_feature (3615)..(3615): n is a, c, g, or t
  misc_feature (3617)..(3619): n is a, c, g, or t
  misc_feature (3621)..(3621): n is a, c, g, or t
  misc_feature (3624)..(3627): n is a, c, g, or t
  misc_feature (3629)..(3629): n is a, c, g, or t
  misc_feature (3631)..(3633): n is a, c, g, or t
  misc_feature (3635)..(3637): n is a, c, g, or t
  misc_feature (3639)..(3646): n is a, c, g, or t
  misc_feature (3651)..(3651): n is a, c, g, or t
  misc_feature (3654)..(3655): n is a, c, g, or t
  misc_feature (3661)..(3662): n is a, c, g, or t
  misc_feature (3664)..(3669): n is a, c, g, or t
  misc_feature (3671)..(3672): n is a, c, g, or t
  misc_feature (3674)..(3677): n is a, c, g, or t
  misc_feature (3679)..(3679): n is a, c, g, or t
  misc_feature (3681)..(3686): n is a, c, g, or t
  misc_feature (3688)..(3689): n is a, c, g, or t
  misc_feature (3693)..(3694): n is a, c, g, or t
  misc_feature (3696)..(3700): n is a, c, g, or t
  misc_feature (3703)..(3706): n is a, c, g, or t
  misc_feature (3708)..(3708): n is a, c, g, or t
  misc_feature (3710)..(3715): n is a, c, g, or t
  misc_feature (3717)..(3717): n is a, c, g, or t
  misc_feature (3719)..(3727): n is a, c, g, or t
  misc_feature (3729)..(3729): n is a, c, g, or t
  misc_feature (3731)..(3731): n is a, c, g, or t
  misc_feature (3734)..(3736): n is a, c, g, or t
  misc_feature (3738)..(3742): n is a, c, g, or t
  misc_feature (3747)..(3747): n is a, c, g, or t
  misc_feature (3749)..(3750): n is a, c, g, or t
  misc_feature (3754)..(3755): n is a, c, g, or t
  misc_feature (3757)..(3760): n is a, c, g, or t
  misc_feature (3763)..(3764): n is a, c, g, or t
  misc_feature (3767)..(3771): n is a, c, g, or t
  misc_feature (3773)..(3779): n is a, c, g, or t
  misc_feature (3782)..(3783): n is a, c, g, or t
  misc_feature (3790)..(3791): n is a, c, g, or t
  misc_feature (3794)..(3795): n is a, c, g, or t
  misc_feature (3799)..(3799): n is a, c, g, or t
  misc_feature (3803)..(3803): n is a, c, g, or t
  misc_feature (3805)..(3805): n is a, c, g, or t
  misc_feature (3807)..(3809): n is a, c, g, or t
  misc_feature (3813)..(3813): n is a, c, g, or t
  misc_feature (3816)..(3816): n is a, c, g, or t
  misc_feature (3818)..(3821): n is a, c, g, or t
  misc_feature (3826)..(3826): n is a, c, g, or t
  misc_feature (3828)..(3829): n is a, c, g, or t
  misc_feature (3832)..(3833): n is a, c, g, or t
  misc_feature (3835)..(3839): n is a, c, g, or t
  misc_feature (3841)..(3845): n is a, c, g, or t
  misc_feature (3847)..(3847): n is a, c, g, or t
  misc_feature (3849)..(3849): n is a, c, g, or t
  misc_feature (3852)..(3852): n is a, c, g, or t
  misc_feature (3857)..(3859): n is a, c, g, or t
  misc_feature (3861)..(3863): n is a, c, g, or t
  misc_feature (3868)..(3868): n is a, c, g, or t
  misc_feature (3871)..(3872): n is a, c, g, or t
  misc_feature (3877)..(3881): n is a, c, g, or t
  misc_feature (3884)..(3885): n is a, c, g, or t
  misc_feature (3887)..(3888): n is a, c, g, or t
  misc_feature (3890)..(3892): n is a, c, g, or t
  misc_feature (3896)..(3897): n is a, c, g, or t
  misc_feature (3900)..(3901): n is a, c, g, or t
  misc_feature (3905)..(3905): n is a, c, g, or t
  misc_feature (3907)..(3907): n is a, c, g, or t
  misc_feature (3909)..(3909): n is a, c, g, or t
  misc_feature (3911)..(3914): n is a, c, g, or t
  misc_feature (3916)..(3918): n is a, c, g, or t
  misc_feature (3920)..(3920): n is a, c, g, or t
  misc_feature (3922)..(3926): n is a, c, g, or t
  misc_feature (3928)..(3928): n is a, c, g, or t
  misc_feature (3930)..(3930): n is a, c, g, or t
  misc_feature (3932)..(3932): n is a, c, g, or t
  misc_feature (3934)..(3940): n is a, c, g, or t
  misc_feature (3942)..(3944): n is a, c, g, or t
  misc_feature (3946)..(3947): n is a, c, g, or t
  misc_feature (3951)..(3952): n is a, c, g, or t
  misc_feature (3955)..(3956): n is a, c, g, or t
  misc_feature (3958)..(3959): n is a, c, g, or t
  misc_feature (3961)..(3965): n is a, c, g, or t
  misc_feature (3967)..(3968): n is a, c, g, or t
  misc_feature (3970)..(3970): n is a, c, g, or t
  misc_feature (3973)..(3976): n is a, c, g, or t
  misc_feature (3978)..(3979): n is a, c, g, or t
  misc_feature (3983)..(3983): n is a, c, g, or t
  misc_feature (3985)..(3987): n is a, c, g, or t
  misc_feature (3989)..(3990): n is a, c, g, or t
  misc_feature (3992)..(3992): n is a, c, g, or t
  misc_feature (3994)..(3998): n is a, c, g, or t
  misc_feature (4000)..(4000): n is a, c, g, or t
atgatgcaatataaggtggaagcgcaagatgaaacaatccagtggtgctgaccatccgtggcccgcgctgacgaagaacggaagacgggcgtccatgagccaccgaatgcgtcggtgcgcatacgaacgacacctgcactatcgcgagtaaccaacatgccttcctcagaaaagcccaagtacgttaaagtcgattgggtagataaagcaacgcgaccacgcgcgagttccgaggagtatcgcacgttgtacacggcgtacgcgagaacttgactacctggggctggtccgatcggcgccgcttcgtgccagacgacagccaacgcatcgtcgctaccggaaattgacaccgcgtcaccttcgagggagattatttgtcgctgcgcaccacctaaagagtaaatgcgaaggtaacgcttggacgtcacagcggcgacccaagtcgagccggtggcgattgaaagtatatcctctcccgctggcatcgtcacttgccactcaccatcgttcgcccagttgtcatactgttgaaagtaaagcacgctttcgttttcggaatccttcatcggactcgcgagcgcgcatcccttctcccccgcgacgcccatcgtgtacccgttgtagtcggtgatggtagggatgcgtcccatgcgcgacgtgtcgtggaactggaattcaacagagttgaatcctccttcgacagtgcttgtaatagatccaaccatggtgtaggataaaaaccgacggttgcttcccggaaccgcggcaacggatccactttggaacgccggttgcggcttgggaccggcttcgacgtgcaccaccgactgcttcacgtgactctgacggcgtcctttgacgtcatcgtcgtcgtcgtattcgacgaagtcatcttcttcatccaaatcttcatccataccgtctgcttcatcgtcgacgaaatcgctcgcattcgtctcatcgatagcgctcacaaagtctatctcggaaggcgaaaccttcgccgagggcgacgagtacttggatggaacgacgtcgttccacatcgcccactcgccgttaacgttgatgagcgccaaagagttaccagtagggtcgaacgaggcgccgcagacgagctcggtgtccgtcatcttcgcaatcgccaactttttcttgacgtcccacacgatgacactcttgtccgcgctcgccgtgaccaagtatttcccgttcggggaccaacggatgagggaaatcgcgtcggtgtgccctttcagctcccattcaatctgtttaaacgtaccacgctcgaagaacgtcacgtcgttctcccgccccggcacggctaggatttgtccatccggtcgccacgccacggcgttcaaaagcggcgactcgcccgtggccaacggcgcctcggtggcgtgtagttttacatccccagcctcctcgtcctcgctcgtgggcttcaacagccacacgacaaccatgccgttctcatccgtcgccgccaagtaatctcctcgcggatcgaacgccacgctcttgatgcacttgcttcgctgacacggaaacacgtgcaagacggttttgtcctccatcttgatgactttcacctcggcgtcctccccccccgcggcgacgtacttcccgtccgcgctccacgccacgcagtgcactggcaatgaaaatctcgtcacgttcgcctcgaacgccttcttttccagcgaaaacagcttcaccgagtaatccgagctcgccgtcgccgcgagcgtcccgcacggcgacgccgcgcacgcgttgacgcagtccgcgtgcgcgtcgtcgaagttctgttccacctctcccgtctccgcgtctcgcacgatcacgaacgaatccgcgccgcacgtcacgatcttcttcctcccatccaccgcgccgcgcgcgacgtcgcacgcccccgcgatgtgggcgtattcgaacgcgccctcgcgcgtctcgagcgccgngacgacggcgttcgaangtctatccatcgccccgcgttcgagcatcgctcgcgcggtcgctcgatcgctcgatcgatcgctcgcgatccgtcgcgcgcgcgtcncngcggcgtcggacgcgcgtcccgatcgacgcccgtcgtcgtcgcggattcaaatcaatcgnnncgcncnngnnnnnnnngnnccnnnnnnncnnnnnnncnnncngnnnnngggaaaantttnnnnnnnnccnntnnnnnggnnncnnnncnnnnnnnnngnnnnnnnnnnngnnnanannnnnnttttnnaccgnnnannnnnannnnnnnnnnnnnncncnnnncnnnnnnnnnnnnnnnnncgnncnncnnggcnnnngnnncgnnnnnngggnncgngngncngnnnngnngnnnnngcnnnnnnnnnnnnncgacgcnnnnncgcganncngaggngcgnganngangnncgnganngnngncngngnnnnnnnnncgngcgnnnnnntcgngcggnnnnnnnnnnnngnnnnnnnnncgnnncgnnnnnnnngnncgcggncgnngnnnncggnggnnnnnnnnngngnggcggngncgnnnngngngnnnnnngnggnngnnnnnnnngnnnnnnnngnnnnngcnnnngnnnacggggaannnggnnngngaagngnggnngnanngcgggnnnnnancgnnngcgcnnnggnngnacgngcgnggngannggnnncggngncnnnnnncgnnnnnntngnggnnnnggnnggcgnngcnngggngntangngncgnngtnnnnngnntnnangnnnngaatnnagnngnnnnnnnnnnnnnnnnnnnngnagcngcngnnntngnngnannaanngnnnggacngaagnagngganggnnnannngnngnggnnnnncgaannnacgcgnnnnnngnnngcgcggcnnangagcncgnngannnngnngncgnnggnnnnnnngnngnncncgangncgnnnnnnnngnnnaanntnnngnnnntnnngncnnaaangnnngnntnnnngnnnntnannnnnaannnnnngnnnnnnnnnncntnttggnnnnnnttnnngggntngaaannnnantngncnanngnnnnnnnnannncnnnntnnnngnacntgncgnnggnaannncnacnngcccgntttnntcnncnncctngangncnnaaannaagnaannnnnnnangnanngccnnnnnncnnnnnnncngnngnnnnnntccggnggnnncnnannannnngangnngnngnncnngnagncgncncccnnaannnncncnntcnnctnnnnnangntcnnnnngnngnnnnngnngnnnnanaagnnntnnnnnnaantntngagcnanaannnagnnaannnncggaacnnnnannagnnactnnnnnaaaananngnttantnaannnnnttnnngaantggangnggnnatnnncgnnnnngangnngncnangnnnnncncnangnnnannangaagnngannnngncaanntnnncnacnnngnnntgnnnnnnnnnntngnatnnnnnnncnncaannnnnnngnncaagnngnngnnncnnnaaaannnaannnannnannnangangnnntngncnangntnnngnccnnnnangnnncnnngnnnnnnnngattncgnncccggnntnnnnnncnngnnnnangnnnnnnannaaanngnnnnngcnnnngnannnnnngncnnnnnnnnngntnggnnncnnnnnttggnanntggnntnnnnaannagnnnnncnnnnnnnagnngccgttnnaanncggnggtnanannntttnccntnnnnaaaangnnttnnannnnngnnnnnancnagngcccnnngnnngcggnttnnaacgnnnnnctnnannannnttcnnccnncgcnancncnnnntnnncnannnnnangncnannnnnnngnnnannaaannccnntnnannnnncnncngannnntnnttcnannngnncnannnnncn

SEQ ID NO: 1173 - DNA, 4000 bp, Escherichia coli
  misc_feature (18)..(18): n is a, c, g, or t
  misc_feature (27)..(28): n is a, c, g, or t
  misc_feature (36)..(36): n is a, c, g, or t
  misc_feature (231)..(231): n is a, c, g, or t
  misc_feature (251)..(251): n is a, c, g, or t
  misc_feature (410)..(410): n is a, c, g, or t
  misc_feature (530)..(530): n is a, c, g, or t
  misc_feature (566)..(566): n is a, c, g, or t
  misc_feature (648)..(648): n is a, c, g, or t
  misc_feature (656)..(656): n is a, c, g, or t
  misc_feature (665)..(665): n is a, c, g, or t
  misc_feature (775)..(775): n is a, c, g, or t
  misc_feature (904)..(904): n is a, c, g, or t
  misc_feature (1083)..(1083): n is a, c, g, or t
  misc_feature (1550)..(1550): n is a, c, g, or t
  misc_feature (1786)..(1786): n is a, c, g, or t
  misc_feature (1959)..(1959): n is a, c, g, or t
  misc_feature (1992)..(1992): n is a, c, g, or t
  misc_feature (2253)..(2253): n is a, c, g, or t
  misc_feature (2899)..(2899): n is a, c, g, or t
  misc_feature (2950)..(2950): n is a, c, g, or t
  misc_feature (3657)..(3657): n is a, c, g, or t
cgcgaaggacgagttccncttcatacnntaagagcngatattgattatggctttgcagaagctcacaccacatttggtcgcttaggtgtaaaggtctggatctataagggcgaagttatcgcttcaagaactgagcgcgaagcagcagctcttgcccaagttcaagcagctaaggctgagcgcgcaccaaagcgtgcacctcgcgcgccaaagggcgaagtgacaaagacntccgttgcagagcgagcaantgaagctgcagcagttaccgagagccaagcagctccccaggttgatagcgaagtaagccctgaaattaagagcgaaggaagtgatgcgtaatgttaattcctcgtcgcgttaagcatcgcaagcaacatcgtccaaagcgttctggtaatgctaagggnggaactgcggttgcattcggcgattttggtctgcaagcaactgagggtggttatgtaaccaaccgtcagattgaagcagctcgtatcgcaatgactcgtcatattaaacgtggtggaaangtttggatcaatatctatccagatcgcccactaacnaagaagcctgctgaaacccgtatgggttctggtaagggatctccagaattctggatcgcaaatgtgaaaccaggaagagttntatttganatatctggngtaacgctagatgttgcaaagcaagcgctctctcgcgcagctcacaaactcccagtcaaatctcgcgtagtaattcgcgaggaggtatagcgatggcaaagatgatcacnactgaagaacttagagctctaagcactgaagatcttgcagcaaagttaaaggatgcaaaggaagagttatttaaccttcgtttccaagctgcaacaggtcaacttgagagccatggacgcctaacagcngtccgtaaagagattgccaagatctataccgttattcgtgaacgcgaactaggaattggaggagcggcatgagtgaggatagaaagtttcgcaaaactcgcgaaggcgtagttgttagcgacaagatggataagacagtggtagtaaaggtcgaagaccgcgctgctcatggtctctantccaaagttattaccaagaataagaagtttaaggctcacgatgaagagaacaccgccggtgttggagatcgcgtgcgcataatggaaacccgtccactttcggcaactaagcgttggcgtgtagtggagattatcgagaaggctaagtaaccatgatccaagcagagtcacgactacgagtcgccgataacacaggagctagagagcttctctgtattcgcgtgctaggtggaacccaacgtcgctatgcctcaatcggtgatgtcattgtctgttccgttaaggatgcaattcctggcggacaggttaagaaaggtgaagtcgttaaggctgtcatcgttcgaactgttaaagagaaccgtagagctgatggttcctatattaaatttgatgagaacgctgcggtaattatcaaggaagataacgaaccaagaggaacccgtattttcggacctgttgctagagancttcgcgataagcgctttatgaagatcatctcacttgccccggaggtgctgtaatgagaataaagaaaggtgacacagttctagtcatcgcaggaaaagataaaggtgtaactggcaaagtattagccgttaataccgttactgcccgcgtaactgttgaaggtgttaaccgcgtgaagaagcatacaaaggaagatacttcacagcgcggagccaaagttggcggaattctcacnattgaagccccaattgcttactccaatgtgatgttgctagatgatgataataaggcaactcgtatcgcagttcgcaaagatgaagagggcaagaacattcgcatctcaagaagaaccggaggagatctctaatgaccactgttttcgcacctcgtctaaaagaggtatataantctgaaattgctcctgccctgcagagcgaattnaacttctcaaatagaatgcagattccaaccctttccaagattgtggtcaatatgggagttggcgaagcagctaaggattcaaagttaattgaaggcgcaattagagatcttgcagcaattactggacagcgtccattagttactaaggcgagaaaatcaattgctaacttcaaactccgtgaaggccagccaattggcgcccatgtcaccctacgtggcgaccggatgtgggagtttatggaccggctattaacagtttcnctgccaagaatccgcgattttcgtggactctctccaaagcaatttgatggcaaaggaaattacaccttcggtctaactgagcaagtggtctttcttgaaattgagcaagacaagctagatcgagtccgtggaatggatatcaccatcgtaacttcagctaagaacgataatgaaggtcgtgcgctacttaaggcgcttggttttcccttcaaagatcaaggggagaaataaataatggcaaagacatcactgaaggttaaggcagcccgcaaacctaaatttaaggttcgtggatacacacgttgccaacgttgtggccgaccacattcggtctatcagaaattcggcatctgccgagtctgcttccgcgagatggcacaccgcggtgaacttcctggtattacgaaagcttcctggtaacaactattggagaggtcccttacatgagggaaaccagccaaagaaaggcgatgagccaactatgacaatgaccgacccgatcgcagacatgctctctcgtttgcgtaacgccaatatggcctaccatgaagtggtttctatgccatcttcatcggtgaaggttcgtattgccgaaattttgcagagagagggatatatcggtggctataaagtcaacgataatccngaaggttttggaaagaccttaactcttgaccttaaatatggttcaaatcgngagcgatcaattgctggtctgcgccgcgtttcaaagccaggtctacgcgtttatgccaaatcaaccggacttcctaaagtattaggcggacttggtgtggcaattatttcaacttcacaaggattactcactgatcgacaagctaacaagaatggcgtaggcggagaagttctcgcttacgtatggtgattgctatgtcacgtatcggaaaaatgccagttgccattccatcaggggttgaggtaaatatctctggtcaatcagtctctgttaaagggcctaagggaactctaagccatgtgcttcctgagttaattactcctaagaaagaggagagctcagtagtgctaacgcgcgctaatgatgagcgcgcagcaaagagcctccatggtctttctcgcacgctaatttcaaatatggttactggtgttacaactggttactcaaagaaaattatgattgttggagttggatataaagtagcggcaaagggcaaagatctagagtttgcactgggctactcacacccaattaatttcacagctcctgctggaatcaccttcaccgttgaaacacctactgatctagtggtttcaggtgttgataagcagctagttggagaagttgttgccaagattcaaaaacttcgcaaagccgatccatataaaggcaagggtctgcatctacaaggtgcacgcattcgccgnaaagctggaaagacaggtaagaaggcatgaatatctctaagaagattgttaagggctctactcaagttgcccgcgcccgtcgccactttagagtgcgaaagagagttaccggaacatctgagcgtccacgtttagttgttactcgctctgctcgccacttagttgcgcaaattgttgatgattcacgtggccatactctggcctctgcctcaactatggagaaagagctaagagcaacatctgcagataagactaagaaggcaagaagtgtgggccaattagttgcagatcgcgcaaaagcagctggagttaccacagtggtctttgaccgtggtggaaatcg

SEQ ID NO: 1174 - DNA, 4000 bp, Escherichia coli
  misc_feature (2)..(3): n is a, c, g, or t
  misc_feature (7)..(14): n is a, c, g, or t
  misc_feature (16)..(20): n is a, c, g, or t
  misc_feature (22)..(23): n is a, c, g, or t
  misc_feature (25)..(27): n is a, c, g, or t
  misc_feature (30)..(30): n is a, c, g, or t
  misc_feature (32)..(34): n is a, c, g, or t
  misc_feature (36)..(36): n is a, c, g, or t
  misc_feature (38)..(38): n is a, c, g, or t
  misc_feature (43)..(48): n is a, c, g, or t
  misc_feature (51)..(51): n is a, c, g, or t
  misc_feature (56)..(56): n is a, c, g, or t
  misc_feature (58)..(61): n is a, c, g, or t
  misc_feature (63)..(66): n is a, c, g, or t
  misc_feature (69)..(70): n is a, c, g, or t
  misc_feature (78)..(78): n is a, c, g, or t
  misc_feature (82)..(82): n is a, c, g, or t
  misc_feature (85)..(85): n is a, c, g, or t
  misc_feature (87)..(91): n is a, c, g, or t
  misc_feature (94)..(95): n is a, c, g, or t
  misc_feature (98)..(98): n is a, c, g, or t
  misc_feature (100)..(107): n is a, c, g, or t
  misc_feature (109)..(111): n is a, c, g, or t
  misc_feature (113)..(114): n is a, c, g, or t
  misc_feature (117)..(133): n is a, c, g, or t
  misc_feature (137)..(146): n is a, c, g, or t
  misc_feature (148)..(156): n is a, c, g, or t
  misc_feature (158)..(168): n is a, c, g, or t
  misc_feature (170)..(186): n is a, c, g, or t
  misc_feature (188)..(192): n is a, c, g, or t
  misc_feature (194)..(207): n is a, c, g, or t
  misc_feature (209)..(238): n is a, c, g, or t
  misc_feature (240)..(243): n is a, c, g, or t
  misc_feature (245)..(250): n is a, c, g, or t
  misc_feature (252)..(305): n is a, c, g, or t
  misc_feature (307)..(307): n is a, c, g, or t
  misc_feature (309)..(314): n is a, c, g, or t
  misc_feature (317)..(325): n is a, c, g, or t
  misc_feature (327)..(370): n is a, c, g, or t
  misc_feature (372)..(407): n is a, c, g, or t
  misc_feature (409)..(427): n is a, c, g, or t
  misc_feature (429)..(429): n is a, c, g, or t
  misc_feature (431)..(433): n is a, c, g, or t
  misc_feature (435)..(439): n is a, c, g, or t
  misc_feature (441)..(444): n is a, c, g, or t
  misc_feature (446)..(460): n is a, c, g, or t
  misc_feature (462)..(479): n is a, c, g, or t
  misc_feature (481)..(531): n is a, c, g, or t
  misc_feature (533)..(565): n is a, c, g, or t
  misc_feature (567)..(623): n is a, c, g, or t
  misc_feature (625)..(628): n is a, c, g, or t
  misc_feature (630)..(637): n is a, c, g, or t
  misc_feature (639)..(645): n is a, c, g, or t
  misc_feature (648)..(649): n is a, c, g, or t
  misc_feature (651)..(662): n is a, c, g, or t
  misc_feature (664)..(664): n is a, c, g, or t
  misc_feature (666)..(670): n is a, c, g, or t
  misc_feature (672)..(674): n is a, c, g, or t
  misc_feature (676)..(677): n is a, c, g, or t
  misc_feature (679)..(679): n is a, c, g, or t
  misc_feature (681)..(683): n is a, c, g, or t
  misc_feature (685)..(685): n is a, c, g, or t
  misc_feature (690)..(690): n is a, c, g, or t
  misc_feature (692)..(694): n is a, c, g, or t
cnnaacnnnnnnnnannnnngnncnnnttntnnnangnttttnnnnnnttnggttnannnnannnngtnnggtttttntaanctntnnnnnttnnaantnnnnnnnncnnngnntcnnnnnnnnnnnnnnnnnaaannnnnnnnnngnnnnnnnnncnnnnnnnnnnngnnnnnnnnnnnnnnnnntnnnnnannnnnnnnnnnnnngnnnnnnnnnnnnnnnnnnnnnnnnnnnnnngnnnngnnnnnnannnnnnnnnnnnnnnnnnnnnnnnnnnnnnnnnnnnnnnnnnnnnnnnnnnnnngncnnnnnnctnnnnnnnnncnnnnnnnnnnnnnnnnnnnnnnnnnnnnnnnnnnnnnnnnnnnngnnnnnnnnnnnnnnnnnnnnnnnnnnnnnnnnnnnngnnnnnnnnnnnnnnnnnnncncnnncnnnnncnnnncnnnnnnnnnnnnnnngnnnnnnnnnnnnnnnnnngnnnnnnnnnnnnnnnnnnnnnnnnnnnnnnnnnnnnnnnnnnnnnnnnnnncnnnnnnnnnnnnnnnnnnnnnnnnnnnnnnnnnannnnnnnnnnnnnnnnnnnnnnnnnnnnnnnnnnnnnnnnnnnnnnnnnnnnnnnnngnnnncnnnnnnnngnnnnnnntgnncnnnnnnnnnnnncnannnnngnnncnncncnnntncacgnannntgtgcaagcgttctggaggcctaggtcgaattctgtccaaacaggtattttcgcacgcggaagtctaggttcccaaaacgcttggcatgcttcccctgtcgtgggccgaaaggaaaccgtttcgatacggcataaactgagccgcgactcacgggagtgtcgcgaaaatccggtaagtctccccagatcagaactgcagcctcagtgaaaacataatttgccgttgcaatgccctaccgcggaaggctgtgtttataatcgtcccgccgccctggcaatccacgcacgtttggggattttcgggattgtccaaattgactttattgaaaaggttgaagatatctgtccggaattgaatcgagataccctctttcaatgagaagttctttgcgactgagacgtccgcttgggagaagccaggcccgcgaagtgaattccggcccgcgcttccgaacgtcccgaaagcaggccgctgccacggtccaatcgtgtctccggccgtgccatgtggttgaagtggtacgccaccggtggtcgtgaagtagccgttcctgcttcccgtgatgtgaacagctccgacaagattgggccggcagggaccggtgtcccggtctgcaaaacatgaatatgatggggaaaatggcaggccgctttcccaggtcatggttccgctgagcgaccaaccaccgacgatgcggtctgcgatcccgcggacgcccccgagaaaagtcttgcccctaccgaagggcagctcaacgagacctgttagaaggaacacatgttttcgatcggtgtcggcgacaccgtaatttagcctgggattgatcgcataatagtcgctgtcgtaatttagcgacttcgaccatgtgtaatgagccaggaactggaatcccttggcaaagcgcttttccactgccgcttgcagggagttgtaattgtcggaggcgtcgctgccaaaatagttgatctgctgtgtccagccgaatttcttaaagaatggttttcgctcatcagtcgacaaagtaccgaacccgacgatgctggcttgattggcatcatagttggggacattgcctgcgaacacgtgagtacccttattggctacatagctgacttgcagcgaaagcgtaggcgtgatcgcctgctgcagggtgacattccaagcgtcgagcgtgggcaaccgcattttggttggcagtacgtaggcactcacctggtcgggaaggctgaactgtcccgaagacggaaccgtagggaaagtggccgttggcggtccttgcgaaaggttgaacacgctcccggtgaatgcaggagggttgagctgctgctgcaccagaaccggcaagttttgcgtaaccgtgtgcccaaataccgagccaaataccccaatgtcaaagctccgcccatatcccagccgaaccaccgttttgggcgtagcttgataagcgacgcccaggcgcggcgccaagttagtaaagttgttcttcacatttccttgcaggttgatgttgccataaccagcgacactgaccaacccagtgttgagatctacccacccacctgctccctttcccgtgaccgattgcggagagtaaatctcccaccgcagtccgtagttgagacttagcctgcgagtgatgcggaaagtatcctggccgtagaagaaccagcgcttctgacgttctcctgcgttgtaagtcttatttacataccggctgaaaatgctcacgtcgccaagcaggaacgtagccaaacccaggccacccccactgggcccttgggttcgcgaattaaaaaaagccagactgcctgagcgcgcgccactgctggccacgcgaaggttccgagcgtaacggatgtcagtaccccacttgaagagatggttcccttccgtcttcgtccagttgtttacccattgaaactgctgttccctttccagggtcggcggggcaatagtgccgaaaacgaactggtctccttcctgtccatcgacaataaagaagggcatgcctgaagtaagggtgtcacccaggttcaacccggggatccctgcatcctttgcgggtgttgttccagccccgttgggcaggacgttcacgtgatagcggaagaagccaaatcgaaaatcagccagcaggctgggacgcagaatatagtcgaaacccgccgcaaaactctggttccgaaccagcgattgaccaacgaacccgtccagggataatccgacgcctccagccacgggcccaaatgcccccacagcgtgttgtctgaagtcagcaaagctgtagcgcccgaaaatcttcagtttctccgtggtgttgtggtcaacgcgaatattgaaaccatcgtcgttgaattgttcagcgcctgacgtaatgtagttctgcgtaatccctgcgcctgggacgttgggcccgggcaagagttccaatagattgacagcttgaggtgatatccggttccgtgcgatcaggttattcgcgaattggttgccggtagccggatcaaaaataggttgcgggtactcgctcagattgcaaaatggaactgtcgaatcaaggcaggtcgagcgcaccagtccggtcgggacgttcaaccgcactgaggtgccgttcgagcgccgtgtcccctgataatcgccgaagaagaacagacgatttttgataatcgggccgccgatcgagccaccgaattggttccacttgatagcaggcaaaggcttgtctggtggctgtgtaaacggattgcgggcctgtccccagccggtgcgacggaactcaaagacactgccatgccaatcgttcgtgccggatttggtctggaccgtgaccacccccgccaatgcctctccaaattccgcgtcataattctgtgtggtcaccttcgtctgcgtgacggattccagggtgggattgatcacgatgattcctaggatagggtcgcgattgtccgtaccgtcaagctgataggacgtgccactgaagtgttgcccgttaaccatgatctgaatcccgccttgcgggttttccgatgaagcgtgctgccatcctaactgtgaagtgcctggagtaagaagttccaggctagtgaagtttcgattgaataagggcagactttcgacctctttctcgctgaatgtagtggccacatccgcccggtcggtcttgatcaatggtatgtcttcggctgagacggttagtgtttcttgcctggccccgacgtggagctgtatatcgacacgggccgcctggtctgcatacaccgggatgcccgtggattccacagctttgaatcctagagcttcgg

SEQ ID NO: 1175 - DNA, 4000 bp, Escherichia coli
  misc_feature (1990)..(1991): n is a, c, g, or t
tatcacgctgctcccatcccagcttgatgcatgcaatcgatgtacggtttcggatccaacatctggtgctcgccgccgccgcgaatcggcctcagctgttcgctcgccgatattgcccgttgtaaggtttccatcatctcggttttctttgcctcaaagcgggtctctgcgagcttgaaaaccgcggcatctaagtcgttgcactcgtacagcttcgctttcagccctggatccatggctccttcactatgatcgccgctgtgcgggtggttggccctgagcgtcgccggcaacaaacttcctctgtcgtagttgctatcactcgtcgatagcggctgtcttcgcaaagtatacgcgagcacgcacgcgctttcgtcgaagcgatgcgtcaaaccgacccaatcaagctccatcactcgctctttcgcaagcgccatgatggcgtcgtggttgtccttcatggacgtccacttatcctcgagtaacttcttcgtttggaagttcttatccaagccggctttgcagtgatcctcgagcatgattttggcgaacttgctgtcggctccgaagtccttcagctcttcctgagtgagcgcggatccgagtggggtttgcgcgagctttccccagccaagtttggcgcgaagatcgtgatacatgaacagctcgcttcgccatgctgcttgttcatactccgcggggtcgcggaacatgcccatgagaatctttggacgtgatagtccgagttccgcttcaagttctgttgttcggcgcaagagttctcgaccggtatgactcgacaacaatcgacattgttcccaattctcccgcgtcgaatcctcgagcggacgcggatgtcccggttcccaaaccgtcccagccttccacaccgtcgtcaaaaacatagcgctccccgggcacaacgcatgtttcgcacgcagatctttgtcaagcatgacgtcttcgctgcgcacacgattgatcaaaccgagcacgtcatcgttgtccgaattcatgagctctagcgtgtgcaacacgagtgatgttccaccgctcttctccgtatggaaatacacgggcaaaatcgccgacgattcttcggcgatttcctcgttgtcgtcgtactcttcgatggcgcccagttgcgcctcgacacccctgcgcaacttccgccgagcatgtcgcttatcctctctcgcgagcacctttaccggcacttcgagcgtgtgcttcagtacggcgatagaatccgcggctccgtcgctcgactcttctgctggcgcctccctctcgccaacggcgtcagcggttttgttgcttgattccaactccacaggcgtttcactctcgacgagtgcctccactggctcactatcgctgatcaaatcgctttgtggcgtcgacagcggcgcagacgccgcatcgagctctctttcctcccgcgccttcgccaacgccgccgcctccgtcttttcccacgcccgctccatctgctgcagcctcttatactgcttcttcttctcgtacaactccttccccgcaatctgcacatcgttctcatccctcacgagcgcggcgaaatcttctaacgatatcccaaacaccgacttgagccgcgcgtcgatcgtctcgcgcttcacttggtcttcgttcgcgccgagcgcggcttcgttcgagcgcgccgcgcgcgtggccacgcccatcgcgagcaagcacgcccccgcgccgagcgcggcgaagacgcgccatcgcttcgcgatccatcgcgagttgtgtttcgtcgtctgcggggtctcggcgtccgccaacaatccggcgcgctcgccgtccgacatgatcgcgcggcgaccgccgacacccacgcgtcgccgcgtcgacgcgcgacgagcggtgcgttcgagacttggtttctttcttgtctcgtcgagactcgcgcgcgtcgatcgccgtgcgcgcgcgtgtgtgcggtttcgcggtgcgagtttgtgannagggtgttggagcccaaatcgcgcgacgggtgcttaaacaacgagcgtagaaatattacatgacgaggccgccgcgcgcgattagctgagcgcgagccgacgccatcgttcgaaggcggtgtctaattcgtagcgctcgaaagcgcgtgtcgcggcggcgccgccgtcagcgggcgggcgcacgcgaaggctgtcgagcgggagcagcggctcgttgagcgacggcacggttaaattttgacgaatctccacgagacgtctggagagcgccgcgctcgccgcacccttttcgctcaataaactctcgcgcgcgcgtttgcccttgacgttcgccgcgttggcgagcgcgctttcgatgtcgccgtactgttcgagcaacgccaacgccgtcttcgggccgacgccctcgacgcccggaatgttatcggcgctgtccccgacgagggccaaaaaatcaatgaattgctcgggttcgatgacgttgttgtgcatcgctcggaaatcatcaaccgtgaacggatcaaacggatcgcccttgctgctcttgctcggcttcaacatcttcgtcttcggcccgagcaactgataaaagtctttgtccggcgagcaaatgctcactcgaaagcccgcatcactggcgcgtctgctcaccgtaccgatgatatcgtccgcctcaaccccactcaacctcaataacggcacccccatgtcccgcacgagctgctcgaccttcggtatgagctccaataacggctccggcgtcggcggtcgattcgccttgtactcgacgaacatttcgtgtcgaaacgtctttcctttcgcatccatgcacaccgccaagtgcgtcggtttcagctccaacagcgagcatatcgtgtgcgcgtacgagtacaacaccgacgtatcctctccagccgagttcgtcagtccttcgccgcttccgcgcgcgttccaaccgtagtacgctcgaaacacaaagctcaacccgtcgacgaggatgagatgcggttcatccgcatccttcgcgatcgacgtcgccgacgtcgacgccgcgtccgcgcggccgtcgatcgaggacgccaccgccgtcatcgcgcgtcggttcgtcgtcgtcgtcgtcgctttcgcgcgtcgttgatggtgtcgctgatgattcaaactttgaacgcgcggcgccgacgttcgcgcgccgcgcgccgacgcgagcggcgcgacgcacggcgcccgtcgcgcgaacatcggcgccgcgcaccgcgcgacgcacttggcgcacgcgccgcgcatggcgacggcgtgtggcgccgcgcgtcgaccgtcgcccgtcgcggacgcgcgacagacggcgacgcgcgacagacgacgacgcgcgatggcgagcgacgcgccggtgacggtgctggacgtcgtggacggcgatctgcggggcgggtacgcgctggacggcgtcgcgcgcgcgccgagcgcgacgcgacgcggtcgagtgcgcgcgaaaagcgctggacgcgggaacggaagcgacgacggcgcgttcgacgcgatcgcgcggtcgcgcgtcgaagacgtggacgcgtacgagtgcgtcgtgcgcgcgatgacgtacggcgacctgggatgggagcgagggagcgaggggatggtggtggcgtgcgaggcgagcgggacgtcgaacaggacgcgcgagcgaacggcgaggatgttctttgaagagttcaacgtcggagggttggcgtttttagataaggcggtgtgcgcgatgtatgcgtgtggacgcgcgagcggagtggcgatcgatgtgggagagcaaggggtggagtgcgcgtgcgtggtggagggggcgacggcgcactcgacgacgaggcggaacgacgacgcgggaggacgagcgatggatcgcgcgctggtggaggcggtgaggaagaaacaagggattgcgttagatttgacgacggcgagtgatattcgtcggaagttggggaaatgtgcggcgacgcgggaggagtacgaggcgt

SEQ ID NO: 1176 - DNA, 4000 bp, Escherichia coli
  misc_feature (156)..(156): n is a, c, g, or t
  misc_feature (158)..(158): n is a, c, g, or t
  misc_feature (182)..(182): n is a, c, g, or t
  misc_feature (314)..(314): n is a, c, g, or t
  misc_feature (353)..(353): n is a, c, g, or t
  misc_feature (479)..(479): n is a, c, g, or t
  misc_feature (485)..(485): n is a, c, g, or t
  misc_feature (527)..(527): n is a, c, g, or t
  misc_feature (746)..(746): n is a, c, g, or t
  misc_feature (788)..(788): n is a, c, g, or t
  misc_feature (848)..(848): n is a, c, g, or t
  misc_feature (956)..(956): n is a, c, g, or t
  misc_feature (1193)..(1193): n is a, c, g, or t
  misc_feature (1214)..(1214): n is a, c, g, or t
  misc_feature (1331)..(1331): n is a, c, g, or t
  misc_feature (1346)..(1346): n is a, c, g, or t
  misc_feature (1373)..(1373): n is a, c, g, or t
  misc_feature (1649)..(1649): n is a, c, g, or t
  misc_feature (1655)..(1657): n is a, c, g, or t
  misc_feature (1663)..(1663): n is a, c, g, or t
  misc_feature (3270)..(3270): n is a, c, g, or t
  misc_feature (3884)..(3884): n is a, c, g, or t
  misc_feature (3989)..(3989): n is a, c, g, or t
cacaggcttggccttggcgcaaaacgcctgattgcccttgaacacataaatatagttctatctcgctttgggctgtaagcgacatgtaatcattcacagtgattcgttgcacggtaaatggagccgaatcaatttgataattcacttcgtcgccantngggcttgacggtgaaaccatcagngcggcgcgagattcaaaacttgcggttgcgaaaaattcattgaggtcaatatgtttttgcgtgaacgcggcgcgcatgacattgtcgctgcttgacatgacttcaactgcaacgccgccaagatacgaatgnacgttgcccggatcgagatagacagcatcacctggtttnagcacgacataattcatcaacaaagcaactagaagcccacccgaatttggatagagctcggcgaccttgcgcagatgttgcggcaagtttggtggtgttttatgcgctttttcttcgagcgcccancgcacngttttttcgatgccagtgagtttgagatggcgtgcaagttcnagccagccgttttgttcggcgcgagcgagagattcgtttacgggtgcgaatccacaaagcatttcgaagtcactgagtgcgcaaagcaactctggttttgaagttttatcgcgatagacgcgattgaaagcagtgcgatcgatgcccagagaattttcgcgttcgaaaccggcgagcgcctgcgccgaagttggatgcgtttgaattgaaagtggtttngcgacaccgatcaacttgacgagaaatgaaagttcgccgacnacatctttgagtgcgactttgccttgaccggtttgtaatgtcgcttgaccgtctgggtgngtgccgaaccaaagttcggcccacggttttgcatcgcgtggtgcgccgatgaaatcgggcaaggctgtgaagtcgccccagtcgtagtttttaattgctggagagagnattgctgtcattacctaatctgctggcattgcgacgatgtgtttggctgcatctttcagtgcgatttcatttgaagtgccggcgcgacgattgcgaacttcgacaacgccggttgcaacaccacgacctgcgataacgatgcgcggtatgccgatgagttcggcgtctttgaaacgcacgccaggtgaaacacctttgcgatcatccaaaataactgtcaagtgttggtcgtgaagntcggcggcgagtttttcgccngcatcggcagtttcgtcacctggtttgccggcaatcacgatgtgcacatcagcaggagcgacagcagttggccacttcaaaccgatttcgtcgtgatttgcttcggcgattgcggcnactgcgcgagaaacnccgatgccgtatgaacccatagttacnacttgcgacttgccgttttgatcgagcaccgtgagaccgagcgactgtgcatattttcggccgagttgaaacacatgaccgatttcgatgccacgacggatgtgaagtttcgaaccacacttcggacacgcatcgccatcgcgaacgtcggcggcatcgacgaccccgtcggcggtgaaatctcgaccgtgcacgagatttgcgacgtgacgacccggcgcgttggcgccggtgatccatgcactgccaatggcgatgctgcgatcaagaagatancgaatnnngctggnatttttttcgccgagagattgtggcccgatgtaacccttgatgagatttttatttttggcgaagtcttcttcggtgaagtcgacgatttcagcgggcgcgacttgtgcttcaagacgtttgaggtcgacatcgcgatcgccgggcacgccaactgcgagcggttcgatgcgaccatcggggtaactcaagttgacgatgacgttttttagtgtgtcacctgcgtgccaagcacgatcgttgcgtttgagatcttgtcgcgaattgaagagatcgacgagcgtggcgattgtcggtgttgctggtgtgtcgtgaacgaccgctgccggtgtattggcgaaatcaatttttgttggctcgccgacgcgaactgcttcggtgttggctgcgtagtcgcattttgtgcaactgacgaaagtgtcttcgcctgactcgcacggaaacaagaactcttcagatgcagagccacccattgcgccagacatcgccgagacgacggcgaacggtaaaccgagtcgctcgaacgtgcgcaagtatgccgaccgatgtgcgtcgtagctgcgttgcagaccttcgtcgtcgatgtcgaaactgtaagagtctttcatcaagaattcgcgaccgcgcaacaaacctgcacgtgggcgagcctcgtcgcgaaacttggtttgaatttgataaagccacaacggcagatctttgtaactgctgtagagatctttcactaataacgtgaacatttcttcgtgagttgggccgagcaaatagtcgacgccgcgacgatcttgaagacgaaacaaattcggaccgtagtctgtccatcgacctgtgacttcgtaaggttcgcgcggcaacattgcggggaagtgcacttcttgtgcgccgatcgcatccatttcttcgcggatgattgtttcgacgcgatttagtgtgcgcaaaccaagaggtaaccatgtgtaaccacctggtgcggcgcgtcgtatgtatcccgcacgaactaaaagccgatgacttggcacttcggcatcaactggatcgtcgcgtaatgtccgtaaaaacattgacgacatacgcaaaatcacagggtcttacctctcgtgcgcatgggatagcgcctcacgaaaactttactaaagcctctatacttgagatgacctttaaagttctaagaaccggaggcgtgggtttaggcccacgccttttgttctctatcgggtcgtgttttggttggtcaaaataggcatttggtagcgatttatagagaaaggagagacaactgatggctgagaatgtacggacaagcgccggagagagcgcggtagttacgcgtatcggcgaactagttacgccaatcgtcagcgatctcggccttgatctctacgacctcgaatttgtgagcggcgttgtgcgcgttgtggtcgattcaaaaacgggcctggtcggcgaaaacggtcagcctgctggtgttgatcttgagaaaattggtttgctgactcgacttgtctcgcgcgagtttgatcattcagagccggtgccaggtcgctacacacttgaagtgacgagcccgggtcttgagcgcaacttgcgtttgccgcgacattacatgcgngagctaaacaaagttgtgagcgtgcgattgacggcgccacatgagacgacaggtgagcgacgagtgcaaggtgtgcttgtggctgcagacgagcgcgagatcaccgtgcgcacttcagacggtgttgaagtgaaagtgaattacgtggcgattgatcgcgcacgaacagtttttgagtggaagacaacttcgaaagaagaagcacgtcactcgaagaaaaaagtcgctaatacaacggaggccaaagcatcatgagcaacatggacatgtcagaagcgctgcgcatgctcgcagcagaccgaggactaacaatcgacgcactcttgcaagtgctcgtcgaagcacttgcgacggcatacaagaagcgtccgaatgcggccgacgaggtaatcgttggcgtcaacccagacaacatggacatcacatttacggcatacgacgtagatgatgacggcaactggatcaacgagcgcgacgacacgccgaaaaaagatgagttgggtcgaattgctgcggtgactttccgtcaagtgatgggccagcgaattcgcgaagtagaacgcgagcgaaagttcgaagagtacgcaaaccgcgaaggcgacatcgtctctggngccgtgcaaaagacagatacgcgctacacattgctcgacctgggtcgtgttgaagcgttgttgccacaagccgaacaagttcttggcgaaactcgcgagccgaangctcgtttgaa

SEQ ID NO: 1177 - DNA, 4000 bp, Escherichia coli
  misc_feature (449)..(449): n is a, c, g, or t
  misc_feature (492)..(492): n is a, c, g, or t
  misc_feature (1657)..(1658): n is a, c, g, or t
  misc_feature (1741)..(1741): n is a, c, g, or t
  misc_feature (1766)..(1766): n is a, c, g, or t
  misc_feature (1770)..(1770): n is a, c, g, or t
  misc_feature (1778)..(1778): n is a, c, g, or t
  misc_feature (1785)..(1785): n is a, c, g, or t
  misc_feature (1792)..(1792): n is a, c, g, or t
  misc_feature (1795)..(1795): n is a, c, g, or t
  misc_feature (1798)..(1799): n is a, c, g, or t
  misc_feature (1801)..(1801): n is a, c, g, or t
  misc_feature (1808)..(1808): n is a, c, g, or t
  misc_feature (1827)..(1827): n is a, c, g, or t
  misc_feature (2549)..(2549): n is a, c, g, or t
  misc_feature (2584)..(2584): n is a, c, g, or t
  misc_feature (2605)..(2605): n is a, c, g, or t
  misc_feature (2623)..(2623): n is a, c, g, or t
  misc_feature (2629)..(2629): n is a, c, g, or t
  misc_feature (2638)..(2638): n is a, c, g, or t
  misc_feature (2641)..(2641): n is a, c, g, or t
  misc_feature (2649)..(2649): n is a, c, g, or t
  misc_feature (2653)..(2653): n is a, c, g, or t
  misc_feature (2656)..(2656): n is a, c, g, or t
  misc_feature (2659)..(2659): n is a, c, g, or t
  misc_feature (2663)..(2663): n is a, c, g, or t
  misc_feature (2666)..(2666): n is a, c, g, or t
  misc_feature (2684)..(2684): n is a, c, g, or t
  misc_feature (2695)..(2695): n is a, c, g, or t
  misc_feature (2701)..(2702): n is a, c, g, or t
  misc_feature (2704)..(2707): n is a, c, g, or t
  misc_feature (2709)..(2712): n is a, c, g, or t
  misc_feature (2715)..(2718): n is a, c, g, or t
  misc_feature (2720)..(2723): n is a, c, g, or t
  misc_feature (2725)..(2725): n is a, c, g, or t
  misc_feature (2727)..(2727): n is a, c, g, or t
  misc_feature (2729)..(2729): n is a, c, g, or t
  misc_feature (2733)..(2738): n is a, c, g, or t
  misc_feature (2740)..(2744): n is a, c, g, or t
  misc_feature (2747)..(2747): n is a, c, g, or t
  misc_feature (2749)..(2749): n is a, c, g, or t
  misc_feature (2751)..(2751): n is a, c, g, or t
  misc_feature (2755)..(2757): n is a, c, g, or t
  misc_feature (2759)..(2759): n is a, c, g, or t
  misc_feature (2761)..(2767): n is a, c, g, or t
  misc_feature (2772)..(2773): n is a, c, g, or t
  misc_feature (2777)..(2777): n is a, c, g, or t
  misc_feature (2779)..(2779): n is a, c, g, or t
  misc_feature (2782)..(2787): n is a, c, g, or t
  misc_feature (2790)..(2791): n is a, c, g, or t
  misc_feature (2794)..(2795): n is a, c, g, or t
  misc_feature (2798)..(2798): n is a, c, g, or t
  misc_feature (2801)..(2801): n is a, c, g, or t
  misc_feature (2804)..(2807): n is a, c, g, or t
  misc_feature (2809)..(2811): n is a, c, g, or t
  misc_feature (2813)..(2813): n is a, c, g, or t
  misc_feature (2815)..(2815): n is a, c, g, or t
  misc_feature (2817)..(2823): n is a, c, g, or t
  misc_feature (2827)..(2827): n is a, c, g, or t
  misc_feature (2829)..(2829): n is a, c, g, or t
  misc_feature (2832)..(2834): n is a, c, g, or t
  misc_feature (2837)..(2840): n is a, c, g, or t
  misc_feature (2842)..(2844): n is a, c, g, or t
  misc_feature (2847)..(2847): n is a, c, g, or t
  misc_feature (2849)..(2849): n is a, c, g, or t
  misc_feature (2851)..(2851): n is a, c, g, or t
  misc_feature (2854)..(2854): n is a, c, g, or t
  misc_feature (2857)..(2857): n is a, c, g, or t
  misc_feature (2860)..(2866): n is a, c, g, or t
  misc_feature (2869)..(2873): n is a, c, g, or t
  misc_feature (2875)..(2876): n is a, c, g, or t
  misc_feature (2878)..(2878): n is a, c, g, or t
  misc_feature (2881)..(2881): n is a, c, g, or t
  misc_feature (2884)..(2884): n is a, c, g, or t
  misc_feature (2886)..(2886): n is a, c, g, or t
  misc_feature (2888)..(2891): n is a, c, g, or t
  misc_feature (2893)..(2896): n is a, c, g, or t
  misc_feature (2899)..(2901): n is a, c, g, or t
  misc_feature (2903)..(2903): n is a, c, g, or t
  misc_feature (2905)..(2905): n is a, c, g, or t
  misc_feature (2907)..(2908): n is a, c, g, or t
  misc_feature (2910)..(2916): n is a, c, g, or t
  misc_feature (2921)..(2922): n is a, c, g, or t
  misc_feature (2924)..(2924): n is a, c, g, or t
  misc_feature (2926)..(2931): n is a, c, g, or t
  misc_feature (2934)..(2940): n is a, c, g, or t
  misc_feature (2942)..(2944): n is a, c, g, or t
  misc_feature (2946)..(2946): n is a, c, g, or t
  misc_feature (2951)..(2952): n is a, c, g, or t
  misc_feature (2955)..(2958): n is a, c, g, or t
  misc_feature (2963)..(2967): n is a, c, g, or t
  misc_feature (2970)..(2971): n is a, c, g, or t
  misc_feature (2973)..(2973): n is a, c, g, or t
  misc_feature (2975)..(2980): n is a, c, g, or t
  misc_feature (2982)..(2988): n is a, c, g, or t
  misc_feature (2994)..(2998): n is a, c, g, or t
  misc_feature (3000)..(3001): n is a, c, g, or t
  misc_feature (3003)..(3003): n is a, c, g, or t
  misc_feature (3008)..(3008): n is a, c, g, or t
  misc_feature (3010)..(3017): n is a, c, g, or t
  misc_feature (3019)..(3023): n is a, c, g, or t
  misc_feature (3025)..(3027): n is a, c, g, or t
  misc_feature (3029)..(3032): n is a, c, g, or t
  misc_feature (3034)..(3037): n is a, c, g, or t
  misc_feature (3040)..(3042): n is a, c, g, or t
  misc_feature (3044)..(3044): n is a, c, g, or t
  misc_feature (3046)..(3046): n is a, c, g, or t
  misc_feature (3048)..(3052): n is a, c, g, or t
  misc_feature (3054)..(3057): n is a, c, g, or t
  misc_feature (3059)..(3059): n is a, c, g, or t
  misc_feature (3062)..(3064): n is a, c, g, or t
  misc_feature (3068)..(3070): n is a, c, g, or t
  misc_feature (3072)..(3073): n is a, c, g, or t
  misc_feature (3075)..(3079): n is a, c, g, or t
  misc_feature (3082)..(3094): n is a, c, g, or t
  misc_feature (3096)..(3096): n is a, c, g, or t
  misc_feature (3098)..(3098): n is a, c, g, or t
  misc_feature (3100)..(3101): n is a, c, g, or t
  misc_feature (3103)..(3103): n is a, c, g, or t
  misc_feature (3105)..(3106): n is a, c, g, or t
  misc_feature (3108)..(3109): n is a, c, g, or t
  misc_feature (3111)..(3111): n is a, c, g, or t
  misc_feature (3113)..(3115): n is a, c, g, or t
  misc_feature (3117)..(3117): n is a, c, g, or t
  misc_feature (3119)..(3129): n is a, c, g, or t
  misc_feature (3131)..(3134): n is a, c, g, or t
  misc_feature (3136)..(3138): n is a, c, g, or t
  misc_feature (3140)..(3141): n is a, c, g, or t
  misc_feature (3143)..(3143): n is a, c, g, or t
  misc_feature (3146)..(3149): n is a, c, g, or t
  misc_feature (3151)..(3152): n is a, c, g, or t
  misc_feature (3156)..(3159): n is a, c, g, or t
  misc_feature (3161)..(3161): n is a, c, g, or t
  misc_feature (3163)..(3164): n is a, c, g, or t
  misc_feature (3166)..(3169): n is a, c, g, or t
  misc_feature (3172)..(3172): n is a, c, g, or t
  misc_feature (3175)..(3176): n is a, c, g, or t
  misc_feature (3178)..(3179): n is a, c, g, or t
  misc_feature (3182)..(3185): n is a, c, g, or t
  misc_feature (3187)..(3190): n is a, c, g, or t
  misc_feature (3192)..(3200): n is a, c, g, or t
  misc_feature (3205)..(3206): n is a, c, g, or t
  misc_feature (3208)..(3211): n is a, c, g, or t
  misc_feature (3213)..(3213): n is a, c, g, or t
  misc_feature (3215)..(3216): n is a, c, g, or t
  misc_feature (3218)..(3222): n is a, c, g, or t
  misc_feature (3226)..(3227): n is a, c, g, or t
  misc_feature (3229)..(3230): n is a, c, g, or t
  misc_feature (3233)..(3233): n is a, c, g, or t
  misc_feature (3235)..(3235): n is a, c, g, or t
  misc_feature (3237)..(3237): n is a, c, g, or t
  misc_feature (3239)..(3240): n is a, c, g, or t
  misc_feature (3243)..(3243): n is a, c, g, or t
  misc_feature (3246)..(3249): n is a, c, g, or t
  misc_feature (3252)..(3253): n is a, c, g, or t
  misc_feature (3257)..(3257): n is a, c, g, or t
  misc_feature (3259)..(3259): n is a, c, g, or t
  misc_feature (3261)..(3262): n is a, c, g, or t
  misc_feature (3266)..(3270): n is a, c, g, or t
  misc_feature (3272)..(3273): n is a, c, g, or t
  misc_feature (3275)..(3275): n is a, c, g, or t
  misc_feature (3277)..(3277): n is a, c, g, or t
  misc_feature (3280)..(3283): n is a, c, g, or t
  misc_feature (3285)..(3286): n is a, c, g, or t
  misc_feature (3288)..(3292): n is a, c, g, or t
  misc_feature (3294)..(3294): n is a, c, g, or t
  misc_feature (3296)..(3296): n is a, c, g, or t
  misc_feature (3299)..(3301): n is a, c, g, or t
  misc_feature (3303)..(3303): n is a, c, g, or t
  misc_feature (3305)..(3305): n is a, c, g, or t
  misc_feature (3307)..(3314): n is a, c, g, or t
  misc_feature (3316)..(3316): n is a, c, g, or t
  misc_feature (3319)..(3322): n is a, c, g, or t
  misc_feature (3327)..(3327): n is a, c, g, or t
  misc_feature (3329)..(3337): n is a, c, g, or t
  misc_feature (3339)..(3340): n is a, c, g, or t
  misc_feature (3344)..(3344): n is a, c, g, or t
  misc_feature (3346)..(3346): n is a, c, g, or t
  misc_feature (3348)..(3349): n is a, c, g, or t
  misc_feature (3351)..(3351): n is a, c, g, or t
  misc_feature (3353)..(3354): n is a, c, g, or t
  misc_feature (3357)..(3360): n is a, c, g, or t
  misc_feature (3362)..(3363): n is a, c, g, or t
  misc_feature (3366)..(3369): n is a, c, g, or t
  misc_feature (3373)..(3379): n is a, c, g, or t
  misc_feature (3381)..(3382): n is a, c, g, or t
  misc_feature (3385)..(3387): n is a, c, g, or t
  misc_feature (3391)..(3395): n is a, c, g, or t
  misc_feature (3397)..(3399): n is a, c, g, or t
  misc_feature (3401)..(3401): n is a, c, g, or t
  misc_feature (3404)..(3405): n is a, c, g, or t
  misc_feature (3407)..(3411): n is a, c, g, or t
  misc_feature (3417)..(3418): n is a, c, g, or t
  misc_feature (3420)..(3420): n is a, c, g, or t
  misc_feature (3422)..(3427): n is a, c, g, or t
  misc_feature (3432)..(3435): n is a, c, g, or t
  misc_feature (3437)..(3439): n is a, c, g, or t
  misc_feature (3442)..(3442): n is a, c, g, or t
  misc_feature (3444)..(3445): n is a, c, g, or t
  misc_feature (3447)..(3450): n is a, c, g, or t
  misc_feature (3452)..(3457): n is a, c, g, or t
  misc_feature (3461)..(3461): n is a, c, g, or t
  misc_feature (3467)..(3470): n is a, c, g, or t
  misc_feature (3472)..(3475): n is a, c, g, or t
  misc_feature (3477)..(3477): n is a, c, g, or t
  misc_feature (3479)..(3479): n is a, c, g, or t
  misc_feature (3484)..(3484): n is a, c, g, or t
  misc_feature (3486)..(3492): n is a, c, g, or t
  misc_feature (3494)..(3495): n is a, c, g, or t
  misc_feature (3497)..(3500): n is a, c, g, or t
  misc_feature (3504)..(3505): n is a, c, g, or t
  misc_feature (3508)..(3510): n is a, c, g, or t
  misc_feature (3512)..(3513): n is a, c, g, or t
  misc_feature (3515)..(3519): n is a, c, g, or t
  misc_feature (3522)..(3524): n is a, c, g, or t
  misc_feature (3528)..(3529): n is a, c, g, or t
  misc_feature (3531)..(3531): n is a, c, g, or t
  misc_feature (3534)..(3538): n is a, c, g, or t
  misc_feature (3541)..(3543): n is a, c, g, or t
  misc_feature (3545)..(3545): n is a, c, g, or t
  misc_feature (3547)..(3547): n is a, c, g, or t
  misc_feature (3549)..(3550): n is a, c, g, or t
  misc_feature (3553)..(3554): n is a, c, g, or t
  misc_feature (3556)..(3557): n is a, c, g, or t
  misc_feature (3559)..(3559): n is a, c, g, or t
  misc_feature (3563)..(3565): n is a, c, g, or t
  misc_feature (3567)..(3567): n is a, c, g, or t
  misc_feature (3569)..(3570): n is a, c, g, or t
  misc_feature (3573)..(3573): n is a, c, g, or t
  misc_feature (3575)..(3575): n is a, c, g, or t
  misc_feature (3577)..(3577): n is a, c, g, or t
  misc_feature (3579)..(3579): n is a, c, g, or t
  misc_feature (3581)..(3583): n is a, c, g, or t
  misc_feature (3585)..(3591): n is a, c, g, or t
  misc_feature (3593)..(3597): n is a, c, g, or t
  misc_feature (3599)..(3601): n is a, c, g, or t
  misc_feature (3605)..(3605): n is a, c, g, or t
  misc_feature (3607)..(3608): n is a, c, g, or t
  misc_feature (3610)..(3610): n is a, c, g, or t
  misc_feature (3613)..(3617): n is a, c, g, or t
  misc_feature (3619)..(3621): n is a, c, g, or t
  misc_feature (3623)..(3623): n is a, c, g, or t
  misc_feature (3626)..(3629): n is a, c, g, or t
  misc_feature (3633)..(3633): n is a, c, g, or t
  misc_feature (3635)..(3637): n is a, c, g, or t
  misc_feature (3639)..(3644): n is a, c, g, or t
  misc_feature (3646)..(3646): n is a, c, g, or t
  misc_feature (3648)..(3655): n is a, c, g, or t
  misc_feature (3657)..(3661): n is a, c, g, or t
  misc_feature (3663)..(3667): n is a, c, g, or t
  misc_feature (3669)..(3673): n is a, c, g, or t
  misc_feature (3675)..(3679): n is a, c, g, or t
  misc_feature (3682)..(3682): n is a, c, g, or t
  misc_feature (3685)..(3685): n is a, c, g, or t
  misc_feature (3689)..(3690): n is a, c, g, or t
  misc_feature (3693)..(3700): n is a, c, g, or t
  misc_feature (3703)..(3704): n is a, c, g, or t
  misc_feature (3709)..(3711): n is a, c, g, or t
  misc_feature (3714)..(3716): n is a, c, g, or t
  misc_feature (3718)..(3719): n is a, c, g, or t
  misc_feature (3722)..(3722): n is a, c, g, or t
  misc_feature (3725)..(3726): n is a, c, g, or t
  misc_feature (3731)..(3733): n is a, c, g, or t
  misc_feature (3736)..(3738): n is a, c, g, or t
  misc_feature (3740)..(3740): n is a, c, g, or t
  misc_feature (3742)..(3747): n is a, c, g, or t
  misc_feature (3749)..(3749): n is a, c, g, or t
  misc_feature (3751)..(3751): n is a, c, g, or t
  misc_feature (3753)..(3756): n is a, c, g, or t
  misc_feature (3759)..(3762): n is a, c, g, or t
  misc_feature (3766)..(3780): n is a, c, g, or t
  misc_feature (3782)..(3783): n is a, c, g, or t
  misc_feature (3786)..(3792): n is a, c, g, or t
  misc_feature (3794)..(3797): n is a, c, g, or t
  misc_feature (3799)..(3803): n is a, c, g, or t
  misc_feature (3805)..(3805): n is a, c, g, or t
  misc_feature (3807)..(3808): n is a, c, g, or t
  misc_feature (3810)..(3810): n is a, c, g, or t
  misc_feature (3812)..(3813): n is a, c, g, or t
  misc_feature (3815)..(3817): n is a, c, g, or t
  misc_feature (3822)..(3823): n is a, c, g, or t
  misc_feature (3825)..(3826): n is a, c, g, or t
  misc_feature (3828)..(3828): n is a, c, g, or t
  misc_feature (3830)..(3832): n is a, c, g, or t
  misc_feature (3834)..(3835): n is a, c, g, or t
  misc_feature (3837)..(3839): n is a, c, g, or t
  misc_feature (3842)..(3843): n is a, c, g, or t
  misc_feature (3847)..(3852): n is a, c, g, or t
  misc_feature (3855)..(3857): n is a, c, g, or t
  misc_feature (3859)..(3859): n is a, c, g, or t
  misc_feature (3861)..(3862): n is a, c, g, or t
  misc_feature (3865)..(3868): n is a, c, g, or t
  misc_feature (3870)..(3872): n is a, c, g, or t
  misc_feature (3875)..(3877): n is a, c, g, or t
  misc_feature (3879)..(3880): n is a, c, g, or t
  misc_feature (3882)..(3883): n is a, c, g, or t
  misc_feature (3885)..(3887): n is a, c, g, or t
  misc_feature (3889)..(3894): n is a, c, g, or t
  misc_feature (3896)..(3897): n is a, c, g, or t
  misc_feature (3900)..(3904): n is a, c, g, or t
  misc_feature (3907)..(3910): n is a, c, g, or t
  misc_feature (3912)..(3912): n is a, c, g, or t
  misc_feature (3914)..(3917): n is a, c, g, or t
  misc_feature (3921)..(3926): n is a, c, g, or t
  misc_feature (3929)..(3935): n is a, c, g, or t
  misc_feature (3937)..(3937): n is a, c, g, or t
  misc_feature (3939)..(3940): n is a, c, g, or t
  misc_feature (3942)..(3948): n is a, c, g, or t
  misc_feature (3950)..(3950): n is a, c, g, or t
  misc_feature (3953)..(3953): n is a, c, g, or t
  misc_feature (3955)..(3957): n is a, c, g, or t
  misc_feature (3959)..(3963): n is a, c, g, or t
  misc_feature (3965)..(3965): n is a, c, g, or t
  misc_feature (3967)..(3970): n is a, c, g, or t
  misc_feature (3972)..(3972): n is a, c, g, or t
  misc_feature (3975)..(3978): n is a, c, g, or t
  misc_feature (3980)..(3988): n is a, c, g, or t
  misc_feature (3990)..(3991): n is a, c, g, or t
  misc_feature (3995)..(3995): n is a, c, g, or t
  misc_feature (3997)..(3997): n is a, c, g, or t
  misc_feature (3999)..(4000): n is a, c, g, or t
tagctttgatacgacggttgatttcgtacgctttgcggccccattccatttcgatgaaaggtgccaccatgcggcctgtaccatgttcggctttcaaagaaccaccaaaaccagatacgcgttcggacatttcttttaccaaatcaccgaagttcttagtatctttagggtcactgaaatcaggagtaatgttaaagtgaacgttaccggacaacgcatgaccgaagattacaccaccatcaacgaaatcgtatttgtggaataattcagtaagcatttcgatgcccttagtgaagtcttcgatttggaagcaaacgtcttctgtgataacagtagtaccttttctacgttgaccaccaacgattggcaagatacctttacggattgcccaccaggaatcgtattctttaggatcttgagaataaagacttggaatagctgttggaatntctttcaattgttctttaatgaaagccaagttttcatcaacantttctttagaatagctttcagtttggaacaagatagcacttgtaccttctggaacttcacgaacgaaatcaggtacattatctagagtttgaactgcttttaaggattgatagtccatcatttcagcagcaacaaccttttcacggcccatattagccaaggctacaacggcaagagatgcgtcgttcaatgtgctgaagaacatgagaccgcaacctttgtgaggtacatcttcaacagtgttgtacacgatttcagatacaaagcccaatgtaccttcggaaccgatgaacaagtgattgataatatcgatgatatcttcaaaatctacaagggagttcaaaccgtaacctgtagtatttttgattttatatttgtgatgaatcaaatgagtcaactcttcatcagccaagatttctttgcgcaattgcaaaatatcttcaaccatttgtggtttttctttgaggaattgatcgatgctctttttatcggatgtatccaaaatggaaccatctaataagacaacgcgaatagagcgaattgttttataagagttttgtgcagtaccacagcacataccggaggagttattgttcaaaataccgcctaccaatgctgttgcaagcgttgcagggtctggaccgattttacgattatatggtttcaacaaatcattcgcatcggaaccgataacaccacattcacaacgcaatgctttgccatcgtcgataacttccatttttttgaagccatcattacaaacgataagcacgtcttcactggaacattgaccagacaaagaagagccagccgcacggaatgtaaatggtgtgccacattgttgacacaaacgaataagacgacgtacttcggattcgttttctgcttttaccactacttttggtaaataactgtaacaagatgcatctacaccatacgcataacggcgcagacggtctgtataaacacgatccttacaaatcgcttgcgcctctttggcaaaacgatcataatctttaactaatatactcacttgaaaagcctccaatcctatccttaggaaaatttcttttataactagtatacgccgttctcatttcggtcgctaccattatgcataaattgtatatgaaatataaattctatagatacacaatacaaaatnnatcttagttgaaagttgatttcatttaccaaaaaaacaagtgcatttcctaggaacacacatcaataaaaatatatgataacnacttatgaaagcccatataggtatncccnatcaatangcgtatncatgggnatnaanngntttatancatgaatacagatctacancaatatatgaatatttatgtgaattttcctagtatcctgtatattacacattaggaattatcaatataaattagttatgcgttttaggaatagatctactgtttgctcgatttttaatagtaatctattattatcacgcctcaatatttgtaaaacatataaatacttttgcttgattttgttttacaaattgatataatatttgtaaaaagaggtgataattatggctacaactaatatcaatatacgagttgacgaattgttaaaaaaagatgccgaagcattgtttaatgacttaggcctcagcatgtcatctgctatcactatgttcttaaaatctgcattaaatcatgatggtatcccattcgaagtaaaacgtgcaaaaccaaatacagaaacaatacaagccttagcagaatatgaaactatgaaagctcatccggaaaaatacaaacggtatagtagttttgcagaattacttaaggatgttgaaaatgaaacttaagattgttgaaaatgccatatagaaccagattggctattaatttatcgaaaagatacagatgtacttgaattatttctattccgaactggaacacatgcagatttattttaaacaacatatatggctatgaaaaacagcaaaaaggctgtaacaaaaatgtggtaaaactatttttgttacagcccttttatatatttttcttatgtttagactatanaggtactcttgtaaattagaacaggcgtgttctanttgtaaaagtatcacatttangtgctcttataaattagnacaggngtgttctanttntaaaagcntcanatntangtgntcntataaattagaacaggcntgttctaattntaaaanncnnnnannnnggnnnncnnnnanantngaannnnnntnnnnnaantntnaaannnantnnnnnnnaatanntatncnacnnnnnncannatnncanagntannnntnnntntnannnnnnntgcnantannncgnnnntnnnaantncnaanatngcnnnnnnnctnnnnngnntngcnatntnannnncnnnntgnnncncnannannnnnnnaatannancnnnnnnagnnnnnnnannnanaatannatnnnntatannnnntgnnanannnnnnannnnnnncgacannnnnannanagcangnnnnnnnncnnnnncnnnannnntnnnnaannncntnannnnnannnnancannnacannnannannnnnccnnnnnnnnnnnnnanantnnanannanncnannnanannnnnnnnnnnannnncnnntnntntannnnanntcannnnancnntnnnnaanganncnnctnnnngnnnncnnnnnnnnncaaanntnnnnanannannnnngaannanncananancnnaanacnnnnaanngcananannaatnnnnnannantnaannnncnngnnnnncnancannnanantnnnnnnnngnaannnngaaanannnnnnnnnanngcancncnnananncannnntnnctnnnntaannnnnnnanngannnagannnnncnnnanacnnannnnnaaatanngntnnnnnnacaannnnannnggngnncnnnntnnnnnncaanacatannnnannnnananatacnannnnnnnanncnnnncaannatnnntnnannnnnagnnntaannanacnnnnnacnnnananannaannannanaaannnanannatnanananannnannnnnnnannnnncnnngtanannanttnnnnntnnnanaannnnatanannnannnnnncnannnnnnnngnnnnncnnnnngnnnnnannnnnatngangcannctnnnnnnnnatnncacgnnngannnannatnctnnatctnnngtnnncncnnnnnncntntnnnnatnnnnaatnnnnnnnnnnnnnnnannttnnnnnnnannnntnnnnntntnntnanncnnnatacnngnnanannntnnannntcnnttgnnnnnnttnnntntnnttnnnngnnncannntnnanntnnncnnnnnntnnttnnnnnctnnnnanannnntgannnnnncannnnnnncntnncnnnnnnntnctncnnnannnnnancnnnnangannnnannnnnnnnntnnttanangnn

SEQ ID NO: 1178 - DNA, 4000 bp, Escherichia coli
  misc_feature (1299)..(1299): n is a, c, g, or t
  misc_feature (2000)..(2000): n is a, c, g, or t
  misc_feature (2077)..(2077): n is a, c, g, or t
tatcaagagtataagatgaggtacgttgaaaactaacaatcagcctagaatccggctgaccgctgaaagctgatcgctcataaataaggaagtaaccaccatgccccaaatgaccgggaaagatgccctggcccagatgctgatcgccgaaggcgccgaatttatcttcgggaacccggggaccagcgagacgccgttgctggatgtattgcaagactatcctcagctcagatacatccaatcgttgcaagaaggaacggcggtgggtatggccgacggttacgcccgggcgacgggacgccccgccttcgccaatatacacatagccgggggtctggccaacggcatcagcgccttgtacaacgcctaccggggcggcacgcccttggtgctaaccgccggcaactccgacactcggatgctcttaaccgacccaactttgtccggggacctggtggagatgaccagccagtacaccaagtggagcacgcaagtgctgcacgcatcggacatacccatggcggtgcggcgggcttataaagaagccaagactcctccaaccggccccgttttcatctctttcccttgggacaccatggacgaaaccggcgacctgaacatcgtgccttcgtcggccggattcttccgcacccggccggataccgatgccgtggcccgggcttcccagctactatcccaagccgacaaccccatcatcgtagtcggcgaccgcgtggcccaatccggcgcggccgcccaggtcgtccgggtggcagagcagttgggggccagggtctacgcaacctcgatgtccgaagtaaacttccccaacagccacgacttatatggaggaatactaaataccagcagcccggctacccaacggctattggccggagccgacgtggtcatggctgtaggcaccgatgtattttcttctttcctctatgtgtctgagccttttttgggctcccagaccaagctgatccacctggacagtagcgcccaagaactggagaagatctatcccacggaggtgggtatcctggccgaccctggagccggactggcggaactggccgaagccttggaccaggagatgtccgcctccaaccgtgaggccgcggcaactcgagcggcaacctggtcggaccagaagaaaaggtccggcgagcaatatcaacaacgactacagcagagatgggacaacacccccatgccggtggagcgcatgatgcacgaactagccaaggccgcgcctcccggcaccatcgttgccgacgaggccatcacctcgcngccagctttgatgcgagcatttaccttcgacgagccgggtagcctgtacggtatccgcggcggcgcgctgggttgggcgatgccaggcgcccttggggtgaagctggccaacccggaccgtccggtgctggcagtggtaggagacggcgcgtccatgtacaccgtgcaagccctttggaccgccgcccggtacaatatcccggtcgtctacgccatctgcaacaaccggtcttaccggatactcaaggtcaatatggacacctacctgcgccacatgcaggacgaccaggaacggcaaagcgactacgtgggcatggacttcgccaatcccctcgatctggccgcgatcgccagggcgatgggagttgccggtgaaacggtggaagacccggccggcctgggacccgctctggaaagagcttatgcctccggtaagccggcgttgctggacgtcagcatcgacggcgctctatagaacgtactttagacagagacggcatataggggtgtcccggctgtgcctccggagatgcggcgcctcgattcacctgggcgaactgctttactccggagacgaatcacatcgctctaaaacaccggtaggtccgtgtctaccttgaaaacctgtgccacgatgggttatttacgatattgatctattacaggcctatagtttaactattacggggatgtaaacgtcnatgtcaacggagtatgtttatagacataactaactggcgacgacaaaagttgacaataaaagcagaacgtaatatanaagtaggtctatatcattcatttgttcttgcttggactcaggaggctctatggtaagtcaatccgtacgaaatacattgctgacacggctgggaggggcccgggcgatgcagcgggtggcatctccttccatcatcatcggcttggggtccacagcctgtcagatcgtccaacacttagatgactccacggctggctggaacgcctcggaccgaaaatcgttggggttcctctatcttgatacccgagaggccaccagagacgagataaaccggggctcgagcttcatcggcctgacactccctcatttctccaacctccgggatatgcggccttggataaccgagtgcgtcccggaacttaagcacctcagcctctccagggaaggggcactggggatgctggccaacgccggtgtggccggccgttataattacgcgagtattagaggccacatagattctcttatcggggaagtctgtccctattacgaggggaagacctatctaagagtccacttggtttgtttcctcggcggcggcaccattggcgctctccccgtcctgttggccgctttggctgaggccaggggcaccgcgtataacttcagtctggttcttcacctattgatgccccaaaggggcatgtcgagggacccggacaacagctacccgcttcagctaaggaacgcgtatgccaccatccagttcctgcgcgtgataaccggggtcgaggtaggccaggggaagcacacgggcaccgatacctacaagattaccgtatacccggaaaagacggtcctggccgtaggccctcacttcgacctggcgatcgtccatcgtgcgcccaaagactctattccggcgcagaaagcccatgtgggcaggattctggagaatctggtgtccgatgccaccggtaccggttcagacctatgggcccggtatcacgaaactatgagggaagccaacaacaagacagacgcccgatttggctccatcagttccaaagaggtcagcctccttgatggatttttcaatctaaccgcccgcaagtacttgcaaactcgttggaccgcgggcaataggtcgtagacaccatgtttcgtaagatttggacacgtaagggagtttcataccgagacgcgtctcagcgcctgcggccttcgttggatcctttggcgttccttaatgcggatggcggggggttcactacgacggacgccctggaccagttgcatagtgcgatccattcatcgttggaagacgtgcagaaggcgtttcaactggtgtttgagcagttgaatccggaagccaacgtgagcgaccgaatcattctggatgccaacaaacagatcaggacccaacaaaccagggcccgcaacttggtaactctgaggcaagaagagttgaaccggcaggtcagggtcaagctggaaaacctctttattcaaggaatagtccaatcgcctcatcaagaaccgtccgtcaggagctgggagaatctgtcttcccggatcgtccaccggaatgaaccggaagtttcggaatactcgtacgaagacctgggcaccgaaaagaggggcaaacgtatcgcggtctgggaccacgaaaccgatgaatggctggaaactctctgccagaataacatccatgagatcatcactaaaatggaagagatgatcaaggactataaggacacttgggttgaggtaaccggggaactgagaaaacgcgctaacttaggtggcctgctctttcaacaggtgaacgaccccgacgtatggaatttcgaaagcgaggacccaacggtgaccaatctgttggaaggggacaaggccctggatattgcaaaccgtatcctggaccgcttccaactggtcaaccaggacatcctagaggttgcagacacggtgcggatgtct

SEQ ID NO: 1179 - DNA, 4000 bp, Escherichia coli
  misc_feature (114)..(114): n is a, c, g, or t
  misc_feature (150)..(150): n is a, c, g, or t
  misc_feature (180)..(180): n is a, c, g, or t
  misc_feature (225)..(225): n is a, c, g, or t
  misc_feature (228)..(228): n is a, c, g, or t
  misc_feature (333)..(333): n is a, c, g, or t
  misc_feature (461)..(461): n is a, c, g, or t
  misc_feature (492)..(492): n is a, c, g, or t
  misc_feature (494)..(494): n is a, c, g, or t
  misc_feature (511)..(511): n is a, c, g, or t
  misc_feature (526)..(526): n is a, c, g, or t
  misc_feature (559)..(559): n is a, c, g, or t
  misc_feature (562)..(562): n is a, c, g, or t
  misc_feature (574)..(574): n is a, c, g, or t
  misc_feature (583)..(583): n is a, c, g, or t
  misc_feature (712)..(713): n is a, c, g, or t
  misc_feature (715)..(715): n is a, c, g, or t
  misc_feature (772)..(772): n is a, c, g, or t
  misc_feature (778)..(778): n is a, c, g, or t
  misc_feature (784)..(784): n is a, c, g, or t
  misc_feature (786)..(787): n is a, c, g, or t
  misc_feature (967)..(967): n is a, c, g, or t
  misc_feature (1014)..(1014): n is a, c, g, or t
  misc_feature (1162)..(1162): n is a, c, g, or t
  misc_feature (1390)..(1390): n is a, c, g, or t
  misc_feature (1432)..(1432): n is a, c, g, or t
  misc_feature (1436)..(1436): n is a, c, g, or t
  misc_feature (1546)..(1546): n is a, c, g, or t
  misc_feature (1698)..(1698): n is a, c, g, or t
  misc_feature (1705)..(1705): n is a, c, g, or t
  misc_feature (1771)..(1771): n is a, c, g, or t
  misc_feature (1858)..(1858): n is a, c, g, or t
  misc_feature (1969)..(1969): n is a, c, g, or t
  misc_feature (1991)..(1991): n is a, c, g, or t
  misc_feature (2000)..(2000): n is a, c, g, or t
  misc_feature (2963)..(2963): n is a, c, g, or t
  misc_feature (2975)..(2975): n is a, c, g, or t
  misc_feature (2981)..(2981): n is a, c, g, or t
  misc_feature (3071)..(3071): n is a, c, g, or t
  misc_feature (3151)..(3151): n is a, c, g, or t
  misc_feature (3158)..(3158): n is a, c, g, or t
  misc_feature (3179)..(3179): n is a, c, g, or t
  misc_feature (3187)..(3187): n is a, c, g, or t
  misc_feature (3226)..(3226): n is a, c, g, or t
  misc_feature (3517)..(3517): n is a, c, g, or t
  misc_feature (3520)..(3520): n is a, c, g, or t
  misc_feature (3586)..(3586): n is a, c, g, or t
  misc_feature (3600)..(3600): n is a, c, g, or t
  misc_feature (3703)..(3703): n is a, c, g, or t
  misc_feature (3748)..(3748): n is a, c, g, or t
  misc_feature (3776)..(3776): n is a, c, g, or t
gagagtcttttgcggcctgccctatttatatcaccaacaatccggcttcttgatctgcttcatgaaatgcgtttgcgccgccgccatttggcgctggttgttgatgaatttggnggggttgatggtttgatcacgatcgaagatctggtngaagaaattgttggtgaaattgaagatgancatgacaccacagcgcaattgcggtttgagcaaaagggcgatggnacngccattgccgatgcccggcttgaagttgaggctcttgaagcgattaccggccctttgcttgatgatgatgaacgtgacgagattgatacgcttggcggattggtntgtgcgcttgctgggcgggtgcccggtcgcggcgaggttgtgcgtcatcgcggcgggttgcaatttgaaattcttgaaggtgacccgcgccgtgtcactttgttaaaacttcgtggattgccgcgtgncaaaaccagctctagcaaaccggactaaaancngcccccttatgcttttntggcatttgcttgcnggcgcatttgccagcctgtccttgccgccattnttnttattgccagcnatttttgcnttatcgattccgcttcttgcctatttaaaagctgaaagccggatgcaggcatcgttgatttttggtgcggcggggaccggatggtttctggcatcaacctattgggtgtcgcattcgctgattgttganncnccatcactttgggttttggcgccgtttatggcgctggcattggcgcttattctggcngttttntgggcnanngcggcaatggtttcatggtcatttgggcggcgaccggtggcgcgcctgttttggtttgttgcctttttcagccttggcgaatgggcgcgtggctttgtggcaaccggatttccgtggaatctgaccggcagtttgtttgctgttgatcttgccagcctgcaatcggccagcgtgattggngcctatgggctatgcgtgattgcgctattttttgcattggtaccggnattctgggttttggggcatcggcgttttgccgcgatatttttgatgttgcctcttatgcttgccgcctttggggcgatgcggcttgccaattcatctgatgcccattcggcatcatcgggatcaatgatccggcttgtgcaaccggcnataccacaagccgataaatgggatcgaagcaaacgccagcgccatctcgacaggcttgtcagcttgtcgcgtcaaggtgatgtggtgccaaaattggtgatctggccggaaaccgcctttgccggatttgctagccgcaatcaagcattgctcaacacaaccattcgcaatgccacgcaaaatgatggtttggtgattaccggtattccgcgatttggcggcggtcgnactttgctgaattcggccattatgattgaccatgatggtgcnattnaagctgtctatgacaaacgccatcttgtgccgtttggcgaatatatgccatttcggaaatggcttcccttccttgagccaattgttggcccgattgattttgtacctggngaaaataatcgcctgatgcgtcttgatggttatggcagcatacaaatgctgatttgctatgaagtgatttttgccggcgcggtcattggtcaagagatgcgcccagatatgatgatcaatatcaccaatgatgcttggtttggccaaagtgnagggccntggcagcatcttgtacaagcccagatgcgcgcggtcgaagaaggcttgccgctgatgcgggttgcnaatacgggcatcactgccggttttgattcctatggccgtattcttggacagatggggcttggcaggcagggtgttcttgatctgccngtgccgccggccctagcgccaacgctatttgcccgtttcggtaatttgggattctttgcacttattttcttgattattggcagtgctgcatgtcttgacctctctcgttcnatcaggcaatagatacaatcancaagaattnaggatcccacccatgagctatatctttacatctgaatctgtttcagaaggccatcccgacaaattatgtgaccgtgtttcggatacggttcttgatctgtttttgaaatatgaaccagaagcgcgtgttgcctgtgaaactttggcaacgacaaaccgtgttgtgctggctggtgaagtgcgggcaagcaagtctacattgacccagatcatggccgagatcgaaccggcagtgcgggcggcggtcaaagatatcggctatgagcaagacaagtttcatcacgccaatttcgaatttcaaaactaccttcatgaacaatcgaccgatatcgcgatgggtgttgattcaggcgataataaagatgaaggcgctggcgatcaggggcttatgtttggttatgcctgtgatgaaaccgatgtcttgatgcctgcggcaattcattattcgcatcagattctaaaagatcttgcaacggttcgtaaacaggatgccgattcaatccttggccctgattcaaaaagccagatcagccttgtttatgatgatgccggccgtccaacgggtgtgcataaggtggttctatcaacgcagcattctgaaaaagcgacacaagccgatattctggcactggtgacgccggtgatcgccaatgttcttcccgatggttggatggtgtcaggtgatgatctgctggtaaacccaaccggacagtttgtgattggtgggccggatggtgatacgggtcttactggccgcaaaatcattgttgatacttatggtggggcggcgccgcatggtggcggtgccttttcgggaaaggacccaacaaaggttgaccggtcggctgcctatgctagccgctatttggcaaaaaatgttgttgcggcgggattggcatcgcgttgcacaattcagatcgcctatgcgattggcgttgccgagccggtatcgctttatgcgaanacacatggcacnggcacnattgatgatcaaaaactgcaagaagcgcttcgcgattgcatggatttgacgccgcgcggtattcgccagcatcttggcatgaatgcgccnatctatgcgccaactgccgcctatgggcattttggccgaattgctggtgaagcaggggcgggcacatttagctgggaagnaaccgancttgttgacgcgcttcgcgcngcggcacnataggatatcacttgccgaaatagctggtcaaatattcnatcaaacatccgatcaaatacgcgttcacatatgggacagattttgcaatggccgatcacgatgctgttaccaagaacggggttttaattgacgggatgccgctggggccgcgtttttatggtcggcgcaaaggccgcccgcttcgtgcctcgatgaagcggcttcttgatgaagctttgccgcaatttgcctttgatccggcgcggccgattgatgatcaatttggccacaaggccgatcgctatcttgaaatcggttttggcggtggtgagcatctggctggccttgcngcngcgatgcctgattgcgatttcatcggcgccgaacctttcatcaatggtgttgccagtctgcttcgncatattgatgaacnacagcttggcaatatccgcatctggccagatgatgttcggctgatcatgcctagtcttggggcggcaagccttgctggtgcctttatcatgtttcccgatccntggccgaaaaaacgccatgcggcgcggcgcattctgcaaaccgcncttcttgaccagcttgcggtgatgatcnggccgggtggacggctggttctggcaagtgatgatcctacggcaaaaagctggcttttgcaggctgccaccgcacatgctgattttatgtggacagcgcgcagcccccaagattggcgtcaacgacctgccgaattgcccgaaacgcgctacatgaaaaaggccgatcgcgccgaacgccaatcatcatggtttctgtttcagcgttgcggcgttgccgactga

SEQ ID NO: 1180 - DNA, 4000 bp, Escherichia coli
  misc_feature (1163)..(1163): n is a, c, g, or t
  misc_feature (1927)..(1927): n is a, c, g, or t
  misc_feature (1977)..(1977): n is a, c, g, or t
  misc_feature (1986)..(1987): n is a, c, g, or t
  misc_feature (2007)..(2007): n is a, c, g, or t
  misc_feature (2688)..(2688): n is a, c, g, or t
ccttgaacccccctgccgagccgccctcgcgggagagtttaatttgttcggctgacggaggagccgaaatttaggcgggattggaattaacagtatctataatatcgcaacaaaagtacatttattcaatatcagttgttccgacaacttcaattaaccggctttttaagctgtgcgacctgcaatgtttaagaacaccgctatacgaagaaaaattctttttattaacccttctgaatatccttcgctttgtcttggttcttataactctgtgatgcggaaaggagacataaccgagataatcgattccgctggcgtatgttttgagaattaatttctttgggtggactttaagattcagtcgttcttgaagaaaatgttcgattttctgacggcaatcaataagcaactctttgttctcatgcataagaacaaaatcatcggcataacgaacataccccttgattcgcagttcgttcttaacgaattgatccagttcgttcaagtatacattcgcgaacagttgcgatgtcaaattaccgagcggcaatccagggttaaaactattgattatttctcgaaaaagattcatgagccgctcgtcactagttctttttgaaagaatatcgagaaggattttatgatcaatggaatcaaaaaacttagtcacatccagttttaaaatccataaagttcttgtgtagttatgggacaacctaagggccaaattctgcaatcgtctcactgccgcatgcacacccttcgtttttctggacggccaagaatcaaaaataaatactttattccacatcggctcaatgatcctgtggacggcatggtggaggaggcggtccattaccgaagctttatggatatgacggcgtttcggatcgtggatgaaaaaagagaagtagccgccatgtttgtaggtctcatgtttaagattttcatgcagcgcaaaaatatggtcttcaagattgacctcgaattcagctacatcgcctttgttgcttttctccttcttgaactccgtccaagcgtcgaacaggttctctaaagaaattatttgatcgaacataaaaatgaatagaaataataatcaaacaacgccatttgcacataatacgcccttatttcaggcagtatataaattgtatcttgcntggtatcgccgttgccagacaattcccaaaaaggatagatttacaattggtcaaaaagcagaaaatactctgttggaaataatgactcttgttgtgtctgcatatcacactaaagacagcgtgcgtaagagagaaatcttatcgcagattaacatcaaagtggaaggaatcaagattctttttcggttggctaagaatgtgaaagcaattgagcaacggccatatattgattatgagagtcgtttgcaagagatagggaagatgcttggcggttggatgagacaaacacaaagcccgtccattagatagacgggctttgtaacacttcgggaaagagaagcgccgagatcgccaccgcggttgtcaggcctccacttgttgccgttcacgcccttcgggtcaaagttgccgagattgacgaggttgccgtcagggttcagagacgcttctcttacgcttttccatccaagtcaacggcacttcatgctaatgggacatgttgcacctgtataagtacgcgcgcactctataaaagtcaatttacctgcgccagaaaagcgtaagcagtgtattttgttggcgagcatgatccgtaaaccatgcttcattagccatatagaaattatactatattccgtggaaaagcccaaaataaaaattttttcgaaaaaatcgactcccgttagggagtcgattatcaaagaaacaaataacaaaaaacaaagttacaatctgcgggaaagagaagcgccgagaccgccacngcggccgacaggcctccactcgccgccgtccacgccccccgggccaaagnggccgaganngacgaggtggccgccagggnccagagacgccgaccaagtatatttacccgaaagtaatcgcttattatgcttgtcataatacattgcaacatcgtaaattgtttcgggaatggtttgtcttgtaagcttggtaatttttaattccgaaagttgcttcgcagcttcttgccaatttttgctcatgagccgtgtgagtcgatctttatttgactcaaattcccgcattgcttcttcatattcttccgggatttcaatatctttgaacgctttttcccgaagagcttttataataacctcagtttgttctacatagttcttactcgtgctatcaggcagtaagtctttagaaactaatgcccaaccagaatggggaacttcttttttaaagtaatcttccccaatccagcttttccaactatctgctgttcgtaatatttcccccttatcatcttttttccatttcttaaccaaaatatcattcattgcttccatagacatcggcttgccagcatcggttttgtctactctcaaaacaagcatttgtcctaatttctcagcgcgttccagctcttcgacagaaaaaggaatctccggtacctcccttaagcgtacgccaaaagttttttctacctcatcagggccgaatacattttctctgccaagtttttcaacggcagtttcgatttgctcggcaaccgtgncttcaagccttgtttcgggtatcgcctctgccttttctttcggtttctctttctctttctctttttcttctctttccggccccttgcgttttgattcggctacttgtggcttccaagacgcttggtcaagcatcagacggactttttgtttatcagcatcagagctatacattccgataacgcaggtctcaaaagcatttttgatagtttcatttatatcgccgtggtaaaaacgagcaatatattgcggaatggtgctcattacgagacggggattaaagcaaagattctgccgctggcttttagccatctcccgctttgcgcccgatgattttgcttccagtaccctcataatggttacgatttctttgcgccagtgcggcattccgggtatttcggcgagttctctgacgggtaggccttcacccgtgtggcgaaattcttgttccggcaaattaatgtccaccttttccccaataacgccggcgagcaatttgttttgctcttcctccgaatactcaattggcaatttacggaaaacccaacgaccaaatgtttccgccgacaattgacttcgatcggtatattcgtgtccttcttcaaaaccaggtggattttgagcggcaaccaaacgaaagtcaggatgcacttttacccgttcgttttcgttatacggattggtaatttctttacggccgtttaagatggcatcaataatcggattgatgatgccggcgagcttactttggcggttatattcatctaagaaagcaacgcctccgtttcggatagcgtacatcaagtcgccgtcataccactccagtttttctttgccattctcatctactttcaaagtatgtccaccgatcacatcttctcgagcagtctcgcggtcaaaattgaccttacagtaattcatgttgaggtcgcggcacatgcgggcaatagtcgtggtcttgttgtagacgccggtgcctccctccaaaagaacaggtttgtttaaaagcaaagcggttgccacttcacgcatggtcgcatagtggccttccaagtagaaatattcttccttaaattcttctgctttggggacgaggcgcccgccttctcctttgggaatctccacgccaagataagagacggatttttcgccaataacaatatagggctcttcaggagagcgcgtggtttccttttctgcttccgatttcgccgcggactgttctgatgtctctttgccgtctcccggcggtatcaccgcctcaaatttttgttcagggcctctcataatgacttggtgaaatttatatattca

SEQ ID NO: 1181 - DNA, 4000 bp, Escherichia coli
  misc_feature (1)..(2): n is a, c, g, or t
  misc_feature (4)..(6): n is a, c, g, or t
  misc_feature (9)..(9): n is a, c, g, or t
  misc_feature (11)..(21): n is a, c, g, or t
  misc_feature (24)..(26): n is a, c, g, or t
  misc_feature (28)..(28): n is a, c, g, or t
  misc_feature (30)..(33): n is a, c, g, or t
  misc_feature (44)..(44): n is a, c, g, or t
  misc_feature (50)..(50): n is a, c, g, or t
  misc_feature (53)..(53): n is a, c, g, or t
  misc_feature (58)..(58): n is a, c, g, or t
  misc_feature (60)..(60): n is a, c, g, or t
  misc_feature (63)..(64): n is a, c, g, or t
  misc_feature (66)..(66): n is a, c, g, or t
  misc_feature (69)..(70): n is a, c, g, or t
  misc_feature (74)..(75): n is a, c, g, or t
  misc_feature (85)..(85): n is a, c, g, or t
  misc_feature (89)..(90): n is a, c, g, or t
  misc_feature (98)..(99): n is a, c, g, or t
  misc_feature (104)..(105): n is a, c, g, or t
  misc_feature (107)..(107): n is a, c, g, or t
  misc_feature (109)..(109): n is a, c, g, or t
  misc_feature (112)..(112): n is a, c, g, or t
  misc_feature (129)..(130): n is a, c, g, or t
  misc_feature (134)..(134): n is a, c, g, or t
  misc_feature (138)..(138): n is a, c, g, or t
  misc_feature (142)..(143): n is a, c, g, or t
  misc_feature (145)..(145): n is a, c, g, or t
  misc_feature (149)..(149): n is a, c, g, or t
  misc_feature (153)..(155): n is a, c, g, or t
  misc_feature (157)..(157): n is a, c, g, or t
  misc_feature (162)..(162): n is a, c, g, or t
  misc_feature (167)..(167): n is a, c, g, or t
  misc_feature (170)..(170): n is a, c, g, or t
  misc_feature (176)..(178): n is a, c, g, or t
  misc_feature (182)..(182): n is a, c, g, or t
  misc_feature (184)..(184): n is a, c, g, or t
  misc_feature (188)..(188): n is a, c, g, or t
  misc_feature (190)..(190): n is a, c, g, or t
  misc_feature (194)..(195): n is a, c, g, or t
  misc_feature (200)..(200): n is a, c, g, or t
  misc_feature (203)..(203): n is a, c, g, or t
  misc_feature (207)..(209): n is a, c, g, or t
  misc_feature (218)..(219): n is a, c, g, or t
  misc_feature (223)..(225): n is a, c, g, or t
  misc_feature (228)..(229): n is a, c, g, or t
  misc_feature (238)..(238): n is a, c, g, or t
  misc_feature (241)..(241): n is a, c, g, or t
  misc_feature (243)..(243): n is a, c, g, or t
  misc_feature (250)..(251): n is a, c, g, or t
  misc_feature (254)..(258): n is a, c, g, or t
  misc_feature (262)..(262): n is a, c, g, or t
  misc_feature (269)..(269): n is a, c, g, or t
  misc_feature (271)..(271): n is a, c, g, or t
  misc_feature (273)..(273): n is a, c, g, or t
  misc_feature (276)..(276): n is a, c, g, or t
  misc_feature (280)..(280): n is a, c, g, or t
  misc_feature (283)..(284): n is a, c, g, or t
  misc_feature (287)..(287): n is a, c, g, or t
  misc_feature (294)..(295): n is a, c, g, or t
  misc_feature (301)..(301): n is a, c, g, or t
  misc_feature (303)..(304): n is a, c, g, or t
  misc_feature (310)..(310): n is a, c, g, or t
  misc_feature (321)..(321): n is a, c, g, or t
  misc_feature (324)..(324): n is a, c, g, or t
  misc_feature (327)..(327): n is a, c, g, or t
  misc_feature (329)..(331): n is a, c, g, or t
  misc_feature (340)..(340): n is a, c, g, or t
  misc_feature (342)..(343): n is a, c, g, or t
  misc_feature (350)..(352): n is a, c, g, or t
  misc_feature (354)..(354): n is a, c, g, or t
  misc_feature (359)..(359): n is a, c, g, or t
  misc_feature (369)..(370): n is a, c, g, or t
  misc_feature (378)..(378): n is a, c, g, or t
  misc_feature (381)..(381): n is a, c, g, or t
  misc_feature (384)..(384): n is a, c, g, or t
  misc_feature (386)..(386): n is a, c, g, or t
  misc_feature (392)..(392): n is a, c, g, or t
  misc_feature (397)..(397): n is a, c, g, or t
  misc_feature (399)..(401): n is a, c, g, or t
  misc_feature (403)..(403): n is a, c, g, or t
  misc_feature (406)..(406): n is a, c, g, or t
  misc_feature (414)..(414): n is a, c, g, or t
  misc_feature (416)..(416): n is a, c, g, or t
  misc_feature (418)..(418): n is a, c, g, or t
  misc_feature (420)..(420): n is a, c, g, or t
  misc_feature (422)..(423): n is a, c, g, or t
  misc_feature (432)..(433): n is a, c, g, or t
  misc_feature (439)..(440): n is a, c, g, or t
  misc_feature (442)..(442): n is a, c, g, or t
  misc_feature (444)..(445): n is a, c, g, or t
  misc_feature (448)..(448): n is a, c, g, or t
  misc_feature (451)..(451): n is a, c, g, or t
  misc_feature (457)..(457): n is a, c, g, or t
  misc_feature (459)..(459): n is a, c, g, or t
  misc_feature (462)..(466): n is a, c, g, or t
  misc_feature (469)..(469): n is a, c, g, or t
  misc_feature (472)..(473): n is a, c, g, or t
  misc_feature (477)..(477): n is a, c, g, or t
  misc_feature (481)..(482): n is a, c, g, or t
  misc_feature (484)..(484): n is a, c, g, or t
  misc_feature (488)..(488): n is a, c, g, or t
  misc_feature (491)..(491): n is a, c, g, or t
  misc_feature (495)..(495): n is a, c, g, or t
  misc_feature (497)..(497): n is a, c, g, or t
  misc_feature (501)..(501): n is a, c, g, or t
  misc_feature (504)..(504): n is a, c, g, or t
  misc_feature (506)..(506): n is a, c, g, or t
  misc_feature (513)..(513): n is a, c, g, or t
  misc_feature (515)..(515): n is a, c, g, or t
  misc_feature (517)..(517): n is a, c, g, or t
  misc_feature (520)..(520): n is a, c, g, or t
  misc_feature (523)..(523): n is a, c, g, or t
  misc_feature (529)..(529): n is a, c, g, or t
  misc_feature (531)..(532): n is a, c, g, or t
  misc_feature (535)..(535): n is a, c, g, or t
  misc_feature (542)..(542): n is a, c, g, or t
  misc_feature (545)..(546): n is a, c, g, or t
  misc_feature (549)..(549): n is a, c, g, or t
  misc_feature (551)..(551): n is a, c, g, or t
  misc_feature (556)..(556): n is a, c, g, or t
  misc_feature (558)..(558): n is a, c, g, or t
  misc_feature (561)..(563): n is a, c, g, or t
  misc_feature (565)..(565): n is a, c, g, or t
  misc_feature (570)..(570): n is a, c, g, or t
  misc_feature (578)..(579): n is a, c, g, or t
  misc_feature (582)..(585): n is a, c, g, or t
  misc_feature (587)..(587): n is a, c, g, or t
  misc_feature (594)..(596): n is a, c, g, or t
  misc_feature (598)..(599): n is a, c, g, or t
  misc_feature (604)..(604): n is a, c, g, or t
  misc_feature (607)..(607): n is a, c, g, or t
  misc_feature (609)..(610): n is a, c, g, or t
  misc_feature (613)..(613): n is a, c, g, or t
  misc_feature (617)..(617): n is a, c, g, or t
  misc_feature (619)..(619): n is a, c, g, or t
  misc_feature (622)..(623): n is a, c, g, or t
  misc_feature (626)..(626): n is a, c, g, or t
  misc_feature (628)..(628): n is a, c, g, or t
  misc_feature (630)..(630): n is a, c, g, or t
  misc_feature (634)..(635): n is a, c, g, or t
  misc_feature (639)..(640): n is a, c, g, or t
  misc_feature (643)..(643): n is a, c, g, or t
  misc_feature (649)..(649): n is a, c, g, or t
  misc_feature (655)..(657): n is a, c, g, or t
  misc_feature (665)..(665): n is a, c, g, or t
  misc_feature (672)..(672): n is a, c, g, or t
  misc_feature (676)..(676): n is a, c, g, or t
  misc_feature (680)..(680): n is a, c, g, or t
  misc_feature (685)..(686): n is a, c, g, or t
  misc_feature (692)..(693): n is a, c, g, or t
  misc_feature (698)..(698): n is a, c, g, or t
  misc_feature (700)..(701): n is a, c, g, or t
  misc_feature (703)..(703): n is a, c, g, or t
  misc_feature (705)..(705): n is a, c, g, or t
  misc_feature (707)..(708): n is a, c, g, or t
  misc_feature (715)..(716): n is a, c, g, or t
  misc_feature (721)..(721): n is a, c, g, or t
  misc_feature (726)..(727): n is a, c, g, or t
  misc_feature (729)..(729): n is a, c, g, or t
  misc_feature (737)..(737): n is a, c, g, or t
  misc_feature (740)..(741): n is a, c, g, or t
  misc_feature (743)..(743): n is a, c, g, or t
  misc_feature (749)..(749): n is a, c, g, or t
  misc_feature (756)..(758): n is a, c, g, or t
  misc_feature (761)..(761): n is a, c, g, or t
  misc_feature (764)..(766): n is a, c, g, or t
  misc_feature (769)..(769): n is a, c, g, or t
  misc_feature (773)..(774): n is a, c, g, or t
  misc_feature (779)..(779): n is a, c, g, or t
  misc_feature (781)..(781): n is a, c, g, or t
  misc_feature (784)..(784): n is a, c, g, or t
  misc_feature (787)..(787): n is a, c, g, or t
  misc_feature (790)..(791): n is a, c, g, or t
  misc_feature (800)..(800): n is a, c, g, or t
  misc_feature (802)..(802): n is a, c, g, or t
  misc_feature (806)..(806): n is a, c, g, or t
  misc_feature (809)..(810): n is a, c, g, or t
  misc_feature (813)..(814): n is a, c, g, or t
  misc_feature (818)..(818): n is a, c, g, or t
  misc_feature (820)..(820): n is a, c, g, or t
  misc_feature (823)..(823): n is a, c, g, or t
  misc_feature (825)..(825): n is a, c, g, or t
  misc_feature (827)..(827): n is a, c, g, or t
  misc_feature (829)..(830): n is a, c, g, or t
  misc_feature (834)..(834): n is a, c, g, or t
  misc_feature (836)..(837): n is a, c, g, or t
  misc_feature (840)..(840): n is a, c, g, or t
  misc_feature (843)..(845): n is a, c, g, or t
  misc_feature (847)..(854): n is a, c, g, or t
  misc_feature (856)..(858): n is a, c, g, or t
  misc_feature (860)..(864): n is a, c, g, or t
  misc_feature (866)..(871): n is a, c, g, or t
  misc_feature (873)..(874): n is a, c, g, or t
  misc_feature (876)..(881): n is a, c, g, or t
  misc_feature (883)..(883): n is a, c, g, or t
  misc_feature (886)..(899): n is a, c, g, or t
  misc_feature (901)..(903): n is a, c, g, or t
  misc_feature (905)..(910): n is a, c, g, or t
  misc_feature (914)..(918): n is a, c, g, or t
  misc_feature (920)..(921): n is a, c, g, or t
  misc_feature (923)..(923): n is a, c, g, or t
  misc_feature (925)..(934): n is a, c, g, or t
  misc_feature (936)..(937): n is a, c, g, or t
  misc_feature (939)..(940): n is a, c, g, or t
  misc_feature (942)..(944): n is a, c, g, or t
  misc_feature (946)..(949): n is a, c, g, or t
  misc_feature (951)..(951): n is a, c, g, or t
  misc_feature (953)..(954): n is a, c, g, or t
  misc_feature (956)..(956): n is a, c, g, or t
  misc_feature (958)..(963): n is a, c, g, or t
  misc_feature (965)..(967): n is a, c, g, or t
  misc_feature (970)..(970): n is a, c, g, or t
  misc_feature (972)..(972): n is a, c, g, or t
  misc_feature (975)..(990): n is a, c, g, or t
  misc_feature (992)..(994): n is a, c, g, or t
  misc_feature (997)..(997): n is a, c, g, or t
  misc_feature (999)..(999): n is a, c, g, or t
  misc_feature (1001)..(1002): n is a, c, g, or t
  misc_feature (1788)..(1788): n is a, c, g, or t
  misc_feature (1989)..(1989): n is a, c, g, or t
  misc_feature (2503)..(2503): n is a, c, g, or t
  misc_feature (2736)..(2736): n is a, c, g, or t
  misc_feature (2803)..(2803): n is a, c, g, or t
  misc_feature (3184)..(3184): n is a, c, g, or t
nngnnngtnannnnnnnnnnnacnnngnannnnaaggctccgangcttcnttnccttntnaanntnctnnggannctgggaaacnggcnncccgggcnncacgnncncnccntccctcccctcttccanntctncctngtgnncntgangccnnngngggtnaagcncgnccaccnnnttcncnttgntncggnnccgcnganccgnnncatccaaannatcnnncgnntggccgccntgncngcccttnngannnnngggntatccgngnangcngaanccnnatntcccganncctttngnncctttngcgccaatggngcnaangnnntttaccccngnnccgaagnnncngacgnttttgcgggnnatgggggnatngcntnatatcnacctnannncntcnaaaaattntncnantnnttttcccannctcttnncntnnccntcnggcccntnggnnnnnttnagnntttnaagnntngaangancaancngccntgnancgttgtnancnaantgntccaangnnccngcggccnagnngtntngaaantnccnnngnccccnggccccgnnggnnnncnacgcctnnncnncaaanttngnnttntccncntgnnctngngncatnnccgnnttnaacggntccacnnnccccccantgttccnggtntccnaggcnnggaggnnaacangnngncntnnccccttnngcaantccgnngnctcggttntcnngncctcgntttcccnnnccnccnnnccngggnnaaaancntcnaanaanncatccaccncntccnccnngtnnccgntnggncngncnnttangnnaantannngnnnnnnnngnnncnnnnncnnnnnnanntnnnnnncnggnnnnnnnnnnnnnncnnnannnnnncccnnnnncnncncnnnnnnnnnncnncnntnnntnnnncnanntngnnnnnntnnnccnanacnnnnnnnnnnnnnnnngnnncangngnnccatcggaaagcccgcgttgctctcgatcgggcaacaccatcatcgtcctcaagcgagatcagaccagaacctcgctcggctgtgcaattcgatcccgttcacaagttgcgaggctcctaactctaatgtcaagcttcctcatgcggtttcgaagggttgatggtggcactcctaaaacctctgcggcacctcccttacctgctatcaatccgttagtcatctccacaacttcggaaatgtgctctctttcggcttgggccagtgtgcacacccttcccacatgcgactttgggagggatgaacttgcatcctcgggagaaattccactcagtggagggatccgaagggttgggtcccctgagattgggactgaggcttccgttcgcactggtaacactgaggtttgcccaaacgtgatacccagtcgtttcatcatggacatcaaggtggtccgtttcacccccagtcgggcggcagcaccatttcgaccacctactacaccctccgtttgttggagagtctgaaggatttgcgagcgctccgcgtcttccagcgtgacaggcgcgaatgacttcggcccgcggcggaattcgggtagcgggccattcaggacagcgccagtcgagagaatgaccgaacgctcgacgaagttcagcaattcccggacattgcccggccaggaatgccgtacaagaaccgacatgaattcttcggaaatgccctttatcggcttctgcatgcggtctgcgtaatccattgcaaaatggtggaccaacaaagggatntcttccggccgttcacgcaagggcggcagttcaacggggaaaacgctgagccgatagaagaggtcggcgcgaaactcacgatcgtcgaccatctcagcgagattgcgatgtgtggcgcagatcacgcgcacatcggtgtgaatcgtggcggcaccgccgagacgttcgaactgtctttcctggatgacgcgaagaattttnggttgcaactcgagcggaaggtcgccgatctcgtccaaaaacaaagtgccgtggttagcccgctcaaaccgtccaatactgcgcgcgaccgcgccggtgaaggcgccacgctcatgtccgaacagttcgctttcgagcaaaccggcaggaatagcggcgcagttcaccttcacaaaggggccattcgatctgtcgctgcacttgtgaatggcttcagcaatcagttccttgcctgttcctgtttccccgttgatcaagaccgtggcgttggtcggcgcaacgatccgcaccattccgaggacgcgtcggagagccgcgcttctaccgacaatgggaggcattccgctgacgcagagttcgttgttatcgaacgcaacgtctgccgacgtcgcatcctccattccaaagagcgcggtattgttgaccgcaggcacttcagttagccagcttgcttgtgtcgccattctctttactcctctcgttcgtccggtatattttcgatgtccgcatactncggccttgcttaagcgctaacttccacctcgagaccttgtgatccactcgcgtacgtatgctgggcaattcttcaatgtgatgctgtccgcttcgcagcgttcgagaaaggcgatcgcctctcgacctaccaacgttaggtcccttaggtccaagaccatacggcgtccagacgcttccgacttaattaacgcttccaggtcggctatgtctccctcgtccattcggccactnagcgtaaagaccacttccccgttcgccgacctttgaattctcagcattctatcctttcagaggacantcctaccgttgacaactgccaggccaatctaacgacttcctccgcccgacccttgttatgccgcgtggcctgccacttcccacactcgcgtggctgcttgttcacggccaaatatcagagccgcggcgcccgcgttgtggctcacgcagatacaatcgccgcggtgaatttgtccgctggccatcaggttcgacaacggttgtacaagtaggcgctcgatcgcgcgcttcaagtgccgcgcgccatacctggaatcggtgccctccaccagcaagaactccttggcggtatcggtgacattaaccaggaacgccgttttgtttgcggcagcggcctggatacgctgttgcaccatctccagttcaatatcaacgattctgngcaattcctctttaccgagcgatttgaagacgacgatgttgtccagacggttgatgaactccggcgtaaattttcgacgagctgccgcgatgccggcgcttgagatccgggcactaagtttacgcatacccgtttcatccactgaggtagcgtggaagcccagccggggactcaccagggaactcatttcagctgcgccgagattgctggtgaggaacaccatggccgctgagaaatcaactctgcgattgtcgcccaacgtcaatgttgctttgtccaggatgcccaggagaagattccacaaggcgtcggatgccttttcgatttcatcgaaaagtaggaaactcagcttgaccttctcggtgtgatgctgattcagcgcttcttgcgacaacagtgcatgcgtttcacggtgccccagatatccgggaggcgacccgatcaatttcgcgatttcatggctgtgttgaaattccgcgcaatcgattttgattactgcacgagagttctgcagtagggatttggcagtcgcctccacgatacgagtctttccggagccggttggccctaggaagagaaagtttccgatcggccgaccgaccggagacagtcccgccacgtgagtctggtaagccctcacgatctggtgaattgcttcgtcttgtccaacgatgaggtggccgagcctgttctccagatcgtctgcctgccttcccgttctggtagggtctagtaatgcgagcctgggcatttttccttctccttccggcagcggccatatcattgtctgcttgccgcgaacgctcggctctggaa

SEQ ID NO: 1182 - DNA, 4000 bp, Escherichia coli
  misc_feature (1)..(1): n is a, c, g, or t
  misc_feature (3)..(10): n is a, c, g, or t
  misc_feature (13)..(16): n is a, c, g, or t
  misc_feature (18)..(20): n is a, c, g, or t
  misc_feature (23)..(33): n is a, c, g, or t
  misc_feature (36)..(36): n is a, c, g, or t
  misc_feature (38)..(38): n is a, c, g, or t
  misc_feature (40)..(40): n is a, c, g, or t
  misc_feature (42)..(54): n is a, c, g, or t
  misc_feature (56)..(57): n is a, c, g, or t
  misc_feature (59)..(62): n is a, c, g, or t
  misc_feature (64)..(66): n is a, c, g, or t
  misc_feature (69)..(70): n is a, c, g, or t
  misc_feature (73)..(74): n is a, c, g, or t
  misc_feature (76)..(78): n is a, c, g, or t
  misc_feature (80)..(81): n is a, c, g, or t
  misc_feature (86)..(87): n is a, c, g, or t
  misc_feature (90)..(95): n is a, c, g, or t
  misc_feature (98)..(102): n is a, c, g, or t
  misc_feature (106)..(114): n is a, c, g, or t
  misc_feature (118)..(118): n is a, c, g, or t
  misc_feature (120)..(120): n is a, c, g, or t
  misc_feature (122)..(124): n is a, c, g, or t
  misc_feature (126)..(126): n is a, c, g, or t
  misc_feature (129)..(130): n is a, c, g, or t
  misc_feature (132)..(134): n is a, c, g, or t
  misc_feature (136)..(137): n is a, c, g, or t
  misc_feature (140)..(144): n is a, c, g, or t
  misc_feature (146)..(147): n is a, c, g, or t
  misc_feature (149)..(150): n is a, c, g, or t
  misc_feature (152)..(156): n is a, c, g, or t
  misc_feature (158)..(168): n is a, c, g, or t
  misc_feature (172)..(172): n is a, c, g, or t
  misc_feature (174)..(175): n is a, c, g, or t
  misc_feature (177)..(178): n is a, c, g, or t
  misc_feature (180)..(181): n is a, c, g, or t
  misc_feature (184)..(187): n is a, c, g, or t
  misc_feature (189)..(213): n is a, c, g, or t
  misc_feature (215)..(215): n is a, c, g, or t
  misc_feature (217)..(227): n is a, c, g, or t
  misc_feature (229)..(235): n is a, c, g, or t
  misc_feature (238)..(238): n is a, c, g, or t
  misc_feature (240)..(243): n is a, c, g, or t
  misc_feature (246)..(249): n is a, c, g, or t
  misc_feature (251)..(253): n is a, c, g, or t
  misc_feature (255)..(259): n is a, c, g, or t
  misc_feature (261)..(261): n is a, c, g, or t
  misc_feature (263)..(269): n is a, c, g, or t
  misc_feature (272)..(275): n is a, c, g, or t
  misc_feature (277)..(282): n is a, c, g, or t
  misc_feature (285)..(292): n is a, c, g, or t
  misc_feature (294)..(296): n is a, c, g, or t
  misc_feature (298)..(301): n is a, c, g, or t
  misc_feature (305)..(315): n is a, c, g, or t
  misc_feature (317)..(320): n is a, c, g, or t
  misc_feature (324)..(327): n is a, c, g, or t
  misc_feature (329)..(332): n is a, c, g, or t
  misc_feature (334)..(336): n is a, c, g, or t
  misc_feature (338)..(340): n is a, c, g, or t
  misc_feature (342)..(342): n is a, c, g, or t
  misc_feature (344)..(344): n is a, c, g, or t
  misc_feature (349)..(350): n is a, c, g, or t
  misc_feature (353)..(355): n is a, c, g, or t
  misc_feature (357)..(359): n is a, c, g, or t
  misc_feature (361)..(361): n is a, c, g, or t
  misc_feature (364)..(368): n is a, c, g, or t
  misc_feature (373)..(376): n is a, c, g, or t
  misc_feature (379)..(379): n is a, c, g, or t
  misc_feature (382)..(385): n is a, c, g, or t
  misc_feature (388)..(388): n is a, c, g, or t
  misc_feature (393)..(402): n is a, c, g, or t
  misc_feature (404)..(406): n is a, c, g, or t
  misc_feature (408)..(408): n is a, c, g, or t
  misc_feature (410)..(410): n is a, c, g, or t
  misc_feature (412)..(415): n is a, c, g, or t
  misc_feature (417)..(422): n is a, c, g, or t
  misc_feature (424)..(425): n is a, c, g, or t
  misc_feature (429)..(430): n is a, c, g, or t
  misc_feature (434)..(436): n is a, c, g, or t
  misc_feature (438)..(439): n is a, c, g, or t
  misc_feature (441)..(448): n is a, c, g, or t
  misc_feature (450)..(451): n is a, c, g, or t
  misc_feature (453)..(453): n is a, c, g, or t
  misc_feature (455)..(457): n is a, c, g, or t
  misc_feature (461)..(462): n is a, c, g, or t
  misc_feature (464)..(474): n is a, c, g, or t
  misc_feature (476)..(477): n is a, c, g, or t
  misc_feature (481)..(485): n is a, c, g, or t
  misc_feature (488)..(489): n is a, c, g, or t
  misc_feature (491)..(492): n is a, c, g, or t
  misc_feature (496)..(497): n is a, c, g, or t
  misc_feature (499)..(501): n is a, c, g, or t
  misc_feature (503)..(503): n is a, c, g, or t
  misc_feature (505)..(513): n is a, c, g, or t
  misc_feature (517)..(525): n is a, c, g, or t
  misc_feature (527)..(534): n is a, c, g, or t
  misc_feature (536)..(536): n is a, c, g, or t
  misc_feature (538)..(539): n is a, c, g, or t
  misc_feature (542)..(545): n is a, c, g, or t
  misc_feature (548)..(548): n is a, c, g, or t
  misc_feature (552)..(554): n is a, c, g, or t
  misc_feature (556)..(557): n is a, c, g, or t
  misc_feature (561)..(562): n is a, c, g, or t
  misc_feature (568)..(573): n is a, c, g, or t
  misc_feature (578)..(584): n is a, c, g, or t
  misc_feature (586)..(586): n is a, c, g, or t
  misc_feature (588)..(598): n is a, c, g, or t
  misc_feature (600)..(605): n is a, c, g, or t
  misc_feature (608)..(616): n is a, c, g, or t
  misc_feature (619)..(619): n is a, c, g, or t
  misc_feature (621)..(622): n is a, c, g, or t
  misc_feature (624)..(633): n is a, c, g, or t
  misc_feature (635)..(636): n is a, c, g, or t
  misc_feature (638)..(643): n is a, c, g, or t
  misc_feature (646)..(649): n is a, c, g, or t
  misc_feature (651)..(652): n is a, c, g, or t
  misc_feature (654)..(667): n is a, c, g, or t
  misc_feature (669)..(676): n is a, c, g, or t
  misc_feature (678)..(682): n is a, c, g, or t
  misc_feature (684)..(686): n is a, c, g, or t
  misc_feature (688)..(695): n is a, c, g, or t
  misc_feature (699)..(704): n is a, c, g, or t
  misc_feature (707)..(712): n is a, c, g, or t
  misc_feature (715)..(715): n is a, c, g, or t
  misc_feature (717)..(719): n is a, c, g, or t
  misc_feature (722)..(722): n is a, c, g, or t
  misc_feature (724)..(724): n is a, c, g, or t
  misc_feature (727)..(729): n is a, c, g, or t
  misc_feature (731)..(736): n is a, c, g, or t
  misc_feature (738)..(739): n is a, c, g, or t
  misc_feature (741)..(743): n is a, c, g, or t
  misc_feature (749)..(751): n is a, c, g, or t
  misc_feature (754)..(761): n is a, c, g, or t
  misc_feature (764)..(765): n is a, c, g, or t
  misc_feature (767)..(767): n is a, c, g, or t
  misc_feature (769)..(770): n is a, c, g, or t
  misc_feature (772)..(775): n is a, c, g, or t
  misc_feature (1389)..(1389): n is a, c, g, or t
  misc_feature (1392)..(1392): n is a, c, g, or t
  misc_feature (1977)..(1977): n is a, c, g, or t
  misc_feature (2010)..(2010): n is a, c, g, or t
  misc_feature (2127)..(2127): n is a, c, g, or t
  misc_feature (2394)..(2394): n is a, c, g, or t
  misc_feature (2550)..(2550): n is a, c, g, or t
  misc_feature (2898)..(2898): n is a, c, g, or t
  misc_feature (2907)..(2907): n is a, c, g, or t
  misc_feature (2910)..(2910): n is a, c, g, or t
  misc_feature (2913)..(2913): n is a, c, g, or t
  misc_feature (3024)..(3024): n is a, c, g, or t
ntnnnnnnnnttnnnnannnaannnnnnnnnnnccntngntnnnnnnnnnnnnnannannnncnnnccnnggnntnnngnnggggnnttnnnnnnaannnnntttnnnnnnnnnaaangnannnanttnngnnntnnaannnnngnntnntnnnnnannnnnnnnnnnaaancnngnngnnttnnnnannnnnnnnnnnnnnnnnnnnnnnnngnannnnnnnnnnntnnnnnnnttncnnnnccnnnntnnncnnnnnangnnnnnnnttnnnnannnnnnaannnnnnnnannntnnnnaaannnnnnnnnnnannnngggnnnngnnnntnnntnnngnanaaaannttnnngnnnanggnnnnnttttnnnnttnaannnnttnaaaannnnnnnnnnannntncntnnnngnnnnnntnntttnnaaannnanntnnnnnnnnanncnannnaaanngnnnnnnnnnnnanngggnnnnnggnngnntttnncnnncnannnnnnnnntttnnnnnnnnncnnnnnnnngnannaannnnccntttnnnanntttnnaaaaannnnnnaaaannnnnnnangnnnnnnnnnnngnnnnnnaannnnnnnnnggngnngnnnnnnnnnnannannnnnnggnnnngnngnnnnnnnnnnnnnnannnnnnnnannnnntnnnannnnnnnntttnnnnnnaannnnnnaancnnnttnanaannntnnnnnncnnannnaaaaannnttnnnnnnnnaanngntnnannnntttttttcataaattttgaataactttttgtcagttttagaaaaagttgtaattttgcaaatcaaataatttaatataaagcaataaaatgcctactattcaacaattagtaagaaaaggaagagccacaattgccaagaagagcaaatcggttgctttggattcttgtccacagaagagaggtgtatgtacgagagtatatacaactacacctaagaaacctaactctgcacttagaaaagttgccagagtaagactttctaatggtaaagaagttaacgcttatatcccgggcgaaggacataatctccaagagcactcgatagtattggtaagaggcggaagggtgaaagacctaccgggagttcgttatcacattgtaagaggtgctttggacactgcaggtgtaaatggaagaacacaaagaagatctaagtatggagctaagagacctaaaccaggtgcagcaccagcagggaaaaagtaatcattaaattttaaggaaagaaacaatgagaaagacaaaagcaaaaaaaagaccgttgttaccagatcctaaatttaatgatcaattggtaacaagatttgtgaataacttgatgatagatggtaanaantctatcgcatttagaattttctatgatgcactagatatcgtagaaactaaaaaagaagatcaggaaaaaacttctcttgaagtatggaaagatgcgcttactaatgtaatgccgcatgtagaagtaagatcaagaagagtaggaggtgctaacttccaaattcctatgccgatcagagctgatagaaaaatttctatggctatgaaatggttgatcaaatatgcttctttgagaaacgataaatctatggcacaaaaattagctgctgagattatcgctgcttctaaagaagaaggagctgctgttaagaaaaagacagatactcacaaaatggcagaagcaaacaaagcattctcacactttaaattctaatctgaaatgggaagagatcttagatatacaagaaatattggtattgctgcacacatcgatgcagggaaaactaccactacagagagaattttattttacactggtaaaactcacaagttgggtgaaactcaccaaggtacatctcagatggactggatggagcaagaggctgaaagagggattacaattacctctgcggctactacttgtaantggaatttcccaactgatcaaggaaaagttttnccagaaactaaaggataccactttaacatcatcgataccccaggacacgttgactttactgtagaggtaaaccgttctttgagagtattggatggtctagtgttcttgttctcagcngttgacggagtagagccacaatcagaaactaactggagattggctgacaactacaaagttgcgagaatgggattcgtaaacaaaatggacagacaaggagctgatttcttggcggtttgccgtcaggtaaaagaaatgctaggttctaacgctgttcctatcgtattaccaatcggagctgaagaagacttcaaaggagtggtagaccttatcaagaacagagctattgtttggcacgaagatactcaaggtatgacatttgatgtngttccaattccagaagatatgaaagctgatgtattggaatacagacaaaaccttgtggaaaatgtggcagaatatgatgagtctttattagagaaattctttgaagatccagattctatcacagaagaagaaatcaatgaagctttaagaaaagcnactattgatttgtctattatcccaatgacttgtggttcttcatttaagaacaaaggagttcagtttatgttggatgctgtatgtaaataccttccatctccactagataaagatgatatcaaaggaactgaccctaaaactgatgctgaaatcacaagaaaaccagatgtaaatgagccatttgctgcattagcatttaagattgctactgacccttatgtaggtagattggcattctttagagcttattctggtaaattggatgcaggttcttatgtattgaacacaagatctgattctaaagaaagaatctcaagaatctatcagatgcacgcgaataagcaaaancctgtagantanatngaagcaggagatatcggtgcagctgtaggatttaaagatatcaaaactggggatacactttgtgatgaaaagaaccctatcgttcttgaatctatgattttcccagatccngtaatcggtatcgctgttgaacctaaaactaaagctgaccaagataaaatgggtaacgctttagcgaagttagcagaagaggatcctactttccaagtgaaaacagatgaagcatctggacaaactatcatctcaggaatgggagagcttcacttggatatcatcgtagaccgtctaagaagagagttcaaggtagaagtaaaccaaggacagccgcaagtagagtacaaagaatctcttacagctacagctaaccacagagaagtttacaaaaaacaaactgggggtagaggtaaattcgcggatatcatcttcgaaattggtcctgctgatgaaggaaaaacaggtcttgaattcatcaacgaaattaaaggtggtaacattccaaaagaatttatcccttctgttgaaaaaggattcaaagaagctatgaaaaatggtcctttggctggattcgagattgaaggaattaaagttacactaaaagatggttctttccacccagtggactctgaccaactttcattcgaattggctgctaaacttggatttagagaagctggtaaagctgctaaaccagtaatcatggagcctatcatgaaattggaagttgttactccagaagaatacatgggggatatcgtaggtgaccttaacagaagaagaggtactgtaaacggtatggatgatagaaataatgctaaagttatcaaagcatttgttccattagcagaaatgtttggatatgtaacagctcttagaacattatcttctggtagagcaacatcttctatggagtttgaaaaatatgaaccagctccacagaatgtggctgaagaagtaatagctaaagcaagaggttaattaaaatttagattaaaatgtcacaaagaatcagaataaaattaaaatcttacgattacaatttagtagataaatctgctgagaaaatcgtaaaaacagtaaaatctacagg

SEQ ID NO: 1183 - DNA, 4000 bp, Escherichia coli
  misc_feature (1)..(1): n is a, c, g, or t
  misc_feature (3)..(11): n is a, c, g, or t
  misc_feature (13)..(14): n is a, c, g, or t
  misc_feature (16)..(22): n is a, c, g, or t
  misc_feature (25)..(33): n is a, c, g, or t
  misc_feature (35)..(35): n is a, c, g, or t
  misc_feature (38)..(38): n is a, c, g, or t
  misc_feature (44)..(44): n is a, c, g, or t
  misc_feature (46)..(47): n is a, c, g, or t
  misc_feature (50)..(53): n is a, c, g, or t
  misc_feature (56)..(65): n is a, c, g, or t
  misc_feature (68)..(75): n is a, c, g, or t
  misc_feature (77)..(79): n is a, c, g, or t
  misc_feature (81)..(89): n is a, c, g, or t
  misc_feature (91)..(91): n is a, c, g, or t
  misc_feature (93)..(94): n is a, c, g, or t
  misc_feature (96)..(96): n is a, c, g, or t
  misc_feature (98)..(100): n is a, c, g, or t
  misc_feature (102)..(108): n is a, c, g, or t
  misc_feature (110)..(111): n is a, c, g, or t
  misc_feature (113)..(113): n is a, c, g, or t
  misc_feature (115)..(132): n is a, c, g, or t
  misc_feature (134)..(143): n is a, c, g, or t
  misc_feature (145)..(150): n is a, c, g, or t
  misc_feature (152)..(170): n is a, c, g, or t
  misc_feature (173)..(174): n is a, c, g, or t
  misc_feature (176)..(181): n is a, c, g, or t
  misc_feature (184)..(185): n is a, c, g, or t
  misc_feature (187)..(189): n is a, c, g, or t
  misc_feature (192)..(195): n is a, c, g, or t
  misc_feature (197)..(197): n is a, c, g, or t
  misc_feature (199)..(202): n is a, c, g, or t
  misc_feature (205)..(205): n is a, c, g, or t
  misc_feature (207)..(208): n is a, c, g, or t
  misc_feature (210)..(212): n is a, c, g, or t
  misc_feature (216)..(217): n is a, c, g, or t
  misc_feature (224)..(224): n is a, c, g, or t
  misc_feature (229)..(230): n is a, c, g, or t
  misc_feature (233)..(233): n is a, c, g, or t
  misc_feature (235)..(235): n is a, c, g, or t
  misc_feature (238)..(242): n is a, c, g, or t
  misc_feature (244)..(244): n is a, c, g, or t
  misc_feature (247)..(247): n is a, c, g, or t
  misc_feature (315)..(315): n is a, c, g, or t
  misc_feature (1988)..(1988): n is a, c, g, or t
  misc_feature (3036)..(3042): n is a, c, g, or t
  misc_feature (3044)..(3045): n is a, c, g, or t
  misc_feature (3048)..(3050): n is a, c, g, or t
  misc_feature (3053)..(3056): n is a, c, g, or t
  misc_feature (3058)..(3058): n is a, c, g, or t
  misc_feature (3060)..(3065): n is a, c, g, or t
  misc_feature (3067)..(3079): n is a, c, g, or t
  misc_feature (3081)..(3083): n is a, c, g, or t
  misc_feature (3090)..(3091): n is a, c, g, or t
  misc_feature (3095)..(3096): n is a, c, g, or t
  misc_feature (3098)..(3102): n is a, c, g, or t
  misc_feature (3106)..(3112): n is a, c, g, or t
  misc_feature (3114)..(3116): n is a, c, g, or t
  misc_feature (3119)..(3120): n is a, c, g, or t
  misc_feature (3123)..(3124): n is a, c, g, or t
  misc_feature (3126)..(3128): n is a, c, g, or t
  misc_feature (3130)..(3132): n is a, c, g, or t
  misc_feature (3136)..(3136): n is a, c, g, or t
  misc_feature (3138)..(3139): n is a, c, g, or t
  misc_feature (3142)..(3142): n is a, c, g, or t
  misc_feature (3144)..(3144): n is a, c, g, or t
  misc_feature (3146)..(3151): n is a, c, g, or t
  misc_feature (3153)..(3156): n is a, c, g, or t
  misc_feature (3158)..(3166): n is a, c, g, or t
  misc_feature (3169)..(3171): n is a, c, g, or t
  misc_feature (3173)..(3174): n is a, c, g, or t
  misc_feature (3176)..(3183): n is a, c, g, or t
  misc_feature (3185)..(3186): n is a, c, g, or t
  misc_feature (3188)..(3191): n is a, c, g, or t
  misc_feature (3194)..(3204): n is a, c, g, or t
  misc_feature (3206)..(3208): n is a, c, g, or t
  misc_feature (3210)..(3219): n is a, c, g, or t
  misc_feature (3221)..(3223): n is a, c, g, or t
  misc_feature (3225)..(3227): n is a, c, g, or t
  misc_feature (3229)..(3234): n is a, c, g, or t
  misc_feature (3236)..(3238): n is a, c, g, or t
  misc_feature (3241)..(3242): n is a, c, g, or t
  misc_feature (3246)..(3247): n is a, c, g, or t
  misc_feature (3249)..(3251): n is a, c, g, or t
  misc_feature (3254)..(3257): n is a, c, g, or t
  misc_feature (3259)..(3260): n is a, c, g, or t
  misc_feature (3263)..(3263): n is a, c, g, or t
  misc_feature (3267)..(3267): n is a, c, g, or t
  misc_feature (3270)..(3275): n is a, c, g, or t
  misc_feature (3277)..(3283): n is a, c, g, or t
  misc_feature (3286)..(3294): n is a, c, g, or t
  misc_feature (3296)..(3300): n is a, c, g, or t
  misc_feature (3302)..(3312): n is a, c, g, or t
  misc_feature (3314)..(3326): n is a, c, g, or t
  misc_feature (3328)..(3328): n is a, c, g, or t
  misc_feature (3330)..(3330): n is a, c, g, or t
  misc_feature (3332)..(3348): n is a, c, g, or t
  misc_feature (3350)..(3361): n is a, c, g, or t
  misc_feature (3364)..(3367): n is a, c, g, or t
  misc_feature (3369)..(3377): n is a, c, g, or t
  misc_feature (3379)..(3382): n is a, c, g, or t
  misc_feature (3385)..(3397): n is a, c, g, or t
  misc_feature (3399)..(3407): n is a, c, g, or t
  misc_feature (3409)..(3410): n is a, c, g, or t
  misc_feature (3413)..(3415): n is a, c, g, or t
  misc_feature (3418)..(3418): n is a, c, g, or t
  misc_feature (3420)..(3420): n is a, c, g, or t
  misc_feature (3422)..(3423): n is a, c, g, or t
  misc_feature (3427)..(3430): n is a, c, g, or t
  misc_feature (3433)..(3433): n is a, c, g, or t
  misc_feature (3437)..(3439): n is a, c, g, or t
  misc_feature (3441)..(3442): n is a, c, g, or t
  misc_feature (3445)..(3446): n is a, c, g, or t
  misc_feature (3448)..(3455): n is a, c, g, or t
  misc_feature (3458)..(3458): n is a, c, g, or t
  misc_feature (3461)..(3468): n is a, c, g, or t
  misc_feature (3470)..(3472): n is a, c, g, or t
  misc_feature (3474)..(3479): n is a, c, g, or t
  misc_feature (3481)..(3483): n is a, c, g, or t
  misc_feature (3485)..(3487): n is a, c, g, or t
  misc_feature (3490)..(3490): n is a, c, g, or t
  misc_feature (3493)..(3496): n is a, c, g, or t
  misc_feature (3499)..(3499): n is a, c, g, or t
  misc_feature (3501)..(3503): n is a, c, g, or t
  misc_feature (3505)..(3512): n is a, c, g, or t
  misc_feature (3514)..(3514): n is a, c, g, or t
  misc_feature (3516)..(3521): n is a, c, g, or t
  misc_feature (3523)..(3531): n is a, c, g, or t
  misc_feature (3533)..(3539): n is a, c, g, or t
  misc_feature (3541)..(3543): n is a, c, g, or t
  misc_feature (3545)..(3546): n is a, c, g, or t
  misc_feature (3548)..(3548): n is a, c, g, or t
  misc_feature (3550)..(3554): n is a, c, g, or t
  misc_feature (3556)..(3556): n is a, c, g, or t
  misc_feature (3559)..(3562): n is a, c, g, or t
  misc_feature (3564)..(3565): n is a, c, g, or t
  misc_feature (3567)..(3568): n is a, c, g, or t
  misc_feature (3571)..(3581): n is a, c, g, or t
  misc_feature (3583)..(3584): n is a, c, g, or t
  misc_feature (3586)..(3587): n is a, c, g, or t
  misc_feature (3589)..(3589): n is a, c, g, or t
  misc_feature (3591)..(3592): n is a, c, g, or t
  misc_feature (3594)..(3596): n is a, c, g, or t
  misc_feature (3598)..(3598): n is a, c, g, or t
  misc_feature (3600)..(3601): n is a, c, g, or t
  misc_feature (3604)..(3605): n is a, c, g, or t
  misc_feature (3608)..(3608): n is a, c, g, or t
  misc_feature (3611)..(3611): n is a, c, g, or t
  misc_feature (3613)..(3613): n is a, c, g, or t
  misc_feature (3615)..(3615): n is a, c, g, or t
  misc_feature (3618)..(3618): n is a, c, g, or t
  misc_feature (3620)..(3626): n is a, c, g, or t
  misc_feature (3628)..(3629): n is a, c, g, or t
  misc_feature (3633)..(3633): n is a, c, g, or t
  misc_feature (3635)..(3637): n is a, c, g, or t
  misc_feature (3639)..(3639): n is a, c, g, or t
  misc_feature (3641)..(3641): n is a, c, g, or t
  misc_feature (3643)..(3643): n is a, c, g, or t
  misc_feature (3645)..(3648): n is a, c, g, or t
  misc_feature (3651)..(3654): n is a, c, g, or t
  misc_feature (3657)..(3657): n is a, c, g, or t
  misc_feature (3659)..(3661): n is a, c, g, or t
  misc_feature (3663)..(3665): n is a, c, g, or t
  misc_feature (3668)..(3674): n is a, c, g, or t
  misc_feature (3676)..(3687): n is a, c, g, or t
  misc_feature (3689)..(3690): n is a, c, g, or t
  misc_feature (3693)..(3695): n is a, c, g, or t
  misc_feature (3698)..(3700): n is a, c, g, or t
  misc_feature (3703)..(3705): n is a, c, g, or t
  misc_feature (3707)..(3708): n is a, c, g, or t
  misc_feature (3712)..(3712): n is a, c, g, or t
  misc_feature (3714)..(3718): n is a, c, g, or t
  misc_feature (3720)..(3722): n is a, c, g, or t
  misc_feature (3725)..(3729): n is a, c, g, or t
  misc_feature (3732)..(3732): n is a, c, g, or t
  misc_feature (3734)..(3734): n is a, c, g, or t
  misc_feature (3736)..(3738): n is a, c, g, or t
  misc_feature (3740)..(3745): n is a, c, g, or t
  misc_feature (3747)..(3749): n is a, c, g, or t
  misc_feature (3751)..(3752): n is a, c, g, or t
  misc_feature (3755)..(3755): n is a, c, g, or t
  misc_feature (3758)..(3758): n is a, c, g, or t
  misc_feature (3761)..(3761): n is a, c, g, or t
  misc_feature (3763)..(3763): n is a, c, g, or t
  misc_feature (3767)..(3769): n is a, c, g, or t
  misc_feature (3772)..(3772): n is a, c, g, or t
  misc_feature (3776)..(3778): n is a, c, g, or t
  misc_feature (3780)..(3781): n is a, c, g, or t
  misc_feature (3784)..(3784): n is a, c, g, or t
  misc_feature (3786)..(3786): n is a, c, g, or t
  misc_feature (3790)..(3791): n is a, c, g, or t
  misc_feature (3794)..(3795): n is a, c, g, or t
  misc_feature (3797)..(3797): n is a, c, g, or t
  misc_feature (3802)..(3802): n is a, c, g, or t
  misc_feature (3806)..(3806): n is a, c, g, or t
  misc_feature (3808)..(3810): n is a, c, g, or t
  misc_feature (3812)..(3812): n is a, c, g, or t
  misc_feature (3814)..(3817): n is a, c, g, or t
  misc_feature (3819)..(3819): n is a, c, g, or t
  misc_feature (3821)..(3821): n is a, c, g, or t
  misc_feature (3829)..(3830): n is a, c, g, or t
  misc_feature (3833)..(3834): n is a, c, g, or t
  misc_feature (3836)..(3836): n is a, c, g, or t
  misc_feature (3840)..(3840): n is a, c, g, or t
  misc_feature (3842)..(3842): n is a, c, g, or t
  misc_feature (3845)..(3845): n is a, c, g, or t
  misc_feature (3848)..(3848): n is a, c, g, or t
  misc_feature (3854)..(3855): n is a, c, g, or t
  misc_feature (3858)..(3859): n is a, c, g, or t
  misc_feature (3861)..(3862): n is a, c, g, or t
  misc_feature (3864)..(3864): n is a, c, g, or t
  misc_feature (3868)..(3868): n is a, c, g, or t
  misc_feature (3870)..(3871): n is a, c, g, or t
  misc_feature (3874)..(3874): n is a, c, g, or t
  misc_feature (3877)..(3877): n is a, c, g, or t
  misc_feature (3880)..(3881): n is a, c, g, or t
  misc_feature (3884)..(3885): n is a, c, g, or t
  misc_feature (3887)..(3887): n is a, c, g, or t
  misc_feature (3889)..(3889): n is a, c, g, or t
  misc_feature (3892)..(3892): n is a, c, g, or t
  misc_feature (3895)..(3898): n is a, c, g, or t
  misc_feature (3900)..(3901): n is a, c, g, or t
  misc_feature (3904)..(3906): n is a, c, g, or t
  misc_feature (3909)..(3909): n is a, c, g, or t
  misc_feature (3911)..(3911): n is a, c, g, or t
  misc_feature (3913)..(3913): n is a, c, g, or t
  misc_feature (3916)..(3917): n is a, c, g, or t
  misc_feature (3919)..(3921): n is a, c, g, or t
  misc_feature (3924)..(3925): n is a, c, g, or t
  misc_feature (3928)..(3928): n is a, c, g, or t
  misc_feature (3933)..(3933): n is a, c, g, or t
  misc_feature (3936)..(3937): n is a, c, g, or t
  misc_feature (3943)..(3946): n is a, c, g, or t
  misc_feature (3949)..(3949): n is a, c, g, or t
  misc_feature (3952)..(3953): n is a, c, g, or t
  misc_feature (3957)..(3957): n is a, c, g, or t
  misc_feature (3962)..(3962): n is a, c, g, or t
  misc_feature (3965)..(3965): n is a, c, g, or t
  misc_feature (3967)..(3967): n is a, c, g, or t
  misc_feature (3969)..(3969): n is a, c, g, or t
  misc_feature (3972)..(3973): n is a, c, g, or t
  misc_feature (3978)..(3978): n is a, c, g, or t
  misc_feature (3983)..(3985): n is a, c, g, or t
  misc_feature (3991)..(3991): n is a, c, g, or t
  misc_feature (3993)..(3994): n is a, c, g, or t
  misc_feature (3997)..(3997): n is a, c, g, or t
  misc_feature (3999)..(4000): n is a, c, g, or t
ntnnnnnnnnntnncnnnnnnnctnnnnnnnnngngcncccgcncnnttnnnnctnnnnnnnnnnccnnnnnnnncnnntnnnnnnnnncncnntncnnncnnnnnnntnncncnnnnnnnnnnnnnnnnnncnnnnnnnnnncnnnnnncnnnnnnnnnnnnnnnnnnntgnntnnnnnnctnncnnngcnnnncncnnnngcnanntnnnctanntcgcttnccccnnacncnccnnnnncncantcgcgacgtgttctatgtcgcttttcccaaaagctccattcgacctgtcggtttgcccgtctatgtcnctcaactcccgtcggctccattcgcggaaattgcgaatgatctgaagcggtcacaagtctaaagcgactgcattccgtttcggtagagtattcggtaacatccgggtcgcatacgagtctagccgcggcagaggctaatgactttgaatcacacgcttgagttcgagtcagatgcctaatgagctgcctgatccggagattctactttgttgctcgcacctgtgcggcgtgaaacgcctgccaggcattccaagcgcgttcccaattttgtttcttggcccaacattgtgcttctaagaaataaaaataggccggggagttcggccgttcgctaaaatgacgtgcggtgagaagggcatcatcgacccgaccactctgcatctgtgcgcgataaagttcgtaaccgatgccgtagttattaggcgcggcggcgaagcggttttccagatcttgaagagaaaaattagcggcgactcgcggaagcgccaccggttcgccgtattgctgggtgagctcgtaggcggcgcgaaaatcattcctgctggcattgtgtttcgccatgccaagccaggcataacgaagccagtcgggatgctgttcaacggccagggaaagctccccggggttgccgcgttcggaccaaaccgcgaagagcgcaagtttttctgtttcgctgaacgattgcaagttaggatcatttttcagcagttgcgcgagagcgcgattgaaagaagcgtccgacagccggtcgagatagggcagcgccaaatcgtgttcgctaagtccaatcgcctccagaaatgggcttacttctggactgctgagcgaagcgtcgctcagcatgcttgcgtagacttccggtcgcagaggtccggctctgcgtagagcctcacgccacgctgtcacggctaaaatcggacggtacggcaaccaggcgtttccttcggtcagcggaacttcatacgcgatcggctgcagaaagcgcgccctgcggaaatcatcgactgcgtttgtcgtctgtttgagttcggcctccgcgatagcacgcgtaaggtaaagttcccaatcgagcggcgcccatcgaagcgtgcgagtcgtcagtacagttgtttcactaaaattgagttcggtgttagctaccgctgatagttgcttcgcgatggagaccccaactgagccgggaaggagtttctcactgggtacagcgacaaccaatgtcagtcccgccgcaagtaacacccccccaacaaagcgaaatagaatcggcatccactcacttgttttcaaagggagcggccgatgcagtgagagcccaagcaaaagtattgcggcaaacgccgtacccacctggtgccctgaaatatcgacaatcccatggattgcgaacaggagcgccgcgatgagcgtggcgagacgatacccttggttggttcccactcgcagtgggaaaactcgactaacaaacatcgcgataccaacgatcgtgagcaccagcgctggccacccgagttcagcccaaagccaaagccagtcgctttccggatgcaaggctcgcgggccgccgagtgaatcgtcgcaaaaaattgcaaagatcgattccaaatttccaaaaccgatgccgcaccagggcgaattacgaatgagtcgaaacgcgtcatgaaaaattcgccacnaaaaatccgttgagatgccggtactgccgaaatcgccaagatgaaatccctcgactgttcgccaaccgaaaagcaacagggccgtgagcagcagaaggagaaaagagattccaagcgctagtcgccagggagagcgttgtcggaacaccaacgcgccaagccaaaatgcgctgcctaccacgagaatcgcgattccagagggcgaagaattcaaaatgatcgctgccccgatcaggagcagcgcgaggatccagacgatccaccgttttcttcgcttgcggagatcgtcctgagcgcaggcaagaatcacgatcgcggtaaccccgaaaagatctccggtttgattccgatttggaaatggaccgaaattttgctcgttgtgccagaccgggagcgtggtgcgtgccaagtaaagcgcgatgcagattgcggctaagagcgcaattccactggtaaacaagcgcagttgaaagcgcacctcgtgaagctcaaggtcttgcgtggagacgatatagagccaactcagtccagcaacgaagctaacgagatagctcagcgtgatccatggctgcggagtgagcgtcgatggaagctgaattccgaagtcatttacaagtgccgcacgccactctggttggaaaaaccagcgggctgggagaaacgcgactgccgccgagataaagagagtgagaagaacgaggttcgtgagcgcgccgagcgaaaaccgtggcggttgaatcagcaggtacgtcccgagaactgtgatgacaagtccctcttcccatttttgattggcgccgcccaggaaacaggcgagcacgggcagcaacgcgacggtcccgttggctatccaacgagtggtagccgactgttggttttcacgcgattgaaattgctgcacggaatttcgcatcagctaaagtcaactgtgatggtatgcgaatcgcttttcgattcgataaccacgctgcccaactaacgtatcatctttatcactgctcgcagagaatctgactttgaatcaaatagggggaatagggaatagggnnnnnnnannaannnttnnnngntnnnnnncnnnnnnnnnnnnngnnnggggaanngggnngnnnnngaannnnnnnannnttnncgnncnnngnnnttancnnttnancnnnnnngnnnngnnnnnnnnnaannntnnannnnnnnngnnannnnaannnnnnnnnnnannntnnnnnnnnnntnnncnnnannnnnngnnnaannaaanngnnnaannnntnngantaanaannnnnnannnnnnntcnnnnnnnnngnnnnngnnnnnnnnnnncnnnnnnnnnnnnntntnannnnnnnnnnnnnnnnncnnnnnnnnnnnnccnnnncnnnnnnnnngnnnnttnnnnnnnnnnnnngnnnnnnnnntnnaannnttncnannaagnnnnggntttnnngnnggnngnnnnnnnnggnccnnnnnnnngnnngnnnnnncnnncnnnccnaannnnccngnnntnnnnnnnngngnnnnnngnnnnnnnnngnnnnnnntnnnannangnnnnnanaannnntnnannccnnnnnnnnnnncnngnncngnngnnngngnnttnnggnccnanancgnannnnnnntnnaagncnnncnanangnnnnggnnnntcncnnngnnnggnnnnnnngnnnnnnnnnnnngnnggnnnccnnnggnnncnngggngnnnnncnnnccnnnnnttncngnnntnnnnnngnnngnnttnggnggncncgcnnnggncgcnnncnnccncnttgnntcnnancagcncccncnnngntnnnncncncaccctcnnggnntnaccngncangtngctcannccnntnncnccantnnccnaangcnncanngngncangannnnannggnnncangntntgnngnnntgnngtnatccnaannttcttnnnnctncgnncggngccanttngnanaanntccangaaannncccacncnnttncnn

SEQ ID NO: 1184 - DNA, 4000 bp, Escherichia coli
  misc_feature (1)..(8): n is a, c, g, or t
  misc_feature (10)..(11): n is a, c, g, or t
  misc_feature (14)..(14): n is a, c, g, or t
  misc_feature (18)..(22): n is a, c, g, or t
  misc_feature (24)..(36): n is a, c, g, or t
  misc_feature (38)..(43): n is a, c, g, or t
  misc_feature (45)..(48): n is a, c, g, or t
  misc_feature (50)..(54): n is a, c, g, or t
  misc_feature (56)..(56): n is a, c, g, or t
  misc_feature (58)..(59): n is a, c, g, or t
  misc_feature (61)..(76): n is a, c, g, or t
  misc_feature (78)..(88): n is a, c, g, or t
  misc_feature (92)..(106): n is a, c, g, or t
  misc_feature (108)..(108): n is a, c, g, or t
  misc_feature (111)..(123): n is a, c, g, or t
  misc_feature (125)..(128): n is a, c, g, or t
  misc_feature (130)..(134): n is a, c, g, or t
  misc_feature (136)..(138): n is a, c, g, or t
  misc_feature (140)..(144): n is a, c, g, or t
  misc_feature (147)..(149): n is a, c, g, or t
  misc_feature (152)..(152): n is a, c, g, or t
  misc_feature (154)..(164): n is a, c, g, or t
  misc_feature (166)..(170): n is a, c, g, or t
  misc_feature (172)..(183): n is a, c, g, or t
  misc_feature (187)..(191): n is a, c, g, or t
  misc_feature (193)..(197): n is a, c, g, or t
  misc_feature (199)..(201): n is a, c, g, or t
  misc_feature (203)..(208): n is a, c, g, or t
  misc_feature (212)..(220): n is a, c, g, or t
  misc_feature (222)..(222): n is a, c, g, or t
  misc_feature (226)..(226): n is a, c, g, or t
  misc_feature (228)..(230): n is a, c, g, or t
  misc_feature (232)..(234): n is a, c, g, or t
  misc_feature (236)..(238): n is a, c, g, or t
  misc_feature (240)..(240): n is a, c, g, or t
  misc_feature (242)..(247): n is a, c, g, or t
  misc_feature (249)..(255): n is a, c, g, or t
  misc_feature (257)..(261): n is a, c, g, or t
  misc_feature (263)..(279): n is a, c, g, or t
  misc_feature (281)..(288): n is a, c, g, or t
  misc_feature (290)..(298): n is a, c, g, or t
  misc_feature (300)..(305): n is a, c, g, or t
  misc_feature (307)..(311): n is a, c, g, or t
  misc_feature (313)..(324): n is a, c, g, or t
  misc_feature (326)..(331): n is a, c, g, or t
  misc_feature (333)..(334): n is a, c, g, or t
  misc_feature (336)..(339): n is a, c, g, or t
  misc_feature (342)..(346): n is a, c, g, or t
  misc_feature (348)..(363): n is a, c, g, or t
  misc_feature (365)..(384): n is a, c, g, or t
  misc_feature (386)..(394): n is a, c, g, or t
  misc_feature (397)..(406): n is a, c, g, or t
  misc_feature (408)..(426): n is a, c, g, or t
  misc_feature (428)..(431): n is a, c, g, or t
  misc_feature (433)..(440): n is a, c, g, or t
  misc_feature (443)..(447): n is a, c, g, or t
  misc_feature (449)..(450): n is a, c, g, or t
  misc_feature (452)..(458): n is a, c, g, or t
  misc_feature (460)..(460): n is a, c, g, or t
  misc_feature (462)..(473): n is a, c, g, or t
  misc_feature (477)..(489): n is a, c, g, or t
  misc_feature (491)..(494): n is a, c, g, or t
  misc_feature (497)..(497): n is a, c, g, or t
  misc_feature (499)..(503): n is a, c, g, or t
  misc_feature (505)..(510): n is a, c, g, or t
  misc_feature (513)..(528): n is a, c, g, or t
  misc_feature (530)..(534): n is a, c, g, or t
  misc_feature (536)..(541): n is a, c, g, or t
  misc_feature (544)..(546): n is a, c, g, or t
  misc_feature (548)..(554): n is a, c, g, or t
  misc_feature (557)..(563): n is a, c, g, or t
  misc_feature (565)..(577): n is a, c, g, or t
  misc_feature (579)..(581): n is a, c, g, or t
  misc_feature (583)..(584): n is a, c, g, or t
  misc_feature (586)..(588): n is a, c, g, or t
  misc_feature (590)..(590): n is a, c, g, or t
  misc_feature (592)..(602): n is a, c, g, or t
  misc_feature (604)..(606): n is a, c, g, or t
  misc_feature (608)..(611): n is a, c, g, or t
  misc_feature (613)..(618): n is a, c, g, or t
  misc_feature (620)..(620): n is a, c, g, or t
  misc_feature (622)..(623): n is a, c, g, or t
  misc_feature (625)..(627): n is a, c, g, or t
  misc_feature (630)..(630): n is a, c, g, or t
  misc_feature (632)..(634): n is a, c, g, or t
  misc_feature (636)..(643): n is a, c, g, or t
  misc_feature (645)..(645): n is a, c, g, or t
  misc_feature (647)..(652): n is a, c, g, or t
  misc_feature (654)..(656): n is a, c, g, or t
  misc_feature (658)..(666): n is a, c, g, or t
  misc_feature (668)..(677): n is a, c, g, or t
  misc_feature (679)..(686): n is a, c, g, or t
  misc_feature (688)..(688): n is a, c, g, or t
  misc_feature (690)..(699): n is a, c, g, or t
  misc_feature (701)..(703): n is a, c, g, or t
  misc_feature (705)..(706): n is a, c, g, or t
  misc_feature (708)..(718): n is a, c, g, or t
  misc_feature (720)..(725): n is a, c, g, or t
  misc_feature (727)..(736): n is a, c, g, or t
  misc_feature (738)..(744): n is a, c, g, or t
  misc_feature (747)..(747): n is a, c, g, or t
  misc_feature (749)..(750): n is a, c, g, or t
  misc_feature (752)..(760): n is a, c, g, or t
  misc_feature (762)..(764): n is a, c, g, or t
  misc_feature (766)..(774): n is a, c, g, or t
  misc_feature (776)..(780): n is a, c, g, or t
  misc_feature (782)..(784): n is a, c, g, or t
  misc_feature (787)..(799): n is a, c, g, or t
  misc_feature (802)..(810): n is a, c, g, or t
  misc_feature (812)..(816): n is a, c, g, or t
  misc_feature (818)..(818): n is a, c, g, or t
  misc_feature (821)..(827): n is a, c, g, or t
  misc_feature (831)..(834): n is a, c, g, or t
  misc_feature (836)..(839): n is a, c, g, or t
  misc_feature (841)..(851): n is a, c, g, or t
  misc_feature (853)..(854): n is a, c, g, or t
  misc_feature (856)..(864): n is a, c, g, or t
  misc_feature (866)..(875): n is a, c, g, or t
  misc_feature (877)..(880): n is a, c, g, or t
  misc_feature (882)..(884): n is a, c, g, or t
  misc_feature (887)..(908): n is a, c, g, or t
  misc_feature (910)..(916): n is a, c, g, or t
  misc_feature (918)..(919): n is a, c, g, or t
  misc_feature (921)..(925): n is a, c, g, or t
  misc_feature (927)..(928): n is a, c, g, or t
  misc_feature (930)..(934): n is a, c, g, or t
  misc_feature (937)..(949): n is a, c, g, or t
  misc_feature (951)..(953): n is a, c, g, or t
  misc_feature (955)..(958): n is a, c, g, or t
  misc_feature (960)..(962): n is a, c, g, or t
  misc_feature (965)..(969): n is a, c, g, or t
  misc_feature (971)..(972): n is a, c, g, or t
  misc_feature (974)..(976): n is a, c, g, or t
  misc_feature (978)..(983): n is a, c, g, or t
  misc_feature (985)..(993): n is a, c, g, or t
  misc_feature (995)..(999): n is a, c, g, or t
  misc_feature (1001)..(1014): n is a, c, g, or t
  misc_feature (1016)..(1032): n is a, c, g, or t
  misc_feature (1034)..(1045): n is a, c, g, or t
  misc_feature (1047)..(1055): n is a, c, g, or t
  misc_feature (1057)..(1066): n is a, c, g, or t
  misc_feature (1068)..(1072): n is a, c, g, or t
  misc_feature (1074)..(1075): n is a, c, g, or t
  misc_feature (1077)..(1088): n is a, c, g, or t
  misc_feature (1090)..(1107): n is a, c, g, or t
  misc_feature (1109)..(1110): n is a, c, g, or t
  misc_feature (1112)..(1128): n is a, c, g, or t
  misc_feature (1130)..(1135): n is a, c, g, or t
  misc_feature (1137)..(1138): n is a, c, g, or t
  misc_feature (1140)..(1144): n is a, c, g, or t
  misc_feature (1146)..(1148): n is a, c, g, or t
  misc_feature (1150)..(1153): n is a, c, g, or t
  misc_feature (1155)..(1156): n is a, c, g, or t
  misc_feature (1159)..(1166): n is a, c, g, or t
  misc_feature (1168)..(1174): n is a, c, g, or t
  misc_feature (1176)..(1177): n is a, c, g, or t
  misc_feature (1179)..(1184): n is a, c, g, or t
  misc_feature (1187)..(1191): n is a, c, g, or t
  misc_feature (1193)..(1197): n is a, c, g, or t
  misc_feature (1199)..(1200): n is a, c, g, or t
  misc_feature (1202)..(1203): n is a, c, g, or t
  misc_feature (1205)..(1205): n is a, c, g, or t
  misc_feature (1207)..(1234): n is a, c, g, or t
  misc_feature (1236)..(1238): n is a, c, g, or t
  misc_feature (1240)..(1242): n is a, c, g, or t
  misc_feature (1244)..(1248): n is a, c, g, or t
  misc_feature (1250)..(1251): n is a, c, g, or t
  misc_feature (1253)..(1256): n is a, c, g, or t
  misc_feature (1258)..(1265): n is a, c, g, or t
  misc_feature (1268)..(1272): n is a, c, g, or t
  misc_feature (1274)..(1279): n is a, c, g, or t
  misc_feature (1281)..(1283): n is a, c, g, or t
  misc_feature (1285)..(1292): n is a, c, g, or t
  misc_feature (1294)..(1333): n is a, c, g, or t
  misc_feature (1335)..(1344): n is a, c, g, or t
  misc_feature (1346)..(1365): n is a, c, g, or t
  misc_feature (1367)..(1367): n is a, c, g, or t
  misc_feature (1369)..(1375): n is a, c, g, or t
  misc_feature (1378)..(1382): n is a, c, g, or t
  misc_feature (1384)..(1393): n is a, c, g, or t
  misc_feature (1395)..(1421): n is a, c, g, or t
  misc_feature (1423)..(1425): n is a, c, g, or t
  misc_feature (1427)..(1451): n is a, c, g, or t
  misc_feature (1453)..(1456): n is a, c, g, or t
  misc_feature (1458)..(1464): n is a, c, g, or t
  misc_feature (1466)..(1472): n is a, c, g, or t
  misc_feature (1474)..(1476): n is a, c, g, or t
  misc_feature (1478)..(1479): n is a, c, g, or t
  misc_feature (1481)..(1489): n is a, c, g, or t
  misc_feature (1491)..(1491): n is a, c, g, or t
  misc_feature (1493)..(1496): n is a, c, g, or t
  misc_feature (1499)..(1499): n is a, c, g, or t
  misc_feature (1501)..(1505): n is a, c, g, or t
  misc_feature (1508)..(1522): n is a, c, g, or t
  misc_feature (1525)..(1530): n is a, c, g, or t
  misc_feature (1532)..(1534): n is a, c, g, or t
  misc_feature (1536)..(1538): n is a, c, g, or t
  misc_feature (1540)..(1541): n is a, c, g, or t
  misc_feature (1543)..(1545): n is a, c, g, or t
  misc_feature (1547)..(1548): n is a, c, g, or t
  misc_feature (1550)..(1552): n is a, c, g, or t
  misc_feature (1554)..(1554): n is a, c, g, or t
  misc_feature (1556)..(1561): n is a, c, g, or t
  misc_feature (1563)..(1575): n is a, c, g, or t
  misc_feature (1577)..(1577): n is a, c, g, or t
  misc_feature (1579)..(1579): n is a, c, g, or t
  misc_feature (1581)..(1581): n is a, c, g, or t
  misc_feature (1583)..(1585): n is a, c, g, or t
  misc_feature (1587)..(1587): n is a, c, g, or t
  misc_feature (1589)..(1591): n is a, c, g, or t
  misc_feature (1593)..(1594): n is a, c, g, or t
  misc_feature (1596)..(1598): n is a, c, g, or t
  misc_feature (1600)..(1606): n is a, c, g, or t
  misc_feature (1610)..(1618): n is a, c, g, or t
  misc_feature (1620)..(1624): n is a, c, g, or t
  misc_feature (1626)..(1627): n is a, c, g, or t
  misc_feature (1631)..(1631): n is a, c, g, or t
  misc_feature (1633)..(1641): n is a, c, g, or t
  misc_feature (1643)..(1645): n is a, c, g, or t
  misc_feature (1647)..(1647): n is a, c, g, or t
  misc_feature (1649)..(1655): n is a, c, g, or t
  misc_feature (1657)..(1657): n is a, c, g, or t
  misc_feature (1659)..(1662): n is a, c, g, or t
  misc_feature (1665)..(1667): n is a, c, g, or t
  misc_feature (1669)..(1671): n is a, c, g, or t
  misc_feature (1673)..(1673): n is a, c, g, or t
  misc_feature (1676)..(1679): n is a, c, g, or t
  misc_feature (1681)..(1685): n is a, c, g, or t
  misc_feature (1689)..(1689): n is a, c, g, or t
  misc_feature (1691)..(1693): n is a, c, g, or t
  misc_feature (1695)..(1696): n is a, c, g, or t
  misc_feature (1699)..(1705): n is a, c, g, or t
  misc_feature (1707)..(1709): n is a, c, g, or t
  misc_feature (1712)..(1712): n is a, c, g, or t
  misc_feature (1715)..(1716): n is a, c, g, or t
  misc_feature (1718)..(1722): n is a, c, g, or t
  misc_feature (1724)..(1730): n is a, c, g, or t
  misc_feature (1732)..(1734): n is a, c, g, or t
  misc_feature (1736)..(1745): n is a, c, g, or t
  misc_feature (1747)..(1750): n is a, c, g, or t
  misc_feature (1752)..(1760): n is a, c, g, or t
  misc_feature (1762)..(1769): n is a, c, g, or t
  misc_feature (1773)..(1783): n is a, c, g, or t
  misc_feature (1785)..(1792): n is a, c, g, or t
  misc_feature (1794)..(1795): n is a, c, g, or t
  misc_feature (1798)..(1798): n is a, c, g, or t
  misc_feature (1801)..(1801): n is a, c, g, or t
  misc_feature (1803)..(1803): n is a, c, g, or t
  misc_feature (1805)..(1805): n is a, c, g, or t
  misc_feature (1807)..(1810): n is a, c, g, or t
  misc_feature (1988)..(1988): n is a, c, g, or t
  misc_feature (3622)..(3622): n is a, c, g, or t
nnnnnnnnannganggannnnngnnnnnnnnnnnnngnnnnnncnnnnannnnngnanntnnnnnnnnnnnnnnnntnnnnnnnnnnngatnnnnnnnnnnnnnnngncannnnnnnnnnnnnannnncnnnnncnnncnnnnnccnnngcncnnnnnnnnnnncnnnnnannnnnnnnnnnncgtnnnnncnnnnnannnannnnnngagnnnnnnnnnangaancnnncnnncnnncncnnnnnngnnnnnnntnnnnngnnnnnnnnnnnnnnnnncnnnnnnnncnnnnnnnnncnnnnnntnnnnngnnnnnnnnnnnnannnnnngnnannnncgnnnnncnnnnnnnnnnnnnnnncnnnnnnnnnnnnnnnnnnnncnnnnnnnnncannnnnnnnnngnnnnnnnnnnnnnnnnnnntnnnntnnnnnnnnctnnnnnanntnnnnnnnantnnnnnnnnnnnncgcnnnnnnnnnnnnngnnnngangnnnnngnnnnnntcnnnnnnnnnnnnnnnntnnnnntnnnnnnccnnncnnnnnnngcnnnnnnngnnnnnnnnnnnnncnnncnnannnancnnnnnnnnnnnannngnnnngnnnnnncngnncnnnccncnnnannnnnnnnanannnnnncnnncnnnnnnnnncnnnnnnnnnnannnnnnnncnannnnnnnnnncnnntnncnnnnnnnnnnncnnnnnngnnnnnnnnnncnnnnnnnggntnngnnnnnnnnncnnngnnnnnnnnncnnnnncnnnacnnnnnnnnnnnnncannnnnnnnntnnnnntngcnnnnnnntgcnnnnannnncnnnnnnnnnnncnncnnnnnnnnncnnnnnnnnnnannnnannnaannnnnnnnnnnnnnnnnnnnnntnnnnnnncnncnnnnngnncnnnnngcnnnnnnnnnnnnncnnncnnnncnnngcnnnnncnncnnncnnnnnncnnnnnnnnncnnnnncnnnnnnnnnnnnnngnnnnnnnnnnnnnnnnncnnnnnnnnnnnntnnnnnnnnngnnnnnnnnnncnnnnngnntnnnnnnnnnnnncnnnnnnnnnnnnnnnnnncnntnnnnnnnnnnnnnnnnncnnnnnngnncnnnnngnnngnnnngnncgnnnnnnnnannnnnnncnncnnnnnnctnnnnncnnnnncnncnntncnnnnnnnnnnnnnnnnnnnnnnnnnnnngnnngnnngnnnnntnngnnnngnnnnnnnngannnnngnnnnnntnnntnnnnnnnntnnnnnnnnnnnnnnnnnnnnnnnnnnnnnnnnnnnnnnnntnnnnnnnnnntnnnnnnnnnnnnnnnnnnnngntnnnnnnngannnnncnnnnnnnnnngnnnnnnnnnnnnnnnnnnnnnnnnnnncnnncnnnnnnnnnnnnnnnnnnnnnnnnnannnnannnnnnntnnnnnnngnnncnngnnnnnnnnngngnnnngcncnnnnntgnnnnnnnnnnnnnnncgnnnnnnannnannnanncnnncnncnnnancnnnnnngnnnnnnnnnnnnncngncncnnnancnnncnncnnncnnnnnnncttnnnnnnnnnannnnntnnctcnannnnnnnnncnnncncnnnnnnncncnnnntgnnngnnngnacnnnncnnnnngcangnnncnngcnnnnnnngnnnggncgnncnnnnncnnnnnnngnnngnnnnnnnnnnannnncnnnnnnnnntnnnnnnnngacnnnnnnnnnnntnnnnnnnntnnttnttntntntnnnnacaacgtcacgtcgcagaatggtttcggctaggtctccagagcaaagaaaacgcaacccccatcaccttctccttcggtgacagcacaagctctccggtatccgcttcatacttcacgcctcggacgagagtcttgccaacgtagtcgtcgcggttcgccgcttttacaaagtgcganacagttcgtggaacgtcggtgaagttgaaaacggcaacagcttcgtattccaaagtcgaagaaacgttctgtgcggtgatgttctgcccatacgtttcaaactccaggaacgcctgcacggtggcgtttaatagctctccttgggtttcggccgacgcggacacgtcacaggtatactggaggaaataggtacggcgcgtttagcgtggagacggaaaagagacgagacaggagcactttggaagtcggggacgtaccgagagattgccctgcgagggggagaaacgtcgtaaacctgggaaccgtgatgatgccttcagagcgtcatcgccgaacatgggaagactcacgagggtgtccaccagctcccatgacggagtgtcacacagcgcttcaacaagttcaagtgtttttgtgtcaagagacactacaagtagtggcgcgaacaacaacgtgaaggtgagagtagccttcacacacagtacctttcgtccgagtcttcttgatagcagcagcatctgtcgcttatcggctcgacgagccgccatcgtgtgctgcgagctaagggagtgagtcccctccagctcgtttttcataggacttcttcggtctccccgagactgcgagacctcgacgagacaaaactttaaccttcctttcccctgcaacgagccccgagggtttcacaactccctgcgctcccgaccagaagcgaactccaggtcggttggagctatgccgcatgagcttccagcattcctgaaggcccggctgaaggcccggggcatcaaagtcgacgatgaggcgaacaacaggggtggttcggcggagaatccgaatgaagactcttctcttcctgccgggtggaccgagaccgtggacgagaagtatggacacgcgtactattacaacgctagccttgggaagagttcttggactcgaccgacgaacggagacgcacacataattggggtgatggtggctaatccggcgccgaagacacttccgccggggtggaagtcggcgattgatccgaagacgaatcggacatactactgcgatgcgtccacgaaggtgacgacatgggagcccccgttgccactgcagcagaagcagcatatgaagcgcacagtcgtgatagttccagctgataacaccgtgtctgcacgagcagcaccagtagcgccagtagcgactaacagaaaaagacagcgtgcggcaccaccaggtattgatcccatggacccagcgagttacagcgacgcaccggtggggggctggggcgctggcctcgcttcgcaaaaagagtcagaggggggatcgagcgggcgcccgctcccgagcccgggcgacgtgttgcgccagaacgcgcaatctcagcagccaaccgaaccttacgacttacaaaagagtggtctgggtgaagcagattgagtgcgatggatagccatttgctcacaacgagtgttagctagtcaccgtctagaaataggaaaccactcgagaaaaggtcgtgtacgagcgccacaccgtcgtcgtctatttcgtggcgattcccgacagaaaggccttgccaattctcagccataatctcatcgttgttcgcgatgtgtcgagcaagctgaatactgctngctgacttcagctgccacacctcgccgcccgcgaaaaacaagcatccttcaagactaccgtcagcgacctcgtgtatgaaagcaaacttgacgtgtgcgcgacgaatcaacgcaccctcttccgcccaaacatcttgcaactcgtcgggagagagtttttcctcgggtacagcctgctctccgtcgaatcccaagttaccagtcacgtggcaaccgaaccatctcgcaatatcagcctccgtttttggcatcgagtcacggatgatgtctcccgctcgcttcacggcagcttgcgatatttgtccaacttctgcttggggctctaaccacggatcactccagcgctccgtcactgcgttccgtgtatccactgccgac

SEQ ID NO: 1185 - DNA, 4000 bp, Escherichia coli
  misc_feature (796)..(796): n is a, c, g, or t
  misc_feature (802)..(802): n is a, c, g, or t
  misc_feature (838)..(838): n is a, c, g, or t
  misc_feature (919)..(919): n is a, c, g, or t
  misc_feature (943)..(943): n is a, c, g, or t
  misc_feature (1195)..(1195): n is a, c, g, or t
  misc_feature (1214)..(1214): n is a, c, g, or t
  misc_feature (1221)..(1221): n is a, c, g, or t
  misc_feature (1837)..(1837): n is a, c, g, or t
  misc_feature (1852)..(1852): n is a, c, g, or t
  misc_feature (1990)..(1990): n is a, c, g, or t
  misc_feature (1993)..(1993): n is a, c, g, or t
  misc_feature (2029)..(2029): n is a, c, g, or t
  misc_feature (2648)..(2648): n is a, c, g, or t
  misc_feature (3082)..(3082): n is a, c, g, or t
  misc_feature (3115)..(3115): n is a, c, g, or t
  misc_feature (3239)..(3239): n is a, c, g, or t
  misc_feature (3560)..(3560): n is a, c, g, or t
  misc_feature (3586)..(3586): n is a, c, g, or t
  misc_feature (3625)..(3625): n is a, c, g, or t
  misc_feature (3748)..(3748): n is a, c, g, or t
aaacacagaaaaaggagaacagaaatatgttggagaaaatcaaggaaatcgtagcagatcagttaggaatcgacgaggatgatatcaaattagagtcaaacttcaaggaggatcttgaggcagattcattagatcttttcgagcttgtaatggcactcgaggaggagtacggagtagaaatcccttcagaggatttagagaaaatcgcaacagtaaacgacatcattgagtatcttaagaacaaaggtgtagaggcttaaaagacatggagacaagaataacaaagcttcttggaatcaaatatccggtcattcagggtggcatggcatgggtagcaacccatgagcttgccagcgctgtgtccaatgcaggcggacttggcatcatcggagcaggcggagccccggcttcatgggtaaaggagcagatagtcgctgcaaagaaggagacagataagccgttcggagtcaacctcatgcttatgaatccggaggccgatgagatagcaaaaatcatcgccgaggaaaaggtaaaggtagtcaccaccggcgcaggaaatcctgcaaagtacatggatatgtggaaagaagcaggcgtcatcgtaatccctgtagttgcaagcgtagcactcgcaaagctcatggagagaggcggggcaagtgcagtaatcgccgagggaatggagtcaggcggacatatcggagcacagactaccatgacacttgtgccacaggttgttgatgcagtgagcatccctgttatcgcagcaggcggaattgcagacaacagaggcttnaatgcngcatttgcactcggtgcggaggcagtccagatgggnacacgctttgtcaccgcaaaagaatcgatagtacatgaaaactataagcagaaggtcattaaggccaaggatatagattcngaggttacaggaatgagcacaggncatccgatcagagtactcagaaacaagatgaccagacaatatctcaagctggaaaaggaaggagctccatttgaagagctcgaaaaaatgacacttggcgcactcagaaaagccgttgtagacggagataccgtatatggcagcgtcatggcaggtcagagcgcaggcctcgtaaagaaagaggaaacctgcaaagaaatcattgaggatgtagtgggactgaacaaatagacagtattcacttttacatgnaaatttaaggataccgggncgcctgnaaagagtggcttacggtatcctgtcagaaataaggagaaaccgaaaatgggtaagagagtatttatgtttcccggacagggctcacagtatataggaatgggtaaggagttttacgatacaatgccaaatgcaaaggcagtaatcgaccttgccagtgaacagacaggcttggatattccggcattatgctttgaggaaaatgacaagctgaatattacagagtacacacagatatgtatgcttgcagttgaggcagctatatatcaggcaatcattgacaaaggtatcacacctgatgtcacagcaggcttaagccttggggaatatggtgctctcatcgcatcaggagccatgactatggcagatgcattcgcagttgtcagaaaaagaggaatctacatgcaggaggcagttcctacaggtggagccatgacagcggttttaggacttgatccgcaggtcattgaggatatctgcaaaaagacagcagatgagacaaattcagtggtatcggtagccaactataactgcccgggacagattgttatcacaggagaaaaggcagcagtagatgccgccgcagcagcatgcagcgaggcaggcgccaagagatgngtaccgctcaaggtnagcggacctttccactcagcaatgcttaagggcgcaggcgaaaagctcgcagatgcacttgagagtgtagaaatccacgatatcaaggtgccatatatcacaaacgtcacagcagactatgtgaagtcaccggcagangtnaaggattatctgacaaagcaggtttcatcgtcagtncgctggcagcagaccatcgagcgccttatcgcagacggtgcagatgagtttgtggaaatcggaccgggacgctcactcagcggatttatgagaaagataaatagagacgtaaaagtcgtaaacatagacaaactggaggattttgaaaagtatgttaacaggtaaaaatgccctggttacaggcgcaagccgcggaattggaagacagatagctcttacacttgccgcagcacacgcctttgtaatagtaaattataatggttcaaaggaaaaggcagatgccgttgttgcagagataaaggcagcaggcggtgatgcagtttcttatcagtgcaatgtatctgattttgacgagtgccagaatatgataacagcgctcatcaaggagtacaagcacatagatatcctcgtaaacaacgcaggaatcacaagagacggtctcatcatgaagatgagcgaggcagactatgacgcagtgctcgacacaaaccttaagggtgcgttcaacacaatccgtcacatgtcacgctatttcttgaagcagaaatcaggaagaattatcaatatttcatcagtttccggaatactcggaaatgcaggacaggccaactacagcgcnagcaaggcaggagttataggactcacaaaggctgtagccagagagcttgccagccggggaatcacagcaaacgcagtggcaccgggctttgtagagacagagatgacagatgtgcttgccgatgcggcaaaggagaatcttttatcacagattccgcttggcagaccgggaaacacaaaggatatcgcaaacgcagtattatttttagcatcagatgcagcaggctacatcacaggccaggtgctgtctgttgacggaggaatggcaatatgagtagaagagtagttgtaacaggacttggagcagtaacaccaatcggaaataatgtggacgatttctgggcatcggtaaaggccggaaaaatcggatttgaccacatcacaaaatttgacacaacagattataaatgtcacattgcagcagagcttaaggantttaacccacaggattttatggacagaaaggcngcaaagagaatggagccattctcacagtacgctgtagctgcagcaaagcaggcaattgatgacagcggacttgatatcgaaaaggaagatccatacatggttggatgtgccatcggttcaggtntcggaagtcttcaggctatggagcgcgagacacaaaagctttatgaaaagggaccaaacagagtcaatcctctgcttgttccgcttatgatctgtaacatggcagcaggaaatgtttctatccagttcggtctcaagggaaagagtatcaatgatgtaacagcctgcgctacaggaacaaacacaatcggtgaggcatacagaagcatccagtacggtgaggctgacgtgatggtagccggtggtacagagggcagtgtatgtcctatcggaatcgcaggatttacagcacttacagcgctttctacagtagatgatccgncaaagtgttcacttccgtttgacaanaacagaagcggctttgtaatgggtgagggcgcaggagtngttatccttgaagagcttgagcatgcaaaggcaagaggtgcaaagatttatgcagaggtagtcggatacggctgctcatcggatgcataccatatcacatctccgcaggaggatggcgcaggngcagcaagagccatgaccaatgccatgagcgatgcaggtgtcacaccggcagatgtaaaatacatcaatgctcacggaacaggcacacatcacaatgatctctttgagacaagagcaatcaagcttgcgttcggtgatgaggctgcaaatcttaaaatcaattcaacaaagtctatgataggacatctgctcggagcagcgggagctgttgagtttataacatgtgtgaaggaaatccaggatggatttata

SEQ ID NO: 1186 - DNA, 4000 bp, Escherichia coli
  misc_feature (158)..(158): n is a, c, g, or t
  misc_feature (335)..(335): n is a, c, g, or t
  misc_feature (338)..(338): n is a, c, g, or t
  misc_feature (473)..(473): n is a, c, g, or t
  misc_feature (500)..(500): n is a, c, g, or t
  misc_feature (578)..(578): n is a, c, g, or t
  misc_feature (584)..(584): n is a, c, g, or t
  misc_feature (587)..(587): n is a, c, g, or t
  misc_feature (1672)..(1672): n is a, c, g, or t
  misc_feature (2248)..(2248): n is a, c, g, or t
  misc_feature (3586)..(3586): n is a, c, g, or t
  misc_feature (3733)..(3733): n is a, c, g, or t
  misc_feature (3739)..(3739): n is a, c, g, or t
  misc_feature (3792)..(3792): n is a, c, g, or t
cgggtttctgcatgagccaggccaggcagcgtctggcgtcgatcaccccgggcgcgacgatggccccagtaggacatgcgggttcgcaccgtgagcaggttccacacccgtcagcgactggctcggagcgggggtagtcggcggtcgtgatgatcganccgaggatgaagaagcttcccgctccggagatgagcaggttcgcgttgcggccgaaccagccgagacctccgagatatgcggcttcccggtcgacgagcgagttgtcgtcagcgaaggcgaccgcccggtgcccagcggctcggatcagtcgcgcctcggcgcggagcgctcggcgnagntcctcgtagtggtcggctcgcgcgtagcgggccacccgtgcccaacccggtcggaccggttcgggctcgacgccggccgcgtagggcatcgctgcgacgatgatcgagcaggccccatccaccgcgcgctgaggntcggtggagcgctccggatcgcggtangtgaactccatcgagtcggccaacccatcggcgcggcgttcgttgagggccgatcgagcgcgatcgagcacctcggcnggggcnacnccgagtgcggtgatgccctgttctcggaggcgatctcggatctcatcgagggttggaagtggagcgttgcgtctcatgtcgacttcagccggtcgtgtgaccgctcacctgccccacaacaggtcggcgaagaccgggctgttgatcaagttggcgccaagagcgcgggcatccgatctcaccgcttgatcgtccgtgaccacgacgacggggcgggtgaccggcacgcgactgagttcctcgcggatcgtgtcgtcggcgtcgacaccctctggcgagtagaggactcgaacgtgtcgacggccacgagcgtgggcaccgacgatcgacgccccgtcgatcgccaccacgatgtccgcgccggtacgggcggcgagctgctcacaggcgctcaggaggcgctcgcgctgctcggcgatctccaggtgtccaagccgaccgagggtgacgttgtaggcatcgacgatcacggtcgctccacatcgcattagatggtcagccgcgcggtcgggcaaaccggtgtaggcgccggggatctggacgggctcgcgacggtcgccttctcgtggcgctgggagcatggcgcgaagcccggccagcagggtctcagcgcttttcaccatgccgctcagatgctcgatgtcgctgagaagttcccgccgctcgtcgagcacgcggtcgcgcacctcctcagcctcctgagtggccgcatcggcgatgccggcctgatcgatggcccgctcgagtcgacccttggtggcggcgtgtcggtcgcgttcgtgccggaggtccatccgcgcggcttggagcgactcgtcgagggcggcgctctcggcgctggacttctcgagagctgcctcgagctcggagactctcgctcggaggtcgctcacctcggtccgctcacgggcgagtgcctcctcagcccgagccgacttctgctcggcggcgaggcgcttgcgaacctcgcgacgtaccgccgatggatcgtcaccgaggccggcgtccgacgtgccggccattccccaccaatcgggtgctcccgccagccacgcacgacagcgctcgtcgagctgaccggcatntacgatctcagcgcagcgcttccgcatgtcctcagcggagagcgcctccacgattcgcgtgatatggccgagcccgaggcggtcgcgacgaggggcattcgtcaccgtgtcgaccaccgcgtcaggacaccagtcgagcggaggcccatcacgaggcacgagcagtgggacgagcgcctcgaccaggggacggaggtgccggggatcattggggggaacctcgcgtctcgcccccgatcgagccatgtgacgatcgtaccggcgcgcccacgcacgggatggcttgacacgaacagatgttcgtgttcgactaggtgtgtgtatcgccagcgcagcctcgacgacttagggctggcgctctcggaggtgaccttctgcgtcgtcgacctcgagaccacgggcacccgagccgactcggacgcgatcaccgagatcggagcggtcaaggtgcgcggaggtgaggtgctcggcacctatcagaccctcgtcaacccgggtcgtcccatccctccgcagatcacactgatcaccggactgaccgacgccgtggtcgccaccgcccctcgtatcgaatcngtgcttccgagcctggagtcgttctgcgagggctgcgtcgtcgtcgcgcacaacgcgcggttcgacgtcggtttccttcgggccgccttcgagcgggcagggcgcgaggagttccgcccgccagtgctcgacacgctcgccatcgcccgacgactactgcgcgacgaggtgccgaacttccgtctcggaaccttggctgagcggttcggcttcgcgaactcaccgagccatcgggcccttgatgacgctcgagccacaacggatctccttcacctgctcatcgaacgagcctccgcgtggggggtcaccggaatcgacgacctcatgcaacttggaacgatcggcggccacccccaggcagcaaagttgcgtctgaccaccgacctcccacgctcccccggcgtctacctgttccgcgacgcgatgggagacatcatctatgtgggaaaggcgaccaacctgcgtcagcgggtgaggagctacttcggtggcgacgaccgtcgaaccgtcggcccgatgctgaggcaactctccaccatcgagcatcttccgaccccggatcccctcaccgccgagatcctcgagcgtcgcctcatcatcagctcgagcccgcggttcaaccgggtcggacgtcatccacggcgaccaacgtggattcgtctcgacaccagtcaggagtggccgcggctctcggtggttcgcgctgacgatgggcgatcaccgcatctcggcccggtcggttcgcaccgtcgcgccgccgcggtgatcgaggccatcgagtcggtcgtgccgatccgccgctgctcggtgcgactgccgagaggccacaccccacgtccagaggccacgccctgcacagcgcaccagctcggggtcgccccatgtccgtgcgccggtttcgccgaccgcgccgagtatgaccttgcggtcgcgaccatcgtcggcctcttccaaggtgagacgaccgctgtcgtggaggcggcgacgacgcgcatgcgcgatctcgcgctcggacagcggttcgaggaggccgcagcctgccgcgatcggctggctgagctgctcggagccctcgaacgcaccgccctcgtgcgcgcggtgctcgacgctggtgctctcaccgtgcgcgacggtgatctcgagttccgcatggagcacggggtgctccatcacccggcgctcgagggacacgatccggtcgacccgatcggtgaggccctcatgctcggtcgacacctcgagcgaatcgcaggccgcgtggatgtcgtctcgtgcagcggcgaatggcgctttcctctgctcttcgatactgaagtgcctcgactcgccctcgctgtntagagcgcgtaaccgttgagcgggtctccgctctaggggtcgacgcgcacaccctcgcggtcgaccgcgaggccaaggacctgatcagcggacgctccggtcgcgtcccgcacaccagcgacgacctggtcgagctcgtccgccttnacccanccagcaaccgtcggacccgagccggacagccacacaccatgcacaccgggaancgactccatcgcggtcgccgcttgcgccgatgctggcgccgccgcgaagcggatgtcttggtggagtcgatcggcgactgagcgacgcagtagtccaaggtctcctgctgccaccgcggtgatcagcgtggcgacccgcgccatgttgaacaccgcgtcgggtcggtcgacgacggtgggaagagtggctcgggagcgatcggtggag

SEQ ID NO: 1187 - DNA, 4000 bp, Escherichia coli
  misc_feature (1989)..(1989): n is a, c, g, or t
aagtcaaattttgcaaatcgctgatccggctgagttaacgcggcgcccaaaaagggctgcatgcccatgctcgagtcattgttcgccggtgcgggcgaggtgtcccgtttgatttgcgcaaaaggagtgatttgaacggtattagacgtgttattggttgcttcgtgcagcacggtgatggtgtggctgccggcctcaaaaacaaacacttttctaacggtgaccgcgctcgttttgtcgttgaaggtgagcacaacctctaagggcgacaggcctgtttgctgataatcggtgcgctcagcgcggtaaagcgcgcggttaggcctatcaataccatcaggaccgactaagcctgattgagcaacataggttcgctgtgaattacgttctagcaatacaaagggatccgatgtgtcttcgagagtcttaggaaaatccttaaacccagcgccaacaacatccccgccttgcagatcaatcatgacctcaagtacgtcggtgtgtacggtaacgaaccgctgctgcacgccggcatctgtcgtgctcagcggctcaggagccgataagctagcgtccggtgacgccggtaaatcaggatctaagatatcagcagatggcgcgacatcttgaggtgctgcttgagaaattgtcgcgcttggcgcaaaagcgtcgaccatggggacttgaggtctctgcgcagagtcctgctcggcgctgtagcgagtccattctcccagcagcataaaacccagtagggcgctggcagctaaaagggcatatcgctggatatccatggtgacggtctcagttgtgttcgtggggctgcggtgtgcttgggacgggatcatacccaccctcgcagccgggttggcaacgcagcaaacggtgtactgtaagccagcaccccgtcactgcaccatgagttcttagcgcatcgatgccgtattgtgagcaagtcggaagaaagcggcaacgcctaccgagccaggggctgagggttagttggtatccgcgaatcaccatggcgaaggcgttggcaacgtgttgatcgattgtttttagccagcccattgacggtccgccgttgcgttaatttgatgccacaactttgcaatgtccagccatacagcggggttgtcgagctcgtcagcaggtgatcgagccaacacgaccaagtccattgagcgtcccagcggtgtcagcctaaactgttctctaacgattcgtttaatacgatttctccgcgaggcgagacggatatgcttttttgccacaatgatgccgatacgagacggtccgtcgttattttctacggctaataaaagaaacgctttactgctggccttgacgttaggaccatcaaagacgcggcgatagtggcagggttgcgagagtcgtgctttaagcggaaaggacggcatgcgctgatactgcgccttgtccgttggggtcaagcagacaggctgtgtcgacctcgagcgcggcgacgtgccaacactttccggccagctttggttgccattctggcgcggaagccgtgactgcgcttgcgcttgagtacgctgggttgaaatgtacgcttcatgacacaaaccttcctaaatggattctggctcgcgcgttacggtagtaggcgctttggcagaatcgagccaattcgttttcgggcgcggagtataggagtagctgaggggcttggcaagacccaaacagaagcccgcagatatgttaaagccgctcgagaaaaataaatgctccaccggcaaccgacccagtttatcacccgccgcgacctcgatgaggcacacgtaacctaatgatatcgctgccctattgataatttggtggccagtgtatgtactggtatcggagcgtgattgggtcgctgtgacaatcactaaacacaggtttacaaaatgatactaacagcttacccacaggcgaattaaaataagcttgcaaacttgtttttgatcctctaggaggctntttttgttttaagcatctgattttaataggtaaaaaaggtgttgataaagacggttccgtgtggataactacccctcttaacgtgcgtaggccgacaacgagattaagacttcgtttgggtcaaacgtcctcgttatgacgatatggacctgcttaggagacagcaaattggccgcgcttcagcctctcaccgacccctgggaacactgtttgaatcgtatcggcagcgatattcctcaacagcaatttaatacctggattcgaccgctgcaggcgcaatggcaggggtctggattgatgttggccgcgcccaatcggtttatcagggattttgtcactgaaaaatatgtgccgatgatcgccacctacctgcttgatatcgttgcgccggcctctgcgcaggtttccgtgaccgtggttggcggtgcggcaccgacgccccctcaacctgtcaggccagtgcaagatgcgccggccgtggcgctaactggggcgttgacaggggcaccaacgcccccagtggttaacaagccgagcccggcggcctccctatcgccctctaatttagtcgcgggttatacctttgagcgttttgtagagggaaaaagcaatcagctagcactggcagcggcacagcaggtttctgaacacccaggtgactcttataacccgttgtttttgtatggcggcgtcgggctcggaaagacccacttaatgcacgcggttggcaacgcgatgcggcgtcggaatccggacgcgaaaattgtgtatttgcattctgagcggtttgttgcggacatggttaaagcactgcagttaaatgcgatcaacgacttcaagcggttttatcgttcggttgatgcgctgctaattgacgatatccagtttttcgcaaacaaagaccgttctcaggaggagttttttcatacctttaacgccttgctcgagggcgggcagcaaatgattctgacctgcgataggtatccgagagaaattgacggtgttgaagagcgtttgaagtcgcgctttgggtgggggctgacggtggcggtagagccgcctgatttagagacgcgggtagcgattttaatgaagaaggcagagcaaagccatatcacgctttcgcccgatgcagcttttttcattgcccagcgaatacgctcgaatgttcgtgagttggagggcgccttaaaacgcgttatcgccagtgcaaacttcacaggtaggccgtttgacattgacctgataaaggaaagtttaaaggacctgctggcgttgcaggacaagcagatttcgttggataacattaagaaaaaggtggctgaatactacaaaatcaaggtcgcggatctgttgtcgaagcgtcgtaataggtccgttgccaggccgcggcaagttgcgatggcattgtcaaaagaactgacgcgtcacagcttgccggagattggggatgccttcggtggacgtgaccacacaacggttttacatgcatgtcgtaaaatcaaagagctacgagatgacagccccgacatcagtgaagactatcaaaatttgttgcggtctttaacaacctgacgtgagtcgggcgtctgatctgttattgtgttcaacagtgcccattacaccttatgagttcaatgccatgaaattttcaatcgcccgcgacgccttgattaaaccattgaatttggttgcaggggtggtcgagagacgacagaccttacccatcctttcgaatgtcttgttggtgctagacggcacaacgttatctttgacaggcactgatctggaggttgagttggtggggcgggtagagcttgatgcgcccggtgttgatggtgaagtcacggtgcccgctagaaagttcgtcgatatttgcaaatcattgccagagggttctaatatagaactatcggtagaggcgggtaaggccaccgtgaaagcgggccggagtcgtttcacattgtctacattgccggcagccgactttcctgctgtagagggcggagct

SEQ ID NO: 1188 - DNA, 4000 bp, Escherichia coli
  misc_feature (1992)..(1992): n is a, c, g, or t
aaggtgcgacatcttcaggccagcaggtctgaatcggtagtttattgagatctatttgatcttcttcaataataatttcctggcagggtggagacttaatcaccttgggtgataaatttaatgcctgcttaaatatcggggctttttcaagtagatccttccagcctttgggtggttcgggctcctttaaaaaagccagtaacctgccaacatccctgagtgattcaacatcattctggcccattgccatggcgacacgtttggttgtgccaaataaattagccaatacagggatatcagagttaacaggattttcaaacagtaatgccggaccttcgcggcgcagggtgcggtcagaaatttcggtaatttccagatagggatcaacaggcgtctggatgcgttttagttcaccttgctgctcaagtaattcaataaaatctcgaaggtccttgaacatgagtcagttacactttttggtagttatgctctggttttatttacgtttcattgcctggaagaattcatcgttggttttggtgtctttcaatttatccagaatgaattcagttgccgggacatcttccatggaagtcagcaatttgcgcaatatccacatacgttgtaattcttcttcagtggttagcagatcttcacggcgggtgcctgagcggcgcacattgatagccggataaacgcgtttctctgccattttcctgtcgagatgcagctccatgttgccggttcccttaaattcttcataaataacttcatccatttttgaaccggtttctatcagacaggttgaaataattgtcaggctaccaccttcctcaatattacgtgcagcaccaaagaaacgttttggtctttccagtgcatgggcatcgacaccacccgtcaggacttttcctgatgaagggatgattgtgttgtaggctctggcgagtcgagtcatggaatccagcagaataacgacatcttccttatgctcgaccagacgtttggctttttcgatcaccatttctgcaacctgaacatgtcgtgcaggcggttcatcaaaagtactggcaactacttcaccacgcacggaacgtttcatctcagtcacttcttcgggtctttcgtcaatcaacagaacaatcaaatgacactctggagaattacgtgtaatcgcctgagcaatattttgcagaattaaagtcttacctgccttgggcggtgacacaatcaggccgcgttgacctttaccgataggggcaaccagatcaatgactcgtgagcttaaatcttctgagctgccgttacccgcttccagtatcagtctgtcatcagggaatagtggtgtaaggttttcaaaaaggattttattgcgggagttttcaggtttgtcgaaattaatttcattgactttgagtagagcaaaatagcgttcaccgtcttttggtggccggatttttccagctatggtgtcgccggtacgaagattaaagcgacgaatctggcttggagaaacataaatatcgtcgggtccggccagataggatgcatcggctgaacgcaaaaaaccaaaaccatcctgtaaaatttcgagtacgccatcgccataaatatcttcgccattttttgcatgacgttttaacagttgaaagataacgtcttgcttgcgtgtacggctaacgttatccaggcccatatcctgggcaatctgtaataattcggaaattggtttggtttttaattcagatagattcatagcataagttcaaagtgttgtgagtcttttttgagaaaaaagaggaggtaggtttactgttaaaaaaggtctttaaaagaaagtaaataagtttgtttgggttaataaatttattgcttgcctgattccgccttttatgccttttatataaaaatatataagggctggttcagttttaaaaattattttgctgatttggcaccttggaatggcgcctgaaaagacaagctggcggntaatctatcatccgccctaacttgtgtaaagtaaatatttaaaaaatcactttttttgaactttttatctattcccggcttaacggtttttagattgtgctgtcgataaaagctgatagctgggctttagaaagagcgcccacttttttgccggctgcatcgccattattaaagatgatcaaagtgggaatgcctttcacattgtatttttcagccatggctttatgttgatcgacatctattttgcaaattttcaatttgccggcatattcatcagccaggtcttctaggacaggagcaatcatcttgcagggaccacaccactcagcccaaaagtctactagtactggtccatttgaattgattacatcatcttcaaaactgtcatctgaaatatgactgatattgtcgctcatgataggttccttacgaataaataaaatgaaatttgattaggggtcttttcttgctgctaaatatggagtcaaaagcatgcttattcaagcttttcggcgaccttttttgcaaaataggttaaaacggcatcggcgccagcacgtttaattgagagtaaagactctagcataactttgtctgcatccaaccagccgttctggaaagcggccatatgcatggcgtactcaccactgacctgatagacaaacgtaggcacgccaaactcgtcttttacccgtctgacgatgtccagataaggcagtccgggtttaatcatgaccatatcagcaccttcacttaaatccatagcaacttcatgtagcgcttcgtcactgttggcgggatccatctgataggtttctttgccacttgagcccagattggttgacgagcccactgcatctctgaatggtccgtaataggcagaagcatattttgccgagtaagccaggattttagtattgatgtgcccggcggattcaagctcatttctgatcgcaccaatccggccatccatcatatccgagggagcaacgatatctgctccggcgttggcatgggaaagcgcctgtttgaccaaggcttctactgttgcatcatttagcacatagcctttggtatcaatgatgccgtcctgtccgtgagtcgtgaaggggtcgagggcaacatcggtaataactcccatttccgggcaggcatctttaatggtttttatggcgcgttgagcaaggccatcagcattaaatgcttcacggccatcttcagtcttgctggtggggtcagttacagggaaaagcgcaatagcagggataccaagctgttttaatacaagtgtttcttttgctaattcatcaagcgttagcctttcaatatccggcatactgggaaccacttgacgttcagctttgccttcaatgacgaagatgggataaatcaggtcatcaacactcagccttgattcacgcatcaaacgacgactgaaatcatcgctgcgcatacggcgcatgcgtgttgccgggaaaaggcgctggtaactgtctttactcaatttatactccgctataaatcaacaagggatatagagggttaaggaggtattaaattaattttcctagtaacatccttaacggaaagttatctatgttcacaaagctgaactaattatggcatatcaacacataaaatgaataaaaaacaactcttcctgctttcactttttctaattgttttagcttgtttttttatttttgatttaggtgcgtatttgcaattatctttttttcaggagcaacgagagctgctgctgagttacaaagaaaacaattttgcattactttcaatcctttatttctttttatatatcctcataacagccttttctctaccggccgcagccctggtgactttggctggaggtgcaatattcggtttctggtgggccttattcctggtgtcatttgcaagctcgataggtgcatcactggcttttctcatggccagaactgtattacgggattgggtgcaatataagtttggtgacaaactgaaacct

SEQ ID NO: 1189 - DNA, 4000 bp, Escherichia coli
  misc_feature (2549)..(2551): n is a, c, g, or t
  misc_feature (2553)..(2553): n is a, c, g, or t
  misc_feature (2565)..(2565): n is a, c, g, or t
  misc_feature (2567)..(2567): n is a, c, g, or t
  misc_feature (2570)..(2573): n is a, c, g, or t
  misc_feature (2575)..(2576): n is a, c, g, or t
  misc_feature (2579)..(2581): n is a, c, g, or t
  misc_feature (2583)..(2585): n is a, c, g, or t
  misc_feature (2588)..(2591): n is a, c, g, or t
  misc_feature (2594)..(2594): n is a, c, g, or t
  misc_feature (2596)..(2596): n is a, c, g, or t
  misc_feature (2598)..(2600): n is a, c, g, or t
  misc_feature (2602)..(2603): n is a, c, g, or t
  misc_feature (2607)..(2608): n is a, c, g, or t
  misc_feature (2610)..(2610): n is a, c, g, or t
  misc_feature (2617)..(2617): n is a, c, g, or t
  misc_feature (2619)..(2619): n is a, c, g, or t
  misc_feature (2624)..(2624): n is a, c, g, or t
  misc_feature (2633)..(2633): n is a, c, g, or t
  misc_feature (2635)..(2635): n is a, c, g, or t
  misc_feature (2637)..(2639): n is a, c, g, or t
  misc_feature (2642)..(2642): n is a, c, g, or t
  misc_feature (2644)..(2644): n is a, c, g, or t
  misc_feature (2649)..(2651): n is a, c, g, or t
  misc_feature (2655)..(2656): n is a, c, g, or t
  misc_feature (2659)..(2660): n is a, c, g, or t
  misc_feature (2662)..(2664): n is a, c, g, or t
  misc_feature (2671)..(2671): n is a, c, g, or t
  misc_feature (2673)..(2673): n is a, c, g, or t
  misc_feature (2680)..(2682): n is a, c, g, or t
  misc_feature (2685)..(2685): n is a, c, g, or t
  misc_feature (2688)..(2689): n is a, c, g, or t
  misc_feature (2691)..(2693): n is a, c, g, or t
  misc_feature (2698)..(2700): n is a, c, g, or t
  misc_feature (2702)..(2702): n is a, c, g, or t
  misc_feature (2704)..(2707): n is a, c, g, or t
  misc_feature (2709)..(2709): n is a, c, g, or t
  misc_feature (2711)..(2713): n is a, c, g, or t
  misc_feature (2715)..(2716): n is a, c, g, or t
  misc_feature (2718)..(2718): n is a, c, g, or t
  misc_feature (2721)..(2721): n is a, c, g, or t
  misc_feature (2724)..(2727): n is a, c, g, or t
  misc_feature (2731)..(2731): n is a, c, g, or t
  misc_feature (2734)..(2736): n is a, c, g, or t
  misc_feature (2739)..(2739): n is a, c, g, or t
  misc_feature (2741)..(2741): n is a, c, g, or t
  misc_feature (2744)..(2745): n is a, c, g, or t
  misc_feature (2749)..(2759): n is a, c, g, or t
  misc_feature (2765)..(2765): n is a, c, g, or t
  misc_feature (2768)..(2769): n is a, c, g, or t
  misc_feature (2771)..(2772): n is a, c, g, or t
  misc_feature (2775)..(2775): n is a, c, g, or t
  misc_feature (2777)..(2777): n is a, c, g, or t
  misc_feature (2779)..(2782): n is a, c, g, or t
  misc_feature (2787)..(2788): n is a, c, g, or t
  misc_feature (2793)..(2795): n is a, c, g, or t
  misc_feature (2797)..(2797): n is a, c, g, or t
  misc_feature (2800)..(2801): n is a, c, g, or t
  misc_feature (2805)..(2806): n is a, c, g, or t
  misc_feature (2810)..(2810): n is a, c, g, or t
  misc_feature (2812)..(2812): n is a, c, g, or t
  misc_feature (2816)..(2817): n is a, c, g, or t
  misc_feature (2820)..(2822): n is a, c, g, or t
  misc_feature (2824)..(2825): n is a, c, g, or t
  misc_feature (2828)..(2828): n is a, c, g, or t
  misc_feature (2830)..(2831): n is a, c, g, or t
  misc_feature (2835)..(2838): n is a, c, g, or t
  misc_feature (2841)..(2846): n is a, c, g, or t
  misc_feature (2848)..(2849): n is a, c, g, or t
  misc_feature (2851)..(2855): n is a, c, g, or t
  misc_feature (2859)..(2859): n is a, c, g, or t
  misc_feature (2865)..(2865): n is a, c, g, or t
  misc_feature (2867)..(2868): n is a, c, g, or t
  misc_feature (2870)..(2870): n is a, c, g, or t
  misc_feature (2874)..(2874): n is a, c, g, or t
  misc_feature (2877)..(2878): n is a, c, g, or t
  misc_feature (2880)..(2881): n is a, c, g, or t
  misc_feature (2885)..(2889): n is a, c, g, or t
  misc_feature (2891)..(2891): n is a, c, g, or t
  misc_feature (2893)..(2893): n is a, c, g, or t
  misc_feature (2895)..(2896): n is a, c, g, or t
  misc_feature (2899)..(2901): n is a, c, g, or t
  misc_feature (2903)..(2903): n is a, c, g, or t
  misc_feature (2905)..(2907): n is a, c, g, or t
  misc_feature (2910)..(2910): n is a, c, g, or t
  misc_feature (2914)..(2917): n is a, c, g, or t
  misc_feature (2919)..(2919): n is a, c, g, or t
  misc_feature (2921)..(2922): n is a, c, g, or t
  misc_feature (2924)..(2928): n is a, c, g, or t
  misc_feature (2931)..(2931): n is a, c, g, or t
  misc_feature (2933)..(2933): n is a, c, g, or t
  misc_feature (2942)..(2942): n is a, c, g, or t
  misc_feature (2944)..(2950): n is a, c, g, or t
  misc_feature (2952)..(2956): n is a, c, g, or t
  misc_feature (2958)..(2958): n is a, c, g, or t
  misc_feature (2962)..(2962): n is a, c, g, or t
  misc_feature (2964)..(2965): n is a, c, g, or t
  misc_feature (2967)..(2967): n is a, c, g, or t
  misc_feature (2969)..(2969): n is a, c, g, or t
  misc_feature (2971)..(2972): n is a, c, g, or t
  misc_feature (2974)..(2974): n is a, c, g, or t
  misc_feature (2976)..(2976): n is a, c, g, or t
  misc_feature (2978)..(2978): n is a, c, g, or t
  misc_feature (2980)..(2980): n is a, c, g, or t
  misc_feature (2982)..(2986): n is a, c, g, or t
  misc_feature (2988)..(2988): n is a, c, g, or t
  misc_feature (2991)..(2993): n is a, c, g, or t
  misc_feature (2996)..(3001): n is a, c, g, or t
  misc_feature (3003)..(3009): n is a, c, g, or t
  misc_feature (3013)..(3013): n is a, c, g, or t
  misc_feature (3015)..(3017): n is a, c, g, or t
  misc_feature (3021)..(3022): n is a, c, g, or t
  misc_feature (3024)..(3025): n is a, c, g, or t
  misc_feature (3027)..(3029): n is a, c, g, or t
  misc_feature (3033)..(3036): n is a, c, g, or t
  misc_feature (3038)..(3038): n is a, c, g, or t
  misc_feature (3040)..(3042): n is a, c, g, or t
  misc_feature (3044)..(3045): n is a, c, g, or t
  misc_feature (3050)..(3050): n is a, c, g, or t
  misc_feature (3052)..(3052): n is a, c, g, or t
  misc_feature (3054)..(3054): n is a, c, g, or t
  misc_feature (3057)..(3058): n is a, c, g, or t
  misc_feature (3060)..(3061): n is a, c, g, or t
  misc_feature (3065)..(3067): n is a, c, g, or t
  misc_feature (3070)..(3070): n is a, c, g, or t
  misc_feature (3072)..(3072): n is a, c, g, or t
  misc_feature (3074)..(3075): n is a, c, g, or t
  misc_feature (3079)..(3080): n is a, c, g, or t
  misc_feature (3082)..(3082): n is a, c, g, or t
  misc_feature (3084)..(3084): n is a, c, g, or t
  misc_feature (3087)..(3087): n is a, c, g, or t
  misc_feature (3089)..(3089): n is a, c, g, or t
  misc_feature (3092)..(3094): n is a, c, g, or t
  misc_feature (3099)..(3099): n is a, c, g, or t
  misc_feature (3104)..(3104): n is a, c, g, or t
  misc_feature (3106)..(3106): n is a, c, g, or t
  misc_feature (3111)..(3111): n is a, c, g, or t
  misc_feature (3114)..(3116): n is a, c, g, or t
  misc_feature (3119)..(3120): n is a, c, g, or t
  misc_feature (3122)..(3122): n is a, c, g, or t
  misc_feature (3124)..(3124): n is a, c, g, or t
  misc_feature (3129)..(3131): n is a, c, g, or t
  misc_feature (3133)..(3133): n is a, c, g, or t
  misc_feature (3135)..(3137): n is a, c, g, or t
  misc_feature (3139)..(3139): n is a, c, g, or t
  misc_feature (3141)..(3141): n is a, c, g, or t
  misc_feature (3143)..(3144): n is a, c, g, or t
  misc_feature (3146)..(3146): n is a, c, g, or t
  misc_feature (3150)..(3154): n is a, c, g, or t
  misc_feature (3156)..(3158): n is a, c, g, or t
  misc_feature (3160)..(3163): n is a, c, g, or t
  misc_feature (3166)..(3166): n is a, c, g, or t
  misc_feature (3170)..(3172): n is a, c, g, or t
  misc_feature (3176)..(3177): n is a, c, g, or t
  misc_feature (3180)..(3181): n is a, c, g, or t
  misc_feature (3183)..(3183): n is a, c, g, or t
  misc_feature (3185)..(3187): n is a, c, g, or t
  misc_feature (3190)..(3190): n is a, c, g, or t
  misc_feature (3192)..(3192): n is a, c, g, or t
  misc_feature (3201)..(3202): n is a, c, g, or t
  misc_feature (3204)..(3204): n is a, c, g, or t
  misc_feature (3207)..(3207): n is a, c, g, or t
  misc_feature (3209)..(3210): n is a, c, g, or t
  misc_feature (3214)..(3217): n is a, c, g, or t
  misc_feature (3220)..(3220): n is a, c, g, or t
  misc_feature (3229)..(3229): n is a, c, g, or t
  misc_feature (3232)..(3233): n is a, c, g, or t
  misc_feature (3235)..(3235): n is a, c, g, or t
  misc_feature (3238)..(3238): n is a, c, g, or t
  misc_feature (3247)..(3247): n is a, c, g, or t
  misc_feature (3251)..(3252): n is a, c, g, or t
  misc_feature (3255)..(3255): n is a, c, g, or t
  misc_feature (3258)..(3258): n is a, c, g, or t
  misc_feature (3261)..(3261): n is a, c, g, or t
  misc_feature (3270)..(3270): n is a, c, g, or t
  misc_feature (3282)..(3282): n is a, c, g, or t
  misc_feature (3287)..(3287): n is a, c, g, or t
  misc_feature (3292)..(3292): n is a, c, g, or t
  misc_feature (3305)..(3305): n is a, c, g, or t
  misc_feature (3309)..(3309): n is a, c, g, or t
  misc_feature (3311)..(3311): n is a, c, g, or t
  misc_feature (3319)..(3319): n is a, c, g, or t
  misc_feature (3333)..(3333): n is a, c, g, or t
  misc_feature (3337)..(3337): n is a, c, g, or t
  misc_feature (3346)..(3347): n is a, c, g, or t
  misc_feature (3350)..(3350): n is a, c, g, or t
  misc_feature (3353)..(3354): n is a, c, g, or t
  misc_feature (3357)..(3362): n is a, c, g, or t
  misc_feature (3364)..(3364): n is a, c, g, or t
  misc_feature (3368)..(3370): n is a, c, g, or t
  misc_feature (3374)..(3375): n is a, c, g, or t
  misc_feature (3379)..(3379): n is a, c, g, or t
  misc_feature (3382)..(3382): n is a, c, g, or t
  misc_feature (3387)..(3387): n is a, c, g, or t
  misc_feature (3389)..(3389): n is a, c, g, or t
  misc_feature (3392)..(3392): n is a, c, g, or t
  misc_feature (3395)..(3395): n is a, c, g, or t
  misc_feature (3399)..(3399): n is a, c, g, or t
  misc_feature (3401)..(3401): n is a, c, g, or t
  misc_feature (3405)..(3405): n is a, c, g, or t
  misc_feature (3408)..(3408): n is a, c, g, or t
  misc_feature (3410)..(3411): n is a, c, g, or t
  misc_feature (3413)..(3414): n is a, c, g, or t
  misc_feature (3416)..(3417): n is a, c, g, or t
  misc_feature (3425)..(3425): n is a, c, g, or t
  misc_feature (3428)..(3428): n is a, c, g, or t
  misc_feature (3432)..(3435): n is a, c, g, or t
  misc_feature (3439)..(3439): n is a, c, g, or t
  misc_feature (3446)..(3448): n is a, c, g, or t
  misc_feature (3451)..(3452): n is a, c, g, or t
  misc_feature (3456)..(3457): n is a, c, g, or t
  misc_feature (3459)..(3461): n is a, c, g, or t
  misc_feature (3464)..(3465): n is a, c, g, or t
  misc_feature (3467)..(3468): n is a, c, g, or t
  misc_feature (3471)..(3472): n is a, c, g, or t
  misc_feature (3475)..(3476): n is a, c, g, or t
  misc_feature (3478)..(3478): n is a, c, g, or t
  misc_feature (3483)..(3485): n is a, c, g, or t
  misc_feature (3491)..(3492): n is a, c, g, or t
  misc_feature (3494)..(3497): n is a, c, g, or t
  misc_feature (3499)..(3500): n is a, c, g, or t
  misc_feature (3504)..(3504): n is a, c, g, or t
  misc_feature (3510)..(3510): n is a, c, g, or t
  misc_feature (3512)..(3512): n is a, c, g, or t
  misc_feature (3515)..(3515): n is a, c, g, or t
  misc_feature (3517)..(3517): n is a, c, g, or t
  misc_feature (3521)..(3521): n is a, c, g, or t
  misc_feature (3525)..(3525): n is a, c, g, or t
  misc_feature (3530)..(3530): n is a, c, g, or t
  misc_feature (3532)..(3533): n is a, c, g, or t
  misc_feature (3535)..(3539): n is a, c, g, or t
  misc_feature (3541)..(3541): n is a, c, g, or t
  misc_feature (3543)..(3545): n is a, c, g, or t
  misc_feature (3549)..(3549): n is a, c, g, or t
  misc_feature (3557)..(3557): n is a, c, g, or t
  misc_feature (3561)..(3562): n is a, c, g, or t
  misc_feature (3564)..(3565): n is a, c, g, or t
  misc_feature (3571)..(3573): n is a, c, g, or t
  misc_feature (3579)..(3581): n is a, c, g, or t
  misc_feature (3584)..(3585): n is a, c, g, or t
  misc_feature (3588)..(3589): n is a, c, g, or t
  misc_feature (3593)..(3593): n is a, c, g, or t
  misc_feature (3596)..(3596): n is a, c, g, or t
  misc_feature (3600)..(3601): n is a, c, g, or t
  misc_feature (3607)..(3607): n is a, c, g, or t
  misc_feature (3618)..(3620): n is a, c, g, or t
  misc_feature (3624)..(3625): n is a, c, g, or t
  misc_feature (3635)..(3635): n is a, c, g, or t
  misc_feature (3639)..(3639): n is a, c, g, or t
  misc_feature (3643)..(3643): n is a, c, g, or t
  misc_feature (3647)..(3648): n is a, c, g, or t
  misc_feature (3651)..(3651): n is a, c, g, or t
  misc_feature (3658)..(3658): n is a, c, g, or t
  misc_feature (3664)..(3665): n is a, c, g, or t
  misc_feature (3669)..(3669): n is a, c, g, or t
  misc_feature (3673)..(3673): n is a, c, g, or t
  misc_feature (3675)..(3675): n is a, c, g, or t
  misc_feature (3679)..(3679): n is a, c, g, or t
  misc_feature (3683)..(3684): n is a, c, g, or t
  misc_feature (3690)..(3693): n is a, c, g, or t
  misc_feature (3695)..(3697): n is a, c, g, or t
  misc_feature (3699)..(3699): n is a, c, g, or t
  misc_feature (3704)..(3704): n is a, c, g, or t
  misc_feature (3706)..(3706): n is a, c, g, or t
  misc_feature (3710)..(3710): n is a, c, g, or t
  misc_feature (3712)..(3718): n is a, c, g, or t
  misc_feature (3720)..(3722): n is a, c, g, or t
  misc_feature (3724)..(3724): n is a, c, g, or t
  misc_feature (3726)..(3728): n is a, c, g, or t
  misc_feature (3730)..(3730): n is a, c, g, or t
  misc_feature (3732)..(3732): n is a, c, g, or t
  misc_feature (3734)..(3736): n is a, c, g, or t
  misc_feature (3740)..(3740): n is a, c, g, or t
  misc_feature (3746)..(3747): n is a, c, g, or t
  misc_feature (3751)..(3751): n is a, c, g, or t
  misc_feature (3758)..(3760): n is a, c, g, or t
  misc_feature (3766)..(3766): n is a, c, g, or t
  misc_feature (3772)..(3775): n is a, c, g, or t
  misc_feature (3777)..(3778): n is a, c, g, or t
  misc_feature (3782)..(3782): n is a, c, g, or t
  misc_feature (3785)..(3785): n is a, c, g, or t
  misc_feature (3787)..(3787): n is a, c, g, or t
  misc_feature (3790)..(3790): n is a, c, g, or t
  misc_feature (3796)..(3797): n is a, c, g, or t
  misc_feature (3803)..(3803): n is a, c, g, or t
  misc_feature (3805)..(3805): n is a, c, g, or t
  misc_feature (3808)..(3808): n is a, c, g, or t
  misc_feature (3813)..(3815): n is a, c, g, or t
  misc_feature (3817)..(3822): n is a, c, g, or t
  misc_feature (3824)..(3824): n is a, c, g, or t
  misc_feature (3826)..(3827): n is a, c, g, or t
  misc_feature (3829)..(3829): n is a, c, g, or t
  misc_feature (3836)..(3836): n is a, c, g, or t
  misc_feature (3840)..(3841): n is a, c, g, or t
  misc_feature (3844)..(3845): n is a, c, g, or t
  misc_feature (3847)..(3847): n is a, c, g, or t
  misc_feature (3853)..(3854): n is a, c, g, or t
  misc_feature (3856)..(3856): n is a, c, g, or t
  misc_feature (3859)..(3859): n is a, c, g, or t
  misc_feature (3861)..(3863): n is a, c, g, or t
  misc_feature (3866)..(3866): n is a, c, g, or t
  misc_feature (3868)..(3868): n is a, c, g, or t
  misc_feature (3870)..(3871): n is a, c, g, or t
  misc_feature (3877)..(3877): n is a, c, g, or t
  misc_feature (3881)..(3881): n is a, c, g, or t
  misc_feature (3885)..(3885): n is a, c, g, or t
  misc_feature (3892)..(3892): n is a, c, g, or t
  misc_feature (3895)..(3895): n is a, c, g, or t
  misc_feature (3897)..(3898): n is a, c, g, or t
  misc_feature (3907)..(3908): n is a, c, g, or t
  misc_feature (3910)..(3910): n is a, c, g, or t
  misc_feature (3913)..(3913): n is a, c, g, or t
  misc_feature (3916)..(3916): n is a, c, g, or t
  misc_feature (3923)..(3929): n is a, c, g, or t
  misc_feature (3932)..(3935): n is a, c, g, or t
  misc_feature (3937)..(3937): n is a, c, g, or t
  misc_feature (3942)..(3943): n is a, c, g, or t
  misc_feature (3947)..(3947): n is a, c, g, or t
  misc_feature (3951)..(3952): n is a, c, g, or t
  misc_feature (3954)..(3954): n is a, c, g, or t
  misc_feature (3958)..(3959): n is a, c, g, or t
  misc_feature (3961)..(3966): n is a, c, g, or t
  misc_feature (3969)..(3970): n is a, c, g, or t
  misc_feature (3973)..(3974): n is a, c, g, or t
  misc_feature (3980)..(3980): n is a, c, g, or t
  misc_feature (3985)..(3985): n is a, c, g, or t
  misc_feature (3989)..(3990): n is a, c, g, or t
  misc_feature (3992)..(3993): n is a, c, g, or t
agaaggataagattcaaaagaagaaggcataaaatccaaaatttccttcttttttgaattaactgtaacattacttgatggtgtaatagaagaataattttgattattaattatcggtgaattattattaccagtgttattaatattattgcttttattactattaacaaaattttgaggtatagatgtcatcattttaagatcagtgggaccattaccaaatatatcaaaatcttcttcttctgtttctaaatgtgtttttgtttttgtgttaaaattataattttgattttgaattctattttgatttgtattacgatagtcattattttgatttgttgaaatgaaatttgtatttattagttcaatttgatcttgttgaaaactatttggggaattatccataggacttaaattaatagaatcataaatactataatgttcattttgggtattaggattatttctcatgtctactgtagtatttggatgaagtggctcaactggaggggaatcaaaaatttcttgggatctctgttctgaatttattttagaatctgatatttcctctaaattttcattcaataatactggctctacccaagatgcataataacgtacaacattaggatgacttctaaattttgcaaaatttttaacctcacgaataactcttaaatcatctaacgttaatgtggatttcatattttcaacgatttttttatcatctgatttataataatcattttcctttccctctgaatttaattcattacatccagaactgcaaccactatcatattcttcatttaatttatcttttgtatcaattaaattcatacattctatataatcctgaggatgacattgtaatggaatctttttaattgcatatatttgttcatctaatttattttttgctaaataaacagatccaaaaccacctttaccaatgcattttatttctattatcaaaatataaaaaaaatagatattgttaaatttatttttaatgttaaaactttttaataatacaaataatatatttttttttaaattttttttttacctttaaattcagtttgataacgagatttggaccactccatttcggttaattgtctagtaacatcacgtacactgaccaagtaaattccagtgatatttgttgaacttgtacttatcacatctttattataatagcatgataacgatacatctatctcaagatcatttttctgatcacgtaatgattttcttacacctgtagttataacagacttttcaatatactttgataacgtttcttttttatcatttttaacaattcgaatcgattatattttatttaaaatcaattattgaattattattattagaaatattattaataactattatgaatttaaaatttaaaataattatttcatttcactaaatagtataccttctttatctaaatttagaattggtattaattgtgatatgtttatatgtcctattaattcatctctcgaatattcaaaaagttcctcagcataagaatttacctcaataattactccattttcatctaaaataaataatggatcaacaagactatctaaaatagcttgtgcattagtcgatgaccaaagattttttatagatgattcagatgattcaattagtttttgtgattgaacttgcattttattattattactcttatttaatattatttttacttccaacaacaattacaaatttttattcaaaaatacaatacttttaagtattataatatgatatctattttcaaatttcaatttttaatttttctattttttttggaaatttttttatactattactttcttttcttttttaaataacaaaataaatattcactattatttgtattaatgtatttgtaaaataacattcaatttttggaaatgaaatttaattttcaatttagcattattttatctttttttttttttctgtatttatttatctatttccaaaactaaaaaaataaaataaaataaaataaaataagatatttttctctaatatactttttatgcaattatataaagatatataaaaaattcaattctcgtcttttatatattgtattggttaattataattattttcttaataaaaatatttagatgttttattgaatatgattttgaataaaatattttttttttctttggtctatttttttttaataaaaaagatttttgacggaagttaaattaactatatatgattataatataaaaaaaatatttatataaaatatataataaattaataagaaaaaggttaaaaaaaataggatattaatatacttttttgcttttatgtttattaattatatatcaaataaattattataaaacaaatttaaaaaatatattttaataaattaaattttatataaatactgtatattaaatatactttaaaaaaaataaattaattacaagttatgtgtgatttttttttctccttttatgagtttctttttgatacttttttttttttttttnnntntttaaatttttnanttnnnntnnttnnntnnnttnnnnttntntnnntnntttnntntttaaantntttantttttaaantnannnttnanaaatnnnaaannttnntnnnttttttnanaaaaaannntanttnntnnnaaatnnnanannnntnannnannanatnatnnnnaatnaannnaantnaannaaannnnnnnnnnnaaattnatnntnnttntnannnnttttnntttannnanaanntttnntttnantaannatnnntnnttnanntttnnnnttnnnnnntnnannnnntttntttaanannanttanttnntnnaaannnnntnantnnaannnantnnnaantttnnnnantnntnnnnnaanantttttttantnnnnnnntnnnnntntttntnntnantnntnantnantnnnnntnaannnaannnnnntnnnnnnnaaantnnnaaanntnntnnntttnnnntnannngnnttttntntnatnnannattnnnttnantnntttnntncnttntnatnnnaaaanttttncnttttnttnnnaannantnaaaannnantnnnantnannanaaannnnnannnannnnttnaaannnaaannatnnanannnttngnaaaaaattnntnatnannaatnnnnaanaaaaaaaanttnntnatnaaaaaaaanaaannaanaanggnaaaaaaaanaaaaaaaaaaanaaaanaaaanaaaaaaaaaaaanaaantnaaaaaaanaaaaaaaaaaaatnattnaaaaaaaannatnaannaannnnnnanaaannnaaannaaanaanataananaanatnaaantnaaanatnannanntnntaatttanatnaatnnnntttnttaaaannnttnntttnntnnnatnntnnttnnttnntnttttnnnaaattnntnnnncnntttntttttnantcnantttntttnttttnannannnnnantnnnttanttaaattntttnntnntttaannntttaannnttnnttnntttnttnattnntttttnttttttttttnnntttnnttttttttcnttantttncttnnttntaaaaantttttnnaaantatntnaaantttnntaaaannnnannntnttatntnattnannnnnnntnnnanannntnantnnnaaanaaaatnntttnaattttnnnaaatantttaannnnanntaantantnaanaaaaannaaaaanantanaatannntnnnnnnanannanattatantatnnttnnanaatatnntnaanannnaantnannaaaatnaatnaaantaaaaanttnanntaattttanntnaanttnttttaannnnnnnaannnntntaaannaaanaaannanaaannannnnnnaannaannaaaaanataanaaannannaaaaaaa

SEQ ID NO: 1190 - DNA, 4000 bp, Escherichia coli
  misc_feature (14)..(14): n is a, c, g, or t
  misc_feature (20)..(21): n is a, c, g, or t
  misc_feature (26)..(26): n is a, c, g, or t
  misc_feature (28)..(29): n is a, c, g, or t
  misc_feature (32)..(32): n is a, c, g, or t
  misc_feature (37)..(37): n is a, c, g, or t
  misc_feature (40)..(41): n is a, c, g, or t
  misc_feature (43)..(43): n is a, c, g, or t
  misc_feature (48)..(48): n is a, c, g, or t
  misc_feature (54)..(55): n is a, c, g, or t
  misc_feature (57)..(59): n is a, c, g, or t
  misc_feature (68)..(69): n is a, c, g, or t
  misc_feature (77)..(77): n is a, c, g, or t
  misc_feature (82)..(83): n is a, c, g, or t
  misc_feature (85)..(85): n is a, c, g, or t
  misc_feature (89)..(89): n is a, c, g, or t
  misc_feature (103)..(103): n is a, c, g, or t
  misc_feature (109)..(109): n is a, c, g, or t
  misc_feature (111)..(111): n is a, c, g, or t
  misc_feature (114)..(115): n is a, c, g, or t
  misc_feature (118)..(118): n is a, c, g, or t
  misc_feature (120)..(123): n is a, c, g, or t
  misc_feature (125)..(125): n is a, c, g, or t
  misc_feature (128)..(130): n is a, c, g, or t
  misc_feature (132)..(133): n is a, c, g, or t
  misc_feature (135)..(136): n is a, c, g, or t
  misc_feature (138)..(138): n is a, c, g, or t
  misc_feature (140)..(144): n is a, c, g, or t
  misc_feature (146)..(150): n is a, c, g, or t
  misc_feature (155)..(156): n is a, c, g, or t
  misc_feature (158)..(160): n is a, c, g, or t
  misc_feature (162)..(165): n is a, c, g, or t
  misc_feature (170)..(172): n is a, c, g, or t
  misc_feature (175)..(177): n is a, c, g, or t
  misc_feature (180)..(180): n is a, c, g, or t
  misc_feature (182)..(182): n is a, c, g, or t
  misc_feature (184)..(185): n is a, c, g, or t
  misc_feature (187)..(188): n is a, c, g, or t
  misc_feature (193)..(195): n is a, c, g, or t
  misc_feature (199)..(199): n is a, c, g, or t
  misc_feature (203)..(205): n is a, c, g, or t
  misc_feature (208)..(208): n is a, c, g, or t
  misc_feature (211)..(211): n is a, c, g, or t
  misc_feature (213)..(214): n is a, c, g, or t
  misc_feature (216)..(216): n is a, c, g, or t
  misc_feature (218)..(219): n is a, c, g, or t
  misc_feature (221)..(222): n is a, c, g, or t
  misc_feature (225)..(225): n is a, c, g, or t
  misc_feature (227)..(228): n is a, c, g, or t
  misc_feature (230)..(230): n is a, c, g, or t
  misc_feature (233)..(237): n is a, c, g, or t
  misc_feature (240)..(240): n is a, c, g, or t
  misc_feature (242)..(242): n is a, c, g, or t
  misc_feature (245)..(247): n is a, c, g, or t
  misc_feature (249)..(249): n is a, c, g, or t
  misc_feature (251)..(251): n is a, c, g, or t
  misc_feature (253)..(257): n is a, c, g, or t
  misc_feature (259)..(259): n is a, c, g, or t
  misc_feature (261)..(267): n is a, c, g, or t
  misc_feature (269)..(270): n is a, c, g, or t
  misc_feature (272)..(283): n is a, c, g, or t
  misc_feature (287)..(287): n is a, c, g, or t
  misc_feature (289)..(289): n is a, c, g, or t
  misc_feature (293)..(297): n is a, c, g, or t
  misc_feature (299)..(299): n is a, c, g, or t
  misc_feature (301)..(302): n is a, c, g, or t
  misc_feature (304)..(304): n is a, c, g, or t
  misc_feature (307)..(311): n is a, c, g, or t
  misc_feature (313)..(313): n is a, c, g, or t
  misc_feature (315)..(321): n is a, c, g, or t
  misc_feature (323)..(323): n is a, c, g, or t
  misc_feature (325)..(327): n is a, c, g, or t
  misc_feature (329)..(330): n is a, c, g, or t
  misc_feature (334)..(342): n is a, c, g, or t
  misc_feature (348)..(348): n is a, c, g, or t
  misc_feature (350)..(353): n is a, c, g, or t
  misc_feature (355)..(355): n is a, c, g, or t
  misc_feature (357)..(359): n is a, c, g, or t
  misc_feature (362)..(362): n is a, c, g, or t
  misc_feature (364)..(366): n is a, c, g, or t
  misc_feature (370)..(370): n is a, c, g, or t
  misc_feature (372)..(372): n is a, c, g, or t
  misc_feature (374)..(374): n is a, c, g, or t
  misc_feature (376)..(379): n is a, c, g, or t
  misc_feature (382)..(384): n is a, c, g, or t
  misc_feature (387)..(390): n is a, c, g, or t
  misc_feature (392)..(393): n is a, c, g, or t
  misc_feature (395)..(407): n is a, c, g, or t
  misc_feature (409)..(415): n is a, c, g, or t
  misc_feature (417)..(418): n is a, c, g, or t
  misc_feature (420)..(424): n is a, c, g, or t
  misc_feature (427)..(427): n is a, c, g, or t
  misc_feature (430)..(431): n is a, c, g, or t
  misc_feature (434)..(434): n is a, c, g, or t
  misc_feature (436)..(437): n is a, c, g, or t
  misc_feature (439)..(441): n is a, c, g, or t
  misc_feature (445)..(445): n is a, c, g, or t
  misc_feature (447)..(448): n is a, c, g, or t
  misc_feature (451)..(452): n is a, c, g, or t
  misc_feature (456)..(456): n is a, c, g, or t
  misc_feature (459)..(459): n is a, c, g, or t
  misc_feature (461)..(462): n is a, c, g, or t
  misc_feature (464)..(466): n is a, c, g, or t
  misc_feature (468)..(469): n is a, c, g, or t
  misc_feature (472)..(473): n is a, c, g, or t
  misc_feature (476)..(476): n is a, c, g, or t
  misc_feature (478)..(482): n is a, c, g, or t
  misc_feature (485)..(485): n is a, c, g, or t
  misc_feature (487)..(487): n is a, c, g, or t
  misc_feature (489)..(491): n is a, c, g, or t
  misc_feature (494)..(496): n is a, c, g, or t
  misc_feature (500)..(502): n is a, c, g, or t
  misc_feature (508)..(526): n is a, c, g, or t
  misc_feature (529)..(531): n is a, c, g, or t
  misc_feature (534)..(535): n is a, c, g, or t
  misc_feature (539)..(543): n is a, c, g, or t
  misc_feature (545)..(552): n is a, c, g, or t
  misc_feature (554)..(559): n is a, c, g, or t
  misc_feature (561)..(562): n is a, c, g, or t
  misc_feature (564)..(566): n is a, c, g, or t
  misc_feature (569)..(569): n is a, c, g, or t
  misc_feature (573)..(574): n is a, c, g, or t
  misc_feature (577)..(578): n is a, c, g, or t
  misc_feature (582)..(583): n is a, c, g, or t
  misc_feature (585)..(586): n is a, c, g, or t
  misc_feature (592)..(592): n is a, c, g, or t
  misc_feature (596)..(597): n is a, c, g, or t
  misc_feature (599)..(599): n is a, c, g, or t
  misc_feature (603)..(603): n is a, c, g, or t
  misc_feature (605)..(605): n is a, c, g, or t
  misc_feature (609)..(611): n is a, c, g, or t
  misc_feature (613)..(613): n is a, c, g, or t
  misc_feature (617)..(618): n is a, c, g, or t
  misc_feature (620)..(620): n is a, c, g, or t
  misc_feature (622)..(623): n is a, c, g, or t
  misc_feature (625)..(630): n is a, c, g, or t
  misc_feature (633)..(634): n is a, c, g, or t
  misc_feature (637)..(642): n is a, c, g, or t
  misc_feature (644)..(648): n is a, c, g, or t
  misc_feature (650)..(650): n is a, c, g, or t
  misc_feature (654)..(654): n is a, c, g, or t
  misc_feature (656)..(657): n is a, c, g, or t
  misc_feature (661)..(662): n is a, c, g, or t
  misc_feature (665)..(665): n is a, c, g, or t
  misc_feature (668)..(671): n is a, c, g, or t
  misc_feature (673)..(674): n is a, c, g, or t
  misc_feature (677)..(679): n is a, c, g, or t
  misc_feature (682)..(686): n is a, c, g, or t
  misc_feature (689)..(691): n is a, c, g, or t
  misc_feature (693)..(696): n is a, c, g, or t
  misc_feature (698)..(699): n is a, c, g, or t
  misc_feature (701)..(702): n is a, c, g, or t
  misc_feature (704)..(705): n is a, c, g, or t
  misc_feature (707)..(707): n is a, c, g, or t
  misc_feature (709)..(709): n is a, c, g, or t
  misc_feature (711)..(711): n is a, c, g, or t
  misc_feature (714)..(715): n is a, c, g, or t
  misc_feature (717)..(717): n is a, c, g, or t
  misc_feature (719)..(719): n is a, c, g, or t
  misc_feature (721)..(724): n is a, c, g, or t
  misc_feature (726)..(726): n is a, c, g, or t
  misc_feature (730)..(734): n is a, c, g, or t
  misc_feature (738)..(739): n is a, c, g, or t
  misc_feature (742)..(742): n is a, c, g, or t
  misc_feature (744)..(746): n is a, c, g, or t
  misc_feature (750)..(751): n is a, c, g, or t
  misc_feature (753)..(754): n is a, c, g, or t
  misc_feature (756)..(756): n is a, c, g, or t
  misc_feature (758)..(761): n is a, c, g, or t
  misc_feature (764)..(770): n is a, c, g, or t
  misc_feature (774)..(774): n is a, c, g, or t
  misc_feature (777)..(777): n is a, c, g, or t
  misc_feature (779)..(779): n is a, c, g, or t
  misc_feature (781)..(781): n is a, c, g, or t
  misc_feature (783)..(785): n is a, c, g, or t
  misc_feature (787)..(787): n is a, c, g, or t
  misc_feature (789)..(789): n is a, c, g, or t
  misc_feature (791)..(792): n is a, c, g, or t
  misc_feature (795)..(800): n is a, c, g, or t
  misc_feature (802)..(805): n is a, c, g, or t
  misc_feature (807)..(807): n is a, c, g, or t
  misc_feature (809)..(813): n is a, c, g, or t
  misc_feature (817)..(817): n is a, c, g, or t
  misc_feature (821)..(823): n is a, c, g, or t
  misc_feature (827)..(828): n is a, c, g, or t
  misc_feature (831)..(833): n is a, c, g, or t
  misc_feature (835)..(836): n is a, c, g, or t
  misc_feature (841)..(844): n is a, c, g, or t
  misc_feature (846)..(848): n is a, c, g, or t
  misc_feature (850)..(853): n is a, c, g, or t
  misc_feature (856)..(856): n is a, c, g, or t
  misc_feature (858)..(859): n is a, c, g, or t
  misc_feature (861)..(861): n is a, c, g, or t
  misc_feature (863)..(863): n is a, c, g, or t
  misc_feature (866)..(870): n is a, c, g, or t
  misc_feature (874)..(874): n is a, c, g, or t
  misc_feature (879)..(881): n is a, c, g, or t
  misc_feature (883)..(883): n is a, c, g, or t
  misc_feature (885)..(886): n is a, c, g, or t
  misc_feature (889)..(893): n is a, c, g, or t
  misc_feature (896)..(896): n is a, c, g, or t
  misc_feature (899)..(900): n is a, c, g, or t
  misc_feature (903)..(903): n is a, c, g, or t
  misc_feature (906)..(906): n is a, c, g, or t
  misc_feature (910)..(912): n is a, c, g, or t
  misc_feature (914)..(916): n is a, c, g, or t
  misc_feature (918)..(919): n is a, c, g, or t
  misc_feature (924)..(926): n is a, c, g, or t
  misc_feature (929)..(935): n is a, c, g, or t
  misc_feature (939)..(939): n is a, c, g, or t
  misc_feature (942)..(942): n is a, c, g, or t
  misc_feature (945)..(946): n is a, c, g, or t
  misc_feature (949)..(950): n is a, c, g, or t
  misc_feature (952)..(952): n is a, c, g, or t
  misc_feature (954)..(955): n is a, c, g, or t
  misc_feature (959)..(963): n is a, c, g, or t
  misc_feature (966)..(966): n is a, c, g, or t
  misc_feature (969)..(969): n is a, c, g, or t
  misc_feature (971)..(971): n is a, c, g, or t
  misc_feature (974)..(978): n is a, c, g, or t
  misc_feature (982)..(982): n is a, c, g, or t
  misc_feature (985)..(985): n is a, c, g, or t
  misc_feature (988)..(988): n is a, c, g, or t
  misc_feature (990)..(990): n is a, c, g, or t
  misc_feature (992)..(1001): n is a, c, g, or t
  misc_feature (1003)..(1008): n is a, c, g, or t
  misc_feature (1010)..(1010): n is a, c, g, or t
  misc_feature (1013)..(1018): n is a, c, g, or t
  misc_feature (1020)..(1021): n is a, c, g, or t
  misc_feature (1023)..(1025): n is a, c, g, or t
  misc_feature (1028)..(1030): n is a, c, g, or t
  misc_feature (1033)..(1035): n is a, c, g, or t
  misc_feature (1038)..(1040): n is a, c, g, or t
  misc_feature (1042)..(1044): n is a, c, g, or t
  misc_feature (1046)..(1047): n is a, c, g, or t
  misc_feature (1050)..(1050): n is a, c, g, or t
  misc_feature (1052)..(1054): n is a, c, g, or t
  misc_feature (1056)..(1058): n is a, c, g, or t
  misc_feature (1060)..(1066): n is a, c, g, or t
  misc_feature (1068)..(1068): n is a, c, g, or t
  misc_feature (1070)..(1071): n is a, c, g, or t
  misc_feature (1074)..(1076): n is a, c, g, or t
  misc_feature (1080)..(1083): n is a, c, g, or t
  misc_feature (1085)..(1086): n is a, c, g, or t
  misc_feature (1088)..(1097): n is a, c, g, or t
  misc_feature (1099)..(1102): n is a, c, g, or t
  misc_feature (1104)..(1107): n is a, c, g, or t
  misc_feature (1109)..(1109): n is a, c, g, or t
  misc_feature (1111)..(1115): n is a, c, g, or t
  misc_feature (1117)..(1123): n is a, c, g, or t
  misc_feature (1125)..(1125): n is a, c, g, or t
  misc_feature (1127)..(1127): n is a, c, g, or t
  misc_feature (1129)..(1133): n is a, c, g, or t
  misc_feature (1138)..(1143): n is a, c, g, or t
  misc_feature (1145)..(1145): n is a, c, g, or t
  misc_feature (1147)..(1147): n is a, c, g, or t
  misc_feature (1150)..(1151): n is a, c, g, or t
  misc_feature (1153)..(1156): n is a, c, g, or t
  misc_feature (1158)..(1158): n is a, c, g, or t
  misc_feature (1160)..(1161): n is a, c, g, or t
  misc_feature (1164)..(1164): n is a, c, g, or t
  misc_feature (1166)..(1166): n is a, c, g, or t
  misc_feature (1168)..(1168): n is a, c, g, or t
  misc_feature (1171)..(1172): n is a, c, g, or t
  misc_feature (1175)..(1176): n is a, c, g, or t
  misc_feature (1180)..(1181): n is a, c, g, or t
  misc_feature (1184)..(1184): n is a, c, g, or t
  misc_feature (1186)..(1186): n is a, c, g, or t
  misc_feature (1188)..(1188): n is a, c, g, or t
  misc_feature (1191)..(1192): n is a, c, g, or t
  misc_feature (1194)..(1197): n is a, c, g, or t
  misc_feature (1201)..(1202): n is a, c, g, or t
  misc_feature (1204)..(1204): n is a, c, g, or t
  misc_feature (1206)..(1206): n is a, c, g, or t
  misc_feature (1211)..(1211): n is a, c, g, or t
  misc_feature (1213)..(1214): n is a, c, g, or t
  misc_feature (1216)..(1216): n is a, c, g, or t
  misc_feature (1218)..(1219): n is a, c, g, or t
  misc_feature (1221)..(1221): n is a, c, g, or t
  misc_feature (1229)..(1230): n is a, c, g, or t
  misc_feature (1232)..(1232): n is a, c, g, or t
  misc_feature (1234)..(1234): n is a, c, g, or t
  misc_feature (1237)..(1237): n is a, c, g, or t
  misc_feature (1242)..(1244): n is a, c, g, or t
  misc_feature (1247)..(1247): n is a, c, g, or t
  misc_feature (1251)..(1252): n is a, c, g, or t
  misc_feature (1255)..(1256): n is a, c, g, or t
  misc_feature (1258)..(1258): n is a, c, g, or t
  misc_feature (1260)..(1260): n is a, c, g, or t
  misc_feature (1264)..(1265): n is a, c, g, or t
  misc_feature (1269)..(1269): n is a, c, g, or t
  misc_feature (1271)..(1271): n is a, c, g, or t
  misc_feature (1274)..(1276): n is a, c, g, or t
  misc_feature (1280)..(1280): n is a, c, g, or t
  misc_feature (1282)..(1284): n is a, c, g, or t
  misc_feature (1286)..(1286): n is a, c, g, or t
  misc_feature (1288)..(1288): n is a, c, g, or t
  misc_feature (1290)..(1290): n is a, c, g, or t
  misc_feature (1294)..(1297): n is a, c, g, or t
  misc_feature (1299)..(1306): n is a, c, g, or t
  misc_feature (1349)..(1349): n is a, c, g, or t
  misc_feature (1548)..(1548): n is a, c, g, or t
  misc_feature (1819)..(1819): n is a, c, g, or t
  misc_feature (1822)..(1823): n is a, c, g, or t
  misc_feature (1987)..(1987): n is a, c, g, or t
  misc_feature (1989)..(1989): n is a, c, g, or t
  misc_feature (2017)..(2017): n is a, c, g, or t
  misc_feature (2027)..(2027): n is a, c, g, or t
  misc_feature (2065)..(2065): n is a, c, g, or t
  misc_feature (2724)..(2724): n is a, c, g, or t
  misc_feature (2833)..(2833): n is a, c, g, or t
  misc_feature (3139)..(3145): n is a, c, g, or t
  misc_feature (3149)..(3149): n is a, c, g, or t
  misc_feature (3153)..(3158): n is a, c, g, or t
  misc_feature (3167)..(3167): n is a, c, g, or t
  misc_feature (3174)..(3174): n is a, c, g, or t
  misc_feature (3181)..(3182): n is a, c, g, or t
  misc_feature (3184)..(3187): n is a, c, g, or t
  misc_feature (3189)..(3189): n is a, c, g, or t
  misc_feature (3192)..(3193): n is a, c, g, or t
  misc_feature (3195)..(3197): n is a, c, g, or t
  misc_feature (3201)..(3202): n is a, c, g, or t
  misc_feature (3208)..(3208): n is a, c, g, or t
  misc_feature (3214)..(3214): n is a, c, g, or t
  misc_feature (3218)..(3223): n is a, c, g, or t
  misc_feature (3228)..(3229): n is a, c, g, or t
  misc_feature (3233)..(3233): n is a, c, g, or t
  misc_feature (3238)..(3238): n is a, c, g, or t
  misc_feature (3244)..(3244): n is a, c, g, or t
  misc_feature (3247)..(3247): n is a, c, g, or t
  misc_feature (3249)..(3249): n is a, c, g, or t
  misc_feature (3253)..(3255): n is a, c, g, or t
  misc_feature (3259)..(3260): n is a, c, g, or t
  misc_feature (3263)..(3270): n is a, c, g, or t
  misc_feature (3272)..(3273): n is a, c, g, or t
  misc_feature (3277)..(3277): n is a, c, g, or t
  misc_feature (3279)..(3281): n is a, c, g, or t
  misc_feature (3283)..(3283): n is a, c, g, or t
  misc_feature (3285)..(3285): n is a, c, g, or t
  misc_feature (3289)..(3289): n is a, c, g, or t
  misc_feature (3292)..(3292): n is a, c, g, or t
  misc_feature (3296)..(3296): n is a, c, g, or t
  misc_feature (3298)..(3299): n is a, c, g, or t
  misc_feature (3302)..(3303): n is a, c, g, or t
  misc_feature (3307)..(3307): n is a, c, g, or t
  misc_feature (3310)..(3310): n is a, c, g, or t
  misc_feature (3314)..(3314): n is a, c, g, or t
  misc_feature (3319)..(3319): n is a, c, g, or t
  misc_feature (3324)..(3325): n is a, c, g, or t
  misc_feature (3328)..(3328): n is a, c, g, or t
  misc_feature (3334)..(3335): n is a, c, g, or t
  misc_feature (3339)..(3339): n is a, c, g, or t
  misc_feature (3347)..(3347): n is a, c, g, or t
  misc_feature (3349)..(3350): n is a, c, g, or t
  misc_feature (3352)..(3353): n is a, c, g, or t
  misc_feature (3356)..(3357): n is a, c, g, or t
  misc_feature (3360)..(3360): n is a, c, g, or t
  misc_feature (3362)..(3372): n is a, c, g, or t
  misc_feature (3383)..(3383): n is a, c, g, or t
  misc_feature (3385)..(3387): n is a, c, g, or t
  misc_feature (3391)..(3391): n is a, c, g, or t
  misc_feature (3400)..(3401): n is a, c, g, or t
  misc_feature (3405)..(3406): n is a, c, g, or t
  misc_feature (3410)..(3413): n is a, c, g, or t
  misc_feature (3420)..(3420): n is a, c, g, or t
  misc_feature (3423)..(3424): n is a, c, g, or t
  misc_feature (3427)..(3427): n is a, c, g, or t
  misc_feature (3429)..(3429): n is a, c, g, or t
  misc_feature (3434)..(3436): n is a, c, g, or t
  misc_feature (3438)..(3439): n is a, c, g, or t
  misc_feature (3441)..(3444): n is a, c, g, or t
  misc_feature (3446)..(3446): n is a, c, g, or t
  misc_feature (3448)..(3449): n is a, c, g, or t
  misc_feature (3451)..(3451): n is a, c, g, or t
  misc_feature (3453)..(3453): n is a, c, g, or t
  misc_feature (3455)..(3456): n is a, c, g, or t
  misc_feature (3460)..(3460): n is a, c, g, or t
  misc_feature (3463)..(3463): n is a, c, g, or t
  misc_feature (3465)..(3467): n is a, c, g, or t
  misc_feature (3471)..(3473): n is a, c, g, or t
  misc_feature (3475)..(3475): n is a, c, g, or t
  misc_feature (3477)..(3479): n is a, c, g, or t
  misc_feature (3482)..(3482): n is a, c, g, or t
  misc_feature (3484)..(3484): n is a, c, g, or t
  misc_feature (3486)..(3491): n is a, c, g, or t
  misc_feature (3497)..(3500): n is a, c, g, or t
  misc_feature (3503)..(3503): n is a, c, g, or t
  misc_feature (3505)..(3505): n is a, c, g, or t
  misc_feature (3507)..(3507): n is a, c, g, or t
  misc_feature (3512)..(3515): n is a, c, g, or t
  misc_feature (3524)..(3524): n is a, c, g, or t
  misc_feature (3526)..(3526): n is a, c, g, or t
  misc_feature (3528)..(3529): n is a, c, g, or t
  misc_feature (3531)..(3531): n is a, c, g, or t
  misc_feature (3533)..(3533): n is a, c, g, or t
  misc_feature (3538)..(3538): n is a, c, g, or t
  misc_feature (3541)..(3543): n is a, c, g, or t
  misc_feature (3545)..(3546): n is a, c, g, or t
  misc_feature (3550)..(3550): n is a, c, g, or t
  misc_feature (3553)..(3553): n is a, c, g, or t
  misc_feature (3559)..(3560): n is a, c, g, or t
  misc_feature (3569)..(3570): n is a, c, g, or t
  misc_feature (3572)..(3572): n is a, c, g, or t
  misc_feature (3574)..(3575): n is a, c, g, or t
  misc_feature (3579)..(3580): n is a, c, g, or t
  misc_feature (3590)..(3590): n is a, c, g, or t
  misc_feature (3595)..(3595): n is a, c, g, or t
  misc_feature (3598)..(3599): n is a, c, g, or t
  misc_feature (3603)..(3603): n is a, c, g, or t
  misc_feature (3606)..(3607): n is a, c, g, or t
  misc_feature (3609)..(3609): n is a, c, g, or t
  misc_feature (3614)..(3614): n is a, c, g, or t
  misc_feature (3616)..(3616): n is a, c, g, or t
  misc_feature (3618)..(3619): n is a, c, g, or t
  misc_feature (3622)..(3623): n is a, c, g, or t
  misc_feature (3628)..(3630): n is a, c, g, or t
  misc_feature (3633)..(3633): n is a, c, g, or t
  misc_feature (3636)..(3637): n is a, c, g, or t
  misc_feature (3639)..(3639): n is a, c, g, or t
  misc_feature (3648)..(3648): n is a, c, g, or t
  misc_feature (3650)..(3650): n is a, c, g, or t
  misc_feature (3652)..(3652): n is a, c, g, or t
  misc_feature (3659)..(3659): n is a, c, g, or t
  misc_feature (3661)..(3663): n is a, c, g, or t
  misc_feature (3666)..(3666): n is a, c, g, or t
  misc_feature (3669)..(3669): n is a, c, g, or t
  misc_feature (3672)..(3672): n is a, c, g, or t
  misc_feature (3674)..(3674): n is a, c, g, or t
  misc_feature (3676)..(3676): n is a, c, g, or t
  misc_feature (3678)..(3678): n is a, c, g, or t
  misc_feature (3682)..(3682): n is a, c, g, or t
  misc_feature (3684)..(3684): n is a, c, g, or t
  misc_feature (3687)..(3688): n is a, c, g, or t
  misc_feature (3690)..(3693): n is a, c, g, or t
  misc_feature (3700)..(3701): n is a, c, g, or t
  misc_feature (3704)..(3705): n is a, c, g, or t
  misc_feature (3707)..(3707): n is a, c, g, or t
  misc_feature (3709)..(3709): n is a, c, g, or t
  misc_feature (3711)..(3711): n is a, c, g, or t
  misc_feature (3713)..(3713): n is a, c, g, or t
  misc_feature (3715)..(3716): n is a, c, g, or t
  misc_feature (3720)..(3720): n is a, c, g, or t
  misc_feature (3725)..(3726): n is a, c, g, or t
  misc_feature (3730)..(3732): n is a, c, g, or t
  misc_feature (3735)..(3735): n is a, c, g, or t
  misc_feature (3737)..(3739): n is a, c, g, or t
  misc_feature (3741)..(3741): n is a, c, g, or t
  misc_feature (3743)..(3743): n is a, c, g, or t
  misc_feature (3747)..(3747): n is a, c, g, or t
  misc_feature (3750)..(3750): n is a, c, g, or t
  misc_feature (3756)..(3756): n is a, c, g, or t
  misc_feature (3762)..(3762): n is a, c, g, or t
  misc_feature (3768)..(3768): n is a, c, g, or t
  misc_feature (3774)..(3775): n is a, c, g, or t
  misc_feature (3777)..(3777): n is a, c, g, or t
  misc_feature (3783)..(3783): n is a, c, g, or t
  misc_feature (3790)..(3791): n is a, c, g, or t
  misc_feature (3793)..(3794): n is a, c, g, or t
  misc_feature (3797)..(3798): n is a, c, g, or t
  misc_feature (3800)..(3801): n is a, c, g, or t
  misc_feature (3803)..(3803): n is a, c, g, or t
  misc_feature (3805)..(3805): n is a, c, g, or t
  misc_feature (3809)..(3810): n is a, c, g, or t
  misc_feature (3812)..(3812): n is a, c, g, or t
  misc_feature (3817)..(3817): n is a, c, g, or t
  misc_feature (3820)..(3821): n is a, c, g, or t
  misc_feature (3823)..(3823): n is a, c, g, or t
  misc_feature (3826)..(3826): n is a, c, g, or t
  misc_feature (3829)..(3829): n is a, c, g, or t
  misc_feature (3831)..(3832): n is a, c, g, or t
  misc_feature (3837)..(3837): n is a, c, g, or t
  misc_feature (3843)..(3844): n is a, c, g, or t
  misc_feature (3848)..(3849): n is a, c, g, or t
  misc_feature (3852)..(3852): n is a, c, g, or t
  misc_feature (3854)..(3856): n is a, c, g, or t
  misc_feature (3859)..(3859): n is a, c, g, or t
  misc_feature (3862)..(3864): n is a, c, g, or t
  misc_feature (3866)..(3867): n is a, c, g, or t
  misc_feature (3871)..(3872): n is a, c, g, or t
  misc_feature (3876)..(3876): n is a, c, g, or t
  misc_feature (3881)..(3884): n is a, c, g, or t
  misc_feature (3888)..(3888): n is a, c, g, or t
  misc_feature (3891)..(3895): n is a, c, g, or t
  misc_feature (3897)..(3900): n is a, c, g, or t
  misc_feature (3903)..(3903): n is a, c, g, or t
  misc_feature (3905)..(3908): n is a, c, g, or t
  misc_feature (3911)..(3915): n is a, c, g, or t
  misc_feature (3918)..(3923): n is a, c, g, or t
  misc_feature (3925)..(3925): n is a, c, g, or t
  misc_feature (3927)..(3927): n is a, c, g, or t
  misc_feature (3929)..(3929): n is a, c, g, or t
  misc_feature (3932)..(3932): n is a, c, g, or t
  misc_feature (3934)..(3934): n is a, c, g, or t
  misc_feature (3940)..(3940): n is a, c, g, or t
  misc_feature (3943)..(3943): n is a, c, g, or t
  misc_feature (3946)..(3946): n is a, c, g, or t
  misc_feature (3950)..(3952): n is a, c, g, or t
  misc_feature (3954)..(3956): n is a, c, g, or t
  misc_feature (3958)..(3958): n is a, c, g, or t
  misc_feature (3960)..(3961): n is a, c, g, or t
  misc_feature (3963)..(3963): n is a, c, g, or t
  misc_feature (3965)..(3968): n is a, c, g, or t
  misc_feature (3971)..(3975): n is a, c, g, or t
  misc_feature (3977)..(3977): n is a, c, g, or t
  misc_feature (3979)..(3979): n is a, c, g, or t
  misc_feature (3984)..(3988): n is a, c, g, or t
  misc_feature (3991)..(3991): n is a, c, g, or t
  misc_feature (3994)..(4000): n is a, c, g, or t
ttcattttcatatntaatannaaagntnnacnattgnaannantttgntgattnnannnaaaacgaannagcaaaangtttnntncaanttcatatataatangaaaantnaannaanannnnantgnnntnnanntnannnnnannnnnaaatnnannnannnnatctnnnttnnnatntntnntnnaattnnnaggnaaannnaanagntnnanannannaangnnanaannnnnaananaannnantnannnnntntnnnnnnnanntnnnnnnnnnnnnagananatannnnncnannanaannnnnanannnnnnnanannnannagtnnnnnnnnntctggntnnnnanannntcnannnaaanananannnnaannnaannnnannannnnnnnnnnnnntnnnnnnntnnannnnnatntanntantnnannnaatnannaannaaanganannannnannaannaanannnnnttngntnnnaannnaatnnncaaaannnnnnnnnnnnnnnnnnntannntannaaannnnntnnnnnnnnannnnnnanntnnntcnatannaanngaannannaaaatntttnntncacntncatnnntnatannananngnnnnnnttnnaannnnnnannnnntncganannaaannaancannnnanngtnnnctnnnnnttnnngnnnnanntnnannantntntanntngntnnnncngatnnnnnattnnttntnnngatnngnntngnnnntgnnnnnnnttgnttntngngnnngntntnntgnnnnnntnnnngntnnnnnagtntgannntgtnntannnanntgttnnnnannntnnnntananngnanatnnnnnaaanaaaannntnannaannnnnttngtnnacnttncaannnannntnnatatnnnatnnnnnnnaaanacnaannaannanannaaannnnnaanatnanaannnnnaaanaantgnangnnnnnnnnnntnnnnnnanttnnnnnnannannnatnnntannnatnnntnnntnnttntnnntnnntnnnnnnntntnnatnnnttgnnnntnnannnnnnnnnnannnntnnnntnannnnngnnnnnnntntntnnnnntgatnnnnnntngnttnntnnnntntnnatnananaannaanntatnnatntntntanntnnnnatanntntntaaanannantnntnataatganntnanttnatttnnnttnttgnnaannananatgnntatntntannntttntnnntntntntatnnnntnnnnnnnnataacgaagctttccgattgatcttgtcggtggctttcctttntcttgaagattaagccatgcatgtctaagtatgaactggtttaaggtgaaactgcgtacggctcattacatcagctataactttctttgatcataaattctaaatggaataaccgaggaaaagcctgggctaatacatgcgacaattccggtagcaatatcggaatgcttttattagatcaaaaccttctagttctttnaccggaactgtttgttggtgactctaaataactttgtgttgatcgtatgacctttgtgtcgacgacatatctttcaagtgtctgacttatcaactttagacggtacattatatgtctaccgtggttgtaacgagtacagagaatcagggtttggttctggagaggccgcctgagaaacggcgaccacttccaaggaaggcagcaggcgcgcaaattacccactctcaaaacgaggaggtagtgaagagaaataacgatgttagtctattanagnntgacaatcggaatgggaacactgtaaacaggttatcgattaacaattggagggcaagtctggtgccagcagccgcggtaattccagctccaataaggaaaactaaagttgctgtgtttaaaaagctcgtagttgaatttcgggtatttgttgctagctggtctnantggccatgttggttaacagatcctcatntgctggacgnctggcgatgatctttatcggttgtcgtcagttgccagnacgtttactttgagaaaattagagtgctaaaagcaggctcacgcctatatatattgcatggaataatgaaataagatctcgattttatttcgttggttttagaaattgagataatgattaataggatcagaggggggcgtacgtactgtggtgtgagaggtgaaattcttggatcgccacaggacgaacagcagcgaaggcgttcgccaagaatgttttcattaatcaagaacgaaagtttgaggttcgaagacgattagataccgtcctagttcaaaccataaacgttgccaactgtcttttagatgcggttatttatatgactcatctggcggatctcgagaaatctaagtttttaggttccgggggaagtatggttgcaaagctgaaacttaaaagaattgacggaaggacacacaagaagtggagcctgtggcctaatttgactcaacacgggaaaccttactcggccaggacacttttaggattgacagattgagagctctttcttgattaggtgggtggtggtgcatggtcgttcgtagttcgtggagcgatttgtctgattaatttcgataacgaacgagactccggcttactaaatagtctaaagttcgaagggacttttcaagacttcttagcaggataagtggcacttnttaagccacacgaaatggagcaataacaggtctgtgatgcccttagatgtccgaggctgcacgcgcgctacactggagagttcagaatgtttcttcctacttcgacagnagtgggtaaccatgaaattctcttcgtgactgggatcggagcttgcaattattctccgtcaacgaggaattcctagtaagcactatttcatcagaatgtgctgattatgtccctgtcctttgtacacaccgcccgtcgctactaccgattgaatgttttagtgagatcttcggcttggttttccgagcggctctcgggtcgttcggtttatatcgaaaagatgctcaaactggatcatttagaggaagtaaaagtcgtaacaaggtattcgtaggtgaacctgcgtatggatcattaccgtttttnnnnnnnattnatcnnnnnnaaaataaanaaaaacntttaacnncnnnnantcnnannnattnntatatntgtttntgtnnnnnnattanntatntaaanaaatcntananatannntttnnttnnnnnnnntnnattnannnantnattnttntttntnnttnnattntgnatcnaatcnataanntanaattanntaanaataattntnnanngtnnatnannnnnnnnnnnattcgatgaanannncagnaaagtgcgnnaaannaatnnnnattgcanganncantnagcannnannannnnancnnancnannagcnaanannnttgnnnangnnnaantngnnnnnntcttgnnnntanancntcaannnnatttatttntnannantnaatgnatnnntnncaanttnaataannaattatttnncntnnaatnnatatataaanaatanatnnattngtnnangtatnanannaanntatannnaanatnnanatatttatntntntaaattntnnnaanatnagnantntntatnanatnntnnnnattgatnnatnnanananantnnattnaatannttannnatntnnntntntaanatnatatanatatcnttcttnactctnntntatatntatatanntnnaanntnnantnaaannanaatanttnntnaanttnannatatnaataannaaannaanannnatnaannnannttgnnttantaatnnnnaatnaannnnnannnnctnannnntgnnnnntgnnnnnntnantnttnanatgcantgnagnattnnngnnnantnntntnnnntgnnnnntngngtgannnnnttngannnnnnn

SEQ ID NO: 1191 - DNA, 4000 bp, Escherichia coli
  misc_feature (1)..(1): n is a, c, g, or t
  misc_feature (5)..(5): n is a, c, g, or t
  misc_feature (7)..(7): n is a, c, g, or t
  misc_feature (13)..(13): n is a, c, g, or t
  misc_feature (17)..(18): n is a, c, g, or t
  misc_feature (23)..(23): n is a, c, g, or t
  misc_feature (26)..(26): n is a, c, g, or t
  misc_feature (29)..(29): n is a, c, g, or t
  misc_feature (34)..(34): n is a, c, g, or t
  misc_feature (40)..(40): n is a, c, g, or t
  misc_feature (43)..(43): n is a, c, g, or t
  misc_feature (48)..(51): n is a, c, g, or t
  misc_feature (59)..(59): n is a, c, g, or t
  misc_feature (66)..(66): n is a, c, g, or t
  misc_feature (71)..(71): n is a, c, g, or t
  misc_feature (73)..(74): n is a, c, g, or t
  misc_feature (76)..(76): n is a, c, g, or t
  misc_feature (79)..(79): n is a, c, g, or t
  misc_feature (84)..(85): n is a, c, g, or t
  misc_feature (91)..(93): n is a, c, g, or t
  misc_feature (107)..(108): n is a, c, g, or t
  misc_feature (112)..(112): n is a, c, g, or t
  misc_feature (116)..(116): n is a, c, g, or t
  misc_feature (119)..(119): n is a, c, g, or t
  misc_feature (125)..(125): n is a, c, g, or t
  misc_feature (134)..(137): n is a, c, g, or t
  misc_feature (139)..(139): n is a, c, g, or t
  misc_feature (150)..(150): n is a, c, g, or t
  misc_feature (153)..(153): n is a, c, g, or t
  misc_feature (161)..(165): n is a, c, g, or t
  misc_feature (168)..(174): n is a, c, g, or t
  misc_feature (179)..(182): n is a, c, g, or t
  misc_feature (189)..(189): n is a, c, g, or t
  misc_feature (194)..(196): n is a, c, g, or t
  misc_feature (200)..(202): n is a, c, g, or t
  misc_feature (204)..(208): n is a, c, g, or t
  misc_feature (211)..(211): n is a, c, g, or t
  misc_feature (215)..(215): n is a, c, g, or t
  misc_feature (217)..(217): n is a, c, g, or t
  misc_feature (224)..(225): n is a, c, g, or t
  misc_feature (228)..(228): n is a, c, g, or t
  misc_feature (232)..(235): n is a, c, g, or t
  misc_feature (237)..(238): n is a, c, g, or t
  misc_feature (245)..(245): n is a, c, g, or t
  misc_feature (251)..(252): n is a, c, g, or t
  misc_feature (255)..(257): n is a, c, g, or t
  misc_feature (259)..(261): n is a, c, g, or t
  misc_feature (266)..(272): n is a, c, g, or t
  misc_feature (275)..(281): n is a, c, g, or t
  misc_feature (283)..(283): n is a, c, g, or t
  misc_feature (287)..(289): n is a, c, g, or t
  misc_feature (297)..(297): n is a, c, g, or t
  misc_feature (303)..(303): n is a, c, g, or t
  misc_feature (309)..(311): n is a, c, g, or t
  misc_feature (314)..(315): n is a, c, g, or t
  misc_feature (319)..(319): n is a, c, g, or t
  misc_feature (321)..(322): n is a, c, g, or t
  misc_feature (325)..(327): n is a, c, g, or t
  misc_feature (329)..(332): n is a, c, g, or t
  misc_feature (337)..(337): n is a, c, g, or t
  misc_feature (359)..(359): n is a, c, g, or t
  misc_feature (629)..(629): n is a, c, g, or t
  misc_feature (1039)..(1039): n is a, c, g, or t
  misc_feature (1538)..(1538): n is a, c, g, or t
  misc_feature (1739)..(1739): n is a, c, g, or t
  misc_feature (1748)..(1748): n is a, c, g, or t
  misc_feature (1752)..(1752): n is a, c, g, or t
  misc_feature (1804)..(1804): n is a, c, g, or t
  misc_feature (1835)..(1835): n is a, c, g, or t
  misc_feature (1931)..(1931): n is a, c, g, or t
  misc_feature (1988)..(1988): n is a, c, g, or t
  misc_feature (2741)..(2741): n is a, c, g, or t
  misc_feature (3359)..(3359): n is a, c, g, or t
  misc_feature (3697)..(3697): n is a, c, g, or t
  misc_feature (3920)..(3920): n is a, c, g, or t
  misc_feature (3929)..(3929): n is a, c, g, or t
  misc_feature (3968)..(3968): n is a, c, g, or t
naatntntttttntttnnaaaanagnttnctctnataccnttntttcnnnntttttagncgccaanaaggngnntnttngctgnnaaaagnnnttagaaaagaaggnnaaancttntantttaangaaaaaaannnntnaggaagaaagnttnttaaaggnnnnnaannnnnnnttttnnnnggttttnggttnnnaaannnannnnnttnccancnaaaaccnnttnaatnnnntnnaaaaagnaaattnnttnnntnnnaaaannnnnnnaannnnnnnanaaannntttaattnaaaaanaaaaannnagnnaacnannccnnnannnnttaanactcgagatctcgatggcatcnaactgaagagcaattgctatcaatgttgcaaaacaaagaggcttgttcgcaggacaactcgcaagagatgaacccttaggttcggtgttcagaaggcatttaacatatcatgttaaacaccgaaagcggcattttccacctcggaacttgtcgctttcatcctttgagggtatgccaactgccttgccacctcattcttctttcgtggcaatgctttttctcttaggatgcaaaccatttgtttctttcttttgattgaagcttaacccnttttcaaccactttttaattcgcttagaaagtgcgtttttgataatcgaaaaattacctctttgcaagttcaaccacaattcttctaagctgtatttcaccttaattgcagggttgttccatgcgttcatgcgataaattcggtctttatatgcagtgtgctcaatgatgtattgggggtgattgtcgaagctcttgggctcgaatcgttgcatggtgaacatctttctaatgccctttggcaaggtgttggttgagcctgtgaagtgcgttgagtcgcttgttacaccgatgttgttcaccaaattgaaggtaggcataatggctaagccgttgttgagcaacatagatgcccagaaaatagtttcgtagtgcgccttacctgtttgcttatggcggtggcacatggcnaagaaatcgttgcgaacattgcgctctttcaccaaattggtgagcaaagtaagcgtctctttattgtctaaaaaggtgtaatgttcgtcccattggtcgataactcgacgccaagaagcccatccccagatagagaatacagacgtaaagaaatagtcttgcgatatatcttcggtcttttcttcagcattaaagcctgcaatcatccacactcgagggtcgttttcatacttatcgagcatgcttttacaaaaatgaaagaatgccaatgagggcacatcatcgtcttctatcacgatgcatttgtctacaaacgagaacgcccaacgctgtgcaatgaactcagaagggtcgcaaccatagttcttttcttgataaagttggtgcacttcgcactcccaatcaatctcactcgcaatgcttctgcatgcttcaatgccctcaatgtcgcccgaatggcgtgctccgtcttgataaaggaacagctttgagggcttgnctttctgcacttgtgcaaacacttctttaaacttttcggggcgattaaagaagatgagtaatacggctacgtcgatttgtgagctttctttcatttcactttgaatctgattgttctatgcaaagataggaatgtttgcctaattatgaaaggtttttcagtctctttttgccccatctctattgaaatgaaaccgaagtngaatgcccntgcnaatcaacaagatagaaatgtcgaaataaaatcaatgcttttagcacgcaatntcaatgctattaaggtgcaaaagcaatgctnttaccatgcaaaaacatagcttttattttgtagttttatggcactctttttgtagatagataaaagtaaaggcacaaaaaaacaaaaatagtgatnttaatagatggtggaacaaataaaaagattaactttgcatagaactatatggtgctntgaaaataatcaatgcaccgccttttgcgtgccaaagtgcacaacggatatggcaaagccattgaggttgatttgcaaagagttagtaaacgaaacaagaaaacaaataaataaaatacgatttataaacaattatggataaacttagctatgctttaggccttggaataggtcgacaattggctcaaatgggtgccgaacaacttagtattgatgattttgcacaagcaattaaagatgttgtggcaggtggacaacttaaactagacgaggctgaagcacaagttatcgttcaagaattcttccaaaaacaagaagaaaagcaacgtgctgcagctgcagaaatgggtaaaaaagctaaagaagaaggcgagaaataccttgcagaaaacgcaaagaaagaaggagttgttactcttccaagtggcttgcaatatcttgttatcaaagaaggaaacggcaaacgccctaaagctaccgacaaagtgaagtgccattacgaaggaatgcttgttgatggaacactctttgacagctcagttcaacgtggtgaaccagctactttcccactaaatcaagtgattgcaggctggactgaaggtctacaattgatgacagaaggttctaaataccgcttcttcattccttatactcttggttatggcgagagaggtgcaggcgcttctattcctcctttcgctgcattggtgttcgatgtagagcttatcgaggttcaataatcgccccactgcnataaaagagcattttacaaagaaaataaaagcaataaactataaaaaacaaatagatcaaaatgaaaaaaattacattagctgcagcagctgtatttgcagccattgcattctcagcatgtggtaattcaactcctaaagctgaccttaaaactgacgtagacacattgagttacgctatgggtgttgctcaaacaggtgactttaagaacgttctttctgaaagaatgggtgtagataccacttatatcaacgagtttattaagggtgttagcgatggtgctaactctggagacgataagaaaaaggctgcatattatgcaggtttgcaagtaggacagaaccttggtggacgctatgttaaagacattagcagccaattgttcggtggtgatagcacaaagactatctctttgaagaactttatcgcaggtttcatcaacggagcaacaggtaaaaacgaaataatggacgctcaacgtgctggcgaagtggctgaacgtttgttcaaaaagatccaaggcgaaagcaatgaaaagcaattctctgctaacaaaaaggctggtgaagctttccttgcagctaacaaaaagaaaccaggtgttgtgactcttcctancggtttgcaatataaagtgatcacagaaggtaaaggtgagcttccaactgatacatcaatggttaaggttcactatgaaggacgcactatagatggtaaggtttttgaaagcagttacgaaagaaaacaaccagcagagttccgtcttaaccaagtaattaagggttggacagaggctattaagcgtatgcctgtaggtagtgtatgggaagtttacatcccacaagacttggcttacggtggccaaaactctggtcctatccaaccattctctgctcttatcttcaaaattgaattgttaggagttaacggaaaataatcaatcattcaataaaagnaatgaaagggacggatacttttacatccgtccctcttttaaattatagaaagtcgtataaaagaggtgagcagttgctattcaagctcaattctcttttattctttatatttaatatcttcattaaaatgaaaaagacaattttagctgtttgtgtgcttcttgcaggctttgcaacaacaatgagcgcaggcaacactaacaaaacaaataaaaagaacaangctactgcnaacgtagtgaaactcacttctcgtgccgactcattgagntatgcttctggtttgttctcaactggtcgcct

SEQ ID NO: 1192 - DNA, 4000 bp, Escherichia coli
  misc_feature (11)..(11): n is a, c, g, or t
  misc_feature (37)..(37): n is a, c, g, or t
  misc_feature (58)..(58): n is a, c, g, or t
  misc_feature (100)..(100): n is a, c, g, or t
  misc_feature (1935)..(1935): n is a, c, g, or t
  misc_feature (1965)..(1965): n is a, c, g, or t
  misc_feature (1986)..(1986): n is a, c, g, or t
  misc_feature (1992)..(1992): n is a, c, g, or t
  misc_feature (2031)..(2031): n is a, c, g, or t
  misc_feature (2132)..(2132): n is a, c, g, or t
  misc_feature (3679)..(3679): n is a, c, g, or t
tgtatcaaaanaaactaataaacctttaagagatccngaggtaatagaaaacattgcnaaaatatatgaaaaagaaggagctgattgttggtttaatgangatccacaaaaatttttaggaaaaaaatataaaaaagaagactatattcaatcaaccgacatttgcgaagtttggtttgatagtggttctactcatagctttgttttagaaaaaaggaaggatttgacatggcccgcatctatgtatttggaaggttcagatcaacatcgagggtggtttcattcatccttattagagtcatgtggtactagaggcagagctcctttcaatagtattctttctcatggtttcgttgtagatggaaagggtttgaaaatgtcaaaatccacaggaaatataattgcaccagaagatatactcaaaaaatatggcgctgatatcttaagagcctgggtagctgcatcagattattctgaagatttaaggttagattattcaattttagaacaacatgctgaatcctatagaaaaattagaaatacatttagatttttgttgggtaatttgcgggatcaaaaaatcaattttgatacaaattcaaaagaaattgaaaagtggcctgaacttgaacgttttatgctacatcaaatttttattttaaatagtaactttaaaaaatactttaaagaatataattttcataaactttacagagaattattaaatttctgttcactggatttatcagcattttattttgatatcagaaaagatactctttattgcgatgaaacgaaatcaaacaaacgaatggcatgcatcagattattatacttaattttagatatattgttaaaatggtttgctccaatattatcttttacaactgaagaaatattcagaattttaaataaagacaaaaacttaagtattcatttggaaacttttccaactattccatctaaatggagagatgaaaaattatttcaaaaatgggataagcttaaaatagtgagaaatgttgctaacgcagctattgaggttaaaagagcaagcaaagaaattggttcgagcttagaagcagatattaaagtttatctaggtgaagaatatttacaacacagtaaagatgttaatttaccagaatatactattacttcaaaagctgaggcgaagccaatgatcaatgatgataagctttttaagttagatagcgtagataatgtaaaagttttagtaaaaaaagccaaaggagaaaaatgttctagatgttggaaaattctagaaagtccctgtgagcgaaaaaactgtggtttaaaaaattaattttttcatgaaaaaaattataattgttttagttgtatttttttttgatagggcaactaaaatgtatttaataaatttacaaacaaccggaacagatatcgatttttatatatttccatttttaaatttttatcttgtatggaatacaggcattggatttggtctagcgtcactagaaacaaatattttttaccacattctaactgcaataattacaatagttaatcttgctcttatttttttccttttaaaagcaaaaggtatttatacttacttgtttgctttaattattggtggttctctaggaaatttgttcgatagaatttattattatgctgtaccagattttatcgatattcatgtaggtaattttcattggtttatatttaatgttgctgatatttttatcacagtgggtataattagttttatatttacagaattattaaaaaaagaaaaaatttctacaaatgtttaaaaaaaaaacaatatttcttatgctgcttatttttttagttacatcttgtgctgattcttggagcaatgtaaaacgcggcttaacaggtgcgaagcaaaaatcaaccgatgaatttttggttcaaaaaaangatccacttattttacctccagatttcganagcttaccttcaccctccganagggangaagcgatagaagaaatgtcaagttttgaaaaaacattnaaacaagagtctgaaactgaaatcaccgcttcttcaactgaaagttctgcagaagattcaatactgaaacagatcagaaaaaaatagatgttaaataaaantattttttttaataattttttttttaagtcaaaaaagttctatcaaaacttaaagaaaactcaaaaaatttttaactcttttcaattagatttaaaaaattttgaaatacctttacttaagtgttatgagaaagattacacatttgatttttcaccaacaacagttaaaaagttttctaaatataaaaatattgtcgtaattggcatgggcggatcaattttaggtacaaaaagtatttattcctttcttaaaacaaaagttaaaaaagaagtgtttttttttgataatctagatgaaaatttacatttacagtttaataaaattaatattttaaaaaattcttgctttataattgtttcaaagtcgggaaatacactcgaaacaatagcaaaccttagtgtagttttttcaaagtttctattcaaaaataaattaatttttattacagagatgaaggataacgtcttaaataatatagccgataaatttaatgctgagattattgaacataaagattttataggtggtcgatattcagtcttgtctgaagcaggaatgtttcctgctgcattaatggggcttaatataaataaatttaaaaacttaaaaaaattaattcaagataaaaattttatttcttctctaattcaaaatgttgcaagtatttatactttaaatatacaagatataaaaaattctgtgattttaaattatgattctgacttaaatgatctaggttattggtatcaacaactagttgctgaaagtttgggtaaaaaaggaaaaggaatcactccaatcttatcggcagcaccaaaggatcatcatagtgttttgcagctttatttagatggaccaaaggataaattttttactttttttagttcatcaaacgaagggaaaaaacataaagtaactggcaaaattattccaaataatatgaaatttttaaaaaatagaaagttaggatatataattcaggcacaatgtaacgcaacaaaaaatatttttaaattaaaaaacattccatttagacactttgtttttaataaaagtaatgaagaagaactaggtatgatttttacattttttgttttggaaacaattcttttagcacgtttaatgaatataaatccctttgatcaacctgctgttgaacaagttaagattgagacaagaaaaattctttcaaggtaaaaattttccaaacgttacttttgatattccgtatattctttcatcaattattttaaaataatttggcaatttttctttagtatttttatttctgtgtaaaatcaaaatgccgtcttttcgaagtacgttattattacaaataagctggattaatttttcaatatttaaatctttaaaaggaggatcacaaaaaattagatcaaattttgatttaaaaatatttcgttttttcattaaatcaaaaacatcatcaaaaaatatatatacatttttttttacttttaatttttcaatatttttttctaatatttttcttgcgtcttttgctttttcaataaaacaaacactnctagctcgtcttgatagacattctaatccaaatgatcctgtgccggcatataaatctagaatatttgatttttcaaattgaaatgacattttatttgaatgagtcaataagttgaaaatgctttctcttgctcgatctttcaacggtcttgttattttattttgcggaagatgtaagatggatcctttaagtttgcctgctattattctcatgtaaatttatatattattgatatatcaataattatttatatatgaacggcaataaagcaaaacttaaatttaatccaaataattttgaagttattgaagagggcgacta

SEQ ID NO: 1193 - DNA, 4000 bp, Escherichia coli
  misc_feature (1987)..(1987): n is a, c, g, or t
  misc_feature (1989)..(1989): n is a, c, g, or t
  misc_feature (2816)..(2816): n is a, c, g, or t
ctttctatttctttatattctccaaacagattatgttaaagaaaataggattcatatcaggaatcattttgctgattgtcactgtttgctctaatctttttgcttcgcaacaaaaagagcatttggttaatcgaagtgaggcgatagtaatgaatccgagtgtaacagtacgaagtactccaagtgagagtgggactagcttgtttattctccatgaagggagaaaggtaagtgtcaaagacaactctatgaaagaatggaaagaaattcgactggaagatggaaaagtcgggtgggtacctgcttctgctatcgaggtgatataaaggtcattaatagattttatatattcaagaaaaaaagataagcaaataatttgttttatctttttttttgcttaagtttatagcgtgataaaaaaatcacatagtattaaccattaaatttatgagacatgagaacaataacgtttaatgaacttcgtaaaattaaagattcattgcctagcggtagcatgcatagaatagcagacgaacttggtttgcacgtagatacagtgcgaaacttcttcggaggacacaatttcaaggagggaaaaagcgtcggaatacatctcgagcccggtccagatggtgggcttgtaatgttggatgacacgaccgttcttgatcgggctttaaaaatcctagatgaattgaatatgagtatgcaaaaagaacaggctaccgaatctgtgcaagtttaaaatataacaaactgaatcccaattgaatcaaacaattgggatttcttatttgttttcaccttataaaatgtacatttatggaagacaaattagtaaccctggccattctgacatacaccaaagcgcagatcttaaagaatgtcttggaaaatgaaggtatagaaacctacattcataacgttaatcaaatacaaccggttgtttcatcgggagtgcgtttacgaattaaagaaagcgatctgccacgtgctttgaaaataacagaaagttctacatggctgtctgaaagtatagtgggagagaaggagcccaaagtaaaagataaatcaaataagattttaattcccgtcgacttctctaattattcgatgaaagcatgtgaatttgcattcaacctggcaaaaacagaaaatgcagaagtcatcctgttgcatgtctatttcacgcctatttatgcatcgtcgttgccttatggggatgttttcaattaccagattggagatgaagaatctgtaaaaacgattatccaaaaagtccattctgatctcaatgctttatcagagaagataaaagaaaaagttacatcaggcgaatttcccaacgttaaatatagctgcatcttacgtgaaggtattccagaggaggaaatcttaagatatgctaaagaacagcgtcctatggtcatcattatgggtacccgaggcaaaaatcagaaagacattgatttaattggcagtgtaaccgctgaagttattgacaggagtcgcacggctgtattggctattccggaaaatacaccatttaaacagtttagtgaagcaaaacggattgcctttattaccaattttgatcaaagagatctaattgctttcgaggcattctttaatacttggaaatcattccatttttctgtatctttgatacaccttacagattctaaagatacctggaatgaaataaaactagcaggtataaaagaatattttcacaagcaatatccggggcttgaaattcattatgacgtagtgatgaatgataatttattaaaaggacttgatcagtatatcaaagataatcatatagatataatcactttgacttcttacaaaaggaatatatttgctcgattatttaatccaagtattgccagaaaaatgattttccattcagatacaccattgcttgttattaacagctgatcaaatcaggcaaaaaatgagcatccaagattagggaataatnantattatgtttaatagaaaaaggagtaatataatgaccttactcctttttctatttttatttaaatgaagaaatttacctgttccactcaagtccatatcaaatataagatttttcaattactactttaaactattgaataaaaaaaagaagactactatttctaatagccttcttatattttttcagaaaacgatcttacttcatcatcttatcgatttcttcgaattcaggtcccatattcaagttatagtaaactctgtaaagaccttgcaaccataaatcttgttgatcgggttttaaagctctggctttttcatagaatggtttagcttcttcgtagaatttcttaaccacagcttgtgcttcagcgtacttaggatcattgatatctgttgttgctttatcagcataatcctgtgctttcatcaaatataccaaacctacattagagtatgcttctgcatattccggatcagcagcaatagcttttttgtagtattcgattgcattatcatattctttcatattatgataaagatatgcttttacatacaaatacaacttgttattcggatcattagctaacattctatcagcaaactccatagctttagaagcttgattagagctattataataatcaaccaaattagcgaagaaataatcatttccagggaacttaaggataccctcttccaaagacttaatccatgcagcagtatcacctttagctttataagcatcagccatcaattgcattgcaaatttacctccatctttatcggataaagccataggagcatatttaatgatcgcatctttatcncctactctatcagcagctaatgttgcataataagcaatttgcggaagaagagtatcgtttttagccaattctttatcagctaacatcggataagaagctgactctacataggttgcaaagaacttcaaagcctctttattcttgtccaggttgaaatactgaataccaccattaatcaaattaggacgttcagccaacatactggaagcattagccttccgatatttgtttttaacttttcccttttcattaggtatttccgctaattcatcacacttattatagtactcatacattttcagaatactattgtatactttcaatgtatcatacggtttcttcaaaaaagcatttttcatttgctcctcgttgatacgtctctgaataaatccagcaacgtcccatgtgtcagcaagatccttcgtttcaggattcttcatagcctccttaataagctgttcagcctgcttaaaattaggttttacgtcattagccatactctttgcttctttcacattcttcatctgagcgaatgagaagctaacagccatcaataaaaccatagaaaataatactcttttcatgattgttgtttgattaattattaatattatgtctattcctcaatttcgttattgctttcgttttcatttacgtccgctgcatcatcaatatcaggaacatcagcattcggatcactcacgattgtaccctctgcctcttctgccggaatttcatcttcaagactttctgtcataaccttacataccgaaccaatctggtcgttacgtttttcaagatttatcagacgaacgccttgagtagcacggcccattatacgaacatccgctaccttcaaacgaatagtgataccagacttattgataatcatcaagtcattttcatcggttaccgacttgattgttaccaacttacctgtcttttcggtaatattcatggtcttcacacccttacctccacggttcgttttacgatagtcttcaatttcagaacgtttaccatatccttgttcggaaactaccattacagattctgtctccaaatctttgatacaaatcattcctactacttcatcctgaccatcattatccaacgtaataccacgtacacctgttgctgtacgtcccattacacgaactgctgcctcatggaaacgaattgca

SEQ ID NO: 1194 - DNA, 4000 bp, Escherichia coli
  misc_feature (1997)..(1997): n is a, c, g, or t
  misc_feature (2002)..(2002): n is a, c, g, or t
catttattcatttattcatttattcatttattcatttattcatttatttacataataaacttaataaataggattcctaataattatttcagaattttaatagagcaactgaatcttagtgattatcttcattctttcctaactaataaagttaaaagtaagcaaaatgtagtaaaagatgaaattaaaccaaaagataccccaatttcatctgatactacaaccacttctttaaataatttaaaactaaatatgatcaatgaaccatataatattggtcaaaattttattaaatatgaagaagcagatgatagttacgccaaaaaatcaagtgataaaagtatttcaaattcctcattctcctcaaaaatcaataattctaatatgacatcaaaatctaaaagcaataacaaatcgtcgaatgaaacgaataaaaataatatcataccgaaaagaaccccgagattaccatttcaacttccaaactttgatgttaccaagttaacattagtacaatccaccccgaccactgatccagcaatttggattacggtcattgaaaatgtcaaagtgtatatgtgtcttatacctgttaatatggatattcttgaaagttcagatagttctatgacccaacctccgcttattccattgcttagaatatataataatgatatggttaatggtactttattactcactgctggtggagtggatagtgatcaaaatcgttcgatcgttctttctctggaaagtagaagaattcgtattcgtaaacattctaatggtttatttggaacttggattcctttaaatcgtgcaagggagttagctagaacttgtagtcttgactctaaactttccgtttttttaagtgataatttaagagattattttccgttgtccgacagcttatctgctattcctttaccattaccgctaacaactaatcctttattagacattaaaaatagtatggcggtggcagcattatcttccttaaatgcggtggctgcttctaccaatgctgttcctgttactacctcaaccacttcaaccacttcaaaatcgacagctactaatggtaaatcaaaggaaattccaatctctatgaaagctcctacaaatccacttcagacggcattgaatttaggaagtatggcgttaaattctaatagtttattattaaataagggaaatcttttaagttccaatcctttattttcttctccttctgcactttcactactattaaaacaattttcatattcacccatttctttacccattggtactactccaaaggtttccatcagcccaagcccaaatacttcttcactattaaagaagcctactaccacaagcaccacttcgacttcctcctcttccaatacaactaaatctcaagcttcaaaaacaactaatgcaacagaaataaatccaccttcctccaccccagcctcgttgacaccgacaccaaacacgacatctattttaacatcgttaccttcagctacagcaacagctacaacaataacttcaacccctactcctgatttggcaacactttcagctttaccattgaatttcccatcaatagccactactacacctatttcagttgcgacgacccctaccccatccgcggcaagtttacaattggcctttgaaaatcctatcaatcctgttagtaaaaatagtaaacctagtagtatttctcaattaatgaaaacaaccagaatcaaaagtaaaaaatttaaaaaaatgcctcttcgttatacgaagaaagaaactcctgttttaaattcaaccttagcaagtttaactaatgaaaaatttcaaaatatgtctctcttaaatgataatggtaataataaaaatttaattgatgaagttcatggttcacaagatactatgctaagtagtaatggtaaaaataattaacaaaaataataataatatatatatatattgaaaaaataaaataaaatgaaatnaaaanaaaaaaaaaaaaaaaaattaactattctttcatattaatatttttttattgatattattttctattatatttacttatttatttatttatttatttatttatttatttatttatttatttgatatatttgatatatttgaatattttatttatatttatagatgattctgattatgaaaatgatcaaaatttattatttttatcttcatcggatgaggaagaggatgaaaataatcaaaatgataatgatgtagaatttttatctaaaaacggttatatatcagaaacgcaacttgatcaaagtacaaatgatagtgaagatgaagatgaagatgaagatgacgacgatgatgatgatgatgatgagaatgatgagaatgatgagaatatggatagagaagatgaagatgaggaaaatgaaaatgaagaagaggatgaagaggatgaagaaaatatagacgatgaccttatggaatatgagaatcttgatgatcttgaaaatgacagtgataatactgatgatatagataaaaatattattaatgtagttgatgattacagtagtgaaagttatcaatccgattctgaaaataatcttgaaagtatgtggtatttgaaaccgagattaactggaggtaaatcaaaaagacttgattctaccgaatacgcaggattaattaacgagattggtaatgagaatattttatctcctgttccatccacctcgaaaaaggatcacaattcaaagaaaaagagttcaaaaggtacttcttcttcttcatcaagaaaaagaaaacactctgagaaatcatcttctaaagcaaatcgtaatgctttggaaaccactcatactaaaaattcagatttacattccagcagaaaaaagaaaaaggtattaaattcttcaacaaatacgaaattaattattaagcagtcccctgaattttattcttcctcctctgtcaccactactaccagtaaaaagaaaaggagatctaagaaactatcaacgagtagtggcaaaataataaatattattagtaataagtcggatattgaagatgacgaaagtgaaattagtattgtcagtgatcacgatagtattattgatattaatggtttaggcgaaagtgaaaacgatgaatatcttgatattgatgatgaagatgaagaaaaagaagaaaacaatgatttttcacctgaaacaagttccatagaaattactaaatcaggtggtggaggtaaaaaaattattattcgtaaacattcttcctcaaatacttcatcgacggcgacctctaaaaaattaaaattggatccaaagggttcaacgactaactcctcagaaaaacgaataaaatctattaccattggtctacccacgaataaaaatgagaaaagtacgaatagacggcaaaagaaaaatagtacaaatagtaccactcgaaaacgaagtgaaagtcatcatggatcagatgtggaggagaaaaagcactcctctactacggccacttctactaccatcaatgaacctattcttcccctatcaattaacattaaaaagagacgtgtcactaaaaaatcgagtaccaccacgatcacttcagattccgcacaatcaacgaatagtaatgataactcaacctcaaaatactcaattcatgatttagatcataataaagcttccatagctaaccatgacgctattagcttaatgaacagtaatacaagtaataataataataataataataataataataataataatacagatataaataatggggaccaaatcaccacttcccaaacctcatttaatctgccgtccttaacagtcaagagtaaaacgattccatcgaaattggaagaacaattattattacaaaatattgttatgtcttccggtatagtgccttcagtcgcatcttcggataaatcaataaatatgtcaacttccactaaaattatgaaagatccctcctcctccctcatcac

SEQ ID NO: 1195 - DNA, 4000 bp, Escherichia coli
  misc_feature (233)..(233): n is a, c, g, or t
  misc_feature (453)..(453): n is a, c, g, or t
  misc_feature (457)..(457): n is a, c, g, or t
  misc_feature (521)..(521): n is a, c, g, or t
  misc_feature (523)..(524): n is a, c, g, or t
  misc_feature (543)..(544): n is a, c, g, or t
  misc_feature (553)..(553): n is a, c, g, or t
  misc_feature (556)..(556): n is a, c, g, or t
  misc_feature (566)..(566): n is a, c, g, or t
  misc_feature (634)..(634): n is a, c, g, or t
  misc_feature (664)..(664): n is a, c, g, or t
  misc_feature (700)..(700): n is a, c, g, or t
  misc_feature (736)..(736): n is a, c, g, or t
  misc_feature (759)..(759): n is a, c, g, or t
  misc_feature (775)..(775): n is a, c, g, or t
  misc_feature (838)..(838): n is a, c, g, or t
  misc_feature (847)..(847): n is a, c, g, or t
  misc_feature (853)..(853): n is a, c, g, or t
  misc_feature (868)..(869): n is a, c, g, or t
  misc_feature (907)..(907): n is a, c, g, or t
  misc_feature (1039)..(1039): n is a, c, g, or t
  misc_feature (2634)..(2634): n is a, c, g, or t
  misc_feature (2664)..(2664): n is a, c, g, or t
  misc_feature (2883)..(2883): n is a, c, g, or t
  misc_feature (3071)..(3071): n is a, c, g, or t
  misc_feature (3383)..(3383): n is a, c, g, or t
  misc_feature (3842)..(3842): n is a, c, g, or t
  misc_feature (3869)..(3869): n is a, c, g, or t
  misc_feature (3890)..(3890): n is a, c, g, or t
  misc_feature (3893)..(3893): n is a, c, g, or t
  misc_feature (3968)..(3968): n is a, c, g, or t
  misc_feature (3970)..(3970): n is a, c, g, or t
tgaaagcaccgcgcaagctgatgatgccgaacgcgtttctgtcaccctcaccaccgcattgaataccgcggacaccggtgctgcgactgacgtatcgtatgtgcctgtcgcccagaatatcgcggcgaacggggcggacacgccagcaattattcccagcctgatcgttccgaacgacagcggtgccgcgatcgtagaagcccgtgctgaaacgaacctgagcagcgaagcgnatattcgttctgtatccggcaaccgtgtgaatgtccgtggtggcccgggcaccgagtttcaggtcgtgagcaagctaggtcgcggcgattcggtcgagatcattcaggataacggcgatggatgggtaaagatgcgtcccgtagacggcgggccagagggctggatggccgatttcctgttgtcgaacgggtaaactactcaacaactcccgagacaacngttnatgcaacaacgtacaattttaattaccggctgctcctccgggatcggctacgcggctgcgcatncnntgcgcgaacgcggctgganngttttcgcntcntgccgccaancacgcgattgcgagaggctagccgccgaaggatttgatgcgccccagctcgactatacggatgccagnagcatcgccgctgcgctggatcatgtactngagcaaaccggtggcacgctcgatgccctttataanaacggtgcccatgcgacacccggtgccgtcgaaganctccccacagacgcgctgcgcgngatattcgaaagcaanttcttcggctggcacgagcttacgcgcaagatcatccctgtgatgcgggcacagggtcacggncgcattatncaatgntcgtccgtcttgggnnttgtcacaatgccgtggcgtggcgcttacaattctacnaaattcgcgctggaaggcttaacagacacgcttcgtattgagctgcgcgacacccccatccacgtgaccctgatcgagcccgggcccattacatccaacatccgcgcgaactctatcccgcacttcgagcgntggatcgattggaaaagctctgcccgaaaggtgcaatacgaaagcgcgttgttagacaggctatacactgcgagagggcccgacaggttcgagcttccgccacaagcagtcgttgacaggcttatccatgcgctggaggccgaccgcccacggccgcggtattatgtcacgacgccgacgcgtatctcgggcattttaaagcgtattttaccaacacgtgccctagactgggtgctctctcgataaattcgggttgcgctactgcatgaccccgctacatctttcagcaacacaaaggatgcttatgttcgctgatccgttatatatcctgaccgtcgttgccgtgattgcggtggttgtcgtattgatttttgggcttgggggcttcgctggtggcggagaattcaataagcgcaattcaaataaacttatgcgcatgcgcatcatcgcacagttcatcgctgtcgttctcatcgtcatatatgtgtacctgcgaaaggacgctggctgatggttgttcttaataaaatctacacccgcaccggcgacaaaggcgaaaccgcgttgggaaacggggaccgtgtggccaaacacgacctgcgggtcgaggcatatggcacatccgacgaattgaactgttttgttggtgtcgcgcggcttgaggcgaaaggcgaaaccgacgccgcgctgtcgcgtatccagaacgacctgttcgacctgggcgctgacctgtgccgccccgatatggaagcggatgcagacgccgaatacccgcctctgcgcctcgcggcggcgcaggtcgacaggcttgaacgtgagatcgacgtgatgaacgctgatctgtccccgctgagaagctttattctacccggcggcaccgcacttgccgcgcatttgcacgtgtgccggacagttgctcgccgcgccgaacggcttgcggtgcacttggctgacagagattctattaatccggccgccgtcaaatatctgaaccggctaagcgattggtttttcgtcgcggcgagggcttcaaataacggcggtaaggacgatgtattatgggtgcccggggcaaatcgctaaggccgtcagtcagaaacgccgcgtcgaaagacaataaattactatttttgactgttttgcattcgattgcttcgttacaccgacgaagagttcacatgatcggggccgaaccggcccggatcgtcaactgaggagagagaacgctcatgaaggtactggtacctgtaaagcgcgtgatcgactacaacgtgaaagtacgcgtcaaagcggacggcacgggtgttgatcttgccaacgtaaagatgtcgatgaacccgtttgacgagatttccgtcgaacaagcgatccgcatgaaagaggccggccaggtcgaagaagttgtggtcgtctctatcggcgtaaaacaggcgcaggaaacactgcgcacagcgctggcaatgggcgcggaccgcgcgattctgatcgtggcggccgacgatgtgcacaacgatatcgagcctttgaccgttgccaaaattctgaaaggcgtcgtcgaagaagagaagcccgaccttgttctttgcggtaagcangcgatcgacaacgatatgaacgccactggncagatgctgtccgctctgctggggtggtcgcaagcgaccttcgcctccaaagtcgacatcgatggcgacagcgctgttgttacacgtgaagtcgacggtggtttgcagactattaaggtttccatgcctacagtcgtgactgtggatcttcgcctgaacgaaccacgctatgcgtcgctacccaacatcatgaaggcaaagaaaaagcctttggatganaagacacctgccgattatggcgtcgaggtttccaaccgtttggaaatcatcaagacggctgagccagcagaacgtgctgcgggcatcaaggtcgagtcggtcgatgaactggttgcgaaacttaaagaagcgggggctgtgtaatggctgttctactccttgcagaagtaactgatggcgaactggcncttgacgcgacatccaaagccgttgctgcggccaagatgctcggcgatgttactgttctctgcgctggtggttccgccgctgcggcgggcgaagcggcggcgaaaatcaacggtgtttccaaagttctggtcgccgaggatgagacccttggccaccgcctcgcggaatccacggcggcgttgatcgtatcgctcgccggtgattacgaccacatcaccgcgccagcgaccacagacgctaaaaacgtgatgccacgtgttgcagcgttgcttgacgtcatgttgctgtccgatgtgtccggtgttgtcgangccgacacgttcgaacgtcccatctatgcgggcaacgcgatccagacggtcaaatcctcggatgcgaaaaaggttatcaccttccgcaccacgacgtttgacgccgctggcgacggtggctccgcctctgtagagacggtatccgctgcggccgatcccggcctgtcttcctgggttgaagaccacgttgcagaaagcgatcgccccgagctgacatcggctggcgtggttgtttccggcggccgtggcgttggctccgaagaagacttcgccttgatcgaaaagctggctgacaagctgggtgccgctgttggcgcttcgcgcgctgccgttgattcgggctatgctccgaacgactggcaagttggtcagaccggtaaggttgtcgcgcccgagctttatgtggcggttggtatctccggtgcgatccagcacttggccggcatgaaagacagcaanatcatcgtcgccatcaacaaagacgangaagcgccgatcttccaggtngcngactatggtctggtggcagatctgttcgaagccgttcccgagctgatcgagaaactgtaagcctttaaggttttnanggataaggcccgcaatcacctgcgggcctt

SEQ ID NO: 1196 - DNA, 4000 bp, Escherichia coli
  misc_feature (1980)..(1980): n is a, c, g, or t
  misc_feature (1987)..(1987): n is a, c, g, or t
  misc_feature (1992)..(1992): n is a, c, g, or t
  misc_feature (2409)..(2409): n is a, c, g, or t
  misc_feature (2412)..(2412): n is a, c, g, or t
  misc_feature (2443)..(2443): n is a, c, g, or t
  misc_feature (2556)..(2556): n is a, c, g, or t
  misc_feature (2636)..(2636): n is a, c, g, or t
  misc_feature (2773)..(2773): n is a, c, g, or t
  misc_feature (2851)..(2853): n is a, c, g, or t
  misc_feature (2859)..(2863): n is a, c, g, or t
  misc_feature (2866)..(2867): n is a, c, g, or t
  misc_feature (2870)..(2872): n is a, c, g, or t
  misc_feature (2874)..(2881): n is a, c, g, or t
  misc_feature (2885)..(2887): n is a, c, g, or t
  misc_feature (2889)..(2890): n is a, c, g, or t
  misc_feature (2892)..(2892): n is a, c, g, or t
  misc_feature (2896)..(2896): n is a, c, g, or t
  misc_feature (2899)..(2899): n is a, c, g, or t
  misc_feature (2902)..(2902): n is a, c, g, or t
  misc_feature (2906)..(2906): n is a, c, g, or t
  misc_feature (2909)..(2909): n is a, c, g, or t
  misc_feature (2912)..(2912): n is a, c, g, or t
  misc_feature (2915)..(2916): n is a, c, g, or t
  misc_feature (2918)..(2925): n is a, c, g, or t
  misc_feature (2928)..(2929): n is a, c, g, or t
  misc_feature (2932)..(2932): n is a, c, g, or t
  misc_feature (2934)..(2935): n is a, c, g, or t
  misc_feature (2937)..(2940): n is a, c, g, or t
  misc_feature (2942)..(2942): n is a, c, g, or t
  misc_feature (2945)..(2952): n is a, c, g, or t
  misc_feature (2954)..(2961): n is a, c, g, or t
  misc_feature (2965)..(2966): n is a, c, g, or t
  misc_feature (2968)..(2973): n is a, c, g, or t
  misc_feature (2975)..(2979): n is a, c, g, or t
  misc_feature (2982)..(3005): n is a, c, g, or t
  misc_feature (3007)..(3012): n is a, c, g, or t
  misc_feature (3014)..(3014): n is a, c, g, or t
  misc_feature (3016)..(3022): n is a, c, g, or t
  misc_feature (3024)..(3029): n is a, c, g, or t
  misc_feature (3031)..(3031): n is a, c, g, or t
  misc_feature (3033)..(3036): n is a, c, g, or t
  misc_feature (3038)..(3040): n is a, c, g, or t
  misc_feature (3042)..(3046): n is a, c, g, or t
  misc_feature (3049)..(3049): n is a, c, g, or t
  misc_feature (3051)..(3052): n is a, c, g, or t
  misc_feature (3054)..(3070): n is a, c, g, or t
  misc_feature (3072)..(3093): n is a, c, g, or t
  misc_feature (3095)..(3095): n is a, c, g, or t
  misc_feature (3097)..(3098): n is a, c, g, or t
  misc_feature (3100)..(3105): n is a, c, g, or t
  misc_feature (3107)..(3118): n is a, c, g, or t
  misc_feature (3120)..(3121): n is a, c, g, or t
  misc_feature (3123)..(3125): n is a, c, g, or t
  misc_feature (3127)..(3134): n is a, c, g, or t
  misc_feature (3136)..(3136): n is a, c, g, or t
  misc_feature (3139)..(3144): n is a, c, g, or t
  misc_feature (3146)..(3149): n is a, c, g, or t
  misc_feature (3151)..(3151): n is a, c, g, or t
  misc_feature (3153)..(3157): n is a, c, g, or t
  misc_feature (3159)..(3162): n is a, c, g, or t
  misc_feature (3165)..(3171): n is a, c, g, or t
  misc_feature (3173)..(3186): n is a, c, g, or t
  misc_feature (3188)..(3193): n is a, c, g, or t
  misc_feature (3195)..(3201): n is a, c, g, or t
  misc_feature (3203)..(3210): n is a, c, g, or t
  misc_feature (3212)..(3212): n is a, c, g, or t
  misc_feature (3214)..(3217): n is a, c, g, or t
  misc_feature (3220)..(3246): n is a, c, g, or t
  misc_feature (3248)..(3248): n is a, c, g, or t
  misc_feature (3250)..(3278): n is a, c, g, or t
  misc_feature (3280)..(3284): n is a, c, g, or t
  misc_feature (3286)..(3286): n is a, c, g, or t
  misc_feature (3288)..(3291): n is a, c, g, or t
  misc_feature (3293)..(3293): n is a, c, g, or t
  misc_feature (3295)..(3296): n is a, c, g, or t
  misc_feature (3298)..(3298): n is a, c, g, or t
  misc_feature (3301)..(3313): n is a, c, g, or t
  misc_feature (3315)..(3316): n is a, c, g, or t
  misc_feature (3318)..(3323): n is a, c, g, or t
  misc_feature (3326)..(3328): n is a, c, g, or t
  misc_feature (3330)..(3332): n is a, c, g, or t
  misc_feature (3335)..(3336): n is a, c, g, or t
  misc_feature (3338)..(3338): n is a, c, g, or t
  misc_feature (3340)..(3340): n is a, c, g, or t
  misc_feature (3343)..(3347): n is a, c, g, or t
  misc_feature (3349)..(3349): n is a, c, g, or t
  misc_feature (3351)..(3352): n is a, c, g, or t
  misc_feature (3356)..(3357): n is a, c, g, or t
  misc_feature (3359)..(3359): n is a, c, g, or t
  misc_feature (3362)..(3364): n is a, c, g, or t
  misc_feature (3366)..(3367): n is a, c, g, or t
  misc_feature (3369)..(3369): n is a, c, g, or t
  misc_feature (3372)..(3374): n is a, c, g, or t
  misc_feature (3376)..(3386): n is a, c, g, or t
  misc_feature (3389)..(3389): n is a, c, g, or t
  misc_feature (3391)..(3393): n is a, c, g, or t
  misc_feature (3395)..(3395): n is a, c, g, or t
  misc_feature (3398)..(3405): n is a, c, g, or t
  misc_feature (3407)..(3408): n is a, c, g, or t
  misc_feature (3411)..(3414): n is a, c, g, or t
  misc_feature (3417)..(3421): n is a, c, g, or t
  misc_feature (3423)..(3428): n is a, c, g, or t
  misc_feature (3430)..(3431): n is a, c, g, or t
  misc_feature (3433)..(3433): n is a, c, g, or t
  misc_feature (3437)..(3443): n is a, c, g, or t
  misc_feature (3446)..(3449): n is a, c, g, or t
  misc_feature (3451)..(3468): n is a, c, g, or t
  misc_feature (3470)..(3478): n is a, c, g, or t
  misc_feature (3480)..(3484): n is a, c, g, or t
  misc_feature (3486)..(3486): n is a, c, g, or t
  misc_feature (3488)..(3495): n is a, c, g, or t
  misc_feature (3497)..(3497): n is a, c, g, or t
  misc_feature (3499)..(3502): n is a, c, g, or t
  misc_feature (3504)..(3504): n is a, c, g, or t
  misc_feature (3506)..(3524): n is a, c, g, or t
  misc_feature (3526)..(3527): n is a, c, g, or t
  misc_feature (3530)..(3540): n is a, c, g, or t
  misc_feature (3542)..(3546): n is a, c, g, or t
  misc_feature (3548)..(3549): n is a, c, g, or t
  misc_feature (3551)..(3553): n is a, c, g, or t
  misc_feature (3556)..(3569): n is a, c, g, or t
  misc_feature (3571)..(3607): n is a, c, g, or t
  misc_feature (3609)..(3613): n is a, c, g, or t
  misc_feature (3615)..(3629): n is a, c, g, or t
  misc_feature (3631)..(3632): n is a, c, g, or t
  misc_feature (3634)..(3636): n is a, c, g, or t
  misc_feature (3638)..(3642): n is a, c, g, or t
  misc_feature (3644)..(3650): n is a, c, g, or t
  misc_feature (3652)..(3652): n is a, c, g, or t
  misc_feature (3654)..(3663): n is a, c, g, or t
  misc_feature (3665)..(3675): n is a, c, g, or t
  misc_feature (3677)..(3681): n is a, c, g, or t
  misc_feature (3683)..(3687): n is a, c, g, or t
  misc_feature (3690)..(3691): n is a, c, g, or t
  misc_feature (3693)..(3697): n is a, c, g, or t
  misc_feature (3699)..(3707): n is a, c, g, or t
  misc_feature (3710)..(3712): n is a, c, g, or t
  misc_feature (3714)..(3721): n is a, c, g, or t
  misc_feature (3723)..(3730): n is a, c, g, or t
  misc_feature (3732)..(3732): n is a, c, g, or t
  misc_feature (3735)..(3735): n is a, c, g, or t
  misc_feature (3738)..(3740): n is a, c, g, or t
  misc_feature (3742)..(3754): n is a, c, g, or t
  misc_feature (3756)..(3764): n is a, c, g, or t
  misc_feature (3767)..(3770): n is a, c, g, or t
  misc_feature (3772)..(3781): n is a, c, g, or t
  misc_feature (3783)..(3787): n is a, c, g, or t
  misc_feature (3789)..(3789): n is a, c, g, or t
  misc_feature (3791)..(3792): n is a, c, g, or t
  misc_feature (3795)..(3795): n is a, c, g, or t
  misc_feature (3797)..(3801): n is a, c, g, or t
  misc_feature (3803)..(3808): n is a, c, g, or t
  misc_feature (3810)..(3812): n is a, c, g, or t
  misc_feature (3814)..(3814): n is a, c, g, or t
  misc_feature (3816)..(3818): n is a, c, g, or t
  misc_feature (3820)..(3825): n is a, c, g, or t
  misc_feature (3827)..(3829): n is a, c, g, or t
  misc_feature (3831)..(3834): n is a, c, g, or t
  misc_feature (3836)..(3840): n is a, c, g, or t
  misc_feature (3842)..(3843): n is a, c, g, or t
  misc_feature (3845)..(3850): n is a, c, g, or t
  misc_feature (3852)..(3855): n is a, c, g, or t
  misc_feature (3857)..(3857): n is a, c, g, or t
  misc_feature (3861)..(3864): n is a, c, g, or t
  misc_feature (3866)..(3875): n is a, c, g, or t
  misc_feature (3878)..(3880): n is a, c, g, or t
  misc_feature (3882)..(3891): n is a, c, g, or t
  misc_feature (3893)..(3895): n is a, c, g, or t
  misc_feature (3897)..(3899): n is a, c, g, or t
  misc_feature (3901)..(3901): n is a, c, g, or t
  misc_feature (3903)..(3911): n is a, c, g, or t
  misc_feature (3913)..(3916): n is a, c, g, or t
  misc_feature (3918)..(3930): n is a, c, g, or t
  misc_feature (3932)..(3934): n is a, c, g, or t
  misc_feature (3936)..(3937): n is a, c, g, or t
  misc_feature (3939)..(3941): n is a, c, g, or t
  misc_feature (3943)..(3943): n is a, c, g, or t
  misc_feature (3945)..(3945): n is a, c, g, or t
  misc_feature (3947)..(3947): n is a, c, g, or t
  misc_feature (3949)..(3960): n is a, c, g, or t
  misc_feature (3962)..(3964): n is a, c, g, or t
  misc_feature (3966)..(3966): n is a, c, g, or t
  misc_feature (3968)..(3976): n is a, c, g, or t
  misc_feature (3979)..(3981): n is a, c, g, or t
  misc_feature (3984)..(3984): n is a, c, g, or t
  misc_feature (3986)..(3990): n is a, c, g, or t
  misc_feature (3992)..(3992): n is a, c, g, or t
  misc_feature (3994)..(3994): n is a, c, g, or t
  misc_feature (3996)..(3996): n is a, c, g, or t
  misc_feature (4000)..(4000): n is a, c, g, or t
tgaaagaccaggtcaagcgagctgtgagctttgtaactgcttttgaggaggcactcgctcacgctgcccgcaaaaggggttttgacggtgttgtatgtggacatattcatcgcgcggagatccgcatgattgatgatgtgctttattgcaacgatggtgattgggttgaaagcatgacggccttggtcgaacatccggatggtcgtcttgaaattatcgattggcccaaaaccaagcttagccagcaagcctcaagcgagcaactcgccctcgatctgaaagcccgtatgggatcgctatgaaccccggcaatatggttttcgatgcaatagggccgcaaaggcgatgaaatccccggtagcgcaagttgtgtttcacgcattatcaccatgaatttgattatctggagacatgccgacgctggcgacagtcttgaagaccacaaacaagaccttgagcgtagcctatcagagcggggcaagaagcaagcgagcagaatgagtcgatggcttgacgcaagacttcctgaaacttttgcggtggtcagcagccccgcccagcgcgcactgcaaacagcgatgaccttgtcagcaaaagtacgccccgagccgcgcttactgccgggcagctcgcttgaagaggctttgcaatcgatcaaagtcgatgaagcgcatttgcgaaagtctgggcatctggttgttgttggacatcagcctttgcttgggcatttaatgtcgcacttggtcagtggcggggatgcttgttggagcttgaaaaaaggtgcgctttggtggcttcaacgcaaggatgcagagcccttctggcaagtcaaagctgcgatcggacccgatttggtatagggtagaggcttgatgatttgccccgtcgtggggctggagcctctggatgactgaaatcgagcttaaattacaggtccccgccacagtgcgggctgcactggcacaagaaattaaagaccgctcccccgataacctacgcagacagcgcctgcaagcggtttatttcgataccccgtcgagattgttagctagtgaagacatggcgctgcggcttcgccgtgaagggcgcaattgggtgcaaaccctgaaggcgggaaaaggtctcgacagcatcagccgtgaagaagacaacattcgattacctgatcgtagcgcggctgagccagcgctcgacgttagcaggcatctgcgcagcccggcagggcgaaggctgcaagtacttttgcaaagggtacaaggcgagagcttgcagcgccgctttgcgaccgacgtaaggcgtcagagccagattcagcgcactcggcgcggctttgttgagctctgcttcgatgaggggatcattcaaagtgagcaacgccagcttgggcttcgcgagcttgaaatcgaatcgatcaaaggctcgccgcttgccgtactcgaagctgctgcgggttatattaaacgttatcaactctggattgatttgcgtagcaaagcgcagcgcggtcacatgctctttgaggatcgcgcatttatctcgccgacaaaggccggatcgattcgccttgaagcaggcgctaatatcgatgaagccttattagcgatcttttccgactgccgccgacaggtgatgcaaaatgcatcacaaattgccgctgaagaggggcacggacccgaacatgttcatcagatccgagtcggactaagaaggcttcgcacggcgatgaaattatttggtcagcgattacaagcgattgcccactgggatgcccaggctcgatcgctggccacagatcttggcgcaagcagagaccgcgatgtgcttgccgaaagtctgtggccgcgactacgtgacattgatgcacccctcattgaactaccctcaccgactgatctaaaatcgccaagagatctgattcgcgataaacagtgtcagttatggtttcttgagtggctagagcacgacatgaagcttgatctngatcgtnccagnaacgataacgaactcggacaaatgccagcgcaagacttgctgcttgaagttcttcaacgctggcatcgtaagtgtaagaagatgagtgccaactttggccaactgagtgttgacgagcgacatgatttgcgcaagcgtatgaaacgtcttcgttatggcgttgagtttgtgcgcagccttttacaggaaaagcgacttgaacattttctacaagtgatggctgaggctcaagacgcgttgggtgaatacaatgatttgcatgttgcccatgcactttataaatcgcatagtgcgcatcagcctcaggcctggtttgcggttggttggcttgctgcgcaatcggattatgccgctgatcgctgcattaaagtcttgcaagactttgccaaagtgcaggcgccctggcgaaaaaggganatnccacgaaacaacacaaatcccgaaatcattnctccagggctatgatcgagatcctgcttctaaccccgctagcacgggctattaagacgagccgcgggtcgcaaccaaccctataaacttgcgttaactcgtccttgaacctgncaagctatgggctcgaactgaggcgcaattcaaaggcgtagtctgtgctttggctgccggtttgctgcatccataaaacnattggcccagcggacaactgggctgccgtcaaattttcgactaaattttgtcccagcttttcgggaccaaagtgcccgaaggcaatcattcggcttgtaaagcacctcgcttgattccggcagttgagctatcaacntaggtgccagcggattggttgaaaactcgatagcttcgccagcacttgcttgcaccaagtccagttcagatcgatctnnngagttnnnnnccnnatnnncnnnnnnnntgannngnntngcangancantacnaantanccnnannnnnnnnccnncancnnannnncnggnnnnnnnntnnnnnnnncganncnnnnnncnnnnnttnnnnnnnnnnnnnnnnnnnnnnnncnnnnnnangnnnnnnnannnnnntnannnngnnngnnnnngancnntnnnnnnnnnnnnnnnnntnnnnnnnnnnnnnnnnnnnnnngngnnannnnnngnnnnnnnnnnnngnngnnntnnnnnnnncntgnnnnnntnnnnancnnnnngnnnncannnnnnngnnnnnnnnnnnnnngnnnnnncnnnnnnngnnnnnnnncngnnnncannnnnnnnnnnnnnnnnnnnnnnnnnncnannnnnnnnnnnnnnnnnnnnnnnnnnnnngnnnnnancnnnntnanntnggnnnnnnnnnnnnnannannnnnnaannnannngcnncncnaannnnntncnnaccnngntcnnncnngnacnnncnnnnnnnnnnnttnannncnctnnnnnnnnanngannnnccnnnnncnnnnnntnncnaagnnnnnnnccnnnntnnnnnnnnnnnnnnnnnngnnnnnnnnngnnnnnancnnnnnnnntncnnnncncnnnnnnnnnnnnnnnnnnngnnggnnnnnnnnnnngnnnnncnnannntgnnnnnnnnnnnnnngnnnnnnnnnnnnnnnnnnnnnnnnnnnnnnnnnnnnnannnnnannnnnnnnnnnnnnnanncnnncnnnnncnnnnnnncnannnnnnnnnntnnnnnnnnnnnannnnncnnnnngannannnnnannnnnnnnnccnnngnnnnnnnngnnnnnnnncnaanaannnannnnnnnnnnnnnannnnnnnnnggnnnncnnnnnnnnnncnnnnnananngcnannnnnannnnnngnnnanannnannnnnntnnntnnnnannnnnannannnnnnannnnanaaannnntnnnnnnnnnnagnnnannnnnnnnnnannnannnangnnnnnnnnncnnnnannnnnnnnnnnnngnnnanncnnngncntnannnnnnnnnnnncnnngntnnnnnnnnnccnnnccnannnnngncntnggcn

SEQ ID NO: 1197 - DNA, 4000 bp, Escherichia coli
  misc_feature (181)..(181): n is a, c, g, or t
  misc_feature (1029)..(1029): n is a, c, g, or t
  misc_feature (1034)..(1035): n is a, c, g, or t
  misc_feature (1131)..(1131): n is a, c, g, or t
  misc_feature (1526)..(1526): n is a, c, g, or t
  misc_feature (1540)..(1540): n is a, c, g, or t
  misc_feature (1587)..(1587): n is a, c, g, or t
  misc_feature (1990)..(1990): n is a, c, g, or t
  misc_feature (2115)..(2115): n is a, c, g, or t
  misc_feature (2208)..(2208): n is a, c, g, or t
  misc_feature (2218)..(2218): n is a, c, g, or t
  misc_feature (2860)..(2860): n is a, c, g, or t
  misc_feature (3394)..(3394): n is a, c, g, or t
  misc_feature (3440)..(3440): n is a, c, g, or t
  misc_feature (3460)..(3460): n is a, c, g, or t
  misc_feature (3500)..(3500): n is a, c, g, or t
  misc_feature (3562)..(3562): n is a, c, g, or t
  misc_feature (3611)..(3611): n is a, c, g, or t
  misc_feature (3731)..(3731): n is a, c, g, or t
  misc_feature (3799)..(3799): n is a, c, g, or t
  misc_feature (3915)..(3915): n is a, c, g, or t
  misc_feature (3917)..(3917): n is a, c, g, or t
  misc_feature (3936)..(3936): n is a, c, g, or t
cgctgcagttcccaggcgagcagcgcactcaccagccccaccgcggccactcccgcggccagccagtagagcacccgcgtgatgacgaaggtgcggtcgaagatgcgcatcgagagcgcgcgaatgtcggcgttggagcggatgaagagcgcctgccggccgcgcgccgccgcgcgcagcncgccggccgccacccgtgcctcgactcccggggcgagatagattccgagcccgctgatcgagtcgtcgtcccagagccgccggtactcgtcgagccccatcagcacctcgccgcggtcgttgccgtactcgcggtacacaccggccaccgggaaggcgcggggtcccgaggccgtggtgagagtgagcgtgtcatgcggcgcgagttggagccgccaggcgaggggttcggagatgaggatcgcgccgcgcgcgaactctcgccacgcgctcgtcgcgctcgcttgcgtgaatcgcacgcccgcgtaactctcgggcgcgagcctgaccgcgttcacatccagcgggccgtgcggcgagggaaccacgacccggcggctctcgctgtgagtgcgcacggcgggcacggcgaggagggagcgcacgacctcggggtcgagccttcgcccggagtcctcccccgcggctggagcgctgacgtagacgtccgcgcgcagcgcctgaatgagccactcacggagcgattcccggaagctctgcaccatgatcgcgacaccgatcatcgcggtgagcgccatgccgagcgcggcgacggccacccccgtgcggctgagcgaaccggcgatgtcccggcaggcgagccgcgccaccggaccgagccgcaccgagagccttgccgcggccagcgccagggctctaagcgccgccggcgtcaccgccgcgacgccgaggagcagcatgaagagcgtcgcgaagccggcgagaaggctgcgaccggagacccagaccagcaagcccgcccccgcggcgagcgaggcgccgacgacgagcagcgaccgcgccaggtgnagcgnncgcctctcgagcaccgagcgcgagagcccgagctgcggcgcgctcgccgcgacctcgagcgccgggagcagtgccgcggcgagcgcagtcagcacnccgccgcccgcggcagcgaccagcgagacagccggaacgctcatctccctcaccgccacgacgaaatagagatcgttgatggtctgcgacacgagaccgacgagccctcgccccatcacgagtccgagcagcacgccgcagaccgcgccgacgatgccgagcgccgcggcctccgcgagcacgagtccgagcacctggccacgggtggccccgagtgcgcgcagcacggccatgatcgggcggcgctgcagcacggcgaagctcaccgcgccgtagatcagaaacgcgcccaccaggagcgccagcaggctcatggccttgagattggtcgtgaacgcgtccgtcatggcgagcgtctcgcgaagctgcgcgcgcgtggcgcgcagctcgagacngggaagcagctgcntgcggagccgcgcgaggagctcttcgcccggcgcgcccgcgggcagncgcacatcgatccgcgagagccttccggtggcgcccagccactcctgcgcctgagcgatgtcggtcagcagcaccccgtcgaggcccgggccggccccggcagcttgggcgatgagcgtggcgggtcgcggcacgccgcccacgagaagctcgaggcggcggcccgtcgcgagcccgagttcggaagcggcggtcgcgctcatgaccacggcgcccggctcggtcagccagtcccgcagcgtgtcgaggccgtcggtcgccggatccggcacaccgggtgcgcgcccttcgcctgcgagctcgagggccgcaaaaggatcgacgccgaccagctgcatcgttcgctcgccgatggcgacatagcccgcgagcaccggcgcgaaaagcggcggcgagcgtccgntggactgcgcgcgcagccgcacgtacagccgctcatcgataccgcgcggaccgccagtgatctgatgcgtagcggggccattcacggcctcgagcgagagctcgaatgcgcgccgcgagctctcngtcgccacctccaccgccacgatcgtgcccaccccgagcgcgagcccgaccagcgcgagcgccagctgcgccgggtggcgcagcagatgccgnacgcccgccnggtgcagcgcgttcatcgaggcgcggagaccgccggctcgcgccgctcgtgcagccgtccctcgcgcagctccagcacgcggtccgcggcgcgcgacagcgcgagatcgtgggtcacgatcacgacggtggtgttgcgcgcgcgggcgagagacaacagcgcgggcaacacctcgccggcggtctgctcgtcgaggttgccggtgggctcgtcggccaggagaagcggcggctcatggaccagcgcccgggcgatcgcgacgcgttgctgctcgcccccggagagccggtccaccgcgctgtccgcgcgcgcggcgagacccacgtcggagagcaccgcgaggctgcgcgcgcgtgcctgcgcgccccgtacgccgttgagctcgagcaccaggcgcacgttctcctcgacatcgagggtcgggatgaggttgaagaactggtagacgaagccgatgtgagcgcggcggaagagcgtacgggcgggctcgcccatcgccgtcacctcacggccgtcgatctgcacggttccgccgtcggcgtggtcgatgccgctgatgagattgaggagcgttgacttgccggagccgctgcgccccgtgaccgcgaccgtctcgccgcggcgcacctcgaggtcggcgcnctcgagcacgcggtgcacccgtccgccttcgctgaagctgcgggaaagctgtcgaacgctcagcatggctggctaaaattcggaaacggctcgcaaatccggggtttcacggcaaaaaagtgagcgcgcgggtcgttaatgggccaaactccccacccgctgcggctcccaagccgtgccgtgcacggcccgcatgcgctcgaagggtaacccatgacactgccagcgccgcgccgcggccgcacccacctcatcgtcaacaccgctgccatcgccgtgctcattgccggcgcgacgctcgcggctgcggaggagcccgccgcgggggcctcggctgcggcgcccgccgctcccgcgaaaaaggctccggcgaagaccggcgccgccaaggaggcacccgcgaaggcgggctccgccagttacagcgtcggcgtgtcgatgggcgagcagctgcgcggcagcggcgtgacgcctgcgctgatcaacccgcaggagctcgcgcagggcgtgcgcgacgcggttggcggcaaggcntcgctcaccgacaaggatcgcgagaacatccgcaacctggtgaacncggtcggcgagtccaatcangccgcagccgtcaagttcctggccgagaacggcaagaagnccgacgtggtcacgaccgcgagcggcctgcagtacaaagtgctgaatgccggcaacggggantcgcccaagaagaccgacgaggtcacggtgaactaccgcgggtcgctgntcaacggcaccgaattcgacagcagctacaagcgcggtcagccggcgacgttcccggtgaacggcgtcattcccggctggaccgaggcgctcggcctcatgaagccgggagccaagtggnagctgttcgtgccgccgcagctggcctatgacatgcagtcccggccgccgattccgccggggtcgctnctgatcttcgaggtcgagctgctgagcgtgaagggggccggcacgccggcgccgcccacctcgtccgcgtctcccgctccggcgcaaccggcaactccctcgcagcccccgaagtnangccacagccctcgatgcgnggcgcgggccgatgaccgcccgcgccttcttcagccctcggcgttcgcgcccggtgtgtagcgc
